United States Patent 9,254,311 (MODIFIED POLYNUCLEOTIDES FOR THE PRODUCTION OF PROTEINS) - sequence listing, part 7

SEQ ID NO: 7382 - DNA, 1834 bp, Homo sapiens
ataatggcacacacacaactggcctcatgcttccataacttcactctgcctcccacttttttcagcccaacccctccaaacatgggtctcggtcggtccccttaagccacaatggagggaatacattaggctaagcaaatattccctcaggatttcatggcaaagccctttcaaccaaagaaaggatcgcgactaaggagaaagataacaaggtttgcttgaggagaggtctgttgagagaggctacagtcggtggtgggagagaagccaaagtctgtgacggtgtctagagggactgacaccacatctaccgggatggaaatggatcgtcataaaggtcttcatcctcatcatcatgttgagtaggctgaagaggaggaggaaaaggagcaattggtcttgctgtctcaggggtggcagaggcaaaagaaaatccatgtctcttgttcagcttctggaatttctgagcagccctcgtcagtacaagatggaccccgtagtcttgagttacatggacagtctactgcggcaatcagatgtctcactattggatccgccaagctggctcaatgaccatattattgggtttgcgtttgagtactttgccaacagtcagtttcatgactgctctgatcacgtcagtttcatcagccctgaagtcacccagttcatcaagtgcactagcaacccagcagagattgccatgttccttgaaccactggacctccccaacaagagagttgtatttttagccatcaatgataactccaaccaggcagctggaggaacccactggagtttattggtctacctccaagataaaaatagcttttttcattatgattcccatagcaggagcaactcagttcacgcaaagcaggtagcagagaaactggaggctttcttaggcagaaaaggagacaaactggcctttgtggaagagaaagcccctgcccaacaaaacagctatgactgtgggatgtacgtgatatgtaacactgaggccttgtgtcagaacttctttaggcaacagacagaatcactgctgcagctactcacccctgcatacatcacaaagaagaggggagaatggaaagatctcattaccacacttgctaaaaagtagctattgaagtatatttgcgacttttgaaggctcctctttctgcccttccccatttgttggatggctgcaatctcagtgcctgagggaagatgcctagtagaggaaagcttaatactctttttcctgaaagaatatcatcctctgcattatccccatggaacgtttcactttaaccctgactggggagcaatatgttctgtgaaaatatcttgaaattgtacaccaaaaccttacaaccaacttatttgaacatttattacacacagggtttacgtaagacttttcttattggtatataattaatttcctttggtctcccttatccacattggcttattctggaggaaaagcagtgatctgtaaaacaaatcaagaatatattaaatctagaggaatgcagagaagaaaactataaaacagaaccaaaaacttgttgcacagcctacataattaagagatcaactggctggaagcagatcaaggcctaacttcattcaagacctaaatattatgagactcagttattcggttttatgtgacatctcttccattcaccatgcacaggcttttccagctatctatataatgtttgcaaatatttgataaagatgatgttaccctatcttcctccatctgattcctggaatgcttgaagaaaggggaaatcttgagtaacctcattaaaattaatgtctggtggacctctca

SEQ ID NO: 7383 - DNA, 1866 bp, Homo sapiens
actatcccaggattcccgactcccggtttcctgtccttctcccctcccagctcctggcgcctgcgatagcggcaagatggcggaccgtggcggcgtgggtgaagccgcagctgttggagcgtctcctgcatctgtccctggcctaaacccgacgctaggctggagggagcgactgcgggccgggctggcggggactggggcctcgttgtggttcgtggcggggctggggctgctttacgccctgaggatccctttgaggctgtgtgagaatttggcagcggtgactgtatttttaaattcattgacacccaaattctatgtggcacttacagggacctcttcattgatatcaggactaatatttatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcagaatgtaaggtatggagaaaccctctaaatcttttcagaggagcagaatataggagatacacttgggtgactggtaaagagccacttacatactatgacatgaacctgtcagctcaggaccatcagacctttttcacctgtgacacagattttttacgtccttcagacacagttatgcagaaggcttggagggaaagaaatcctccagctcgaatcaaagcagcctatcaagctttagaattaaacaatgactgtgccactgcatatgttctactggctgaggaagaagcaacaactattgtagatgctgaaaggttatttaaacaggcactcaaggcaggagaaacaatttataggcagtcacagcagtgccagcaccaaagtcctcagcatgaagctcaactgaggagagataccaatgtactggtatatattaaaagaagattggcaatgtgtgcaagaaaattaggaagaataagagaagcagtaaaaataatgagagatttgatgaaagaatttcctcctcttaccatgttgaacatccatgaaaatctcttagaatcacttttagaattacaggcctatccagatgttcaggcagtcctagcaaaatatgatgatataagccttccaaagtcagcagcaatctgttacacagcagcactgttgaagacaaggactgtttcagaaaaattctctccagaaacagcctccagaagaggattaagcacagcagaaattaatgccgtggaagcaattcatagagctgtggaatttaatcctcatgttccaaaatatttattagagatgaaaagtttaattttacctccagaacacattctgaaacggggtgatagtgaagcaattgcctatgctttctttcatcttcagcactggaaacgaatagaaggtgctcttaatctgttacagtgtacatgggaaggcacttttagaatgattccatacccgttagagaaaggacatctattttacccttatcccagctgcacagagacggctgatagagagctattacctacctttcatcatgtttctgtttacccaaaaaaggagcttcctttgttcatccatttcacagcaggattttgctcttctacagcaatgatagccattctcactcaccagtttcctgaaatcatgggtatttttgctaaagctgtaagtatgatctcaaggacttgtgtagattatttgtaaaacacacaagaaaccatctctgatctgcctgtgctaacccagctgaacaatggaagatatttgttgtaaattaaaggaattgatttgtatatagttgctgccataaatacatcaaacataaa

SEQ ID NO: 7384 - DNA, 4528 bp, Homo sapiens
cggggggggggcggtgtgaaaggtgaccctcatttcgtttggaagcggtaacacttcggggtcacatctcagtccagttcctccagaataggcgctgctgtccgccccttccctgccccacgaaagaacaggtagccccaatcttgagacacgctcctccaccttcgaaatcttctcggtcccggttccccaggactcagccttcacagaggccaacttcaggtccgccactatcccaggattcccgactcccggtttcctgtccttctcccctcccagctcctggcgcctgcgatagcggcaagatggcggaccgtggcggcgtgggtgaagccgcagctgttggagcgtctcctgcatctgtccctggcctaaacccgacgctaggctggagggagcgactgcgggccgggctggcggggactggggcctcgttgtggttcgtggcggggctggggctgctttacgccctgaggatccctttgaggctgtgtgagaatttggcagcggtgactgtatttttaaattcattgacacccaaattctatgtggcacttacagggacctcttcattgatatcaggactaatatttatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcagaatgtaaggtatggagaaaccctctaaatcttttcagaggagcagaatataggagatacacttgggtgactggtaaagagccacttacatactatgacatgaacctgtcagctcaggaccatcagacctttttcacctgtgacacagattttttacgtccttcagacacagttatgcagaaggcttggagggaaagaaatcctccagctcgaatcaaagcagcctatcaagctttagaattaaacaatgactgtgccactgcatatgttctactggctgaggaagaagcaacaactattgtagatgctgaaaggttatttaaacaggcactcaaggcaggagaaacaatttataggcagtcacagcagtgccagcaccaaagtcctcagcatgaagctcaactgaggagagataccaatgtactggtatatattaaaagaagattggcaatgtgtgcaagaaaattaggaagaataagagaagcagtaaaaataatgagagatttgatgaaagaatttcctcctcttaccatgttgaacatccatgaaaatctcttagaatcacttttagaattacaggcctatccagatgttcaggcagtcctagcaaaatatgatgatataagccttccaaagtcagcagcaatctgttacacagcagcactgttgaagacaaggactgtttcagaaaaattctctccagaaacagcctccagaagaggattaagcacagcagaaattaatgccgtggaagcaattcatagagctgtggaatttaatcctcatgttccaaaatatttattagagatgaaaagtttaattttacctccagaacacattctgaaacggggtgatagtgaagcaattgcctatgctttctttcatcttcagcactggaaacgaatagaaggtgctcttaatctgttacagtgtacatgggaaggcacttttagaatgattccatacccgttagagaaaggacatctattttacccttatcccagctgcacagagacggctgatagagagctattacctacctttcatcatgtttctgtttacccaaaaaaggagcttcctttgttcatccatttcacagcaggattttgctcttctacagcaatgatagccattctcactcaccagtttcctgaaatcatgggtatttttgctaaagctgtgctgggactctggtgcccccaaccctgggcatcctcaggctttgaggagaatacacaggatttgaagtcagaagacctaggtttgagttctggctgagccacgcactgttcatgtgaccttggacaaatcaccaaatttttctgaacagcatctgtaaagtgacagtaacccctacctcacagggttgttgtgaggattacatatatgctaaagcattttgcatatgaaaaagcttcttatgaatattgttattcctaggcaaaccccccttggaagctgtcaaaaaggacaactgtagatgaaattgtcttccttttttcttcattcagcttagcctttctgtttggccagggctacttacaggggctgttggggttgaagtcaagtcaccgcattttggctcctttggtcaaagagaaagaactctaatgtccagctgctccatcgatatactcatagaatggaagtgagcaaaggaaaattttaagccaggatagttaaccgttagggggccagtgggagaatgcttgccttgcatttgcacatccagaatgactaaaacatcttaagtaaatgaggaatagccaccgagatgctcagagataatataagccatgagtgggaagtgggaaaatgagtttgtcaacgccctctcttttctatccctttacctttgaggtcagggacagggcatattactgacaccccactggctattgccctatacctgccaatcacccaaagaaaataatagcttctgagaaagctcaattcactgtagcaactgtgatatatttaccctaataaagccaccacttggtcttttccagtgcttctctcttatggagatcatccctggaatccaaagctctccagttttctaacccagttaagagttaaaaacaaccacaggtcatgagcagtaggcttggcagttataccccatgcagtcataggagactgctccatcattctcagcacatagggtgcacatctcactatctctggcatgaaccagccttgcgaacttatacagtctcagccactctgctttgatggtaattcttcaccactgatctctcctcaccatgcccttcctgcatccttcccccaaccacccaccagaggagttctggtccccaaaccaaagagttgcctgcaggttggtaatgtgactttgtagatattccttgattaaagccagaccctattggtatcctttttgaagtactggatcgaaatctaattgcttttttttttaattgttggggagaggaggatgagcagaactcctatgcagcctgagagaagttctctatgtgtctgtatatgtacacctctgtgtgtgtgtgtgtaacctcatggttgtgctcaggctgacagggagggcaaagagtgaaaaggaagcatctctttcttgttatccaacattgcttcaaagatgcccaacccccgtagtagcaggcagttcccaagtggagggtcggggcagaggcctccaccaaggccatcaataaccaggtgtgagctacaggtctctgtgtaatgtgaagctctcccgtatttcatttctgcacccagggggcggctctgcaggattgcttacggagaactctgtgtctggcacctctctccacaaggcccaggcgcccagggtcccaccgacctgcccaggaatgcatcacattgttctctggtgctgtaatttggctgcaggagctaggctgaatgcctcccagggatgagaaacatactctccctggcgtcctcccttcgccccagctagcttgagcttctgccctatgaccactgagtgcatttaaataaaaacctcagaaagactgaggaaaaaaaaatcctaattatctctcttctgttaagccatgtagagactcgtgtcctgagtgggtctgagaatttggcaaagacttactggttggtgttcttgataagggaagtgagacaaaggagaagaaattactccctgcaacaggaggaatagaaatgaagcagtgagtgttcagaaattagatctacaagaagttttgcaaacagaccctcagggccaggcaatgtttgtttttgttttttgttttttgtttttttttttaatctgaagcccctgattttatttttccagcatcactctaaggaagagtgtggattagtgccattattcagggctggtattaataaaagttagcttttatctgcagggctaggttaaggctggcattcttacttttacattaaaaaaactggctacaggctgcgcagctgaggtacttcagtcatgtgccttctctaaaggattcttagatccttaaaatatatagtatgttttaagtttgtatctaaatagcacttactgtaatgtattatacctaaatgtttattaaaagttagaagaaatgagtaccaacaggaaggaatggaagagaggagaggggctaagacattgctgatctgagggacagacctctatcaaatagaagagggctgggagaaggggtgattagaagcagagtgagggaactaaatggagccctgactgcaccaaataaagttctcattttgctgcttgttccaaa

SEQ ID NO: 7385 - DNA, 4206 bp, Homo sapiens
actatcccaggattcccgactcccggtttcctgtccttctcccctcccagctcctggcgcctgcgatagcggcaagatggcggaccgtggcggcgtgggtgaagccgcagctgttggagcgtctcctgcatctgtccctggcctaaacccgacgctaggctggagggagcgactgcgggccgggctggcggggactggggcctcgttgtggttcgtggcggggctggggctgctttacgccctgaggatccctttgaggctgtgtgagaatttggcagcggtgactgtatttttaaattcattgacacccaaattctatgtggcacttacagggacctcttcattgatatcaggactaatatttatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcagaatgtaaggtatggagaaaccctctaaatcttttcagaggagcagaatataggagatacacttgggtgactggtaaagagccacttacatactatgacatgaacctgtcagctcaggaccatcagacctttttcacctgtgacacagattttttacgtccttcagacacagttatgcagaaggcttggagggaaagaaatcctccagctcgaatcaaagcagcctatcaagctttagaattaaacaatgactgtgccactgcatatgttctactggctgaggaagaagcaacaactattgtagatgctgaaaggttatttaaacaggcactcaaggcaggagaaacaatttataggcagtcacagcagtgccagcaccaaagtcctcagcatgaagctcaactgaggagagataccaatgtactggtatatattaaaagaagattggcaatgtgtgcaagaaaattaggaagaataagagaagcagtaaaaataatgagagatttgatgaaagaatttcctcctcttaccatgttgaacatccatgaaaatctcttagaatcacttttagaattacaggcctatccagatgttcaggcagtcctagcaaaatatgatgatataagccttccaaagtcagcagcaatctgttacacagcagcactgttgaagacaaggactgtttcagaaaaattctctccagaaacagcctccagaagaggattaagcacagcagaaattaatgccgtggaagcaattcatagagctgtggaatttaatcctcatgttccaaaatatttattagagatgaaaagtttaattttacctccagaacacattctgaaacggggtgatagtgaagcaattgcctatgctttctttcatcttcagcactggaaacgaatagaaggtgctcttaatctgttacagtgtacatgggaaggcacctttcatcatgtttctgtttacccaaaaaaggagcttcctttgttcatccatttcacagcaggattttgctcttctacagcaatgatagccattctcactcaccagtttcctgaaatcatgggtatttttgctaaagctgtgctgggactctggtgcccccaaccctgggcatcctcaggctttgaggagaatacacaggatttgaagtcagaagacctaggtttgagttctggctgagccacgcactgttcatgtgaccttggacaaatcaccaaatttttctgaacagcatctgtaaagtgacagtaacccctacctcacagggttgttgtgaggattacatatatgctaaagcattttgcatatgaaaaagcttcttatgaatattgttattcctaggcaaaccccccttggaagctgtcaaaaaggacaactgtagatgaaattgtcttccttttttcttcattcagcttagcctttctgtttggccagggctacttacaggggctgttggggttgaagtcaagtcaccgcattttggctcctttggtcaaagagaaagaactctaatgtccagctgctccatcgatatactcatagaatggaagtgagcaaaggaaaattttaagccaggatagttaaccgttagggggccagtgggagaatgcttgccttgcatttgcacatccagaatgactaaaacatcttaagtaaatgaggaatagccaccgagatgctcagagataatataagccatgagtgggaagtgggaaaatgagtttgtcaacgccctctcttttctatccctttacctttgaggtcagggacagggcatattactgacaccccactggctattgccctatacctgccaatcacccaaagaaaataatagcttctgagaaagctcaattcactgtagcaactgtgatatatttaccctaataaagccaccacttggtcttttccagtgcttctctcttatggagatcatccctggaatccaaagctctccagttttctaacccagttaagagttaaaaacaaccacaggtcatgagcagtaggcttggcagttataccccatgcagtcataggagactgctccatcattctcagcacatagggtgcacatctcactatctctggcatgaaccagccttgcgaacttatacagtctcagccactctgctttgatggtaattcttcaccactgatctctcctcaccatgcccttcctgcatccttcccccaaccacccaccagaggagttctggtccccaaaccaaagagttgcctgcaggttggtaatgtgactttgtagatattccttgattaaagccagaccctattggtatcctttttgaagtactggatcgaaatctaattgcttttttttttaattgttggggagaggaggatgagcagaactcctatgcagcctgagagaagttctctatgtgtctgtatatgtacacctctgtgtgtgtgtgtgtaacctcatggttgtgctcaggctgacagggagggcaaagagtgaaaaggaagcatctctttcttgttatccaacattgcttcaaagatgcccaacccccgtagtagcaggcagttcccaagtggagggtcggggcagaggcctccaccaaggccatcaataaccaggtgtgagctacaggtctctgtgtaatgtgaagctctcccgtatttcatttctgcacccagggggcggctctgcaggattgcttacggagaactctgtgtctggcacctctctccacaaggcccaggcgcccagggtcccaccgacctgcccaggaatgcatcacattgttctctggtgctgtaatttggctgcaggagctaggctgaatgcctcccagggatgagaaacatactctccctggcgtcctcccttcgccccagctagcttgagcttctgccctatgaccactgagtgcatttaaataaaaacctcagaaagactgaggaaaaaaaaatcctaattatctctcttctgttaagccatgtagagactcgtgtcctgagtgggtctgagaatttggcaaagacttactggttggtgttcttgataagggaagtgagacaaaggagaagaaattactccctgcaacaggaggaatagaaatgaagcagtgagtgttcagaaattagatctacaagaagttttgcaaacagaccctcagggccaggcaatgtttgtttttgttttttgttttttgtttttttttttaatctgaagcccctgattttatttttccagcatcactctaaggaagagtgtggattagtgccattattcagggctggtattaataaaagttagcttttatctgcagggctaggttaaggctggcattcttacttttacattaaaaaaactggctacaggctgcgcagctgaggtacttcagtcatgtgccttctctaaaggattcttagatccttaaaatatatagtatgttttaagtttgtatctaaatagcacttactgtaatgtattatacctaaatgtttattaaaagttagaagaaatgagtaccaacaggaaggaatggaagagaggagaggggctaagacattgctgatctgagggacagacctctatcaaatagaagagggctgggagaaggggtgattagaagcagagtgagggaactaaatggagccctgactgcaccaaataaagttctcattttgctgcttgttccaaa

SEQ ID NO: 7386 - DNA, 862 bp, Homo sapiens
atatactgtactattctttagctgtagacaggatgaagtgtttagggcccaggtccccttaccatgtgattatatttcactcaagatctgagcagcaacctcagaacaagatataagtatttccattacatgattcagtatggtggttgatttttctgaagcaaaaggcagcaaatgtcccctttcctgttcagagatgacatgaaagacttgactgtatttttaaattcattgacacccaaattctatgtggcacttacagggacctcttcattgatatcaggactaatatttatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcagaatgtaaggtatggagaaaccctctaaatcttttcagaggagcagaatataggagatacacttgggtgactggtaaagagccacttacatactatgacatgaacctgtcagctcaggaccatcagacctttttcacctgtgacacagattttttacgtccttcagacacagttatgcagaaggcttggagggaaagaaatcctccagctcgaatcaaagcagcctatcaagctttagaattaaacaatgactgtgccactgcatatgttctactggctgaggaagaagcaacaactattgtagatgctgaaaggttatttaaacaggcactcaaggcaggagaaacaatttataggcagtcacagcagtgccagcaccaaagtcctcagcatgaagctcaactga

SEQ ID NO: 7387 - DNA, 1634 bp, Homo sapiens
cggggggggggcggtgtgaaaggtgaccctcatttcgtttggaagcggtaacacttcggggtcacatctcagtccagttcctccagaataggcgctgctgtccgccccttccctgccccacgaaagaacaggtagccccaatcttgagacacgctcctccaccttcgaaatcttctcggtcccggttccccaggactcagccttcacagaggccaacttcaggtccgccactatcccaggattcccgactcccggtttcctgtccttctcccctcccagctcctggcgcctgcgatagcggcaagatggcggaccgtggcggcgtgggtgaagccgcagctgttggagcgtctcctgcatctgtccctggcctaaacccgacgctaggctggagggagcgactgcgggccgggctggcggggactggggcctcgttgtggttcgtggcggggctggggctgctttacgccctgaggatccctttgaggctgtgtgagaatttggcagcggtgactgtatttttaaattcattgacacccaaattctatgtggcacttacagggacctcttcattgatatcaggactaatatttatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcagaatgtaaggtatggagaaaccctctaaatcttttcagaggagcagaatataggagatacacttgggtgactggtaaagagccacttacatactatgacatgaacctgtcagctcaggaccatcagacctttttcacctgtgacacagattttttacgtccttcagacacagttatgcagaaggcttggagggaaagaaatcctccagctcgaatcaaagcagcctatcaagctttagaattaaacaatgactgtgccactgcatatgttctactggctgaggaagaagcaacaactattgtagatgctgaaaggttatttaaacaggcactcaaggcaggagaaacaatttataggcagtcacagcagtgccagcaccaaagtcctcagcatgaagctcaactgaggagagataccaatgtactggtatatattaaaagaagattggcaatgtgtgcaagaaaattaggaagaataagagaagcagtaaaaataatgagagatttgatgaaagaatttcctcctcttaccatgttgaacatccatgaaaatctcttagaatcacttttagaattacaggcctatccagatgttcaggcagtcctagcaaaatatgatgatataagccttccaaagtcagcagcaatctgttacacagcagcactgttgaagacaaggactgtttcagaaaaattctctccagaaacagcctccagaagaggattaagcacagcagaaattaatgccgtggaagcaattcatagagctgtggaatttaatcctcatgttccaaaagtagaaatttacccattttcccctcaactaaatatcaaagcagttgacaattcagctatttcaaaatatccagctaatatgtac

SEQ ID NO: 7388 - DNA, 1815 bp, Homo sapiens
actatcccaggattcccgactcccggtttcctgtccttctcccctcccagctcctggcgcctgcgatagcggcaagatggcggaccgtggcggcgtgggtgaagccgcagctgttggagcgtctcctgcatctgtccctggcctaaacccgacgctaggctggagggagcgactgcgggccgggctggcggggactggggcctcgttgtggttcgtggcggggctggggctgctttacgccctgaggatccctttgaggctgtgtgagaatttggcagcggggacctcttcattgatatcaggactaatatttatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcagaatgtaaggtatggagaaaccctctaaatcttttcagaggagcagaatataggagatacacttgggtgactggtaaagagccacttacatactatgacatgaacctgtcagctcaggaccatcagacctttttcacctgtgacacagattttttacgtccttcagacacagttatgcagaaggcttggagggaaagaaatcctccagctcgaatcaaagcagcctatcaagctttagaattaaacaatgactgtgccactgcatatgttctactggctgaggaagaagcaacaactattgtagatgctgaaaggttatttaaacaggcactcaaggcaggagaaacaatttataggcagtcacagcagtgccagcaccaaagtcctcagcatgaagctcaactgaggagagataccaatgtactggtatatattaaaagaagattggcaatgtgtgcaagaaaattaggaagaataagagaagcagtaaaaataatgagagatttgatgaaagaatttcctcctcttaccatgttgaacatccatgaaaatctcttagaatcacttttagaattacaggcctatccagatgttcaggcagtcctagcaaaatatgatgatataagccttccaaagtcagcagcaatctgttacacagcagcactgttgaagacaaggactgtttcagaaaaattctctccagaaacagcctccagaagaggattaagcacagcagaaattaatgccgtggaagcaattcatagagctgtggaatttaatcctcatgttccaaaatatttattagagatgaaaagtttaattttacctccagaacacattctgaaacggggtgatagtgaagcaattgcctatgctttctttcatcttcagcactggaaacgaatagaaggtgctcttaatctgttacagtgtacatgggaaggcacttttagaatgattccatacccgttagagaaaggacatctattttacccttatcccagctgcacagagacggctgatagagagctattacctacctttcatcatgtttctgtttacccaaaaaaggagcttcctttgttcatccatttcacagcaggattttgctcttctacagcaatgatagccattctcactcaccagtttcctgaaatcatgggtatttttgctaaagctgtaagtatgatctcaaggacttgtgtagattatttgtaaaacacacaagaaaccatctctgatctgcctgtgctaacccagctgaacaatggaagatatttgttgtaaattaaaggaattgatttgtatatagttgctgccataaatacatcaaacataaa

SEQ ID NO: 7389 - DNA, 1973 bp, Homo sapiens
cggggggggggcggtgtgaaaggtgaccctcatttcgtttggaagcggtaacacttcggggtcacatctcagtccagttcctccagaataggcgctgctgtccgccccttccctgccccacgaaagaacaggtagccccaatcttgagacacgctcctccaccttcgaaatcttctcggtcccggttccccaggactcagccttcacagaggccaacttcaggtccgccactatcccaggattcccgactcccggtttcctgtccttctcccctcccagctcctggcgcctgcgatagcggcaagatggcggaccgtggcggcgtgggtgaagccgcagctgttggagcgtctcctgcatctgtccctggcctaaacccgacgctaggctggagggagcgactgcgggccgggctggcggggactggggcctcgttgtggttcgtggcggggctggggctgctttacgccctgaggatccctttgaggctgtgtgagaatttggcagcggtgactgtatttttaaattcattgacacccaaattctatgtggcacttacagggacctcttcattgatatcaggactaatatttatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcagaatgtaaggtatggagaaaccctctaaatcttttcagaggagcagaatataggagatacacttgggtgactggtaaagagccacttacatactatgacatgaacctgtcagctcaggaccatcagacctttttcacctgtgacacagattttttacgtccttcagacacagttatgcagaaggcttggagggaaagaaatcctccagctcgaatcaaagcagcctatcaagctttagaattaaacaatgactgtgccactgcatatgttctactggctgaggaagaagcaacaactattgtagatgctgaaaggttatttaaacaggcactcaaggcaggagaaacaatttataggcagtcacagcagtgccagcaccaaagtcctcagcatgaagctcaactgaggagagataccaatgtactggtatatattaaaagaagattggcaatgtgtgcaagaaaattaggaagaataagagaagcagtaaaaataatgagagatttgatgaaagaatttcctcctcttaccatgttgaacatccatgaaaatctcttagaatcacttttagaattacaggcctatccagatgttcaggcagtcctagcaaaatatgatgatataagccttccaaagtcagcagcaatctgttacacagcagcactgttgaagacaaggactgtttcagaaaaattctctccagaaacagcctccagaagaggattaagcacagcagaaattaatgccgtggaagcaattcatagagctgtggaatttaatcctcatgttccaaaatatttattagagatgaaaagtttaattttacctccagaacacattctgaaacggggtgatagtgaagcaattgcctatgctttctttcatcttcagcactggaaacgaatagaaggtgctcttaatctgttacagtgtacatgggaaggcacttttagaatgattccatacccgttagagaaaggacatctattttacccttatcccagctgcacagagacggctgatagagagctattacctacctttcatcatgtttctgtttacccaaaaaaggagcttcctttgttcatccatttcacagcaggattttgctcttctacagcaatgatagccattctcactcaccagtttcctgaaatcatgggtatttttgctaaagctgtagtaggagttaaaacccaaaaagaaaatgctgattaa

SEQ ID NO: 7390 - DNA, 1743 bp, Homo sapiens
gtgtgagaatttggcagcgggtgagaggaccagacctcctggggcagggcggggggccaggagagatgtcgggggcaagagccaaagggcaagagattctcggtagtcctagagggcctctgaggagtcgatgatgagcgatcaatgactgtatttttaaattcattgacacccaaattctatgtggcacttacagggacctcttcattgatatcaggactaatatttatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcagatacacttgggtgactggtaaagagccacttacatactatgacatgaacctgtcagctcaggaccatcagacctttttcacctgtgacacagattttttacgtccttcagacacagttatgcagaaggcttggagggaaagaaatcctccagctcgaatcaaagcagcctatcaagctttagaattaaacaatgactgtgccactgcatatgttctactggctgaggaagaagcaacaactattgtagatgctgaaaggttatttaaacaggcactcaaggcaggagaaacaatttataggcagtcacagcagtgccagcaccaaagtcctcagcatgaagctcaactgaggagagataccaatgtactggtatatattaaaagaagattggcaatgtgtgcaagaaaattaggaagaataagagaagcagtaaaaataatgagagatttgatgaaagaatttcctcctcttaccatgttgaacatccatgaaaatctcttagaatcacttttagaattacaggcctatccagatgttcaggcagtcctagcaaaatatgatgatataagccttccaaagtcagcagcaatctgttacacagcagcactgttgaagacaaggactgtttcagaaaaattctctccagaaacagcctccagaagaggattaagcacagcagaaattaatgccgtggaagcaattcatagagctgtggaatttaatcctcatgttccaaaatatttattagagatgaaaagtttaattttacctccagaacacattctgaaacggggtgatagtgaagcaattgcctatgctttctttcatcttcagcactggaaacgaatagaaggtgctcttaatctgttacagtgtacatgggaaggcacttttagaatgattccatacccgttagagaaaggacatctattttacccttatcccagctgcacagagacggctgatagagagctattacctacctttcatcatgtttctgtttacccaaaaaaggagcttcctttgttcatccatttcacagcaggattttgctcttctacagcaatgatagccattctcactcaccagtttcctgaaatcatgggtatttttgctaaagctgtgctgggactctggtgcccccaaccctgggcatcctcaggctttgaggagaatacacaggatttgaagtcagaagacctaggtttgagttctggctgagccacgcactgttcatgtgaccttggacaaatcaccaaatttttctgaacagcatctgtaaagtgacagtaacccctacctcacagggttgttgtgaggattacatatatgctaaagcattttgcatatg

SEQ ID NO: 7391 - DNA, 4141 bp, Homo sapiens
cggggggggggcggtgtgaaaggtgaccctcatttcgtttggaagcggtaacacttcggggtcacatctcagtccagttcctccagaataggcgctgctgtccgccccttccctgccccacgaaagaacaggtagccccaatcttgagacacgctcctccaccttcgaaatcttctcggtcccggttccccaggactcagccttcacagaggccaacttcaggtccgccactatcccaggattcccgactcccggtttcctgtccttctcccctcccagctcctggcgcctgcgatagcggcaagatggcggaccgtggcggcgtgggtgaagccgcagctgttggagcgtctcctgcatctgtccctggcctaaacccgacgctaggctggagggagcgactgcgggccgggctggcggggactggggcctcgttgtggttcgtggcggggctggggctgctttacgccctgaggatccctttgaggctgtgtgagaatttggcagcggtgactgtatttttaaattcattgacacccaaattctatgtggcacttacagggacctcttcattgatatcaggactaatatttatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcagaatgtaaggtatggagaaaccctctaaatcttttcagaggagcagaatataggagatacacttgggtgactggtaaagagccacttacatactatgacatgaacctgtcagctcaggaccatcagacctttttcacctgtgacacagattttttacgtccttcagacacagttatgcagaaggcttggagggaaagaaatcctccagctcgaatcaaagcagcctatcaagctttagaattaaacaatgactgtgccactgcatatgttctactggctgaggaagaagcaacaactattgtagatgctgaaaggttatttaaacaggcactcaaggcaggagaaacaatttataggcagtcacagcagtgccagcaccaaagtcctcagcatgaagctcaactgaggagagataccaatgtactggtatatattaaaagaagattggcaatgtgtgcaagaaaattaggaagaataagagaagcagtaaaaataatgagagattatttattagagatgaaaagtttaattttacctccagaacacattctgaaacggggtgatagtgaagcaattgcctatgctttctttcatcttcagcactggaaacgaatagaaggtgctcttaatctgttacagtgtacatgggaaggcacctttcatcatgtttctgtttacccaaaaaaggagcttcctttgttcatccatttcacagcaggattttgctcttctacagcaatgatagccattctcactcaccagtttcctgaaatcatgggtatttttgctaaagctgtgctgggactctggtgcccccaaccctgggcatcctcaggctttgaggagaatacacaggatttgaagtcagaagacctaggtttgagttctggctgagccacgcactgttcatgtgaccttggacaaatcaccaaatttttctgaacagcatctgtaaagtgacagtaacccctacctcacagggttgttgtgaggattacatatatgctaaagcattttgcatatgaaaaagcttcttatgaatattgttattcctaggcaaaccccccttggaagctgtcaaaaaggacaactgtagatgaaattgtcttccttttttcttcattcagcttagcctttctgtttggccagggctacttacaggggctgttggggttgaagtcaagtcaccgcattttggctcctttggtcaaagagaaagaactctaatgtccagctgctccatcgatatactcatagaatggaagtgagcaaaggaaaattttaagccaggatagttaaccgttagggggccagtgggagaatgcttgccttgcatttgcacatccagaatgactaaaacatcttaagtaaatgaggaatagccaccgagatgctcagagataatataagccatgagtgggaagtgggaaaatgagtttgtcaacgccctctcttttctatccctttacctttgaggtcagggacagggcatattactgacaccccactggctattgccctatacctgccaatcacccaaagaaaataatagcttctgagaaagctcaattcactgtagcaactgtgatatatttaccctaataaagccaccacttggtcttttccagtgcttctctcttatggagatcatccctggaatccaaagctctccagttttctaacccagttaagagttaaaaacaaccacaggtcatgagcagtaggcttggcagttataccccatgcagtcataggagactgctccatcattctcagcacatagggtgcacatctcactatctctggcatgaaccagccttgcgaacttatacagtctcagccactctgctttgatggtaattcttcaccactgatctctcctcaccatgcccttcctgcatccttcccccaaccacccaccagaggagttctggtccccaaaccaaagagttgcctgcaggttggtaatgtgactttgtagatattccttgattaaagccagaccctattggtatcctttttgaagtactggatcgaaatctaattgcttttttttttaattgttggggagaggaggatgagcagaactcctatgcagcctgagagaagttctctatgtgtctgtatatgtacacctctgtgtgtgtgtgtgtaacctcatggttgtgctcaggctgacagggagggcaaagagtgaaaaggaagcatctctttcttgttatccaacattgcttcaaagatgcccaacccccgtagtagcaggcagttcccaagtggagggtcggggcagaggcctccaccaaggccatcaataaccaggtgtgagctacaggtctctgtgtaatgtgaagctctcccgtatttcatttctgcacccagggggcggctctgcaggattgcttacggagaactctgtgtctggcacctctctccacaaggcccaggcgcccagggtcccaccgacctgcccaggaatgcatcacattgttctctggtgctgtaatttggctgcaggagctaggctgaatgcctcccagggatgagaaacatactctccctggcgtcctcccttcgccccagctagcttgagcttctgccctatgaccactgagtgcatttaaataaaaacctcagaaagactgaggaaaaaaaaatcctaattatctctcttctgttaagccatgtagagactcgtgtcctgagtgggtctgagaatttggcaaagacttactggttggtgttcttgataagggaagtgagacaaaggagaagaaattactccctgcaacaggaggaatagaaatgaagcagtgagtgttcagaaattagatctacaagaagttttgcaaacagaccctcagggccaggcaatgtttgtttttgttttttgttttttgtttttttttttaatctgaagcccctgattttatttttccagcatcactctaaggaagagtgtggattagtgccattattcagggctggtattaataaaagttagcttttatctgcagggctaggttaaggctggcattcttacttttacattaaaaaaactggctacaggctgcgcagctgaggtacttcagtcatgtgccttctctaaaggattcttagatccttaaaatatatagtatgttttaagtttgtatctaaatagcacttactgtaatgtattatacctaaatgtttattaaaagttagaagaaatgagtaccaacaggaaggaatggaagagaggagaggggctaagacattgctgatctgagggacagacctctatcaaatagaagagggctgggagaaggggtgattagaagcagagtgagggaactaaatggagccctgactgcaccaaataaagttctcattttgctgcttgttcc

SEQ ID NO: 7392 - DNA, 860 bp, Homo sapiens
gcatttcagaaccaggttctccttcgaggaacagagaaaatgaaaccagcagacagaatttgtcagaatgtaaggtatggagaaaccctctaaatcttttcagaggagcagaatataggagatacacttgggtgactggtaaagagccacttacatactatgacatgaacctgtcagctcaggaccatcagacctttttcacctgtgacacagattttttacgtccttcagacacagttatgcagaaggcttggagggaaagaaatcctccagctcgaatcaaagcagcctatcaagctttagaattaaacaatgactgtgccactgcatatgttctactggctgaggaagaagcaacaactattgtagatgctgaaaggttatttaaacaggcactcaaggcaggagaaacaatttataggcagtcacagcagtgccagcaccaaagtcctcagcatgaagctcaactgaggagagataccaatgtactggtatatattaaaagaagattggcaatgtgtgcaagaaaattaggaagaataagagaagcagtaaaaataatgagagattatttattagagatgaaaagtttaattttacctccagaacacattctgaaacggggtgatagtgaagcaattgcctatgctttctttcatcttcagcactggaaacgaatagaaggtgctcttaatctgttacagtgtacatgggaaggcacctttcatcatgtttctgtttacccaaaaaaggagcttcctttgttcatccatttcacagcaggattttgctcttctacagcaatgatagccattctcactcaccagtttcctgaaatcatgggtatttttgctaaagct

SEQ ID NO: 7393 - DNA, 1780 bp, Homo sapiens
actatcccaggattcccgactcccggtttcctgtccttctcccctcccagctcctggcgcctgcgatagcggcaagatggcggaccgtggcggcgtgggtgaagccgcagctgttggagcgtctcctgcatctgtccctggcctaaacccgacgctaggctggagggagcgactgcgggccgggctggcggggactggggcctcgttgtggttcgtggcggggctggggctgctttacgccctgaggatccctttgaggctgtgtgagaatttggcagcggggacctcttcattgatatcaggactaatatttatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcagaatgtaaggtatggagaaaccctctaaatcttttcagaggagcagaatataggagatacacttgggtgactggtaaagagccacttacatactatgacatgaacctgtcagctcaggaccatcagacctttttcacctgtgacacagattttttacgtccttcagacacagttatgcagaaggcttggagggaaagaaatcctccagctcgaatcaaagcagcctatcaagctttagaattaaacaatgactgtgccactgcatatgttctactggctgaggaagaagcaacaactattgtagatgctgaaaggttatttaaacaggcactcaaggcaggagaaacaatttataggcagtcacagcagtgccagcaccaaagtcctcagcatgaagctcaactgaggagagataccaatgtactggtatatattaaaagaagattggcaatgtgtgcaagaaaattaggaagaataagagaagcagtaaaaataatgagagatttgatgaaagaatttcctcctcttaccatgttgaacatccatgaaaatctcttagaatcacttttagaattacaggcctatccagatgttcaggcagtcctagcaaaatatgatgatataagccttccaaagtcagcagcaatctgttacacagcagcactgttgaagacaaggactgtttcagaaaaattctctccagaaacagcctccagaagaggattaagcacagcagaaattaatgccgtggaagcaattcatagagctgtggaatttaatcctcatgttccaaaatatttattagagatgaaaagtttaattttacctccagaacacattctgaaacggggtgatagtgaagcaattgcctatgctttctttcatcttcagcactggaaacgaatagaaggtgctcttaatctgttacagtgtacatgggaaggcacttttagaatgattccatacccgttagagaaaggacatctattttacccttatcccagctgcacagagacggctgatagagagctattacctacctttcatcatgtttctgtttacccaaaaaaggagcttcctttgttcatccatttcacagcaggattttgctcttctacagcaatgatagccattctcactcaccagtttcctgaaatcatgggtatttttgctaaagctgtgctgggactctggtgcccccaaccctgggcatcctcaggctttgaggagaatacacaggatttgaagtcagaagacctaggtttgagttctggctgagccacgcactgttcatgtgaccttgga

SEQ ID NO: 7394 - DNA, 1793 bp, Homo sapiens
atatactgtactattctttagctgtagacaggatgaagtgtttagggcccaggtccccttaccatgtgattatatttcactcaagatctgagcagcaacctcagaacaagatataagtatttccattacatgattcagtatggtggttgatttttctgaagcaaaaggcagcaaatgtcccctttcctgttcagagatgacatgaaagacttgactgtatttttaaattcattgacacccaaattctatgtggcacttacagggacctcttcattgatatcaggactaatatttatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcagaatgtaaggtatggagaaaccctctaaatcttttcagaggagcagaatataggagatacacttgggtgactggtaaagagccacttacatactatgacatgaacctgtcagctcaggaccatcagacctttttcacctgtgacacagattttttacgtccttcagacacagttatgcagaaggcttggagggaaagaaatcctccagctcgaatcaaagcagcctatcaagctttagaattaaacaatgactgtgccactgcatatgttctactggctgaggaagaagcaacaactattgtagatgctgaaaggttatttaaacaggcactcaaggcaggagaaacaatttataggcagtcacagcagtgccagcaccaaagtcctcagcatgaagctcaactgaggagagataccaatgtactggtatatattaaaagaagattggcaatgtgtgcaagaaaattaggaagaataagagaagcagtaaaaataatgagagatttgatgaaagaatttcctcctcttaccatgttgaacatccatgaaaatctcttagaatcacttttagaattacaggcctatccagatgttcaggcagtcctagcaaaatatgatgatataagccttccaaagtcagcagcaatctgttacacagcagcactgttgaagacaaggactgtttcagaaaaattctctccagaaacagcctccagaagaggattaagcacagcagaaattaatgccgtggaagcaattcatagagctgtggaatttaatcctcatgttccaaaatatttattagagatgaaaagtttaattttacctccagaacacattctgaaacggggtgatagtgaagcaattgcctatgctttctttcatcttcagcactggaaacgaatagaaggtgctcttaatctgttacagtgtacatgggaaggcacttttagaatgattccatacccgttagagaaaggacatctattttacccttatcccagctgcacagagacggctgatagagagctattacctacctttcatcatgtttctgtttacccaaaaaaggagcttcctttgttcatccatttcacagcaggattttgctcttctacagcaatgatagccattctcactcaccagtttcctgaaatcatgggtatttttgctaaagctgtaagtatgatctcaaggacttgtgtagattatttgtaaaacacacaagaaaccatctctgatctgcctgtgctaacccagctgaacaatggaagatatttgttgtaaattaaaggaattgatttgtatatagttgctgccataaatacatcaaacat

SEQ ID NO: 7395 - DNA, 1262 bp, Homo sapiens
gcgatagcggcaagatggcggaccgtggcggcgtgggtgaagccgcagctgttggagcgtctcctgcatctgtccctggcctaaacccgacgctaggctggagggagcgactgcgggccgggctggcggggactggggcctcgttgtggttcgtggcggggctggggctgctttacgccctgaggatccctttgaggctgtgtgagaatttggcagcggggacctcttcattgatatcaggactaatatttatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcagaatgtaaggtatggagaaaccctctaaatcttttcagaggagcagaatataggagatacacttgggtgactggtaaagagccacttacatactatgacatgaacctgtcagctcaggaccatcagacctttttcacctgtgacacagattttttacgtccttcagacacagttatgcagaaggcttggagggaaagaaatcctccagctcgaatcaaagcagcctatcaagctttagaattaaacaatgactgtgccactgcatatgttctactggctgaggaagaagcaacaactattgtagatgctgaaaggttatttaaacaggcactcaaggcaggagaaacaatttataggcagtcacagcagtgccagcaccaaagtcctcagcatgaagctcaactgaggagagataccaatgtactggtatatattaaaagaagattggcaatgtgtgcaagaaaattaggaagaataagagaagcagtaaaaataatgagagatttgatgaaagaatttcctcctcttaccatgttgaacatccatgaaaatctcttagaatcacttttagaattacaggcctatccagatgttcaggcagtcctagcaaaatatgatgatataagccttccaaagtcagcagcaatctgttacacagcagcactgttgaagacaaggactgtttcagaaaaattctctccagaaacagcctccagaagaggattaagcacagcagaaattaatgccgtggaagcaattcatagagctgtggaatttaatcctcatgttccaaaacttttagaatgattccatacccgttagagaaaggacatctattttacccttatc

SEQ ID NO: 7396 - DNA, 1790 bp, Homo sapiens
aagatggcggaccgtggcggcgtgggtgaagccgcagctgttggagcgtctcctgcatctgtccctggcctaaacccgacgctaggctggagggagcgactgcgggccgggctggcggggactggggcctcgttgtggttcgtggcggggctggggctgctttacgccctgaggatccctttgaggctgtgtgagaatttggcagcggtgactgtatttttaaattcattgacacccaaattctatgtggcacttacagggacctcttcattgatatcaggactaatatttatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcagaatgtaaggtatggagaaaccctctaaatcttttcagaggagcagaatataggagctgtgccactgcatatgttctactggctgaggaagaagcaacaactattgtagatgctgaaaggttatttaaacaggcactcaaggcaggagaaacaatttataggcagtcacagcagtgccagcaccaaagtcctcagcatgaagctcaactgaggagagataccaatgtactggtatatattaaaagaagattggcaatgtgtgcaagaaaattaggaagaataagagaagcagtaaaaataatgagagatttgatgaaagaatttcctcctcttaccatgttgaacatccatgaaaatctcttagaatcacttttagaattacaggcctatccagatgttcaggcagtcctagcaaaatatgatgatataagccttccaaagtcagcagcaatctgttacacagcagcactgttgaagacaaggactgtttcagaaaaattctctccagaaacagcctccagaagaggattaagcacagcagaaattaatgccgtggaagcaattcatagagctgtggaatttaatcctcatgttccaaaatatttattagagatgaaaagtttaattttacctccagaacacattctgaaacggggtgatagtgaagcaattgcctatgctttctttcatcttcagcactggaaacgaatagaaggtgctcttaatctgttacagtgtacatgggaaggcacttttagaatgattccatacccgttagagaaaggacatctattttacccttatcccagctgcacagagacggctgatagagagctattacctacctttcatcatgtttctgtttacccaaaaaaggagcttcctttgttcatccatttcacagcaggattttgctcttctacagcaatgatagccattctcactcaccagtttcctgaaatcatgggtatttttgctaaagctgtgctgggactctggtgcccccaaccctgggcatcctcaggctttgaggagaatacacaggatttgaagtcagaagacctaggtttgagttctggctgagccacgcactgttcatgtgaccttggacaaatcaccaaatttttctgaacagcatctgtaaagtgacagtaacccctacctcacagggttgttgtgaggattacatatatgctaaagcattttgcatatgaaaaagcttcttatgaatattgttattcctaggcaaaccccccttggaagctgtcaaaaaggacaactgtagatgaaattgtcttccttttttcttcattcagcttagcctttctgtttggcca

SEQ ID NO: 7397 - DNA, 1021 bp, Homo sapiens
cggattctaccccaggatacttcatgagaacgaaccccttcagagaggccctacaaaacagattagagggaagacagaggggtccaagggagatggtctctcttctcaagtaggaacaccccagcctcagacagacacagcaggaaggggcctgagaggctgacagaggcaggatgggtgcaaggcaggggtggaggggagggaccagcccgggctgcaccagtgggagtggctccacccttcccacctcagagccatggggagccagggctctggcggggtgcccttggtgcaggctccctacacagtcctgctgctgccgctggggacaagccgccaagacccaggggcccagagcttcttcctttggctacgcaggatgcaggctctggagagagaacaggatgccctgtggcagggtctggagctgctacagcatggccaggcctggtttgaagaccatctgagggaggcacagcgacagcagctgcatctaggggcccttggtgagaattttctaacagatttacactcagagcctggtcgccccccgttagcccagattcaaaaggtgaacatctgtttgcagaatctgattcatgagaagttgtcaaggcagcagaaaggagtcacccagccaaaggaggagatggctcagcggggctgcaccaaggggccaagaggccctacccgtgtctaaaccctcctctcactcccctaagcctggtgaaagagtcagaagccccaggctcctttttctgtttcttaactcaacagctaaaaaatggctccaggtagtgagtcaatgaagttcagacatgttggtgtaaagtttctcctctgctcctgaaaacttcatcttcttggtgtctcatgtcctcattctcccctatatgacatgcaaaaacgatctttctttgaaatccctctgggaagaagacatgtttattgaaactgtccttcagccttaaatacaaaaataaaactgaaactgctccagaaagcagctttctccaaaaat

SEQ ID NO: 7398 - DNA, 916 bp, Homo sapiens
ggagggaccagcccgggctgcaccagtgggagtggctccacccttcccacctcagagccatggggagccagggctctggcggggtgcccttggtgcaggctccctacacagtcctgctgctgccgctggggacaagccgccaagacccaggggcccagagcttcttcctttggctacgcaggatgcaggctctggagagagaacaggatgccctgtggcagggtctggagctgctacagcatggccaggcctggtttgaagaccatctgagggaggcacagcgacagcagctgcatctaggggcccttggtgagaattttctaacagatttacactcagagcctggtcgccccccgttagcccagattcaaaaggtgaacatctgtttgcagaatctgattcatgagaagttctccccaagtccactgaacaaggctagttcctgcaccacccaggattcaaaggaaagacgaagggagcagaacttgtggcagcaacaggagttgtcaaggcagcagaaaggagtcacccagccaaaggaggagatggctcagcggggctgcaccaaggggccaagaggccctacccgtgtctaaaccctcctctcactcccctaagcctggtgaaagagtcagaagccccaggctcctttttctgtttcttaactcaacagctaaaaaatggctccaggtagtgagtcaatgaagttcagacatgttggtgtaaagtttctcctctgctcctgaaaacttcatcttcttggtgtctcatgtcctcattctcccctatatgacatgcaaaaacgatctttctttgaaatccctctgggaagaagcatgtttattgaaactgtccttcagccttaaatacaaaaataaaactgaaactgctccagaaagcagctttctccaaaaat

SEQ ID NO: 7399 - DNA, 1020 bp, Homo sapiens
cggattctaccccaggatacttcatgagaacgaaccccttcagagaggccctacaaaacagattagagggaagacagaggggtccaagggagatggtctctcttctcaagtaggaacaccccagcctcagacagacacagcaggaaggggcctgagaggctgacagaggcaggatgggtgcaaggcaggggtggaggggagggaccagcccgggctgcaccagtgggagtggctccacccttcccacctcagagccatggggagccagggctctggcggggtgcccttggtgcaggctccctacacagtcctgctgctgccgctggggacaagccgccaagacccaggggcccagagcttcttcctttggctacgcaggatgcaggctctggagagagaacaggatgccctgtggcagggtctggagctgctacagcatggccaggcctggtttgaagaccatctgagggaggcacagcgacagcagctgcatctaggggcccttggtgagaattttctaacagatttacactcagagcctggtcgccccccgttagcccagattcaaaaggtgaacatctgtttgcagaatctgattcatgagaagttgtcaaggcagcagaaaggagtcacccagccaaaggaggagatggctcagcggggctgcaccaaggggccaagaggccctacccgtgtctaaaccctcctctcactcccctaagcctggtgaaagagtcagaagccccaggctcctttttctgtttcttaactcaacagctaaaaaatggctccaggtagtgagtcaatgaagttcagacatgttggtgtaaagtttctcctctgctcctgaaaacttcatcttcttggtgtctcatgtcctcattctcccctatatgacatgcaaaaacgatctttctttgaaatccctctgggaagaagcatgtttattgaaactgtccttcagccttaaatacaaaaataaaactgaaactgctccagaaagcagctttctccaaaaat

SEQ ID NO: 7400 - DNA, 820 bp, Homo sapiens
ggagggaccagcccgggctgcaccagtgggagtggctccacccttcccacctcagagccatggggagccagggctctggcggggtgcccttggtgcaggctccctacacagtcctgctgctgccgctggggacaagccgccaagacccaggggcccagagcttcttcctttggctacgcaggatgcaggctctggagagagaacaggatgccctgtggcagggtctggagctgctacagcatggccaggcctggtttgaagaccatctgagggaggcacagcgacagcagctgcatctaggggcccttggtgagaattttctaacagatttacactcagagcctggtcgccccccgttagcccagattcaaaaggtgaacatctgtttgcagaatctgattcatgagaaggagttgtcaaggcagcagaaaggagtcacccagccaaaggaggagatggctcagcggggctgcaccaaggggccaagaggccctacccgtgtctaaaccctcctctcactcccctaagcctggtgaaagagtcagaagccccaggctcctttttctgtttcttaactcaacagctaaaaaatggctccaggtagtgagtcaatgaagttcagacatgttggtgtaaagtttctcctctgctcctgaaaacttcatcttcttggtgtctcatgtcctcattctcccctatatgacatgcaaaaacgatctttctttgaaatccctctgggaagaagcatgtttattgaaactgtccttcagccttaaatacaaaaataaaactgaaactgctccagaaagcagctttctcc

SEQ ID NO: 7401 - DNA, 1020 bp, Homo sapiens; identical to SEQ ID NO: 7399

SEQ ID NO: 7402 - DNA, 1020 bp, Homo sapiens; identical to SEQ ID NO: 7399

SEQ ID NO: 7403 - DNA, 1020 bp, Homo sapiens; identical to SEQ ID NO: 7399

SEQ ID NO: 7404 - DNA, 916 bp, Homo sapiens; identical to SEQ ID NO: 7398

SEQ ID NO: 7405 - DNA, 916 bp, Homo sapiens; identical to SEQ ID NO: 7398

SEQ ID NO: 7406 - DNA, 916 bp, Homo sapiens; identical to SEQ ID NO: 7398

SEQ ID NO: 7407 - DNA, 1020 bp, Homo sapiens; identical to SEQ ID NO: 7399

SEQ ID NO: 7408 - DNA, 917 bp, Homo sapiens
ggagggaccagcccgggctgcaccagtgggagtggctccacccttcccacctcagagccatggggagccagggctctggcggggtgcccttggtgcaggctccctacacagtcctgctgctgccgctggggacaagccgccaagacccaggggcccagagcttcttcctttggctacgcaggatgcaggctctggagagagaacaggatgccctgtggcagggtctggagctgctacagcatggccaggcctggtttgaagaccatctgagggaggcacagcgacagcagctgcatctaggggcccttggtgagaattttctaacagatttacactcagagcctggtcgccccccgttagcccagattcaaaaggtgaacatctgtttgcagaatctgattcatgagaagttctccccaagtccactgaacaaggctagttcctgcaccacccaggattcaaaggaaagacgaagggagcagaacttgtggcagcaacaggagttgtcaaggcagcagaaaggagtcacccagccaaaggaggagatggctcagcggggctgcaccaaggggccaagaggccctacccgtgtctaaaccctcctctcactcccctaagcctggtgaaagagtcagaagccccaggctcctttttctgtttcttaactcaacagctaaaaaatggctccaggtagtgagtcaatgaagttcagacatgttggtgtaaagtttctcctctgctcctgaaaacttcatcttcttggtgtctcatgtcctcattctcccctatatgacatgcaaaaacgatctttctttgaaatccctctgggaagaagacatgtttattgaaactgtccttcagccttaaatacaaaaataaaactgaaactgctccagaaagcagctttctccaaaaat

SEQ ID NO: 7409 - DNA, 821 bp, Homo sapiens
ggagggaccagcccgggctgcaccagtgggagtggctccacccttcccacctcagagccatggggagccagggctctggcggggtgcccttggtgcaggctccctacacagtcctgctgctgccgctggggacaagccgccaagacccaggggcccagagcttcttcctttggctacgcaggatgcaggctctggagagagaacaggatgccctgtggcagggtctggagctgctacagcatggccaggcctggtttgaagaccatctgagggaggcacagcgacagcagctgcatctaggggcccttggtgagaattttctaacagatttacactcagagcctggtcgccccccgttagcccagattcaaaaggtgaacatctgtttgcagaatctgattcatgagaaggagttgtcaaggcagcagaaaggagtcacccagccaaaggaggagatggctcagcggggctgcaccaaggggccaagaggccctacccgtgtctaaaccctcctctcactcccctaagcctggtgaaagagtcagaagccccaggctcctttttctgtttcttaactcaacagctaaaaaatggctccaggtagtgagtcaatgaagttcagacatgttggtgtaaagtttctcctctgctcctgaaaacttcatcttcttggtgtctcatgtcctcattctcccctatatgacatgcaaaaacgatctttctttgaaatccctctgggaagaagacatgtttattgaaactgtccttcagccttaaatacaaaaataaaactgaaactgctccagaaagcagctttctcc

SEQ ID NO: 7410 - DNA, 820 bp, Homo sapiens; identical to SEQ ID NO: 7400

SEQ ID NO: 7411 - DNA, 820 bp, Homo sapiens; identical to SEQ ID NO: 7400

SEQ ID NO: 7412 - DNA, 820 bp, Homo sapiens; identical to SEQ ID NO: 7400

SEQ ID NO: 7413 - DNA, 820 bp, Homo sapiens; identical to SEQ ID NO: 7400

SEQ ID NO: 7414 - DNA, 1058 bp, Homo sapiens
ggctgcttaagacggaagctcggttgatgtttctgcagaagttttcccccttggtcggtggcggagctgctgagcgcgatagtagcagctccggcggcagcaacattgactacgaggaatggcggcggctgccgcaggacctgcagcatcccagaggtttttccagagcttctcagatgctctaatcgaccaggacccccaggcggcgttagagtagagacggggtttcaccatgttagccagactagtctcgatctgctgacctcgtgatccacctgccttggcctcccaaagtgctgggattacaggcatgagccaccatgcctggccaaaaacccatctttttctacatagttgctgttgctgatgtaaagaagtctcgtgaactcaatccaaataattccactgctgtgctgagaaaagggtatgcaatagctactctttttgttgagcttggactgtaaataatagatgtttaatttgttgaatgagttcattgtaagctttataagtagtaaaattatttatacatattatagcagagatatgattcaattttaaatataaagttatagttctattattttgttaaccataatatgtgataggagatctatacttaatatattttaaaatagtgatgattgaaataactgcagggtatagatgaaactgatgcatttcacattccttttttgtttatcatttggaatttactctatttaactgactggtgaacatcctattattcaaccaagctgaataggctacatttaatgctatgaaagctctgtatctatgtgctttatatcccatcttgtttctgttgataagtgtaactttattctttaagtaagaaactgctttaattcctttgtataattatattttggaataagcaagtatgtataattaaagtgaaattccttctgaagtaagttctaaaattgaattttactggaaattatactagatgttaacagtattttagaaagtctcttggcttactaacatatgcttaaaataaattttttctttcaacaatagaaaatactaaa

SEQ ID NO: 7415 - DNA, 194 bp, Homo sapiens
cggttgatgtttctgcagaagttttcccccttggtcggtggcggagctgctgagcgcgatagtagcagctccggcggcagcaacattgactacgaggaatggcggcggctgccgcaggacctgcagcatcccagaggtttttccagagcttctcagatgctctaatcgaccaggacccccaggcggcgttagag

SEQ ID NO: 7416 - DNA, 14371 bp, Homo sapiens
cgggccgcagccggactcggagcccgagggagcgatcggcgtgcgggcggcgggggcccgggcgcgctccgggggcgcggcgaggccgagggggcgggcgccgggcggagccgcagccggagccggggcgcctggaggcggtcgggccgcactctccgagcccagagcagcggagagaccgcgcggcggggcttgggacggggacgcggtgtcggggccgaggtgggccgagagcagccgcagccccagcggccggagccgcgccgggtccctccccagggacgtcgaggccgggcgggcctgggccatgcgcgcagctcgctgaggccgagggaggccgcgatggaggcgccggcggccgagcccccggtccggggctgcggtccccagcccgcgcctgcacccgcgcctgccccggagaggaaaaagagccaccgcgcgccgtcgccggcccggcccaaagacgtggccggctggtcgctggctaagggccgccgcggcccaggcccgggctcagcagtcgcctgcagcgccgcgttctcctcacggccggacaagaaggggcgcgcagtggctcccggggcgcgcggtgcgggtgtgcgggtggccggggtccgcaccggggtccgtgccaagggccgtccgcgctcgggtgcggggccgcgaccgccaccgccgccccccagcctcacggatagcagctcggaggtgtcggactgcgcgtcggaggaggcgcgcctgctgggcctggagctggcgctgagcagcgacgccgagtccgcggccgggggcccggcgggggtccgtacggggcagccggcccagcccgcgccctccgcgcagcagcccccgcggccgcccgcctccccggacgagccgtcggtggccgcgtcgtcggtgggcagcagccgcttgccgctcagcgcctcgcttgccttctccgacctcaccgaggagatgctggactgcgggcccagcggcttggtgcgggagctggaggagctgcgctcggagaacgactatctcaaggacgagattgaggagctgcgggccgagatgctggagatgcgggacgtctatatggaggaggacgtgtatcagctgcaggagctgcgacagcagctggaccaggccagcaagacctgccgcatcctgcagtaccggctgcgcaaagccgagcgccgcagtctccgtgccgcccagaccggccaggtggacggcgagcttatccgtggtctggagcaggatgtcaaggtctctaaggacatctccatgcggctgcataaggagctcgaggtggtggagaagaaacgggcgcggctggaggaggagaacgaagagcttcgtcagcggctcatcgagactgagctggctaagcaggtgctgcagacggagctggagcgaccgagagagcattccttgaagaaaagaggaacccgctccctggggaaggccgataagaagactttggtgcaggaggacagtgcagacctgaagtgccagttgcactttgcaaaggaggagtcagccctcatgtgcaagaagctcactaagcttgccaaggagaatgacagcatgaaggaggagctgctgaagtaccgctcgctctatggggacctggacagcgcgctgtcagccgaggagctggccgatgccccccactcgcgggagaccgagctgaaggtgcacctgaagctggtggaggaggaagccaacctgctgagccgccgcatcgtggagctggaggtggagaaccgaggcctgcgggctgagatggacgacatgaaggatcatggaggtggctgtgggggtcctgaggcacgcctggccttctccgcgctgggtggcggagagtgcggggagagcttggcagagctgcggcgacacctgcagtttgtcgaagaggaggccgagctgctgcggcgctcctctgccgagctcgaggaccagaacaagctgctgctgaacgagctggccaagttccgctcggagcacgagctggacgtggcgctgtcggaggacagttgttctgtgctcagcgaaccttcacaggaggagctggcggccgccaagctgcagatcggcgagctcagcggcaaggtcaagaagctgcagtacgagaaccgcgtgctcctctccaacctccagcgctgtgacctcgcctcctgccagagtacgcggcccatgctggagacggacgccgaggccggggactctgcccagtgtgtgcctgctcccctgggcgagacacacgagtcccatgcggtccgactctgcagagccagggaggccgaggtgctgcctgggctgagagagcaggccgccctggtcagtaaggccatcgatgtcctggtggctgatgccaatggcttcacggctggcctccggctgtgtctggacaacgagtgtgctgacttccggctgcatgaggcccccgacaacagcgagggccccagggacaccaagctcatccatgccatcctggtgcgcctgagcgtgctgcagcaggagctgaatgccttcacgcggaaggcagatgcagtcctcgggtgctctgtcaaggaacagcaggagtccttctcatcactgccccccttgggctcccaggggctctctaaggagattcttctggcaaaagaccttggctcagactttcagccacctgacttcagggacctgccggaatgggagcccaggatccgagaggctttccgcactggtgacttggactctaagcccgaccccagccggagcttcaggccttaccgagctgaagacaatgattcctatgcctctgagatcaaggagctgcagctggtgctggctgaggcccacgacagcctccggggcttgcaagagcagctctcccaggagcggcagctacgaaaggaggaggccgacaatttcaaccagaaaatggtccagctgaaggaggaccagcagagggcgctcctgaggcgggagtttgagctgcagagtctgagcctccagcggaggctggagcagaaattctggagccaggagaagaacatgctggtgcaggagtcccagcaattcaagcacaacttcctgctgctcttcatgaagctcaggtggttcctcaagcgctggcggcagggcaaggttttgcccagcgaaggggatgacttcctcgaggtgaacagcatgaaggagctgtacttgctgatggaggaagaggagataaacgctcagcattctgataacaaggcctgcacgggggacagctggacccagaacacgcccaatgagtacatcaagacactggccgacatgaaggtgacgctgaaggagctgtgctggctgctccgggatgaacgccgtggtctgacggagcttcagcaacagtttgccaaggccaaggctacctgggagacagagcgggcagagctcaagggccatacctcccagatggagctgaagacagggaagggggccggggagcgggcagggcccgactggaaggcagccctacagcgggagcgtgaggagcagcagcacctcctagctgagtcctacagcgctgtcatggagctgactcggcagctgcagatcagtgagcgcaactggagccaggaaaagctgcagctggtggagcggctgcagggtgagaagcagcaggtggagcagcaggtgaaggagctgcagaaccgcctaagccagctgcagaaggctgccgacccctgggtcctgaagcactcggagctggagaagcaggacaacagctggaaggagacacgcagtgagaagatccacgacaaggaggctgtttccgaagttgagcttggaggaaatggtttaaagagaaccaaatctgtttcttccatgtctgagtttgaaagtttgctcgactgttccccttaccttgctggcggagatgcccggggcaagaagctgcctaacaaccctgcctttggctttgtgagctccgagccaggggatccagagaaagacaccaaggagaagcctgggctctcgtcgagggactgcaaccacctgggtgccctggcctgccaggaccccccagggaggcagatgcagcgcagctacacggctcctgacaagacgggcatccgagtctactatagtcccccggtggcccggcgcctcggagtccctgtggttcatgacaaagagggcaagatcattatcgagcccggcttcctcttcaccacagccaagcccaaagagtcggccgaggctgatgggctggctgagagctcctatggtcggtggctctgcaacttctcacggcagcgcctggacggaggctcagcgggcagcccctcggcggccgggcctggcttcccagcggccctgcatgactttgagatgtcaggcaacatgagtgatgacatgaaggagatcaccaactgtgtgcgccaggccatgcgctccggctcactggagaggaaagtgaagagcacatccagccagacggtgggcctggccagtgtgggcacacagaccatccgcacggtcagcgtgggcctgcagaccgacccaccccgcagcagcctccatggcaaggcctggtcaccccgcagctcttcgctcgtgtctgtgcgcagcaagcagatctcctcctccctggacaaggtccattcgcgcatcgagcggccctgctgctcccccaagtatggctcaccaaagctccagaggcggtctgtgtccaagctggacagcagcaaggaccgcagcctgtggaacctgcaccagggcaagcagaacggctcggcctgggcccgctccaccaccacgcgggacagccctgtattgagaaacatcaacgatggactctccagcctcttcagtgtggtggagcactcagggagcacggagtctgtctggaaactaggcatgtctgagacgcgggccaagcccgagcctcccaagtacggcattgtgcaggaattcttccgtaatgtgtgtggccgggcaccgagccccacctcatcagcaggagaggagggcaccaagaagccagagcccctctccccagccagctaccatcagccagagggtgtggccaggatcctgaacaagaaggcagccaagttgggcagcagtgaggaggtcagactcaccatgctcccccaggtggggaaggatggtgtcctccgggacggagatggagccgtggtccttcccaatgaggacgctgtttgtgactgtagtacccagtctctcacctcctgcttcgcccgatcgtcccgctctgccatccgccactctccttccaagtgcaggctgcacccttcagagtccagctggggtggggaggagagggcactcccccccagcgagtgacagagcagccaagctccccgcctcaaccagcccagcccctggatagcagaagggaaccagcagagacgagacgaggtgaggcgaggggctgtgtcctcagcattgcctggccctggagggacagcagtgatgccactgccagaatgcagctttcacatcaaggtaaagccgggtctcctgctggcccctgggtggtgagcttcgacttcccaggggaaggcagtgagtgggagagagaccaaacctgggcttcccaagcatccactgagagatctgtcaagagccgatccctgggtcctaagagagagccttgcctggttctgcccatgccaccctcttggaagagcccaagaaggatacatgtctggccatgcctttggggaaaaggagtcggagagatgtttcctgctgaccatccaccccttcatttgggaggagacactgctgagaagaacaggctttgctctagggctccatgtttggttcctggtggagccctgttgggcatcatcaccatcacctccttctctccaccacctcctcctcccagccccactgctctagattgctgggacactagggagtatgatagggcagtagccagggccattgcttagtgtcctggagccctggatctccctgcccatagcctggatgcagcaagagctgggaggcgaagtggaaacatgcagggctcagggttggggagtgattgcaattgccttccttgccaaagtgacttggggccccaacgttcccagcagaccccttgaggacagaaataggtagagtcagtctcaagacctggtgcatagataaatgcctaaatacactgccttgatctcaagtgatctcagaggcctctttccctggcaccctgagaggcagcaggcactacatctccactgtgtttacatcctgcagctggtcggggggcaaagatattcccagtaagagattcttggttggccaggtcaggcccaggagaacaccaagaggccagagcccaggacacagcagtagactggggcctggaaacacgtatcttgcctagattgtttatttgaatttttcctactataaatatttaaggtggtttactttattttaataatttaatttaccccaaagtccctaaggtaatttattggaggttgaaacatgcattcttgccactgggacaacatgaggcctctaacagcacgggcaggcatggggtcccctgggtggacgaggccgcttggcagccaggtttggagacctggcctcctggtcagctttggagggcccctcaacagagctggagccctgcaccccaacacggctggccatgtggcctcagaacactacttattactcaatgcctggtacttggccagccccagcggtcagtctataaatactcactgacaaggtggagggctggacggccatcaccactccccagacgttctccattgcctgtctcatttccctccctccctctgacacctttcttcatgagtcgaacgtggattactaaagctctattaagagtgtggagatccctccaagtttcccaaatgagaactcacaggaaaacaggactgaactttgagaatgttgtttatcgcagctttgcacataaacctgagtgtctcccagcctgcctcggttctcaccagcctgccagccttttcaccagcctctctccttagccttatggcctttcacggctcttctccctgccccagctctgctgcccgcccttcctcacgtcccctgtgagctgcctgagccattggttggatttcgatgtggctcattgcagcatgtggggcagcgcctcccatggcctcgccttggtgccggtgaaccccttttggttgcacacatgctccccacacacacatagacatcagccttcctgtaactgactggggacccagagtggaaacaccaggatggatcagcttgtctgcagaattgcccatcaggaagaccaaaagccagtagctttgctgatctgcccccaggactctggaggcgcccctgcactcccacctcccacctgccagttcccagacccacccattcgggatcacctggaccagttaccccaagtcctgcatctcccttccctgcaggctgaacaccagggtcatgccagtcccgccagccgcctcctccatgccccagtgactggtgtgggcagagcaggcagccagtggagctgtgggccagttccgctcttggatgctgctgctctcacccatgaggtcaggggggccctccaaggttatctccaggtgaggggattcacatcaggccacaagccaccagaggccttctgccacctcccagagcgacagccagggaggctgcgtactcagcctcggggagaaatccccgtgggacctgagccccaagacctacggaccactcagccttaccatcgtaccgtccaggattgtccttgccatctttgttgtctcagccagaccttggttttcagtaaagccccagtttctacttcctgcatgccactgtgcaaggccactcatcactgttcctgcagaagcctctggacgtggggctggatggggttgaaaatgttacatgtaaatattggtttggttcggtttttagcattttacttggtaactggttgttttcttttttggggtggggggattggtttgtaaaaattctctactcttttggaatgtgatttctaagtttgttggtttcttcaaatgccttttaagtcttggtaacattcccaaagcagaaaactgcctgacccacagtggggattccctggagaattggggtcccaagaaggaatgctgcccttctcgaacccgttctcccccttcctcctgcctctctgccttttactgctattcccttcttctcctcctttatccttctttctgttttccccatctccactctctcttcaaccaaagtcccaaggaaccctcggggctcaatcccccatagaccacttggcttgggtccatggggttggcatcagttggttggcggaaatgggggaccagttggcatgatggccctaaactgggaaacctcatgtttcttatgtctcacctctttccagagccaaatcagccccttttggaatgatgacttcattggaatgcaaatcaagtcattttggtgcatcagtggctcttaggcctgcacacacgagacatcagaatccaatcctctgaccctgtgccagccctttcccccagtttatttcccaccaaaggctgacctctaagaggtcttgctttctatgaactcaagatgggtcccacctctaggtgtccccaggtgcactcttctaccggttggcttccgatgtgacaaggccaagggcccaaagacttgaccctcttacacccttgctgacatggttccatcatgtccacccgcatgcacttttatggtttcatcacccagcctcttctcctctggcccacccagcgtccaggctctttctccctctcccctcctatctagaatgtcccctgcttctagcctcaccagaccccccaagctcccactacttcttccataataatagtaataacaatggttatcatcatcccctgcacatcccgcctaaagcactttactatatagaaaacgtttcccctggccgggcatggtggctcacgcctgaaatcccagctctttgggaggctgaggcgagcggatcagttgaggtcaggagttcaacgccagcctggccaacgtggtgaatccctgtctgtactaaaagtacaaaaaattagctgagcatggtggtgcgtgcctgtaatcccagctactcgggaggctgaggtgggagaatcgcttgagcccaggaggcggaggttgcaggagcagagattgcgccactgcactccagcctggatgacagagtgagacccaatctcaaaaaagaaatcgtttcccaccccacatctccttcagacctctcagggacaactctgggaggcagccttggcaggacatgggttagtgcgcccattttgctgtgaggaaactgaggtacaggtctcatcccagagcatgagaagtcactgagtttagatgagaacttgggtccaactctgtcctgtttgctgtgcaaatccgctgccctgctgggggcttttggtgggtccagaatacccagaatatgctgctggccaacccaggcataaaacaagtccattctagatcactgagccttgtgtattccagagggtgatctgaggtccccattcagcagaattctctgagggcatgttcagaatgtagattcctgggccccaccttgaatttgcatgtttaacaaactctcctggggttgaggggtgggtgcagtggtcacacctgtaatcccagcactttgggaggctgaggcgggtggatcacttgagctcaggagttcgagcctggccaatatggtgaaaccctgtctctactaaaaatgcaaaaattagccaggtgtggtggcacatgcctgtaatcccagctacttgggaggctgaggcaggagaatcacttgaacctggtggggagcagcggttgcagtgagccgagattgtgccattgcgctctagcctgggcaacggaatgagacttgtctcaaaaaaaataaaaaataaaaccagccctccccgggggatcttaggcactattggccacaccattggtgttcgtggccctgattattaggctatctttctttttttaagtttttttagatttattttttattttatttatttatttatttattatttattattattatttttagagacagggggtctccctatgttgcccaggctggtttcaaactcctgggctcaagtgatctgccctcctcagcctcccaaagtgctggggttacaggcaggcatcagccaccgtgccaggtcatcttcctttttcttttttttttggagacagagtcttgctctgtcattcaggctggagtacagtggcgccatttcagctcaccgcagcctccacctcccaggttcaagcagttctcctgcctcaacctcccgagtaactgggattacaggtgtgtgccaccacacccgactaatttttttatttttagtagagacggggtttcaccatgttggccaggctggtcttgaactcctgacctcaggtgatccacccacctcggcctcccaaagtactgggattataggcgtgagccacggcatccagcctcatctttcttttaaccaataaacatgatgctgtatcttaaaaagagcactgagcagggacttaagggatcgagtcctcaaccaaactgatttaattactcaggattttcaaaaagcatcagaggctatttacaatcttaatcataggggttcagtaaaataaaaataagaagtaaaaaagcaagagaaattattctgtaaatctaactggtgtaattcccataatcatgcaattaagttttactcttgagtttcctgacagccattggtaaaaagagaaacacatcaggatttataatttttatcatccaattatgggaagcaagcatgttggccccaggagacgaactcttctactaatttatagcatgtatcctttcatcaagggccactgagccagttggtgagtcaacgggtgaacctaagatgcaaggatgttttccaggtgactatttaaaaaaataaataatccaccaacgtgattgaccttggcgagatcatgtttctagtctatacctcagtttccccatctgtaaagtgaggataatgtcccaccccatgtaactgtggtgaggaccaactgcaacactgtgcctgcgagtctccttggaaaagtgtaaggttctacacaaatggaaagtgatctgatcacactcagtgtccccagcccagcctttcagtgccctggccctggggtgggggacaatactctcctcacccccttcactagtcttcatgaatagcaaggaggccataacataatttggtctaaaccccttcctttttaaaagaatgatggcaaaatgtgcataacattaaatttaccattttaaagatttctaagtgtctcgaagtacatttgcaatgtgtaactgccacctccagaactttttcatcatcctaaactgaaactctgtacccactaaacagtaactccccactccccctgtccccagtccctggtaacctctattctactttttttttttctctgtggattggcctattctaggtatctcttttaagtagaatcatatagtatttgtccttttgtgtccagccccctcattttttgagatgaggaatcaggcccagagaaggcagtggctcacccaaggtcacatcgcaaaccagaggcagagccaagaccagaacccaggtttcctgactcctaacaggtcttgcatccccagtagtgaatgagacactgctttgactttctgtaatcttggtttagccccttcctttctctgggctcagtctgcttcccaccactcacccattctttctttatcatctccctccaaagcctcttgtcctcctgcctcctcttctccttggctggttcctgccagcaaatggagtggccctggtccatgccaggttttcctcttctgggtccggagctcactatagtattcagccctcagtcctcccaggatgttcttcccagcactgctgcctcgtgcggattttcccgtaacctcagtaactggcttcttgtccccctgcttcctaccagggaagccttcctgtccgcgtctgtggtttcccaactctgatatttgctctcaaatgtggtggtgtcctggttctgtgtttatttattttgtgttttctcacacacacaaaaaaaagcctcttcctccaatgcatcaggaggcaccagccctgccagcccttctcactgggctcaccctgccccagcaaccccccggtgccacccttaagccacactgtcttctctgtaagcagcctgccagcagcagccccagcactttgcaatgggcgtgtgtgtggtggtgggtggggggggcttggatccctcctttttcctcccctgccctgcccaggcccagatggccttgactgtaaagcaggtgctgcctgacaggttcttctctccctgtctctggtcattgatccatctctttgtccattcagtatccaaccatcctctccattctcctctggacctcaccactctcagagctgcttgtcctggcagaatctacagttcaccccaactctatgccttacccctcccaacccaacagcatttgcagtttgcaaaatatacagacccaagtcctgaggggactgaggacatgatgctgggcccaagtctcctgctcagggcttctctccaatgccagccctgccactccttcctcaccctccttggagcctcctctgctgcttgtctatcccaacggccctgctcccctcccttcctgcccttcaccagctttctggacaccatgccctgaggaagggacctttggttttctctaaacatctttgaagggctgaggcagtcagggctggctgccttgtcactctttatttggaagccactcaaaccattcccaagaagagggacctcagctggcaatctggaaacctggcccaggtctgggcagatgtcttcacttctcctaccttcccagtcttgtgatcctgtgatgagcaccaggatggccctgtggtccctagagcacccctcatgctgtagggtcctgcagccccatcctttctctactgggccctggtatcctggctcctctctcagctctgccactgatctctgtgccttagtttacttctctgcacgggggactcaccccaagaccatttccagcagcttcccaggtgatgtggtgccccaaggctgggctttgccagctgtggcccagctccttagtgctgcccaggagacaccaggctgctcagaatgaggtgactgcgggcaccattctcagccagtggttcttgtattgcattccagcagcaggaatatcacctgggaacttgatagaagtgcagattagcagccccacccaagacccactgaattagagcttgtggagtggggccctacaagctggggttttaaggagccctccaaatgattctgacgcataagaatatgccaactgctgatctgggctagccattagtagagcctggggagggactgggactggctaggccaagaacaggtggaaaacaccagccttatctggactcctgagattgggaaccaccaccaacaaaaaccaaccctatagtcgctcctcttggaagaggaagagaagttgaagggcctggagaaagcacacattgtttgtttccctgctcctgctcacctctctcacttgtcttggttttacaaaaggctgtgtggatggtgccagccagggagggggtgggagtcctggggaggcaggaggcagaagaccctgactgtttctcccttgggaacctcaccataggccagatagcgcctcttcaaactgaaagaaatcttaactccacaaagaaagcatcctaaatccccagttcctcctcctcccaaccccagggataccttgtagacagtgccaaaaaacagctccaacccccagcagctgggaagagagccagaagctgcccttcctcctcatcctggcccctccccagcccccgccaatactgtgaacccccttcccactcagcctggtttcctggtgagggtcctgcagtcatgggccctgggggacccccagggcaaggcccatgggagggaagggaccaagggcatccttgggccaactgtccacctctcttgtccactattctctcctttccacttctgtcttcaaaaggctccttcctaggatggatcgggtgctaggacaactgcagtccaatccaccagctctccctgcccctgtgtcttatttcagacatgagaataactgtacagtgtaaacttataaagcgtttttaatggttgtagattggaaataaagtatgtcatatgaacagct

SEQ ID NO: 7417 - DNA, 3710 bp, Homo sapiens
gatgtgttttctgcctttctggactactttgcctctaagatgcagaaactgagtacaagggaaaggactccaaatccccagtatgtcccctgcaggagcagagttgaaggaggtcccaccaggtctggtgggtggccctgctcaggcttacctcccccttgtaggggtcactgggaactgtcaactgcgaaggactgtgatctccagtctggtatggtctgctctggggtccaagtgaggaaagcataaatcgggcaactctctcccagtgagaagatagaaggagcttctacagagaaggacgagattgaggagctgcgggccgagatgctggagatgcgggacgtctatatggaggaggacgtgtatcagctgcaggagctgcgacagcagctggaccaggccagcaagacctgccgcatcctgcagtaccggctgcgcaaagccgagcgccgcagtctccgtgccgcccagaccggccaggtggacggcgagcttatccgtggtctggagcaggatgtcaaggtctctaaggacatctccatgcggctgcataaggagctcgaggtggtggagaagaaacgggcgcggctggaggaggagaacgaagagcttcgtcagcggctcatcgagactgagctggctaagcaggtgctgcagacggagctggagcgaccgagagagcattccttgaagaaaagaggaacccgctccctggggaaggccgataagaagactttggtgcaggaggacagtgcagacctgaagtgccagttgcactttgcaaaggaggagtcagccctcatgtgcaagaagctcactaagcttgccaaggagaatgacagcatgaaggaggagctgctgaagtaccgctcgctctatggggacctggacagcgcgctgtcagccgaggagctggccgatgccccccactcgcgggagaccgagctgaaggtgcacctgaagctggtggaggaggaagccaacctgctgagccgccgcatcgtggagctggaggtggagaaccgaggcctgcgggctgagatggacgacatgaaggatcatggaggtggctgtgggggtcctgaggcacgcctggccttctccgcgctgggtggcggagagtgcggggagagcttggcagagctgcggcgacacctgcagtttgtcgaagaggaggccgagctgctgcggcgctcctctgccgagctcgaggaccagaacaagctgctgctgaacgagctggccaagttccgctcggagcacgagctggacgtggcgctgtcggaggacagttgttctgtgctcagcgaaccttcacaggaggagctggcggccgccaagctgcagatcggcgagctcagcggcaaggtcaagaagctgcagtacgagaaccgcgtgctcctctccaacctccagcgctgtgacctcgcctcctgccagagtacgcggcccatgctggagacggacgccgaggccggggactctgcccagtgtgtgcctgctcccctgggcgagacacacgagtcccatgcggtccgactctgcagagccagggaggccgaggtgctgcctgggctgagagagcaggccgccctggtcagtaaggccatcgatgtcctggtggctgatgccaatggcttcacggctggcctccggctgtgtctggacaacgagtgtgctgacttccggctgcatgaggcccccgacaacagcgagggccccagggacaccaagctcatccatgccatcctggtgcgcctgagcgtgctgcagcaggagctgaatgccttcacgcggaaggcagatgcagtcctcgggtgctctgtcaaggaacagcaggagtccttctcatcactgccccccttgggctcccaggggctctctaaggagattcttctggcaaaagaccttggctcagactttcagccacctgacttcagggacctgccggaatgggagcccaggatccgagaggctttccgcactggtgacttggactctaagcccgaccccagccggagcttcaggccttaccgagctgaagacaatgattcctatgcctctgagatcaaggagctgcagctggtgctggctgaggcccacgacagcctccggggcttgcaagagcagctctcccaggagcggcagctacgaaaggaggaggccgacaatttcaaccagaaaatggtccagctgaaggaggaccagcagagggcgctcctgaggcgggagtttgagctgcagagtctgagcctccagcggaggctggagcagaaattctggagccaggagaagaacatgctggtgcaggagtcccagcaattcaagcacaacttcctgctgctcttcatgaagctcaggtggttcctcaagcgctggcggcagggcaaggttttgcccagcgaaggggatgacttcctcgaggtgaacagcatgaaggagctgtacttgctgatggaggaagaggagataaacgctcagcattctgataacaaggcctgcacgggggacagctggacccagaacacgcccaatgagtacatcaagacactggccgacatgaaggtgacgctgaaggagctgtgctggctgctccgggatgaacgccgtggtctgacggagcttcagcaacagtttgccaaggccaaggctacctgggagacagagcgggcagagctcaagggccatacctcccagatggagctgaagacagggaagggggccggggagcgggcagggcccgactggaaggcagccctacagcgggagcgtgaggagcagcagcacctcctagctgagtcctacagcgctgtcatggagctgactcggcagctgcagatcagtgagcgcaactggagccaggaaaagctgcagctggtggagcggctgcagggtgagaagcagcaggtggagcagcaggtgaaggagctgcagaaccgcctaagccagctgcagaaggctgccgacccctgggtcctgaagcactcggagctggagaagcaggacaacagctggaaggagacacgcagtgagaagatccacgacaaggaggctgtttccgaagttgagcttggaggaaatggtttaaagagaaccaaatctgtttcttccatgtctgagtttgaaagtttgctcgactgttccccttaccttgctggcggagatgcccggggcaagaagctgcctaacaaccctgcctttggctttgtgagctccgagccaggggatccagagaaagacaccaaggagaagcctgggctctcgtcgagggactgcaaccacctgggtgccctggcctgccaggaccccccagggagccagaagctgcccttcctcctcatcctggcccctccccagcccccgccaatactgtgaacccccttcccactcagcctggtttcctggtgagggtcctgcagtcatgggccctgggggacccccagggcaaggcccatgggagggaagggaccaagggcatccttgggccaactgtccacctctcttgtccactattctctcctttccacttctgtcttcaaaaggctccttcctaggatggatcgggtgctaggacaactgcagtccaatccaccagctctccctgcccctgtgtcttatttcagacatgagaataactgtacagtgtaaacttataaagcgtttttaatggttgtagattggaaataaagtatgtcatatgaacagct

SEQ ID NO: 7418 - DNA, 4599 bp, Homo sapiens
gatgtgttttctgcctttctggactactttgcctctaagatgcagaaactgagtacaagggaaaggactccaaatccccagtatgtcccctgcaggagcagagttgaaggaggtcccaccaggtctggtgggtggccctgctcaggcttacctcccccttgtaggggtcactgggaactgtcaactgcgaaggactgtgatctccagtctggtatggtctgctctggggtccaagtgaggaaagcataaatcgggcaactctctcccagtgagaagatagaaggagcttctacagagaaggacgagattgaggagctgcgggccgagatgctggagatgcgggacgtctatatggaggaggacgtgtatcagctgcaggagctgcgacagcagctggaccaggccagcaagacctgccgcatcctgcagtaccggctgcgcaaagccgagcgccgcagtctccgtgccgcccagaccggccaggtggacggcgagcttatccgtggtctggagcaggatgtcaaggtctctaaggacatctccatgcggctgcataaggagctcgaggtggtggagaagaaacgggcgcggctggaggaggagaacgaagagcttcgtcagcggctcatcgagactgagctggctaagcaggtgctgcagacggagctggagcgaccgagagagcattccttgaagaaaagaggaacccgctccctggggaaggccgataagaagactttggtgcaggaggacagtgcagacctgaagtgccagttgcactttgcaaaggaggagtcagccctcatgtgcaagaagctcactaagcttgccaaggagaatgacagcatgaaggaggagctgctgaagtaccgctcgctctatggggacctggacagcgcgctgtcagccgaggagctggccgatgccccccactcgcgggagaccgagctgaaggtgcacctgaagctggtggaggaggaagccaacctgctgagccgccgcatcgtggagctggaggtggagaaccgaggcctgcgggctgagatggacgacatgaaggatcatggaggtggctgtgggggtcctgaggcacgcctggccttctccgcgctgggtggcggagagtgcggggagagcttggcagagctgcggcgacacctgcagtttgtcgaagaggaggccgagctgctgcggcgctcctctgccgagctcgaggaccagaacaagctgctgctgaacgagctggccaagttccgctcggagcacgagctggacgtggcgctgtcggaggacagttgttctgtgctcagcgaaccttcacaggaggagctggcggccgccaagctgcagatcggcgagctcagcggcaaggtcaagaagctgcagtacgagaaccgcgtgctcctctccaacctccagcgctgtgacctcgcctcctgccagagtacgcggcccatgctggagacggacgccgaggccggggactctgcccagtgtgtgcctgctcccctgggcgagacacacgagtcccatgcggtccgactctgcagagccagggaggccgaggtgctgcctgggctgagagagcaggccgccctggtcagtaaggccatcgatgtcctggtggctgatgccaatggcttcacggctggcctccggctgtgtctggacaacgagtgtgctgacttccggctgcatgaggcccccgacaacagcgagggccccagggacaccaagctcatccatgccatcctggtgcgcctgagcgtgctgcagcaggagctgaatgccttcacgcggaaggcagatgcagtcctcgggtgctctgtcaaggaacagcaggagtccttctcatcactgccccccttgggctcccaggggctctctaaggagattcttctggcaaaagaccttggctcagactttcagccacctgacttcagggacctgccggaatgggagcccaggatccgagaggctttccgcactggtgacttggactctaagcccgaccccagccggagcttcaggccttaccgagctgaagacaatgattcctatgcctctgagatcaaggagctgcagctggtgctggctgaggcccacgacagcctccggggcttgcaagagcagctctcccaggagcggcagctacgaaaggaggaggccgacaatttcaaccagaaaatggtccagctgaaggaggaccagcagagggcgctcctgaggcgggagtttgagctgcagagtctgagcctccagcggaggctggagcagaaattctggagccaggagaagaacatgctggtgcaggagtcccagcaattcaagcacaacttcctgctgctcttcatgaagctcaggtggttcctcaagcgctggcggcagggcaaggttttgcccagcgaaggggatgacttcctcgaggtgaacagcatgaaggagctgtacttgctgatggaggaagaggagataaacgctcagcattctgataacaaggcctgcacgggggacagctggacccagaacacgcccaatgagtacatcaagacactggccgacatgaaggtgacgctgaaggagctgtgctggctgctccgggatgaacgccgtggtctgacggagcttcagcaacagtttgccaaggccaaggctacctgggagacagagcgggcagagctcaagggccatacctcccagatggagctgaagacagggaagggggccggggagcgggcagggcccgactggaaggcagccctacagcgggagcgtgaggagcagcagcacctcctagctgagtcctacagcgctgtcatggagctgactcggcagctgcagatcagtgagcgcaactggagccaggaaaagctgcagctggtggagcggctgcagggtgagaagcagcaggtggagcagcaggtgaaggagctgcagaaccgcctaagccagctgcagaaggctgccgacccctgggtcctgaagcactcggagctggagaagcaggacaacagctggaaggagacacgcagtgagaagatccacgacaaggaggctgtttccgaagttgagcttggaggaaatggtttaaagagaaccaaatctgtttcttccatgtctgagtttgaaagtttgctcgactgttccccttaccttgctggcggagatgcccggggcaagaagctgcctaacaaccctgcctttggctttgtgagctccgagccaggggatccagagaaagacaccaaggagaagcctgggctctcgtcgagggactgcaaccacctgggtgccctggcctgccaggaccccccagggaggcagatgcagcgcagctacacggctcctgacaagacgggcatccgagtctactatagtcccccggtggcccggcgcctcggagtccctgtggttcatgacaaagagggcaagatcattatcgagcccggcttcctcttcaccacagccaagcccaaagagtcggccgaggctgatgggctggctgagagctcctatggtcggtggctctgcaacttctcacggcagcgcctggacggaggctcagcgggcagcccctcggcggccgggcctggcttcccagcggccctgcatgactttgagatgtcaggcaacatgagtgatgacatgaaggagatcaccaactgtgtgcgccaggccatgcgctccggctcactggagaggaaagtgaagagcacatccagccagacggtgggcctggccagtgtgggcacacagaccatccgcacggtcagcgtgggcctgcagaccgacccaccccgcagcagcctccatggcaaggcctggtcaccccgcagctcttcgctcgtgtctgtgcgcagcaagcagatctcctcctccctggacaaggtccattcgcgcatcgagcggccctgctgctcccccaagtatggctcaccaaagctccagaggcggtctgtgtccaagctggacagcagcaaggaccgcagcctgtggaacctgcaccagggcaagcagaacggctcggcctgggcccgctccaccaccacgcgggacagccctgtattgagaaacatcaacgatggactctccagcctcttcagtgtggtggagcactcagggagcacggagtctgtctggaaactaggcatgtctgagacgcgggccaagcccgagcctcccaagtacggcattgtgcaggaattcttccgtaatgtgtgtggccgggcaccgagccccacctcatcagcaggagaggagggcaccaagaagccagagcccctctccccagccagctaccatcagccagagggtgtggccaggatcctgaacaagaaggcagccaagttgggcagcagtgaggaggtcagactcaccatgctcccccaggtggggaaggatggtgtcctccgggacggagatggagccgtggtccttcccaatgaggacgctgtttgtgactgtagtacccagtctctcacctcctgcttcgcccgatcgtcccgctctgccatccgccactctccttccaagtgcaggctgcacccttcagagtccagctggggtggggaggagagggcactcccccccagcgagtga

SEQ ID NO: 7419 - DNA, 4478 bp, Homo sapiens
gttgcactttgcaaaggaggagtcagccctcatgtgcaagaagctcactaagcttgccaaggagaatgacagcatgaaggaggagctgctgaagtaccgctcgctctatggggacctggacagcgcgctgtcagccgaggagctggccgatgccccccactcgcgggagaccgagctgaaggtgcacctgaagctggtggaggaggaagccaacctgctgagccgccgcatcgtggagctggaggtggagaaccgaggcctgcgggctgagatggacgacatgaaggatcatggaggtggctgtgggggtcctgaggcacgcctggccttctccgcgctgggtggcggagagtgcggggagagcttggcagagctgcggcgacacctgcagtttgtcgaagaggaggccgagctgctgcggcgctcctctgccgagctcgaggaccagaacaagctgctgctgaacgagctggccaagttccgctcggagcacgagctggacgtggcgctgtcggaggacagttgttctgtgctcagcgaaccttcacaggaggagctggcggccgccaagctgcagatcggcgagctcagcggcaaggtcaagaagctgcagtacgagaaccgcgtgctcctctccaacctccagcgctgtgacctcgcctcctgccagagtacgcggcccatgctggagacggacgccgaggccggggactctgcccagtgtgtgcctgctcccctgggcgagacacacgagtcccatgcggtccgactctgcagagccagggaggccgaggtgctgcctgggctgagagagcaggccgccctggtcagtaaggccatcgatgtcctggtggctgatgccaatggcttcacggctggcctccggctgtgtctggacaacgagtgtgctgacttccggctgcatgaggcccccgacaacagcgagggccccagggacaccaagctcatccatgccatcctggtgcgcctgagcgtgctgcagcaggagctgaatgccttcacgcggaaggcagatgcagtcctcgggtgctctgtcaaggaacagcaggagtccttctcatcactgccccccttgggctcccaggggctctctaaggagattcttctggcaaaagaccttggctcagactttcagccacctgacttcagggacctgccggaatgggagcccaggatccgagaggctttccgcactggtgacttggactctaagcccgaccccagccggagcttcaggccttaccgagctgaagacaatgattcctatgcctctgagatcaaggagctgcagctggtgctggctgaggcccacgacagcctccggggcttgcaagagcagctctcccaggagcggcagctacgaaaggaggaggccgacaatttcaaccagaaaatggtccagctgaaggaggaccagcagagggcgctcctgaggcgggagtttgagctgcagagtctgagcctccagcggaggctggagcagaaattctggagccaggagaagaacatgctggtgcaggagtcccagcaattcaagcacaacttcctgctgctcttcatgaagctcaggtggttcctcaagcgctggcggcagggcaaggttttgcccagcgaaggggatgacttcctcgaggtgaacagcatgaaggagctgtacttgctgatggaggaagaggagataaacgctcagcattctgataacaaggcctgcacgggggacagctggacccagaacacgcccaatgagtacatcaagacactggccgacatgaaggtgacgctgaaggagctgtgctggctgctccgggatgaacgccgtggtctgacggagcttcagcaacagtttgccaaggccaaggctacctgggagacagagcgggcagagctcaagggccatacctcccagatggagctgaagacagggaagggggccggggagcgggcagggcccgactggaaggcagccctacagcgggagcgtgaggagcagcagcacctcctagctgagtcctacagcgctgtcatggagctgactcggcagctgcagatcagtgagcgcaactggagccaggaaaagctgcagctggtggagcggctgcagggtgagaagcagcaggtggagcagcaggtgaaggagctgcagaaccgcctaagccagctgcagaaggctgccgacccctgggtcctgaagcactcggagctggagaagcaggacaacagctggaaggagacacgcagtgagaagatccacgacaaggaggctgtttccgaagttgagcttggaggaaatggtttaaagagaaccaaatctgtttcttccatgtctgagtttgaaagtttgctcgactgttccccttaccttgctggcggagatgcccggggcaagaagctgcctaacaaccctgcctttggctttgtgagctccgagccaggggatccagagaaagacaccaaggagaagcctgggctctcgtcgagggactgcaaccacctgggtgccctggcctgccaggaccccccagggaggcagatgcagcgcagctacacggctcctgacaagacgggcatccgagtctactatagtcccccggtggcccggcgcctcggagtccctgtggttcatgacaaagagggcaagatcattatcgagcccggcttcctcttcaccacagccaagcccaaagagtcggccgaggctgatgggctggctgagagctcctatggtcggtggctctgcaacttctcacggcagcgcctggacggaggctcagcgggcagcccctcggcggccgggcctggcttcccagcggccctgcatgactttgagatgtcaggcaacatgagtgatgacatgaaggagatcaccaactgtgtgcgccaggccatgcgctccggctcactggagaggaaagtgaagagcacatccagccagacggtgggcctggccagtgtgggcacacagaccatccgcacggtcagcgtgggcctgcagaccgacccaccccgcagcagcctccatggcaaggcctggtcaccccgcagctcttcgctcgtgtctgtgcgcagcaagcagatctcctcctccctggacaaggtccattcgcgcatcgagcggccctgctgctcccccaagtatggctcaccaaagctccagaggcggtctgtgtccaagctggacagcagcaaggaccgcagcctgtggaacctgcaccagggcaagcagaacggctcggcctgggcccgctccaccaccacgcgggacagccctgtattgagaaacatcaacgatggactctccagcctcttcagtgtggtggagcactcagggagcacggagtctgtctggaaactaggcatgtctgagacgcgggccaagcccgagcctcccaagtacggcattgtgcaggaattcttccgtaatgtgtgtggccgggcaccgagccccacctcatcagcaggagaggagggcaccaagaagccagagcccctctccccagccagctaccatcagccagagggtgtggccaggatcctgaacaagaaggcagccaagttgggcagcagtgaggaggtcagactcaccatgctcccccaggtggggaaggatggtgtcctccgggacggagatggagccgtggtccttcccaatgaggacgctgtttgtgactgtagtacccagtctctcacctcctgcttcgcccgatcgtcccgctctgccatccgccactctccttccaagtgcaggctgcacccttcagagtccagctggggtggggaggagagggcactcccccccagcgagtgacagagcagccaagctccccgcctcaaccagcccagcccctggatagcagaagggaaccagcagagacgagacgaggctgaacaccagggtcatgccagtcccgccagccgcctcctccatgccccagtgactggtgtgggcagagcaggcagccagtggagctgtgggccagttccgctcttggatgctgctgctctcacccatgaggtcaggggggccctccaaggttatctccaggtgaggggattcacatcaggccacaagccaccagaggccttctgccacctcccagagcgacagccagggaggctgcgtactcagcctcggggagaaatccccgtgggacctgagccccaagacctacggaccactcagccttaccatcgtaccgtccaggattgtccttgccatctttgttgtctcagccagaccttggttttcagtaaagccccagtttctacttcctgcatgccactgtgcaaggccactcatcactgttcctgcagaagcctctggacgtggggctggatggggttgaaaatgttacatgtaaatattggtttggttcggtttttagcattttacttggtaactggttgttttcttttttggggtggggggattggtttgtaaaaattctctactcttttgg

SEQ ID NO: 7420 - DNA, 451 bp, Homo sapiens
ggggtgtagaaacaggcctgttaaggagaggccaccgggacttcagtgtctcctccatcccaggagcgcagtggccactatggggtctgggctgccccttgtcctcctcttgaccctccttggcagctcacatggaacagggccgggtatgactttgcaactgaagctgaaggagtcttttctgacaagttcctcctatgagtccagcttcctggaattgcttgaaaagctctgcctcctcctccatctcccttcagggaccagcgtcaccctccaccatgcaagatctcaacaccatgttgtctgcaacacatgacagccattgaagcctgtgtccttcttggcccgggcttttgggccggggatgcaggaggcaggccccgactctgtctttcagcaggcccccaccctcctgagtggcaataaataaaattcggtatgctgaattcaa

SEQ ID NO: 7421 - DNA, 1662 bp, Homo sapiens
aaccaggggcggtgcggcctggtccggggaggagaacatgcctgccgccggaccgcctttgctgctgctcggtacaccaggatctggaaaaacagcgctgctatttgctgcggccctagaggcggcgggggagggccaaggcccagtcctcttcctgacacgaaggcctcttcaaagcatgccccgcgggaccggaacgactctagacccaatgcgactccagaagatccgcttccagtacccaccctcaacccgagagcttttccggctcctgtgctctgcccatgaggccccggggccagccccctcccttctgctgctcgacggcctagaagagtacctagcggaagacccagagccccaggaagccgcctacctcattgccttacttctagacacagctgcccacttcagccaccggcttgggcctggccgggattgtgggctcatggtggccctccagacccaggaggaagcaggtagtggggacgtcctgcacctggcactgctccagcggtattttcctgcccagtgctggctgcagccagatgcaccaggtccaggagagcacggcctccgagcctgcctggagccaggcgggctgggccccagaacagagtggtgggtgactttccgatcagatggagaaatgatgatcgctccgtggcccacccaggctggtgaccccagctcaggcaagggttcaagctctggaggccagccctgagctttggtgggtgactacctctctgtgcttcagtttcccatggctggaatacttacctcagggacatatgcagatccaaagacctaaacaatgtaaagtgctttttctcttttaaaagtatagcattatcttgtatatattttacccaatcaatatgttgtttatagtttcattgctttaaactttataaaaagagcttcaggccaggcgtggtggctcacgcctgtaatcccagcactttgggaggctgaggcggtcagatcaccagaggtcaggagttggagaccagcctgcccaacatgatgaaaccctgtatcaactaaaagtacaaaaaaaattagctgggtgtggtggcaggtgcctgtagtctcagctactcaggaggcttaggcaggagaattgcttgaacccaggaagcggaggttgcagtgagccgagattgtgccactacactccagcctgggtgacaaagcgagactccatctcaaaaaaaaaaaaaaaaaaaagtttgagacttccttctttttgcactcaacgttgttactaagattcatctacatttttttagttcattcctttttccatattgcatataattccatgggtgactataccctgatttcttcatcagattgccttatttactgctgcgaacattcttgcacacatgccctggtacgtgtgtgtgtttttaggggccgagacaggtggatcacctgaggtcaggagttcgaggtcagcccggcctacatggtgaaaccccgtctctactaaaaatacaaaatttagccaggcatggtggcatgcacttgtactcccagctacttgggaggctgagacaggagaattgcttgaacccgggaggcagaggttgcagtgagctgagatcgagccactgcactccagcctgggtgatgaagacgagactctgtctc

SEQ ID NO: 7422 - DNA, 3830 bp, Homo sapiens
ggggcggtgagtaggtagtgcggatgcgggcgcagaactacgtttcccagcaggcatacagttggtggggcggggtgtgtgtgtgtgttgggaggcgggggtccctctcctttggcttggggctccggagttgccactgccgccggcgctggtaagcttttcaggatgtccagcaaagaatcctgtgggaaaaaagagacatctcagaggaaagacaccaccacctcatcacccaattttggtgaaaaagacaagaaagagagaaaaaccccagcaagttctactagttcatcttctataagatcagtttcatcagaaaagagaaaactgaaatcagatcatacagatgttctgtactataatataaaaagaagacaaggactgaaaagattgagtgtagaaattgacactctcagaaggagaccaaaaatcggttcttcatcccaaagacctattaaactcaaagaagcatcatattcaaatgataatcaaattattttgcagagtccttcttcaaatggaactaaaaaagacatacataaatgtgtagactttaaacctaaagatatcaaattgacaaatgctgggagcaagcttgaccatggaattaaaagccttagtagtcctaagattgccagtgatgtgaaacctaaagccgaaggccaggcaagtgaaaataaatggtctcatttacttgttcagagagagaagatgaaagaactcaagaaaggaagaaacagtaaatttagagacaattctgaaaaatgtgtcttagagaaatggaagagaaatcaattttctcaggattataactccaacaagataattaaggaacccttgggatctagaagacagaagatcagtttcaaaatccctataaaatcccgtgacaccctccagaaacttgtagaagaaaatgtcttcaacatagattctaataattcgaagactaagcaggaagaaagagaatacctggaaagctcccaggtttcattaaatgtgactaggcagaaaactgaacatttactttcagattttacatataagcggactgttcatgagtggaaacgaaaacatcattatgaccatcaagaaagtaatgattcacattctagggaaaacctaacccagagttttgaagcaccatgttgttccgtgtcatctgaaagtatccaggatgcagatcaagagatgcagatagtagaagagcttcatgctgcacgtgtgggaaaaagtgtggatttacctggagagttaatgagtatggaaattgacttagaagatgatgtacattcctcctctgcaaataatacttcagacagaaagcttctaattgttattgacacaaatattctgatgaatcatctcaaatttgttagaattttgaagacaacagaagtaccaggttttgacaaacttgtgttaataattccctgggtcgttatgcaagagctagatcgtatgaaggaaggaaaactactaaaacgtgcccagcacaaagctatacctgcagttcatttcatcaacgacagtctcaaaaatcaagatagaaagctatggggtcagtcaatacaacttgcatcccaaaaacattatggattgagtgatgagaacaatgatgatcgagtactaaaatgctgtctccagcaccaggaattattcccttgttcttttgttattctgtgcacggatgatagaaacttaagaaacaaaggcctaataagtggtgtgaagtcactcagtaaagaagaattgagtgcagagttattacacttatctctgaacacagatgtgtgtcatcagccttgtattcctaagcaacagttgaaagcagaaacaacacccttgaaagagagctataaggaggaatctacaaattctggactgtccattctgcttgagagcattgtatctgatcttgaaaaatctcttggaacaggtttatcttcaatattagaaacagaaatgaaaattgcttttggaaacctttggatggagatcctgtacctgaaaccaccatggactctactacatttactacagtgctttaaaaaacattggttggctgtatttggattagttatggaaaagaacttgcttttaactattgagagcctatacaaaaatctccgtaaagctaataaggcagtggattttacaacagtcaaattcttgcttcaggattctagaagtttgttacatgctttcagtacaaggtcaaattatgatggtattcttccacagacctttgctcaagtaaacaacctccttcagacatttgcagaggtcaagacaaaacttaagccaaattcttcagaaaacacagtgactaaaaagcaggaaggtacttcattgaagaattctcataatcaagaaatcactgttttctcgagttctcatcttccccaacccagcaggcatcaagaaatctggtctatcctagagagtgtttggattacaatatatcagaacagcacggatgtatttcaaagattgggctcaaattcagctctgactacttcaaatatagcatcatttgaagaagcatttatatgtcttcaaaagttaatggcagctgtgagggatattcttgaaggaattcaaaggattttggccccaaacagtaattatcaagatgttgagaccctctataacttcctaatcaagtatgaggtaaataaaaatgtcaaatttactgcccaggaaatttatgattgtgtttctcagactgagtatagggaaaagttaaccattggatgccgccagctggttgagatggaatataccatgcagcagtgcaatgcatctgtttatatggaggccaaaaacaggggatggtgtgaagacatgctcaactataggatataagtactgatttgtaactttaaaggaattgcatttgtccttaagaataacagagtagttttcaatctggtcactcttttgggccaaacccaagagaattttaagaaatgtttcataggtataaaaaggtgatcgcctattactgacagtctcattgtagctctaaaaagcctaatgtatccactgtggaataaactccatagactcaactcttctggagttcacaatgcctccctacctctattcttgatagtgagccagtatctctaaggaaaggagagccgtatttttagtcatcctagggcaggagccactgtggcatctgaggaagacccagggtacagtattagcatttctttcaaccctaagtatgggcatgtgaccagagacactgccaaaccctaagaaatcattagggcatgatcatgctcaccatatttcacaaatgaaatcttaatgtgggctgttttttatgatcaaactgtcatccatgttgacctgatgaaaataacaccctccttcacctccctcagggtaatgaaagtagaaatttgactgaagctcctacttccttatacagcctttccttctgtgggcttgtcacttttcagtacatttctagtggggaagagcagggcgacccctctgctgggtttctccttaaatgtgaagcaaaataaatttatataatggaatttggtggcagtgactgatgtttgtctctagctaaaaccaactgtttagttgactttttagttataggataagttggaagtccttgtttactggaatatattatgcttttgttaacacattagattaaatagaatttggtattctattataaatgtttattttttaaagcaataaataacttatttttggtaagatttggctttttacttccaaattgtttctgatatgtacataaggtatgattataaaagtgactgtctgcaataaaa

SEQ ID NO: 7423 - DNA, 3001 bp, Homo sapiens
aggatacactgcgcagtctgggggcggggccggagttcaagcctcggaggaagtaaatgcaaatctaagcgagcgctgtggggcgcttttcaggatgtccagcaaagaatcctgtgggaaaaaagagacatctcagaggaaagacaccaccacctcatcacccaattttggtgaaaaagacaagaaagagagaaaaaccccagcaagttctactagttcatcttctataagatcagtttcatcagaaaagagaaaactgaaatcagatcatacagatgttctgtactataatataaaaagaagacaaggactgaaaagattgagtgtagaaattgacactctcagaaggagaccaaaaatcggttcttcatcccaaagacctattaaactcaaagaagcatcatattcaaatgataatcaaattattttgcagagtccttcttcaaatggaactaaaaaagacatacataaatgtgtagactttaaacctaaagatatcaaattgacaaatgctgggagcaagcttgaccatggaattaaaagccttagtagtcctaagattgccagtgatgtgaaacctaaagccgaaggccaggcaagtgaaaataaatggtctcatttacttgttcagagagagaagatgaaagaactcaagaaaggaagaaacagtaaatttagagacaattctgaaaaatgtgtcttagagaaatggaagagaaatcaattttctcaggattataactccaacaagataattaaggaacccttgggatctagaagacagaagatcagtttcaaaatccctataaaatcccgtgacaccctccagaaacttgtagaagaaaatgtcttcaacatagattctaataattcgaagactaagcaggaagaaagagaatacctggaaagctcccaggtttcattaaatgtgactaggcagaaaactgaacatttactttcagattttacatataagcggactgttcatgagtggaaacgaaaacatcattatgaccatcaagaaagtaatgattcacattctagggaaaacctaacccagagttttgaagcaccatgttgttccgtgtcatctgaaagtatccaggatgcagatcaagagatgcagatagtagaagagcttcatgctgcacgtgtgggaaaaagtgtggatttacctggagagttaatgagtatggaaattgacttagaagatgatgtacattcctcctctgcaaataatacttcagacagaaagcttctaattgttattgacacaaatattctgatgaatcatctcaaatttgttagaattttgaagacaacagaagtaccaggttttgacaaacttgtgttaataattccctgggtcgttatgcaagagctagatcgtatgaaggaaggaaaactactaaaacgtgcccagcacaaagctatacctgcagttcatttcatcaacgacagtctcaaaaatcaagatagaaagctatggggtcagtcaatacaacttgcatcccaaaaacattatggattgagtgatgagaacaatgatgatcgagtactaaaatgctgtctccagcaccaggaattattcccttgttcttttgttattctgtgcacggatgatagaaacttaagaaacaaaggcctaataagtggtgtgaagtcactcagtaaagaagaattgagtgcagagttattacacttatctctgaacacagatgtgtgtcatcagccttgtattcctaagcaacagttgaaagcagaaacaacacccttgaaagagagctataaggaggaatctacaaattctggactgtccattctgcttgagagcattgtatctgatcttgaaaaatctcttggaacaggtttatcttcaatattagaaacagaaatgaaaattgcttttggaaacctttggatggagatcctgtacctgaaaccaccatggactctactacatttactacagtgctttaaaaaacattggttggctgtatttggattagttatggaaaagaacttgcttttaactattgagagcctatacaaaaatctccgtaaagctaataaggcagtggattttacaacagtcaaattcttgcttcaggattctagaagtttgttacatgctttcagtacaaggtcaaattatgatggtattcttccacagacctttgctcaagtaaacaacctccttcagacatttgcagaggtcaagacaaaacttaagccaaattcttcagaaaacacagtgactaaaaagcaggaaggtacttcattgaagaattctcataatcaagaaatcactgttttctcgagttctcatcttccccaacccagcaggcatcaagaaatctggtctatcctagagagtgtttggattacaatatatcagaacagcacggatgtatttcaaagattgggctcaaattcagctctgactacttcaaatatagcatcatttgaagaagcatttatatgtcttcaaaagttaatggcagctgtgagggatattcttgaaggaattcaaaggattttggccccaaacagtaattatcaagatgttgagaccctctataacttcctaatcaagtatgaggtaaataaaaatgtcaaatttactgcccaggaaatttatgattgtgtttctcagactgagtatagggaaaagttaaccattggatgccgccagctggttgagatggaatataccatgcagcagtgcaatgcatctgtttatatggaggccaaaaacaggggatggtgtgaagacatgctcaactataggatataagtactgatttgtaactttaaaggaattgcatttgtccttaagaataacagagtagttttcaatctggtcactcttttgggccaaacccaagagaattttaagaaatgtttcataggtataaaaaggtgatcgcctattactgacagtctcattgtagctctaaaaagcctaatgtatccactgtggaataaactccatagactc

SEQ ID NO: 7424 - DNA, 633 bp, Homo sapiens
gggtgtggttctggcccggcttgcctccggggctgccccttgcccggtgttggggtctggtcggttcgtgcggagcccgcgggcccgcggcggtttactagcagctgacgagcttgcctgtccatccagctgacttggaattaggcttttcaggatgtccagcaaagaatcctgtgggaaaaaagagacatctcagaggaaagacaccaccacctcatcacccaattttggtgaaaaagacaagaaagagagaaaaaccccagcaagttctactagttcatcttctataagatcagtttcatcagaaaagagaaaactgaaatcagatcatacagatgttctgtactataatataaaaagaagacaaggactgaaaagattgagtgtagaaattgacactctcagaaggagaccaaaaatcggttcttcatcccaaagacctattaaactcaaagaagcatcatattcaaatgataatcaaattattttgcagagtccttcttcaaatggaactaaaaaagacatacataaatgtgtagactttaaacctaaagatatcaaattgacaaatgctgggagcaagcttgaccatggaattaaaagccttagtagtcctaagattgccagtgatgt

SEQ ID NO: 7425 - DNA, 2491 bp, Homo sapiens
agaccgccgctgctgtctgcggggtctggtgccggggcctgagtctctgctggctaagccgacgcctcagccgcctcagtcgcctcaatctcgccttccgccctcgctctccctccgcgccaccggaccccgtagccccgcgcgcccccagacctttaagccagatgatgaacttcctgcggcgccggctgtcggacagcagcttattcagctcgctgtcccaagcggtaaagcagacggccgcctcggctggcctggtggacgcgcccggtgccgcgccggcagccgccaggaaggccaaggtgctgctggtggtcgacgagccgcacgccgactgggccaagtgctttcggggcaaaaaagtccttggagattatgatatcaaggtggaacaggcagaattttcagagctcaacctggtggcccatgcagatggcacctatgctgtggatatgcaggttctccggaatggcacaaaggttgtccggtccttccggccagacttcgtgctcatccggcagcatgcatttggcatggcggagaatgaggacttccgccacctgatcattggtatgcagtatgcaggcctccccagcatcaactcactggaatccatatacaacttctgtgacaagccatgggtgtttgcccagctggtcgctatctataagacactgggaggagaaaagttccctctcattgaacagacatactaccccaaccacaaagagatgctgacactgcccacgttccctgtggtggtgaagattggccacgctcactcaggcatgggcaaggtcaaagtggaaaaccactacgacttccaggacattgccagcgtggtggctctcacccagacctatgccactgcagagcctttcattgactccaagtatgacatccgggtccagaagattggcaacaactacaaggcttacatgaggacatcgatctcagggaactggaagacgaacactggctctgcgatgctggagcagattgccatgtcagacaggtacaaactgtgggtggacacctgctctgagatgtttggcggcctggacatctgtgctgtcaaagctgtacatggcaaagatgggaaagactacatttttgaggtcatggactgtagcatgccactgattggggaacatcaggtggaggacaggcaactcatcaccgaactagtcatcagcaagatgaaccagctgctgtccaggactcctgccctgtctcctcagagacccctaacaacccagcagccacagagcggaacacttaaggatccggactcaagcaagaccccacctcagcggccaccccctcaagggggccctgggcaaccccaaggaatgcagcccccaggcaaggtgctgcctccacgccggctcccccctggaccatcactgccaccttcctcctcttcctcctcttcttcctcctcctcggctcctcagcggccgggcggccccaccacccacggagatgcaccctccagcagcagctccctggcagaggcccagccacccctggctgctccaccacagaagccccagcctcacccacagctcaacaagtcgcagtccctgacaaatgccttcagcttctctgagtcctccttcttccggtcttcagccaatgaggatgaagccaaagcagagaccatccggagcttgaggaagtcctttgccagcctcttttcagattagctcttcagacacacggggcacccagcccaaccgggaaaggcatctaagacattcaccaacaacagtcagccagcttggtggttatgtcccatgaccttgacgtgtgtggtcccttcctctgctctgttgtactaagtgatgttgtgcagcccagaaaggaccatttgacagtctcagggcaggtgcctacccagcaaggggtacctggcatcagagaggaaagagctgcttccctgtagtcatgagagcttccttctgaagtcatcgttcgctgtgagtttagtggccttattgtgacagtgccatcatgtcttattcttccctgtgaaaccaggattaatcgtggactcctggcagcttaacctagctcagttgcagtgctaagcatgccccgcccccattcagtgatacctgtttgggaagtatatacttccccaaaagtactcttggccctaagttttaggaactttccccgacctggatcccttgtcatacctgtgttactgtttaaagcacacccacccaacttacaagatcttaggctgctgtggtggtgaagcaccttgagtctgctgatattcgggagaacaaggatctgcagtttccccttttctcccctctgaagagtggttcttatgtgcaatctgcagtaaccttgaactccagagctgcactatagaggagaatgcatgccactatgacagcagtatgccaagctttgtgttcatctcctaataaacgttaagacctttggtgtaataaaagcagcagcattcaccaac

SEQ ID NO: 7426 - DNA, 877 bp, Homo sapiens
atggcggggaagctgaaacctctgaatgtggaggcgccagaagctactgaggaggctgaagggcaagccaagtctttgaagactgaagacttgctggcaatggtgataaagctgcagaaagagggaagcctggagccacagatagaggacctgattagccggattaatgatcttcagcaagcaaagaagaaatccagtgaggaactgagagagacccacagtctctgggaggccctgcatagggaattagactccttgaatggagagaaagtgcacctagaggaggtcttgggcaaaaagcaagaggcactgaggatcctccagatgcactgccaagagaaggaaagcgaggctcagaggttggatgtcagaggacagctggaggatctgatgggccagcacaaggacctctgggaattccacatgctggagcagcgactggcccgggagatccgtgccctggagagaagcaaggagcagctgctctcggagaggaggctggtgcgcgccaagctgcgggaggtggagcggcggctgcactcgccgcctgaggtcgagggcgccatggcggtgaatgacgggctgaaggcggagctggagatattcggggagcaggtccggagcgcccccgaggtcggggccggcgagggagaggccggacctgagctcccccgcgctcgcgacgaggaggatcccgagccgccggtggctgcccctgacgccctctaggccagcaggacccgcccgttcccgaccttccctcgagacccgccaagaaataaaggcgatgatttccgaccatgctcgcgttctccgcggagtctgtgctacaccgtggagcggggcggggcgtgctgggatctcgaggcggggcctc

SEQ ID NO: 7427 - DNA, 448 bp, Homo sapiens
ggccgctgggggcgccagagcaggaccggagcgcgggccaagctggagatggatgatgctgaccctgaggaaagaaactatgacaacatgctgaaaatgctgtcagatctgaataaggacttggaaaagctattagaagagatggagaaaatctcagtgcaggcgacctggatggcctatgacatggtggtgatgcgcaccaaccctacgctggccgagtccatgcgtcggctggaggatgccttcgtcaactgcaaggaggagatggagaagaactggcaagagctgctgcatgagaccaagcaaaggctgtaggccccactggcccaccacagctgccatgccaccctctgcccgtatgaagaggtcactgggggatggagctggcacccacatgaatagctgtatgcactgtacttgtttcttaataaacttatttttaagcaca

SEQ ID NO: 7428 - DNA, 2486 bp, Homo sapiens
aacgagcgcgcgccgcccccgccgcgccccgcgccgcccttgctagccgagcctcccgccccctgcattgctgatgctgctgctggcggacatggacgtggtgaatcagctggtggctgggggtcagttccgggtggtcaaggagcccctcggctttgtgaaggtgctgcaatgggtcttcgccatcttcgcctttgccacatgcggcagctacagtggggagctccagctgagcgtggattgtgccaacaagaccgagagtgacctcagcatcgaggtcgagttcgagtaccccttcaggctgcaccaagtgtactttgatgcacccacctgccgagggggcaccaccaaggtcttcttagttggggactactcctcgtcagccgaattctttgtcaccgtggccgtgtttgccttcctctactccatgggggctctggccacctacatcttcctgcagaacaagtaccgagagaataacaaagggcccatgctggactttctggccacggctgtgttcgccttcatgtggctagttagctcatcggcatgggccaaggggctgtcagatgtgaagatggccacagacccagagaacattatcaaggagatgcctgtctgccgccagacagggaacacatgcaaggagctgagagaccctgtgacctcgggactcaacacctcggtggtgttcggcttcctgaacctggtgctctgggtcggcaacctgtggttcgtgtttaaggagacaggctgggccgccccgttcctgcgcgcgcctcccggcgcccccgagaaacaaccggcacccggggacgcctacggcgatgcaggctacgggcagggccccggcgggtacgggccccaggattcctacgggcctcagggcggctaccagcctgactatggtcaaccagccggcagcggtggcagtggctacgggcctcagggcgactatgggcagcaaggctacggcccgcagggtgcacccacctccttctccaatcagatgtagtctggtcagtgaagcccaggaggacctggggggggcaagagctcaggagaaggcctgccccccttcccacccctataccctaggtctccacccctcaagccaggagaccctgtctttgctgtttatatatatatatattatatataaatatctatttatctgtctgagccctgccctcactccactcccctcatccactaggtgcccagtcttgagtgggccccctctcttaccccgtccctttccctgcatcccttggcccctctctgtttaccctccctgtcccctgaggttaaggggatctaaaaggaggacagggagggaacagacctcggctgtgtggggagggtgggcgtgacttcagactctctcctctctctccctccactcctcccaactctggccttggttcctccagcaatgcctgcctgaacaaaggccgttagggaaatccaactccagggttaaagaaaggcagagattgggggggcttggggtagagaggacagtttaggacccaaggtggtcttggagaggaggtgtggagtggaggggtcagcaggggggttgggttccagacagagtggatctggagtctgaaggagaggagtgcgctagagcattctggggtggggcttggaagggcgctgagggcagggttctagaaggggcgaggctttaagcgaggcagaatggtgggctccagagtaggtgggtcttggattggtaccagagcctatggaaagggtgtggcttggaacatttgggagactgagcttgattctaaaggggacagatcttgagcaaggcaagaagtgggattcaggaatgggccaagccagggttccagacagggtggggcttagaatggggcttccatggtggtttcagaaagggcagcccctccccatggtgcagtgaagaaaatgttttacaatggctgggtttgggcagtggagaggggacttggataggagcttccagatgggttttgttaggggtgggggagaatggctctggctacgacttgggacggaagtggcctgagaagagtcgagtgatatggcttgtagggtgaggcgtgggatccagagagaagcaccccaccacacacacccttccccactcccgtgatgaaacagctaggttaataggaggacagaaccaacgggtctgtgggactggcccacccctcttcccccttcccctgcgccctccctccctccacacctccacccgtcctggggtggttggaggcctggtctggagcccctatcctgcaccctctgctatgtctgtgatgtcagtagtgcctgtgatcgtgtgttgccattttgtctggctgtggcccctccttctcccctccagacccctaccctttcccaaacccttcggtattgttcaaagaacccccctccccaaggaagaacaaatatgattctcctctcccaaataaactccttaaccacct

SEQ ID NO: 7429 - DNA, 1536 bp, Homo sapiens
actgcgcggctccccgcgccgcagctgggcaccagcagcaccacggaccgcccctgtgctcgcccgacggcgccccgcggcgctttaagagacggcctggcagcccagccccagccgcccagaccggcgagaccagcctgcgggagcagccccatggcggagcagctggccctggtgattgggggcaccatcggggggctgctgctgctgctgttgatcggggcaagctgctgtctgtggagaaggttctgtgccaccctcacctatgaggagctgcctgggacaccagccatggccaccacagctgcctccagtgggcagcgggacaggccctgccagccgcatgctaggacccaactgagcaggccaccagctgtgccattcgtggtgcccccaacccttcaaggccgagattgggtgcccctgcacagtggagagtgggccgatgccccatgggacccctgcccggcatcagagctgctgcctcacacctccagcggcggccttggagatgcatgtatggtgggggccatcaacccagagctgtacaagttcccggaggacaaaagtgagaccgacttccccgacggctgcctggggcggctgtggttctcggtggaatatgagcaggaggctgagcggctgctggtgggcttgatcaaggcacagcacctgcaagccccctcggagacctgcagccccctggtgaagctctacctgctgcccgatgagcggcgcttcctccaatccaagaccaaacgcaaaacctccaacccgcagtttgacgagcacttcatctttcaggtgtccagcaagaccatcacccagagggtgctgaagttctccgtctaccacgtggacaggcagaggaagcaccagctcctgggccaggtgctcttccccttgaagaatgagaccctagtgggggactgccggcgtgtcatctggagagacctggaggccgagagcctggagcccccctcggagtttggcgacctccagttctgcctcagctacaacgactacctgagccgcctgacggtggttgtgctgcgtgccaagggcctccggctccaggaggacagaggcattgtcagtgtgtttgtcaaagtgtctctgatgaaccacaacaagtttgtcaagtgcaagaagacttcagctgtgctgggctccatcaaccctgtgtacaatgagaccttcagcttcaaggccgatgccaccgagctggataccgctagcctcagcctgactgtggtgcagaacatggaaggggacaagcaggctactacagtggaactgtttctgtttcatctgacatccggatagatgccagccacccccacattccaagattccagttctttgatgaaagtctctattccacccatcaagtctgtgtctgataacaccaatatctgggtcattagtggctccgttttgttgtgtctgttttcccctccttcctgttttgtggtgtgtttgatcacttattgttgaatgctaaccattataataaattttagtggctccaggaaa

SEQ ID NO: 7430 - DNA, 2292 bp, Homo sapiens
ggaacctggatctaaggagggaagaggcgttgcccctgctggcatagtcaggtaccagcccagccaggtattgaacgggctgagcttttcatgatggttcctgctgacctggaaacatcttaaatggaagggcgtgagcgcttggtccatgcagtgaagctcttccaacctgggtcaacgaaaacggagaagaaatggcccaagaaatagatctgagtgctctcaaggagttagaacgcgaggccattctccaggtcctgtaccgagaccaggcggttcaaaacacagaggaggagaggacacggaaactgaaaacacacctgcagcatctccggtggaaaggagcgaagaacacggactgggagcacaaagagaagtgctgtgcgcgctgccagcaggtgctggggttcctgctgcaccggggcgccgtgtgccggggctgcagccaccgcgtgtgtgcccagtgccgagtgttcctgagggggacccatgcctggaagtgcacggtgtgcttcgaggacaggaatgtcaaaataaaaactggagaatggttctatgaggaacgagccaagaaatttccaactggaggcaaacatgagacagttggagggcagctcttgcaatcttatcagaagctgagcaaaatttctgtggttcctcctactccacctcctgtcagcgagagccagtgcagccgcagtcctggcaggttacaggaatttggtcagtttagaggatttaataagtccgtggaaaatttgtttctgtctcttgctacccacgtgaaaaagctctccaaatcccagaatgatatgacttctgagaagcatcttctcgccacgggccccaggcagtgtgtgggacagacagagagacggagccagtctgacactgcggtcaacgtcaccaccaggaaggtcagtgcaccagatattctgaaacctctcaatcaagaggatcccaaatgctctactaaccctattttgaagcaacagaatctcccatccagtccggcacccagtaccatattctctggaggttttagacacggaagtttaattagcattgacagcacctgtacagagatgggcaattttgacaatgctaatgtcactggagaaatagaatttgccattcattattgcttcaaaacccattctttagaaatatgcatcaaggcctgtaagaaccttgcctatggagaagaaaagaagaaaaagtgcaatccgtatgtgaagacctacctgttgcccgacagatcctcccagggaaagcgcaagactggagtccaaaggaacaccgtggacccgacctttcaggagaccttgaagtatcaggtggcccctgcccagctggtgacccggcagctgcaggtctcggtgtggcatctgggcacgctggcccggagagtgtttcttggagaagtgatcattcctctggccacgtgggactttgaagacagcacaacacagtccttccgctggcatccgctccgggccaaggcggagaaatacgaagacagcgttcctcagagtaatggagagctcacagtccgggctaagctggttctcccttcacggcccagaaaactccaagaggctcaagaagggacagatcagccatcacttcatggtcaactttgtttggtagtgctaggagccaagaatttacctgtgcggccagatggcaccttgaactcatttgttaagggctgtctcactctgccagaccaacaaaaactgagactgaagtcgccagtcctgaggaagcaggcttgcccccagtggaaacactcatttgtcttcagtggcgtaaccccagctcagctgaggcagtcaagcttggagttaactgtctgggatcaggccctctttggaatgaacgaccgcttgcttggaggaaccagacttggttcaaagggagacacagctgttggcggggatgcatgctcactatcgaagctccagtggcagaaagtcctttccagccccaatctatggacagacatgactcttgtcctgcactgacatgaaggcctcaaggttccaggttgcagcaggcgtgaggcactgtgcgtctgcagaggggctacgaaccaggtgcagggtcccagctggagacccctttgaccttgagcagtctccatctgcggccctgtcccatggcttaaccgcctattggtatctgtgtatatttacgttaaacacaattatgttacctaagcctctggtgggttatctcctctttgagatgtagaaaatggccagattttaataaacgttgttacccatg

SEQ ID NO: 7431 - DNA, 2277 bp, Homo sapiens
aagaagaattgacttccttctctgcagagccggctctggtctcttctcttgaagcagatgcgaaggctccccgaatgagaaagaatactcggaatcagcggtgaattgcagtgatctttcagagaaagcgcctgttcaactttgtcctctctcagagactcagagccttggggcactgagggatgccagttctgcctgttcatctggaacctggatctaaggagggaagaggcgttgcccctgctggcatagtcaggtattgaacgggctgagcttttcatgatggttcctgctgacctggaaacatcttaaatggaagggcgtgagcgcttggtccatgcagtgaagctcttccaacctgggtcaacgaaaacggagaagaaatggcccaagaaatagatctgagtgctctcaaggagttagaacgcgaggccattctccaggtcctgtaccgagaccaggcggttcaaaacacagaggaggagaggacacggaaactgaaaacacacctgcagcatctccggtggaaaggagcgaagaacacggactgggagcacaaagagaagtgctgtgcgcgctgccagcaggtgctggggttcctgctgcaccggggcgccgtgtgccggggctgcagccaccgcgtgtgtgcccagtgccgagtgttcctgagggggacccatgcctggaagtgcacggtgtgcttcgaggacaggaatgtcaaaataaaaactggagaatggttctatgaggaacgagccaagaaatttccaactggaggcaaacatgagacagttggagggcagctcttgcaatcttatcagaagctgagcaaaatttctgtggttcctcctactccacctcctgtcagcgagagccagtgcagccgcagtcctggcaggaaggtcagtgcaccagatattctgaaacctctcaatcaagaggatcccaaatgctctactaaccctattttgaagcaacagaatctcccatccagtccggcacccagtaccatattctctggaggttttagacacggaagtttaattagcattgacagcacctgtacagagatgggcaattttgacaatgctaatgtcactggagaaatagaatttgccattcattattgcttcaaaacccattctttagaaatatgcatcaaggcctgtaagaaccttgcctatggagaagaaaagaagaaaaagtgcaatccgtatgtgaagacctacctgttgcccgacagatcctcccagggaaagcgcaagactggagtccaaaggaacaccgtggacccgacctttcaggagaccttgaagtatcaggtggcccctgcccagctggtgacccggcagctgcaggtctcggtgtggcatctgggcacgctggcccggagagtgtttcttggagaagtgatcattcctctggccacgtgggactttgaagacagcacaacacagtccttccgctggcatccgctccgggccaaggcggagaaatacgaagacagcgttcctcagagtaatggagagctcacagtccgggctaagctggttctcccttcacggcccagaaaactccaagaggctcaagaagggacagatcagccatcacttcatggtcaactttgtttggtagtgctaggagccaagaatttacctgtgcggccagatggcaccttgaactcatttgttaagggctgtctcactctgccagaccaacaaaaactgagactgaagtcgccagtcctgaggaagcaggcttgcccccagtggaaacactcatttgtcttcagtggcgtaaccccagctcagctgaggcagtcaagcttggagttaactgtctgggatcaggccctctttggaatgaacgaccgcttgcttggaggaaccagacttggttcaaagggagacacagctgttggcggggatgcatgctcactatcgaagctccagtggcagaaagtcctttccagccccaatctatggacagacatgactcttgtcctgcactgacatgaaggcctcaaggttccaggttgcagcaggcgtgaggcactgtgcgtctgcagaggggctacgaaccaggtgcagggtcccagctggagacccctttgaccttgagcagtctccatctgcggccctgtcccatggcttaaccgcctattggtatctgtgtatatttacgttaaacacaattatgttacctaagcctctggtgggttatctcctctttgagatgtagaaaatggccagattttaataaacgttgttacccatg

SEQ ID NO: 7432 - DNA, 1758 bp, Homo sapiens
aaacaaggctggctgcagctggcctccgccgctcatctgcagggcgtgagcgcttggtccatgcagtgaagctcttccaacctgggtcaacgaaaacggagaagaaatggcccaagaaatagatctgagtgctctcaaggagttagaacgcgaggccattctccaggtcctgtaccgagaccaggcggttcaaaacacagaggaggagaggacacgggctgcaggaaactgaaaacacacctgcagcatctccggtggaaaggagcgaagaacacggactgggagcacaaagagaagtgctgtgcgcgctgccagcaggtgctggggttcctgctgcaccggggcgccgtgtgccggggctgcagccaccgcgtgtgtgcccagtgccgagtgttcctgagggggacccatgcctggaagtgcacggtgtgcttcgaggacaggaatgtcaaaataaaaactggagaatggttctatgaggaacgagccaagaaatttccaactggagggaagtttaattagcattgacagcacctgtacagagatgggcaattttgacaatgctaatgtcactggagaaatagaatttgccattcattattgcttcaaaacccattctttagaaatatgcatcaaggcctgtaagaaccttgcctatggagaagaaaagaagaaaaagtgcaatccgtatgtgaagacctacctgttgcccgacagatcctcccagggaaagcgcaagactggagtccaaaggaacaccgtggacccgacctttcaggagaccttgaagtatcaggtggcccctgcccagctggtgacccggcagctgcaggtctcggtgtggcatctgggcacgctggcccggagagtgtttcttggagaagtgatcattcctctggccacgtgggactttgaagacagcacaacacagtccttccgctggcatccgctccgggccaaggcggagaaatacgaagacagcgttcctcagagtaatggagagctcacagtccgggctaagctggttctcccttcacggcccagaaaactccaagaggctcaagaagggacagatcagccatcacttcatggtcaactttgtttggtagtgctaggagccaagaatttacctgtgcggccagatggcaccttgaactcatttgttaagggctgtctcactctgccagaccaacaaaaactgagactgaagtcgccagtcctgaggaagcaggcttgcccccagtggaaacactcatttgtcttcagtggcgtaaccccagctcagctgaggcagtcaagcttggagttaactgtctgggatcaggccctctttggaatgaacgaccgcttgcttggaggaaccagacttggttcaaagggagacacagctgttggcggggatgcatgctcactatcgaagctccagtggcagaaagtcctttccagccccaatctatggacagacatgactcttgtcctgcactgacatgaaggcctcaaggttccaggttgcagcaggcgtgaggcactgtgcgtctgcagaggggctacgaaccaggtgcagggtcccagctggagacccctttgaccttgagcagtctccatctgcggccctgtcccatggcttaaccgcctattggtatctgtgtatatttacgttaaacacaattatgttacctaagcctctggtgggttatctcctctttgagatgtagaaaatggccagattttaataaacgttgttacccatgtcctcca

SEQ ID NO: 7433 - DNA, 2256 bp, Homo sapiens
ctcttctcttgaagcagatgcgaaggctccccgaatgagaaagaatactcggaatcagcggtgaattgcagtgatctttcagagaaagcgcctgttcaactttgtcctctctcagagactcagagccttggggcactgagggatgccagttctgcctgttcatctggaacctggatctaaggagggaagaggcgttgcccctgctggcatagtcaggtaccagcccagccaggtattgaacgggctgagcttttcatgatggttcctgctgacctggaaacatcttaaatggaagggcgtgagcgcttggtccatgcagtgaagctcttccaacctgggtcaacgaaaacggagaagaaatggcccaagaaatagatctgagtgctctcaaggagttagaacgcgaggccattctccaggtcctgtaccgagaccaggcggttcaaaacacagaggaggagaggacacggaaactgaaaacacacctgcagcatctccggtggaaaggagcgaagaacacggactgggagcacaaagagaagtgctgtgcgcgctgccagcaggtgctggggttcctgctgcaccggggcgccgtgtgccggggctgcagccaccgcgtgtgtgcccagtgccgagtgttcctgagggggacccatgcctggaagtgcacggtgtgcttcgaggacaggaatgtcaaaataaaaactggagaatggttctatgaggaacgagccaagaaatttccaactggaggcaaacatgagacagttggagggcagctcttgcaatcttatcagaagctgagcaaaatttctgtggttcctcctactccacctcctgtcagcgagagccagtgcagccgcagtcctggcaggttacaggaatttggtcagtttagaggatttaataagtccgtggaaaatttgtttctgtctcttgctacccacgtgaaaaagctctccaaatcccagaatgatatgacttctgagaagcatcttctcgccacgggccccaggcagtgtgtgggacagacagagagacggagccagtctgacactgcggtcaacgtcaccaccaggaaggtcagtgcaccagatattctgaaacctctcaatcaagaggatcccaaatgctctactaaccctattttgaagcaacagaatctcccatccagtccggcacccagtaccatattctctggaggttttagacacggaagtttaattagcattgacagcacctgtacagagatgggcaattttgacaatgctaatgtcactggagaaatagaatttgccattcattattgcttcaaaacccattctttagaaatatgcatcaaggcctgtaagaaccttgcctatggagaagaaaagaagaaaaagtgcaatccgtatgtgaagacctacctgttgcccgacagatcctcccagggaaagcgcaagactggagtccaaaggaacaccgtggacccgacctttcaggagaccttgaagtatcaggtggcccctgcccagctggtgacccggcagctgcaggtctcggtgtggcatctgggcacgctggcccggagagtgtttcttggagaagtgatcattcctctggccacgtgggactttgaagacagcacaacacagtccttccgctggcatccgctccgggccaaggcggagaaatacgaagacagcgttcctcagagtaatggagagctcacagtccgggctaagctggttctcccttcacggcccagaaaactccaagaggctcaagaagggacagatcagccatcacttcatggtcaactttgtttggtagtgctaggagccaagaatttacctgtgcggccagatggcaccttgaactcatttgttaagggctgtctcactctgccagaccaacaaaaactgagactgaagtcgccagtcctgaggaagcaggcttgcccccagtggagacacagctgttggcggggatgcatgctcactatcgaagctccagtggcagaaagtcctttccagccccaatctatggacagacatgactcttgtcctgcactgacatgaaggcctcaaggttccaggttgcagcaggcgtgaggcactgtgcgtctgcagaggggctacgaaccaggtgcagggtcccagctggagacccctttgaccttgagcagtctccatctgcggccctgtcccatggcttaaccgcctattggtatctgtgtatatttacgttaaacacaattatgttacctaagcc

SEQ ID NO: 7434 - DNA, 4722 bp, Homo sapiens
cacaagggtcaagtagtccagcattctacagtttgtgtgtttgagagaaaaataagcccataaaaacattctaaccttcagattaagtgttttctgcattctctcccagcggatctgattcctgttctgaagaattgaagttgagcatcgttagttaaattcagctgctgcctgactgtataccacagcaaaggctttggaaacatttttcagttaaaacaataatgactttcttggagtgtaatcccagtggaggctgttctacgtatagcctgaaagaatacttaactaccatacgcaattctgcagagaccttgtaaaaatcacactttacaccaaacaactgagtgattctgaattggttgggggaatcttagttgtagatatcaattcaccttcttgaagattcaaccactgctactcagagctgctgctgaaataccatgtctaagaactcagagttcatcaatctgtcatttttattagatcatgagaaggaaatgatcctgggcgtcctaaagagagatgaatatttgaaaaaagtggaggacaagagaataaggaagctgaaaaatgaactcttagaagcaaaacgtagaagtgggaaaactcaacaagaggccagcagagtttgtgttcactgtcacagaaacctgggcctaatctttgaccggggagacccttgtcaggcttgctcactgagggtatgcagggagtgtcgagttgcaggccccaatggcagctggaagtgcactgtctgtgacaaaatcgcgcagctaaggattataactggtgagtggttttttgaagaaaaggcaaaacgtttcaagcaagtcaatgttctcggcactgatgttgtccgacagtccattttaagaagaagtccaggagctgaagaagtacagagccaagagcaaacccgccaggatgcagaaaagtcagacacttcacctgttgctgggaagaaggccagccatgatgggcccaagagaaagggatttcttcttagcaagttcagatcggcaaccagaggagaaatcataactcccaaaactgacactgggcggagctatagcttggacttagacggtcaacattttcggagtttaaaatcacctcctggttcagacaggggaagcactggctcatcagatctcaatgaccaggaacctggtcctaggaccccgaagagcagtcggagcaatggtgtgaccccaggcactcagagttcaccagccccaagcacacgaactgtgacctcagtcatcagtagagagtatggttttgaaaattccatggatttggctgctattgaaggtacctctcaggagctcacaaagagtcaccgcagaaacacttctggcacaccttccatagcagtgtctggaacctctctctcctcagatcagagtcgatctgagttagatttgagtgagtcatttacagaagactcagaggatactgtaagcataagaagcaagtctgtccctggggctttagacaaggactccttggaagagactgaagaaagcattgatgccttagtgtcctcgcagttatctacaaacactcaccgtctggcaagtggcctatcaactaccagccttaacagcatgatgagcgtttacagtgaaacgggagactatggcaacgtgaaagtcagtggtgaaatccttctccatatcagctactgctacaaaactggtgggctgtacatttttgtcaagaattgcagaaatctggccataggagatgaaaagaaacagaggacagatgcttatgtcaagtcatatcttcttcctgacaagtcccggaacaacaagcgtaagaccaaaatcagaacaggcaccaatccagaattcaatgaaacactaaagtacactatcagccatacccagctggaaacaagaactctgcagctctcagtctggcactatgatcgatttggacgtaatagcttcctcggggaagtagagattccttttgactcatggaactttgaaaatccaactgatgagtggtttgtgcttcaacccaaggtggagtttgctcctgatattggccttcaatacaaaggagagctgacagttgttttacgttacattcccccagaagagaacctgatgcttccaccagaacaactccaaggaaataagacttttaaaaagggaaagaagaaggagtcacctgtaatctctggaggaatactagaagtgttcatcaaagaggcaaagaatttgacagcagtgaagtcaggaggcacttctgatagctttgtgaagggctacctgctccctgatgatagcaaagccaccaagcacaaaactctggtaataaaaaagagtgttaaccctcagtggaatcatacattcatgttcagtggcatccatccccaggatataaagaatgtttgcctagaacttactatctgggacaaggaggccttttccagcaacatctttctgggaggagttcgtttgaattctggaagtggtgtgagccatgggaagaacgtggattggatggactctcagggggaagagcagcgcctttggcagaagatggccaacaaccctggaactccctttgagggtgtactcatgcttcgttccagcatgggaaaatgtaggctctaaagggaccagttctccaagaatgaggccaccaggacctatctggctgtcttttcctaccattagcaaactgagacctgggattctgcttccctgccatttctcacctgacagtgttgggacatgaggggagagatgtcagtagtatgaacatttagggtcttgctgagtgcctaaaaaacatatatttccatccaatcaaggccttcttgattggatgatagaaagtgtactacttgtcctgtcaacaagcaaattgtgcaaaggcttatagggtttatgccataaaagaaatggcacaagcctccatttgctaattataagttactttagatttcctcaaatcctttgaagagaaagaggaccactgagaaggtagatcacttgaaaagtcagaagaaaggatactggccaacttttactcaccctaggaatccacatgatctcaagaaggcatggtggagatggttgcttgagcaaggggattgtcctgttattgcagcaaacttgtggattaaccaagtagtatttcaagatggattgacagggctttctatgattactatagaatttatcatctaaatcagtttactttttagaacaaagagagctaaataactacatcagaacgattgatgttgattagaattgacctgggaaaattgggatgtagggtcaccctactgatgacctaagagagctctgttttaaacatttattttataaaatgttctaagccattaactaaaaggaaatgagatataatggtcaattgatataccttttcacattgtgttcactgacgagactagtttaatgaaaaaggaggtactctacctgctattttacttctgttcctcttctgccctgttatgggagagaatcaaagactccatctgctctcttcccccttgttttctccttcactgagtttttcttatctccttttgcagtggttaactattgtcacaataatgctgaatgaaaaaacacaccaaatgtcagtggcttaaaatgaccatcctttttctcacagttatgaagattggctatggcacctctgcttcctgctataggcctgaggttctagggcttcttatgcctcatcctctttaagccaaagggatagccagagcatcttgatggcagaagtgcaataagatgagccccactgctcgggtacattttcagcccctggttgtgtcatgtctactgatatctcattggtcaaaggaagtcagagggccaagatgaagaggcagggaaatatgcactgcccacagtgaagccatgacaagagtgaggatgcaggaaggcatgaagaattggggccaacagttcaatctaccataccttctctcacctggaattccagatgcttgagctacgaaacttagatgcaaagaaagttaaagctagaaggaacctcaggcccagttgctcattttgcagattccaaatgtgaatttcagagagctgagataacttgcccaaggccatatagaggctgtgactaaatctggacttaaatccagactatcaatcttaggccagtgttcttttttcaatatagtccttggcataatgctatgcttattaggtagataaaagggcttatgtcaagaaatttggagcagagtctgattacttgagcatgaacatacccgaccaaggtatgttctggagtcatattctagcctctgagctcattttttcatgcgagttcatataaaatcctcgaaagtttagaaactaggttttagtagtaacggagctagaatcatcttcgggcttattcctgctagttgttccatatttctagatttcatcttgaattttgaaaactgatttaagaatatatttagtattattattagtaagggaatacgcaatccagtttcaattttattcagaagtaggtcacctaattctagaaaatggttattagtctagtgtcgcttagcaaggtacttaaaagaaaatctgcacatatccttgtgctgcccttcttaaaaacagaaaacaaaaagtgtaagatcatcattgcttcccacataggaaaaataaaatgtcttcagacttgatgtga

SEQ ID NO: 7435 - DNA, 4828 bp, Homo sapiens
cacaagggtcaagtagtccagcattctacagtttgtgtgtttgagagaaaaataagcccataaaaacattctaaccttcagattaagttagatacaacaaaatttcaaaaattaggcagttttacaagtgctatgggaaaaatagcctaattaaatttttctctcctcttttttttctccaccgtcttagtgttttctgcattctctcccagcggatctgattcctgttctgaagaattgaagttgagcatcgttagttaaattcagctgctgcctgactgtataccacagcaaaggctttggaaacatttttcagttaaaacaataatgactttcttggagtgtaatcccagtggaggctgttctacgtatagcctgaaagaatacttaactaccatacgcaattctgcagagaccttgtaaaaatcacactttacaccaaacaactgagtgattctgaattggttgggggaatcttagttgtagatatcaattcaccttcttgaagattcaaccactgctactcagagctgctgctgaaataccatgtctaagaactcagagttcatcaatctgtcatttttattagatcatgagaaggaaatgatcctgggcgtcctaaagagagatgaatatttgaaaaaagtggaggacaagagaataaggaagctgaaaaatgaactcttagaagcaaaacgtagaagtgggaaaactcaacaagaggccagcagagtttgtgttcactgtcacagaaacctgggcctaatctttgaccggggagacccttgtcaggcttgctcactgagggtatgcagggagtgtcgagttgcaggccccaatggcagctggaagtgcactgtctgtgacaaaatcgcgcagctaaggattataactggtgagtggttttttgaagaaaaggcaaaacgtttcaagcaagtcaatgttctcggcactgatgttgtccgacagtccattttaagaagaagtccaggagctgaagaagtacagagccaagagcaaacccgccaggatgcagaaaagtcagacacttcacctgttgctgggaagaaggccagccatgatgggcccaagagaaagggatttcttcttagcaagttcagatcggcaaccagaggagaaatcataactcccaaaactgacactgggcggagctatagcttggacttagacggtcaacattttcggagtttaaaatcacctcctggttcagacaggggaagcactggctcatcagatctcaatgaccaggaacctggtcctaggaccccgaagagcagtcggagcaatggtgtgaccccaggcactcagagttcaccagccccaagcacacgaactgtgacctcagtcatcagtagagagtatggttttgaaaattccatggatttggctgctattgaaggtacctctcaggagctcacaaagagtcaccgcagaaacacttctggcacaccttccatagcagtgtctggaacctctctctcctcagatcagagtcgatctgagttagatttgagtgagtcatttacagaagactcagaggatactgtaagcataagaagcaagtctgtccctggggctttagacaaggactccttggaagagactgaagaaagcattgatgccttagtgtcctcgcagttatctacaaacactcaccgtctggcaagtggcctatcaactaccagccttaacagcatgatgagcgtttacagtgaaacgggagactatggcaacgtgaaagtcagtggtgaaatccttctccatatcagctactgctacaaaactggtgggctgtacatttttgtcaagaattgcagaaatctggccataggagatgaaaagaaacagaggacagatgcttatgtcaagtcatatcttcttcctgacaagtcccggaacaacaagcgtaagaccaaaatcagaacaggcaccaatccagaattcaatgaaacactaaagtacactatcagccatacccagctggaaacaagaactctgcagctctcagtctggcactatgatcgatttggacgtaatagcttcctcggggaagtagagattccttttgactcatggaactttgaaaatccaactgatgagtggtttgtgcttcaacccaaggtggagtttgctcctgatattggccttcaatacaaaggagagctgacagttgttttacgttacattcccccagaagagaacctgatgcttccaccagaacaactccaaggaaataagacttttaaaaagggaaagaagaaggagtcacctgtaatctctggaggaatactagaagtgttcatcaaagaggcaaagaatttgacagcagtgaagtcaggaggcacttctgatagctttgtgaagggctacctgctccctgatgatagcaaagccaccaagcacaaaactctggtaataaaaaagagtgttaaccctcagtggaatcatacattcatgttcagtggcatccatccccaggatataaagaatgtttgcctagaacttactatctgggacaaggaggccttttccagcaacatctttctgggaggagttcgtttgaattctggaagtggtgtgagccatgggaagaacgtggattggatggactctcagggggaagagcagcgcctttggcagaagatggccaacaaccctggaactccctttgagggtgtactcatgcttcgttccagcatgggaaaatgtaggctctaaagggaccagttctccaagaatgaggccaccaggacctatctggctgtcttttcctaccattagcaaactgagacctgggattctgcttccctgccatttctcacctgacagtgttgggacatgaggggagagatgtcagtagtatgaacatttagggtcttgctgagtgcctaaaaaacatatatttccatccaatcaaggccttcttgattggatgatagaaagtgtactacttgtcctgtcaacaagcaaattgtgcaaaggcttatagggtttatgccataaaagaaatggcacaagcctccatttgctaattataagttactttagatttcctcaaatcctttgaagagaaagaggaccactgagaaggtagatcacttgaaaagtcagaagaaaggatactggccaacttttactcaccctaggaatccacatgatctcaagaaggcatggtggagatggttgcttgagcaaggggattgtcctgttattgcagcaaacttgtggattaaccaagtagtatttcaagatggattgacagggctttctatgattactatagaatttatcatctaaatcagtttactttttagaacaaagagagctaaataactacatcagaacgattgatgttgattagaattgacctgggaaaattgggatgtagggtcaccctactgatgacctaagagagctctgttttaaacatttattttataaaatgttctaagccattaactaaaaggaaatgagatataatggtcaattgatataccttttcacattgtgttcactgacgagactagtttaatgaaaaaggaggtactctacctgctattttacttctgttcctcttctgccctgttatgggagagaatcaaagactccatctgctctcttcccccttgttttctccttcactgagtttttcttatctccttttgcagtggttaactattgtcacaataatgctgaatgaaaaaacacaccaaatgtcagtggcttaaaatgaccatcctttttctcacagttatgaagattggctatggcacctctgcttcctgctataggcctgaggttctagggcttcttatgcctcatcctctttaagccaaagggatagccagagcatcttgatggcagaagtgcaataagatgagccccactgctcgggtacattttcagcccctggttgtgtcatgtctactgatatctcattggtcaaaggaagtcagagggccaagatgaagaggcagggaaatatgcactgcccacagtgaagccatgacaagagtgaggatgcaggaaggcatgaagaattggggccaacagttcaatctaccataccttctctcacctggaattccagatgcttgagctacgaaacttagatgcaaagaaagttaaagctagaaggaacctcaggcccagttgctcattttgcagattccaaatgtgaatttcagagagctgagataacttgcccaaggccatatagaggctgtgactaaatctggacttaaatccagactatcaatcttaggccagtgttcttttttcaatatagtccttggcataatgctatgcttattaggtagataaaagggcttatgtcaagaaatttggagcagagtctgattacttgagcatgaacatacccgaccaaggtatgttctggagtcatattctagcctctgagctcattttttcatgcgagttcatataaaatcctcgaaagtttagaaactaggttttagtagtaacggagctagaatcatcttcgggcttattcctgctagttgttccatatttctagatttcatcttgaattttgaaaactgatttaagaatatatttagtattattattagtaagggaatacgcaatccagtttcaattttattcagaagtaggtcacctaattctagaaaatggttattagtctagtgtcgcttagcaaggtacttaaaagaaaatctgcacatatccttgtgctgcccttcttaaaaacagaaaacaaaaagtgtaagatcatcattgcttcccacataggaaaaataaaatgtcttcagacttgatgtgactc

SEQ ID NO: 7436 - DNA, 4704 bp, Homo sapiens
tgttttctgcattctctcccagcggatctgattcctgttctgaagaattgaagttgagcatcgttagttaaattcagctgctgcctgactgtataccacagcaaaggctttggaaacatttttcagttaaaacaataatgactttcttggagtgtaatcccagtggaggctgttctacgtatagcctgaaagaatacttaactaccatacgcaattctgcagagaccttgtaaaaatcacactttacaccaaacaactgagtgattctgaattggttgggggaatcttagttgtagatatcaattcaccttcttgaagattcaaccactgctactcagagctgctgctgaaataccatgtctaagaactcagagttcatcaatctgtcatttttattagatcatgagaaggaaatgatcctgggcgtcctaaagagagatgaatatttgaaaaaagtggaggacaagagaataaggaagctgaaaaatgaactcttagaagcaaaacgtagaagtgggaaaactcaacaagaggccagcagagtttgtgttcactgtcacagaaacctgggcctaatctttgaccggggagacccttgtcaggcttgctcactgagggtatgcagggagtgtcgagttgcaggccccaatggcagctggaagtgcactgtctgtgacaaaatcgcgcagctaaggattataactggtgagtggttttttgaagaaaaggcaaaacgtttcaagcaagtcaatgttctcggcactgatgttgtccgacagtccattttaagaagaagtccaggagctgaagaagtacagagccaagagcaaacccgccaggatgcagaaaagtcagacacttcacctgttgctgggaagaaggccagccatgatgggcccaagagaaagggatttcttcttagcaagttcagatcggcaaccagaggagaaatcataactcccaaaactgacactgggcggagctatagcttggacttagacggtcaacattttcggagtttaaaatcacctcctggttcagacaggggaagcactggctcatcagatctcaatgaccaggaacctggtcctaggaccccgaagagcagtcggagcaatggtgtgaccccaggcactcagagttcaccagccccaagcacacgaactgtgacctcagtcatcagtagagagtatggttttgaaaattccatggatttggctgctattgaaggtacctctcaggagctcacaaagagtcaccgcagaaacacttctggcacaccttccatagcagtgtctggaacctctctctcctcagatcagagtcgatctgagttagatttgagtgagtcatttacagaagactcagaggatactgtaagcataagaagcaagtctgtccctggggctttagacaaggactccttggaagagactgaagaaagcattgatgccttagtgtcctcgcagttatctacaaacactcaccgtctggcaagtggcctatcaactagttctcaagcaggttctgacaggaagtggacctacctaaatgtgcctgatgctgactcagacactaccagccttaacagcatgatgagcgtttacagtgaaacgggagactatggcaacgtgaaagtcagtggtgaaatccttctccatatcagctactgctacaaaactggtgggctgtacatttttgtcaagaattgcagaaatctggccataggagatgaaaagaaacagaggacagatgcttatgtcaagtcatatcttcttcctgacaagtcccggaacaacaagcgtaagaccaaaatcagaacaggcaccaatccagaattcaatgaaacactaaagtacactatcagccatacccagctggaaacaagaactctgcagctctcagtctggcactatgatcgatttggacgtaatagcttcctcggggaagtagagattccttttgactcatggaactttgaaaatccaactgatgagtggtttgtgcttcaacccaaggtggagtttgctcctgatattggccttcaatacaaaggagagctgacagttgttttacgttacattcccccagaagagaacctgatgcttccaccagaacaactccaaggaaataagacttttaaaaagggaaagaagaaggagtcacctgtaatctctggaggaatactagaagtgttcatcaaagaggcaaagaatttgacagcagtgaagtcaggaggcacttctgatagctttgtgaagggctacctgctccctgatgatagcaaagccaccaagcacaaaactctggtaataaaaaagagtgttaaccctcagtggaatcatacattcatgttcagtggcatccatccccaggatataaagaatgtttgcctagaacttactatctgggacaaggaggccttttccagcaacatctttctgggaggagttcgtttgaattctggaagtggtgtgagccatgggaagaacgtggattggatggactctcagggggaagagcagcgcctttggcagaagatggccaacaaccctggaactccctttgagggtgtactcatgcttcgttccagcatgggaaaatgtaggctctaaagggaccagttctccaagaatgaggccaccaggacctatctggctgtcttttcctaccattagcaaactgagacctgggattctgcttccctgccatttctcacctgacagtgttgggacatgaggggagagatgtcagtagtatgaacatttagggtcttgctgagtgcctaaaaaacatatatttccatccaatcaaggccttcttgattggatgatagaaagtgtactacttgtcctgtcaacaagcaaattgtgcaaaggcttatagggtttatgccataaaagaaatggcacaagcctccatttgctaattataagttactttagatttcctcaaatcctttgaagagaaagaggaccactgagaaggtagatcacttgaaaagtcagaagaaaggatactggccaacttttactcaccctaggaatccacatgatctcaagaaggcatggtggagatggttgcttgagcaaggggattgtcctgttattgcagcaaacttgtggattaaccaagtagtatttcaagatggattgacagggctttctatgattactatagaatttatcatctaaatcagtttactttttagaacaaagagagctaaataactacatcagaacgattgatgttgattagaattgacctgggaaaattgggatgtagggtcaccctactgatgacctaagagagctctgttttaaacatttattttataaaatgttctaagccattaactaaaaggaaatgagatataatggtcaattgatataccttttcacattgtgttcactgacgagactagtttaatgaaaaaggaggtactctacctgctattttacttctgttcctcttctgccctgttatgggagagaatcaaagactccatctgctctcttcccccttgttttctccttcactgagtttttcttatctccttttgcagtggttaactattgtcacaataatgctgaatgaaaaaacacaccaaatgtcagtggcttaaaatgaccatcctttttctcacagttatgaagattggctatggcacctctgcttcctgctataggcctgaggttctagggcttcttatgcctcatcctctttaagccaaagggatagccagagcatcttgatggcagaagtgcaataagatgagccccactgctcgggtacattttcagcccctggttgtgtcatgtctactgatatctcattggtcaaaggaagtcagagggccaagatgaagaggcagggaaatatgcactgcccacagtgaagccatgacaagagtgaggatgcaggaaggcatgaagaattggggccaacagttcaatctaccataccttctctcacctggaattccagatgcttgagctacgaaacttagatgcaaagaaagttaaagctagaaggaacctcaggcccagttgctcattttgcagattccaaatgtgaatttcagagagctgagataacttgcccaaggccatatagaggctgtgactaaatctggacttaaatccagactatcaatcttaggccagtgttcttttttcaatatagtccttggcataatgctatgcttattaggtagataaaagggcttatgtcaagaaatttggagcagagtctgattacttgagcatgaacatacccgaccaaggtatgttctggagtcatattctagcctctgagctcattttttcatgcgagttcatataaaatcctcgaaagtttagaaactaggttttagtagtaacggagctagaatcatcttcgggcttattcctgctagttgttccatatttctagatttcatcttgaattttgaaaactgatttaagaatatatttagtattattattagtaagggaatacgcaatccagtttcaattttattcagaagtaggtcacctaattctagaaaatggttattagtctagtgtcgcttagcaaggtacttaaaagaaaatctgcacatatccttgtgctgcccttcttaaaaacagaaaacaaaaagtgtaagatcatcattgcttcccacataggaaaaataaaatgtcttcagacttgatgtgactc

SEQ ID NO: 7437 - DNA, 6389 bp, Homo sapiens
agtctgcgggcctccggggcagcggcgaggccggagcgtcgcggcggagaggacgagaccgggacaagaccagggcaggagggagccggccagccgcgagaaccccgcacgcccggcaagatgctgtcctggcggctgcagacgggccccgagaaggccgagctccaggagctcaacgcccggctctatgactacgtgtgtcgggtgcgggagctggagcgcgaaaacctactcctggaggaggagctgcgcggccggcgcgggcgagagggcctgtgggccgaggggcaggcccgctgcgccgaggaggcgcgcagcttgcggcagcagctggacgagctgagctgggccactgcgctggcggagggcgagcgggacgctctgcggcgcgagctgcgggagctgcagcgcctggatgcggaggagcgcgccgcccgcggccgcctggacgccgagctgggtgcgcagcagcgcgagctgcaggaggcgctgggcgcgcgcgccgccctcgaggcgctgctgggccggctgcaggccgagcgccgaggcctcgacgcggcccacgaacgcgacgtgagggagctgcgcgcgcgcgccgccagccttaccatgcatttccgcgcccgcgccaccggccccgccgcgccgccgccacgcctgcgggaggtgcacgacagctacgcactgctggtggccgagtcgtggcgggagacggtgcagctgtacgaggacgaggtgcgcgagctggaggaggcgctgcggcgcggccaggagagcagactccaggcggaggaagagacgcggctgtgcgcgcaggaggcagaggcgctgcggcgcgaggcgctcgggttggagcagctgcgcgcgcggctggaggacgcgctgctgcggatgcgcgaggagtacgggatacaggccgaggagcggcagagagtgattgactgcctggaggatgagaaggcaaccctcaccttggccatggctgactggctgcgggactatcaggacctcctgcaggtgaagaccggcctcagtctggaggtggcgacctaccgggccttattggaaggagaaagtaatccagagatagtgatctgggctgagcacgttgaaaacatgccgtcagaattcagaaacaaatcctatcactataccgactcactactacagagggaaaatgaaaggaatctattttcaaggcagaaagcacctttggcaagtttcaatcacagctcggcactgtattctaacctgtcagggcaccgtggatctcagacgggcacatctattggaggtgatgccagaagaggcttcttgggctcgggatattcttcctcggccactacccagcaggaaaactcatacggaaaagccgtcagcagtcaaaccaacgtcagaactttctctccaacctatggccttttaagaaatactgaggctcaagtgaaaacattccctgacagaccaaaagccggagatacaagggaggtccccgtttacataggtgaagattccacaattgcccgcgagtcgtaccgggatcgccgagacaaggtggcagcaggtgcttcggaaagcacacggtcaaatgagaggaccgtcattctgggaaagaaaacagaagtgaaagccacgagggagcaagaaagaaacagaccagaaaccatccgaacaaagccagaagagaaaatgttcgattctaaagagaaggcttccgaggagagaaacctaagatgggaagaattgacaaagttagataaggaagcgagacagagagaaagccagcagatgaaggagaaggctaaggagaaggactcaccgaaggagaagagcgtgcgagagagagaggtgccgattagtctagaagtatcccaggacagaagagcagaggtgtccccgaaaggtttgcagacgcctgtgaaggatgctggtggtgggaccggtagagaggcagaagcaagagagctacggttcaggttgggcaccagtgatgccactggttctctgcaaggcgattccatgacagaaaccgtagcagaaaacatcgttaccagtatcctgaagcagttcactcagtctccagagacagaagcatctgctgattcttttccagacacaaaagtcacttacgtggacaggaaagagcttcctggggaaaggaaaacaaagactgaaatagttgtggagtctaaactgactgaggatgttgatgtttccgatgaagctggcctggactaccttttaagcaaggatattaaggaagtggggctgaaaggcaagtcagccgagcagatgataggagacatcatcaacctcggcctgaaagggagggaggggagagcaaaggtcgtcaacgtggagatcgtggaggagcccgtgagttatgtcagcggggagaagccggaggagttttccgtcccattcaaagtggaggaggtcgaagatgtgtcgccaggcccctgggggttggttaaggaggaggaaggttatggagaaagcgatgtcacattctcagttaatcagcatcgaaggaccaagcagcctcaggagaacacgactcacgtggaagaagtgacagaggcaggtgattcagagggcgagcagagttattttgtgtccactccagatgaacaccccggggggcacgacagagatgacggctcggtgtacgggcagatccacatcgaggaggaatccaccatcaggtactcttggcaggatgaaatcgtgcaggggactcgaaggaggacacagaaggacggtgcagtgggcgagaaggttgtgaagcccttggatgtcccagcgccctctctggagggggacctgggttccactcactggaaagaacaagctagaagcggtgaatttcatgccgaacccacagtcattgaaaaagaaattaaaataccccacgaattccacacctccatgaagggcatctcctccaaggagccccggcagcagctggtggaggtcatcgggcagctggaggaaacccttcccgagcgcatgagggaggagctgtccgccctcaccagagaggggcagggtgggccggggagcgtttccgtggatgtcaagaaggtccagggtgctggtggcagttccgtgaccctggttgctgaagtcaacgtctcacaaactgtggatgccgatcggttagacctggaggagctgagcaaagatgaggccagtgagatggagaaggctgtggagtcggtggttcgggagagcctgagcaggcaacgcagcccagcgcctggcagcccagatgaggaaggtggagcggaggccccggctgctggcattcgctttaggcgttgggccacccgggagctgtacatcccttcaggcgagagcgaggttgctggtggggcctctcacagctcgggacagcgcactccccagggcccagtgtcggccactgtggaggtcagcagccccacaggctttgcccagtcacaggtgctggaggatgtgagccaggctgcaaggcacataaaactcggcccctctgaagtctggaggactgagcgaatgtcatatgaaggacccactgcagaagtggtggagatggatgtgagtaacgtagaggcgatccgcagccggacacaggaagcgggagctctcggtgtgtctgaccgtggttcctggagagacgcggacagtaggaatgaccaggcagttggtgtgagctttaaggcctctgctggggaaggagaccaggcccacagagaacagggcaaggagcaggccatgtttgataagaaggtgcagctccagagaatggtagaccaaaggtcggtgatttcagatgaaaagaaagttgccctcctctatctagacaatgaggaggaggagaatgatgggcattggttttaataagcagaaacattttgttttaatggcagcctgttggcgacgtgccaacatccaaaggccttaacttattttaagaggccgagggagtctatgaaaatctccccttttttacttttttaaagagtactcccggcatggtcaatttcctttatagttaatccgtaaaggtttccagttaattcatgccttaaaaggcactgcaattttatttttgagttgggacttttacaaaacacttttttccctggagtcttctctccacttctggagatgaatttctatgttttgcacctggtcacagacatggcttgcatctgtttgaaactacaattaattatagatgtcaaaacattaaccagattaaagtaatatatttaagagtaaattttgcttgcatgtgctaatatgaaataacagactaacattttaggggaaaaataaatacaatttagactctaaaaagtcttttcaaaaagaaatgggaaataggcagactgtttatgttaaaaaaattcttgctaaatgatttcatctttaggaaaaaattacttgccatatagagctaaattcatcttaagacttgaatgaattgctttctatgtacagaactttaaacaatatagtatttatggcgaggacagctgtagtctgttgtgatatttcacattctatttgcacaggttccctggcactggtagggtagatgattattgggaatcgcttacagtaccatttcattttttggcactaggtcattaagtagcacacagtctgaatgcccttttctggagtggccagttcctatcagactgtgcagacttgcgcttctctgcaccttatcccttagcacccaaacatttaatttcactggtgggaggtagaccttgaagacaatgaagagaatgccgatactcagactgcagctggaccggcaagctggctgtgtacaggaaaattggaagcacacagtggactgtgcctcttaaagatgcctttcccaaccctccattcatgggatgcaggtctttctgagctcaagggtgaaagatgaatacaataacaaccatgaacccacctcacggaagctttttttgcactttgaacagaagtcattgcagttggggtgttttgtccagggaaacagtttattaaatagaaggatgttttggggaaggaactggatatctctcctgcagcccagcaccgagatacccaggacgggcctggggggcgagaaaggcccccatgctcatgggccgcggagtgtggacctgtagataggcaccaccgagtttaagatactgggatgagcatgcttcattggattcattttattttacacgtcagtattgttttaaagtttctgtctgtaaagtgtagcatcatatataaaaagagtttcgctagcagcgcattttttttagttcaggctagcttctttcacataatgctgtctcagctgtatttccagtaacacagcatcatcgcactgactgtggcgcactggggaataacagtctgagctagcaccaccctcagccaggctacaacgacagcactggagggtcttccctctcagattcacctggaggccctcagacccccagggtgcacgtctccccaggtcctgggagtggctaccgcaggtagtttctggagagcacgttttcttcattgataagtggaggagaaatgcagcacagctttcaagatactattttaaaaacaccatgaatcagatagggaaagaaagttgattggaatagcaagtttaaacctttgttgtccatctgccaaatgaactagtgattgtcagactggtatggaggtgactgctttgtaaggttttgtcgtttctaatacagacagagatgtgctgattttgttttagctgtaacaggtaatggtttttggatagatgattgactggtgagaatttggtcaaggtgacagcctcctgtctgatgacaggacagactggtggtgaggagtctaagtgggctcagtttgatgtcagtgtctgggctcatgacttgtaaatggaagctgatgtgaacaggtaattaatattatgacccacttctatttactttgggaaatatcttggatcttaattatcatctgcaagtttcaagaagtattctgccaaaagtatttacaagtatggactcatgagctattgttggttgctaaatgtgaatcacgcgggagtgagtgtgcccttcacactgtgacattgtgacattgtgacaagctccatgtcctttaaaatcagtcactctgcacacaagagaaatcaacttcgtggttggatggggccggaacacaaccagtctttttgtatttattgttactgagacaaaacagtactcactgagtgtttttcagtttcctactggtggttttgatattgtttgtttaagatgtatatttagaatgacatcatctaagaagctgattttgctaaactcctgttccctacaatgggaaatgtcacaagaatgtgc

SEQ ID NO: 7438 - DNA, 6386 bp, Homo sapiens
agtctgcgggcctccggggcagcggcgaggccggagcgtcgcggcggagaggacgagaccgggacaagaccagggcaggagggagccggccagccgcgagaaccccgcacgcccggcaagatgctgtcctggcggctgcagacgggccccgagaaggccgagctccaggagctcaacgcccggctctatgactacgtgtgtcgggtgcgggagctggagcgcgaaaacctactcctggaggaggagctgcgcggccggcgcgggcgagagggcctgtgggccgaggggcaggcccgctgcgccgaggaggcgcgcagcttgcggcagcagctggacgagctgagctgggccactgcgctggcggagggcgagcgggacgctctgcggcgcgagctgcgggagctgcagcgcctggatgcggaggagcgcgccgcccgcggccgcctggacgccgagctgggtgcgcagcagcgcgagctgcaggaggcgctgggcgcgcgcgccgccctcgaggcgctgctgggccggctgcaggccgagcgccgaggcctcgacgcggcccacgaacgcgacgtgagggagctgcgcgcgcgcgccgccagccttaccatgcatttccgcgcccgcgccaccggccccgccgcgccgccgccacgcctgcgggaggtgcacgacagctacgcactgctggtggccgagtcgtggcgggagacggtgcagctgtacgaggacgaggtgcgcgagctggaggaggcgctgcggcgcggccaggagagcagactccaggcggaggaagagacgcggctgtgcgcgcaggaggcagcgctgcggcgcgaggcgctcgggttggagcagctgcgcgcgcggctggaggacgcgctgctgcggatgcgcgaggagtacgggatacaggccgaggagcggcagagagtgattgactgcctggaggatgagaaggcaaccctcaccttggccatggctgactggctgcgggactatcaggacctcctgcaggtgaagaccggcctcagtctggaggtggcgacctaccgggccttattggaaggagaaagtaatccagagatagtgatctgggctgagcacgttgaaaacatgccgtcagaattcagaaacaaatcctatcactataccgactcactactacagagggaaaatgaaaggaatctattttcaaggcagaaagcacctttggcaagtttcaatcacagctcggcactgtattctaacctgtcagggcaccgtggatctcagacgggcacatctattggaggtgatgccagaagaggcttcttgggctcgggatattcttcctcggccactacccagcaggaaaactcatacggaaaagccgtcagcagtcaaaccaacgtcagaactttctctccaacctatggccttttaagaaatactgaggctcaagtgaaaacattccctgacagaccaaaagccggagatacaagggaggtccccgtttacataggtgaagattccacaattgcccgcgagtcgtaccgggatcgccgagacaaggtggcagcaggtgcttcggaaagcacacggtcaaatgagaggaccgtcattctgggaaagaaaacagaagtgaaagccacgagggagcaagaaagaaacagaccagaaaccatccgaacaaagccagaagagaaaatgttcgattctaaagagaaggcttccgaggagagaaacctaagatgggaagaattgacaaagttagataaggaagcgagacagagagaaagccagcagatgaaggagaaggctaaggagaaggactcaccgaaggagaagagcgtgcgagagagagaggtgccgattagtctagaagtatcccaggacagaagagcagaggtgtccccgaaaggtttgcagacgcctgtgaaggatgctggtggtgggaccggtagagaggcagaagcaagagagctacggttcaggttgggcaccagtgatgccactggttctctgcaaggcgattccatgacagaaaccgtagcagaaaacatcgttaccagtatcctgaagcagttcactcagtctccagagacagaagcatctgctgattcttttccagacacaaaagtcacttacgtggacaggaaagagcttcctggggaaaggaaaacaaagactgaaatagttgtggagtctaaactgactgaggatgttgatgtttccgatgaagctggcctggactaccttttaagcaaggatattaaggaagtggggctgaaaggcaagtcagccgagcagatgataggagacatcatcaacctcggcctgaaagggagggaggggagagcaaaggtcgtcaacgtggagatcgtggaggagcccgtgagttatgtcagcggggagaagccggaggagttttccgtcccattcaaagtggaggaggtcgaagatgtgtcgccaggcccctgggggttggttaaggaggaggaaggttatggagaaagcgatgtcacattctcagttaatcagcatcgaaggaccaagcagcctcaggagaacacgactcacgtggaagaagtgacagaggcaggtgattcagagggcgagcagagttattttgtgtccactccagatgaacaccccggggggcacgacagagatgacggctcggtgtacgggcagatccacatcgaggaggaatccaccatcaggtactcttggcaggatgaaatcgtgcaggggactcgaaggaggacacagaaggacggtgcagtgggcgagaaggttgtgaagcccttggatgtcccagcgccctctctggagggggacctgggttccactcactggaaagaacaagctagaagcggtgaatttcatgccgaacccacagtcattgaaaaagaaattaaaataccccacgaattccacacctccatgaagggcatctcctccaaggagccccggcagcagctggtggaggtcatcgggcagctggaggaaacccttcccgagcgcatgagggaggagctgtccgccctcaccagagaggggcagggtgggccggggagcgtttccgtggatgtcaagaaggtccagggtgctggtggcagttccgtgaccctggttgctgaagtcaacgtctcacaaactgtggatgccgatcggttagacctggaggagctgagcaaagatgaggccagtgagatggagaaggctgtggagtcggtggttcgggagagcctgagcaggcaacgcagcccagcgcctggcagcccagatgaggaaggtggagcggaggccccggctgctggcattcgctttaggcgttgggccacccgggagctgtacatcccttcaggcgagagcgaggttgctggtggggcctctcacagctcgggacagcgcactccccagggcccagtgtcggccactgtggaggtcagcagccccacaggctttgcccagtcacaggtgctggaggatgtgagccaggctgcaaggcacataaaactcggcccctctgaagtctggaggactgagcgaatgtcatatgaaggacccactgcagaagtggtggagatggatgtgagtaacgtagaggcgatccgcagccggacacaggaagcgggagctctcggtgtgtctgaccgtggttcctggagagacgcggacagtaggaatgaccaggcagttggtgtgagctttaaggcctctgctggggaaggagaccaggcccacagagaacagggcaaggagcaggccatgtttgataagaaggtgcagctccagagaatggtagaccaaaggtcggtgatttcagatgaaaagaaagttgccctcctctatctagacaatgaggaggaggagaatgatgggcattggttttaataagcagaaacattttgttttaatggcagcctgttggcgacgtgccaacatccaaaggccttaacttattttaagaggccgagggagtctatgaaaatctccccttttttacttttttaaagagtactcccggcatggtcaatttcctttatagttaatccgtaaaggtttccagttaattcatgccttaaaaggcactgcaattttatttttgagttgggacttttacaaaacacttttttccctggagtcttctctccacttctggagatgaatttctatgttttgcacctggtcacagacatggcttgcatctgtttgaaactacaattaattatagatgtcaaaacattaaccagattaaagtaatatatttaagagtaaattttgcttgcatgtgctaatatgaaataacagactaacattttaggggaaaaataaatacaatttagactctaaaaagtcttttcaaaaagaaatgggaaataggcagactgtttatgttaaaaaaattcttgctaaatgatttcatctttaggaaaaaattacttgccatatagagctaaattcatcttaagacttgaatgaattgctttctatgtacagaactttaaacaatatagtatttatggcgaggacagctgtagtctgttgtgatatttcacattctatttgcacaggttccctggcactggtagggtagatgattattgggaatcgcttacagtaccatttcattttttggcactaggtcattaagtagcacacagtctgaatgcccttttctggagtggccagttcctatcagactgtgcagacttgcgcttctctgcaccttatcccttagcacccaaacatttaatttcactggtgggaggtagaccttgaagacaatgaagagaatgccgatactcagactgcagctggaccggcaagctggctgtgtacaggaaaattggaagcacacagtggactgtgcctcttaaagatgcctttcccaaccctccattcatgggatgcaggtctttctgagctcaagggtgaaagatgaatacaataacaaccatgaacccacctcacggaagctttttttgcactttgaacagaagtcattgcagttggggtgttttgtccagggaaacagtttattaaatagaaggatgttttggggaaggaactggatatctctcctgcagcccagcaccgagatacccaggacgggcctggggggcgagaaaggcccccatgctcatgggccgcggagtgtggacctgtagataggcaccaccgagtttaagatactgggatgagcatgcttcattggattcattttattttacacgtcagtattgttttaaagtttctgtctgtaaagtgtagcatcatatataaaaagagtttcgctagcagcgcattttttttagttcaggctagcttctttcacataatgctgtctcagctgtatttccagtaacacagcatcatcgcactgactgtggcgcactggggaataacagtctgagctagcaccaccctcagccaggctacaacgacagcactggagggtcttccctctcagattcacctggaggccctcagacccccagggtgcacgtctccccaggtcctgggagtggctaccgcaggtagtttctggagagcacgttttcttcattgataagtggaggagaaatgcagcacagctttcaagatactattttaaaaacaccatgaatcagatagggaaagaaagttgattggaatagcaagtttaaacctttgttgtccatctgccaaatgaactagtgattgtcagactggtatggaggtgactgctttgtaaggttttgtcgtttctaatacagacagagatgtgctgattttgttttagctgtaacaggtaatggtttttggatagatgattgactggtgagaatttggtcaaggtgacagcctcctgtctgatgacaggacagactggtggtgaggagtctaagtgggctcagtttgatgtcagtgtctgggctcatgacttgtaaatggaagctgatgtgaacaggtaattaatattatgacccacttctatttactttgggaaatatcttggatcttaattatcatctgcaagtttcaagaagtattctgccaaaagtatttacaagtatggactcatgagctattgttggttgctaaatgtgaatcacgcgggagtgagtgtgcccttcacactgtgacattgtgacattgtgacaagctccatgtcctttaaaatcagtcactctgcacacaagagaaatcaacttcgtggttggatggggccggaacacaaccagtctttttgtatttattgttactgagacaaaacagtactcactgagtgtttttcagtttcctactggtggttttgatattgtttgtttaagatgtatatttagaatgacatcatctaagaagctgattttgctaaactcctgttccctacaatgggaaatgtcacaagaatgtgc

SEQ ID NO: 7439 - DNA, 7322 bp, Homo sapiens
agtctgcgggcctccggggcagcggcgaggccggagcgtcgcggcggagaggacgagaccgggacaagaccagggcaggagggagccggccagccgcgagaaccccgcacgcccggcaagatgctgtcctggcggctgcagacgggccccgagaaggccgagctccaggagctcaacgcccggctctatgactacgtgtgtcgggtgcgggagctggagcgcgaaaacctactcctggaggaggagctgcgcggccggcgcgggcgagagggcctgtgggccgaggggcaggcccgctgcgccgaggaggcgcgcagcttgcggcagcagctggacgagctgagctgggccactgcgctggcggagggcgagcgggacgctctgcggcgcgagctgcgggagctgcagcgcctggatgcggaggagcgcgccgcccgcggccgcctggacgccgagctgggtgcgcagcagcgcgagctgcaggaggcgctgggcgcgcgcgccgccctcgaggcgctgctgggccggctgcaggccgagcgccgaggcctcgacgcggcccacgaacgcgacgtgagggagctgcgcgcgcgcgccgccagccttaccatgcatttccgcgcccgcgccaccggccccgccgcgccgccgccacgcctgcgggaggtgcacgacagctacgcactgctggtggccgagtcgtggcgggagacggtgcagctgtacgaggacgaggtgcgcgagctggaggaggcgctgcggcgcggccaggagagcagactccaggcggaggaagagacgcggctgtgcgcgcaggaggcagcgctgcggcgcgaggcgctcgggttggagcagctgcgcgcgcggctggaggacgcgctgctgcggatgcgcgaggagtacgggatacaggccgaggagcggcagagagtgattgactgcctggaggatgagaaggcaaccctcaccttggccatggctgactggctgcgggactatcaggacctcctgcaggtgaagaccggcctcagtctggaggtggcgacctaccgggccttattggaaggagaaagtaatccagagatagtgatctgggctgagcacgttgaaaacatgccgtcagaattcagaaacaaatcctatcactataccgactcactactacagagggaaaatgaaaggaatctattttcaaggcagaaagcacctttggcaagtttcaatcacagctcggcactgtattctaacctgtcagggcaccgtggatctcagacgggcacatctattggaggtgatgccagaagaggcttcttgggctcgggatattcttcctcggccactacccagcaggaaaactcatacggaaaagccgtcagcagtcaaaccaacgtcagaactttctctccaacctatggccttttaagaaatactgaggctcaagtgaaaacattccctgacagaccaaaagccggagatacaagggaggtccccgtttacataggtgaagattccacaattgcccgcgagtcgtaccgggatcgccgagacaaggtggcagcaggtgcttcggaaagcacacggtcaaatgagaggaccgtcattctgggaaagaaaacagaagtgaaagccacgagggagcaagaaagaaacagaccagaaaccatccgaacaaagccagaagagaaaatgttcgattctaaagagaaggcttccgaggagagaaacctaagatgggaagaattgacaaagttagataaggaagcgagacagagagaaagccagcagatgaaggagaaggctaaggagaaggactcaccgaaggagaagagcgtgcgagagagagaggtgccgattagtctagaagtatcccaggacagaagagcagaggtgtccccgaaaggtttgcagacgcctgtgaaggatgctggtggtgggaccggtagagaggcagaagcaagagagctacggttcaggttgggcaccagtgatgccactggttctctgcaaggcgattccatgacagaaaccgtagcagaaaacatcgttaccagtatcctgaagcagttcactcagtctccagagacagaagcatctgctgattcttttccagacacaaaagtcacttacgtggacaggaaagagcttcctggggaaaggaaaacaaagactgaaatagttgtggagtctaaactgactgaggatgttgatgtttccgatgaagctggcctggactaccttttaagcaaggatattaaggaagtggggctgaaaggcaagtcagccgagcagatgataggagacatcatcaacctcggcctgaaagggagggaggggagagcaaaggtcgtcaacgtggagatcgtggaggagcccgtgagttatgtcagcggggagaagccggaggagttttccgtcccattcaaagtggaggaggtcgaagatgtgtcgccaggcccctgggggttggttaaggaggaggaaggttatggagaaagcgatgtcacattctcagttaatcagcatcgaaggaccaagcagcctcaggagaacacgactcacgtggaagaagtgacagaggcaggtgattcagagggcgagcagagttattttgtgtccactccagatgaacaccccggggggcacgacagagatgacggctcggtgtacgggcagatccacatcgaggaggaatccaccatcaggtactcttggcaggatgaaatcgtgcaggggactcgaaggaggacacagaaggacggtgcagtgggcgagaaggttgtgaagcccttggatgtcccagcgccctctctggagggggacctgggttccactcactggaaagaacaagctagaagcggtgaatttcatgccgaacccacagtcattgaaaaagaaattaaaataccccacgaattccacacctccatgaagggcatctcctccaaggagccccggcagcagctggtggaggtcatcgggcagctggaggaaacccttcccgagcgcatgagggaggagctgtccgccctcaccagagaggggcagggtgggccggggagcgtttccgtggatgtcaagaaggtccagggtgctggtggcagttccgtgaccctggttgctgaagtcaacgtctcacaaactgtggatgccgatcggttagacctggaggagctgagcaaagatgaggccagtgagatggagaaggctgtggagtcggtggttcgggagagcctgagcaggcaacgcagcccagcgcctggcagcccagatgaggaaggtggagcggaggccccggctgctggcattcgctttaggcgttgggccacccgggagctgtacatcccttcaggcgagagcgaggttgctggtggggcctctcacagctcgggacagcgcactccccagggcccagtgtcggccactgtggaggtcagcagccccacaggctttgcccagtcacaggtgctggaggatgtgagccaggctgcaaggcacataaaactcggcccctctgaagtctggaggactgagcgaatgtcatatgaaggacccactgcagaagtggtggaggtaagtgcgggaggtgacctaagtcaggcagcgagcccgaccggagccagccggtctgtgaggcatgtcacgctgggtcccggtcaaagtccactgtccagagaagtcatcttcctaggccctgcccctgcctgtccagaggcatggggctcgccagaacctggcccagcagagtcttctgcagatatggacggatcagggaggcacagcacatttggctgcagacaatttcatgctgaaaaggagattatttttcagggccccatttctgctgcagggaaggttggtgattattttgcaacagaagagtcagtgggtacccagacttctgtcaggcaactccagttaggccctaaagaagggttcagtgggcaaatccagttcacagctccactttcagacaaggtggagttgggtgtcataggagattctgtacacatggaagggttgccagggagcagcacatccatcaggcacatcagcattgggcctcagaggcatcagaccacccagcagatagtttaccatgggctggttccccaactgggggaatctggtgactcagagagcactgtgcacggagagggctcagcagatgtgcaccaggccactcacagtcatacctcgggtagacaaaccgttatgactgaaaagagcaccttccaaagtgtcgtttctgaatctccccaggaggatagtgcagaggacacatcaggggcagaaatgacatcgggtgttagcagatcctttaggcacattcgactaggtcctacagaaacggaaacctctgaacacattgccatccgtggacccgtgtccagaacatttgtgcttgctggttcagcggactcccctgagctaggcaagttagcagacagcagcagaacgctaaggcacattgcaccagggcccaaagaaacttcgtttacctttcagatggatgtgagtaacgtagaggcgatccgcagccggacacaggaagcgggagctctcggtgtgtctgaccgtggttcctggagagacgcggacagtaggaatgaccaggcagttggtgtgagctttaaggcctctgctggggaaggagaccaggcccacagagaacagggcaaggagcaggccatgtttgataagaaggtgcagctccagagaatggtagaccaaaggtcggtgatttcagatgaaaagaaagttgccctcctctatctagacaatgaggaggaggagaatgatgggcattggttttaataagcagaaacattttgttttaatggcagcctgttggcgacgtgccaacatccaaaggccttaacttattttaagaggccgagggagtctatgaaaatctccccttttttacttttttaaagagtactcccggcatggtcaatttcctttatagttaatccgtaaaggtttccagttaattcatgccttaaaaggcactgcaattttatttttgagttgggacttttacaaaacacttttttccctggagtcttctctccacttctggagatgaatttctatgttttgcacctggtcacagacatggcttgcatctgtttgaaactacaattaattatagatgtcaaaacattaaccagattaaagtaatatatttaagagtaaattttgcttgcatgtgctaatatgaaataacagactaacattttaggggaaaaataaatacaatttagactctaaaaagtcttttcaaaaagaaatgggaaataggcagactgtttatgttaaaaaaattcttgctaaatgatttcatctttaggaaaaaattacttgccatatagagctaaattcatcttaagacttgaatgaattgctttctatgtacagaactttaaacaatatagtatttatggcgaggacagctgtagtctgttgtgatatttcacattctatttgcacaggttccctggcactggtagggtagatgattattgggaatcgcttacagtaccatttcattttttggcactaggtcattaagtagcacacagtctgaatgcccttttctggagtggccagttcctatcagactgtgcagacttgcgcttctctgcaccttatcccttagcacccaaacatttaatttcactggtgggaggtagaccttgaagacaatgaagagaatgccgatactcagactgcagctggaccggcaagctggctgtgtacaggaaaattggaagcacacagtggactgtgcctcttaaagatgcctttcccaaccctccattcatgggatgcaggtctttctgagctcaagggtgaaagatgaatacaataacaaccatgaacccacctcacggaagctttttttgcactttgaacagaagtcattgcagttggggtgttttgtccagggaaacagtttattaaatagaaggatgttttggggaaggaactggatatctctcctgcagcccagcaccgagatacccaggacgggcctggggggcgagaaaggcccccatgctcatgggccgcggagtgtggacctgtagataggcaccaccgagtttaagatactgggatgagcatgcttcattggattcattttattttacacgtcagtattgttttaaagtttctgtctgtaaagtgtagcatcatatataaaaagagtttcgctagcagcgcattttttttagttcaggctagcttctttcacataatgctgtctcagctgtatttccagtaacacagcatcatcgcactgactgtggcgcactggggaataacagtctgagctagcaccaccctcagccaggctacaacgacagcactggagggtcttccctctcagattcacctggaggccctcagacccccagggtgcacgtctccccaggtcctgggagtggctaccgcaggtagtttctggagagcacgttttcttcattgataagtggaggagaaatgcagcacagctttcaagatactattttaaaaacaccatgaatcagatagggaaagaaagttgattggaatagcaagtttaaacctttgttgtccatctgccaaatgaactagtgattgtcagactggtatggaggtgactgctttgtaaggttttgtcgtttctaatacagacagagatgtgctgattttgttttagctgtaacaggtaatggtttttggatagatgattgactggtgagaatttggtcaaggtgacagcctcctgtctgatgacaggacagactggtggtgaggagtctaagtgggctcagtttgatgtcagtgtctgggctcatgacttgtaaatggaagctgatgtgaacaggtaattaatattatgacccacttctatttactttgggaaatatcttggatcttaattatcatctgcaagtttcaagaagtattctgccaaaagtatttacaagtatggactcatgagctattgttggttgctaaatgtgaatcacgcgggagtgagtgtgcccttcacactgtgacattgtgacattgtgacaagctccatgtcctttaaaatcagtcactctgcacacaagagaaatcaacttcgtggttggatggggccggaacacaaccagtctttttgtatttattgttactgagacaaaacagtactcactgagtgtttttcagtttcctactggtggttttgatattgtttgtttaagatgtatatttagaatgacatcatctaagaagctgattttgctaaactcctgttccctacaatgggaaatgtcacaagaatgtgc

SEQ ID NO: 7440 - DNA, 1261 bp, Homo sapiens
cgctctgattgtttcgattcttccaaaatcagagacagagtgctcccggtgccatgaacggagacgatgcctttgtacggagacctagggttggttctcaaataccagagaagatgcaaaaggccttcgatgatattgccaaatacttctctgagaaagagtgggaaaagatgaaagcctcggagaaaatcatctatgtgtatatgaagagaaagtatgaggccatgactaaactaggtttcaaggccaccctcccacctttcatgcgtaataaacgggtcgcagacttccaggggaatgattttgataatgaccctaaccgtgggaatcaggttgaacatcctcagatgactttcggcaggctccagggaatcttcccgaagatcacgcccgagaagccagcagaggaaggaaatgattcgaagggagtgccagaagcatctggcccacagaacaatgggaaacagctgcgcccctcaggaaaactaaatacctctgagaaggttaacaagacatctggacccaaaagggggaaacatgcctggacccacagagtgcgtgagagaaagcaactggtgatttatgaagagatcagcgaccctcaggaagatgacgagtaactcccctcggggatatgacacatgcccatgatgagaagcagaacgtggtgacctttcacgaacatgggcatggctgcggatccctcgtcatcaggtgtatagcaagtgaaagcaagtgttcacaacagtgaaaagttgagcgtcatttttcttagtgtgccaagagttcgatgttagtgtttctgttgtattttgttacagtgtgccattctgttagatattagcgttttcactgatgagcaagacatacttaatgcatatttcagtttgtgtatccatgcacctacctcagaaaacaagtatcgtcaggtattctctgcatagaacaacactaccctcctctcttcccagatgtgaccactgagggcagttctgagtgtttaatttcagattttttcctctgcatttacacaaacacacacacatgccacacagacacacatgcgcgcgcgcgcgcacacacacacacacacacacacacacacacacacacaccaagtaccagtataggcatctcccaactgcttttccccatgtgtcctggtcaagcccccctcactctgtttcctgttcagcatgtactcccctcatccgattcccctctatcagtcactgccagttaataaacctttgcaaacgtt

SEQ ID NO: 7441 - DNA, 1158 bp, Homo sapiens
gtgtgaagtaagcaatctattttcacttgctattaacagcaaacgtacaactttatctcttatttgacttcattatttggctttcaaattaacaacatgaaaactatacagaaattagtctgtgccctataagacagagatttagataatttgttcaaaacatgagatgatattcagatattctctcaaaggcaggactccaacaccgcaggtggaaaaccaacaaaaggaagaaaacagaaaggaggaaagggaagatgaaagaccgacttcaagaactaaagcagagaacaaaggaaattgaactctctagagacagtcatgtatcaactacagaaacagaggaacaaggggtgtttctacagcaagctgttatttatgaaagagagcctgtagctgagagacacctacatgaaatccaaaaactacaggaaagtattaacaatttggcagataatgttcaaaaatttgggcagcaacagaaaagtctggtggcttcaatgagaaggtttagtctacttaagagagagtctaccattacaaaggagataaaaattcaggcagaatacatcaacagaagtttgaatgatttagttaaagaagttaaaaagtcagaggttgaaaatggtccatcttcagtggtcacaaggatacttaaatctcagcatgctgcaatgttccgccattttcagcaaatcatgtttatatacaatgacacaatagcagcaaagcaagagaagtgcaagacatttattttacgtcagcttgaagttgctggaaaagagatgtctgaagaagatgtaaatgatatgcttcatcaaggaaaatgggaagtttttaatgaaagcttacttacagaaatcaatatcactaaagcacaactttcagagattgaacagagacacaaggaacttgttaatttggagaaccaaataaaggatttaagggatcttttcattcagatatctcttttagtagaggaacaaggagagagcatcaacaatattgaaatgacagtgaatagtacaaaagagtatgttaacaatactaaagagaaatttggactagctgtaaaatacaaaaaaagaaatccttgcagagtactgtgttgttggtgctgtccatgctgtagctcaaaataaagaagctattttaaaa

SEQ ID NO: 7442 - DNA, 390 bp, Homo sapiens
atggagacagtggtcacaactctccccagagaaggtggtgtggggccatcacggaagatgctgctgcttctgctgcttctggggccaggctccgggcttagtgctgtcgtctctcaacatccgagcagggttatctgtaagagtggaacctctgtgaacatcgagtgccgttccctggactttcaggccacaactatgttttggtatcgtcagctccggaaacagagcctcatgctgatggcaacttccaatgagggctccgaggtcacatacgagcaaggcgtcaagaaggacaagtttcccatcaaccatccaaacctgaccttctccgctctgacagtgaccagtgcccatcctgaagacagcagcttctacatctgcagtgctaga

SEQ ID NO: 7443 - DNA, 342 bp, Homo sapiens
acgggcaccaggcttctcggctgggtagctctttgtctcctggcagcaggctgttttcatgccaaagtcacacagactccaggatatttggtcaaaggaaaaggaaggaaaacaaagatgtattgtacccccaaaaacggacatacttttgtttgttggtatcagcagaatcagaataaagagtttatgtttttgatttcctttcagaatgaacaagttcttcaagaaatggagatgcacaagaagcgattctcatctcaatgccccaagaacccaccctgcagcctggcaatcctgtcctcggaaccgggagacaccgcactgtatctctgtgccaccagt

SEQ ID NO: 7444 - DNA, 349 bp, Homo sapiens
ccccaactgtgccatgactatcaggttcctccgccaagtggccttttattttctggaggcaggccttaaggaagctgaaatctaccagaccccaagacaccgtgttataggggcaggaaagaagatcactctggaatgttctcaaaccatgggccatgacaaaatgtactggtcaagatccaggaatggaattacacctcatccaccattcctatgggttaattccacagagaagggagatctttgctctgagtcaacagtctccagaataaggatagagcgttttcccctgaccctggagtctgccagcccctcacatacctctcagtacctctgtgccagcagtgaa

SEQ ID NO: 7445 - DNA, 794 bp, Homo sapiens
cgcgctcgcgcacactacgccagaacaagatggccgacgcggcggccacagctggggccggtggctccggaacgagatcgggaagtaaacagtccactaaccctgccgataactatcatctggcccggaggagaaccctgcaggtggttgtgagctccttgctgacagaggcagggtttgagagtgccgagaaagcatccgtggaaacgctgacagagatgctgcagagctacatttcagaaattgggagaagtgccaagtcttactgtgagcacacagccaggacccagcccacactgtccgatatcgtggtcacacttgttgagatgggtttcaatgtggacactctccctgcttatgcaaaacggtctcagaggatggtcatcactgctcctccggtgaccaatcagccagtgacccccaaggccctcactgcagggcagaaccgaccccacccgccgcacatccccagccattttcctgagttccctgatccccacacctacatcaaaactccggtgagtgatgaagcactgggactgcgcgtggtgtaaagcacggagtcagttcctactgactgtcacgtggcagagtccagtccaaaagcttgttgatgaaagagtggttcaaaactcagaatgtggccgggcacattggctcacacctgtaatcccagcattttaggaggccgaggcaggaggatcacttgagcctgggagttcaagaccagcctgggcagcagagcaagaccctgtctcatttgaaaaataaataaataaagaaaaaaaaaagaa

SEQ ID NO: 7446 - DNA, 1805 bp, Homo sapiens
gcacactacgccagaacaagatggccgacgcggcggccacagctggggccggtggctccggaacgagatcgggaagtaaacagtccactaaccctgccgataactatcatctggcccggaggagaaccctgcaggtggttgtgagctccttgctgacagaggcagggtttgagagtgccgagaaagcatccgtggaaacgctgacagagatgctgcagagctacatttcagaaattgggagaagtgccaagtcttactgtgagcacacagccaggacccagcccacactgtccgatatcgtggtcacacttgttgagatgggtttcaatgtggacactctccctgcttatgcaaaacggtctcagaggatggtcatcactgctcctccggtgaccaatcagccagtgacccccaaggccctcactgcagggcagaaccgaccccacccgccgcacatccccagccattttcctgagttccctgatccccacacctacatcaaaactccgacgtaccgtgagcccgtgtcagactaccaggtcctgcgggagaaggctgcatcccagaggcgcgatgtggagcgggcacttacccgtttcatggccaagacaggcgagactcagagtcttttcaaagatgacgtcagcacatttccattgattgctgccagacctttcaccatcccctacctgacagctcttcttccgtctgaactggagatgcaacaaatggaagagacagattcctcggagcaggatgaacagacagacacagagaaccttgctcttcatatcagcatgatagagtctcgctccgtcacccaggctggagtgcagtggcaagatcttggctcactgcaacctccgcctcctgggttcaagcgattctccagcctcagcctcctgagtagctggaattacaggaggattctggagccgagaaggagaacacctctgtcctgcagcagaacccctccttgtcgggtagccggaatggggaggagaacatcatcgataacccttatctgcggccggtgaagaagcccaagatccgcaggaagaagccagatacattctagagaattgtgagactttgccctaagctgccaagtgctccccaaggagatcggtcaccaggagagcagccacaaaggtcaagaaagacacacacggaagcaaacccaggctctgtgctccttccagcccttgctggtgcagatgctaccccacaagcttgtcagatcgcccaggtgacgggccaggcgcagccatcgggaaggtcattcagccaacccagaggatgtagaccctgtcctcaagaagtgcagggcgagttctgccgtgccctctgaaatactctccctcctctcagagccctccctcgagagcctgagtgcaccatgtcttgtggcctcgcctgaagccttcctctggcttcacagaatgctctggaactctggggtctggtcagggagtgtgtcctcagcttgtctggaggaggcctgcatccctcctgagctcttggaggtgcccaggaaccctgcttctcctcacagggcctggccatatagccagctccaacccaaagccctgcacagtgcctcacccactcccttctcctggtctctcctcaaaagaattttacatgattttaaaataataatagctttcatttacatagtgcttacatttatatagcacttactatgtgcgatgtactaatttaagtactttatattaactcatataataaatggacacaacacaaaactcaaaaggtacaaaagaataaaacagttaaaaact

SEQ ID NO: 7447 - DNA, 1293 bp, Homo sapiens
gcacactacgccagaacaagatggccgacgcggcggccacagctggggccggtggctccggaacgagatcgggaagtaaacagtccactaaccctgccgataactatcatctggcccggaggagaaccctgcaggtggttgtgagctccttgctgacagaggcagggtttgagagtgccgagaaagcatccgtggaaacgctgacagagatgctgcagagctacatttcagaaattgggagaagtgccaagtcttactgtgagcacacagccaggacccagcccacactgtccgatatcgtggtcacacttgttgagatgggtttcaatgtggacactctccctgcttatgcaaaacggtctcagaggatggtcatcactgctcctccggtgaccaatcagccagtgacccccaaggccctcactgcagggcagaaccgaccccacccgccgcacatccccagccattttcctgagttccctgatccccacacctacatcaaaactccgacgtaccgtgagcccgtgtcagactaccaggtcctgcgggagaaggctgcatcccagaggcgcgatgtggagcgggcacttacccgtttcatggccaagacaggcgagactcagagtcttttcaaagatgacgtcagcacatttccattgattgctgccagacctttcaccatcccctacctgacagctcttcttccgtctgaactggagatgcaacaaatggaagagacagattcctcggagcaggatgaacagacagacacagagaaccttgctcttcatatcagcatggaggattctggagccgagaaggagaacacctctgtcctgcagcagaacccctccttgtcgggtagccggaatggggaggagaacatcatcgataacccttatctgcggccggtgaagaagcccaagatccgcaggaagaagccagatacattctagagaattgtgagactttgccctaagctgccaagtgctccccaaggagatcggtcaccaggagagcagccacaaaggtcaagaaagacacacacggaagcaaacccaggctctgtgctccttccagcccttgctggtgcagatgctaccccacaagcttgtcagatcgcccaggtgacgggccaggcgcagccatcgggaaggtcattcagccaacccagaggatgtagaccctgtcctcaagaagtgcagggcgagttctgccgtgccctctgaaatactctccctcctctcagagccctccctcgagagcctgagtgcaccatgtcttgtggcctcg

SEQ ID NO: 7448 - DNA, 2402 bp, Homo sapiens
gcacactacgccagaacaagatggccgacgcggcggccacagctggggccggtggctccggaacgagatcgggaagtaaacagtccactaaccctgccgataactatcatctggcccggaggagaaccctgcaggtggttgtgagctccttgctgacagaggcagggtttgagagtgccgagaaagcatccgtggaaacgctgacagagatgctgcagagctacatttcagaaattgggagaagtgccaagtcttactgtgagcacacagccaggacccagcccacactgtccgatatcgtggtcacacttgttgagatgggtttcaatgtggacactctccctgcttatgcaaaacggtctcagaggatggtcatcactgctcctccggtgaccaatcagccagtgacccccaaggccctcactgcagggcagaaccgaccccacccgccgcacatccccagccattttcctgagttccctgatccccacacctacatcaaaactccgacgtaccgtgagcccgtgtcagactaccaggtcctgcgggagaaggctgcatcccagaggcgcgatgtggagcgggcacttacccgtttcatggccaagacaggcgagactcagagtcttttcaaagatgacgtcagcacatttccattgattgctgccagacctttcaccatcccctacctgacagctcttcttccgtctgaactggagatgcaacaaatggaagagacagattcctcggagcaggatgaacagacagacacagagaaccttgctcttcatatcagcatgatagagtctcgctccgtcacccaggctggagtgcagtggcaagatcttggctcactgcaacctccgcctcctgggttcaagcgattctccagcctcagcctcctgagtagctggaattacaggaggattctggagccgagaaggagaacacctctgtcctgcagcagaacccctccttgtcgggtagccggaatggggaggagaacatcatcgataacccttatctgcggccggtgaagaagcccaagatccgcaggaagaagtccctctcctgagctgagaaggaaacctggcttgtacaggggcgcagattccaccctcccggggagttaaagccactcaagggaagaagagggtgacctcctcatggccaagccgaggctgcagggtgtgatcggacatgattttcatggcaaaccgtcttattaagatgacctattttcactggatgtttgggttgaggaagatatgaacagaataatgagaatttttttttttattttgagatggagtcttactctatcacccaggctggaatgcagtggtgtgatctcagctcactgcagtctcagcaaccctgggtccaagtgattctcctgccttggcctcccgagtagctgggactagaggcaagcgccaccatgctggctaatttttgtattttgagtagagatagggtttcgccatgttggccaggctggtcttgaactcctgacctcaagtgatccacccgcattggcctcccaaagagttgcgattacaggtgtgagccaccacgcccagctaatttttgtatttttaatagagataaggtttcgccatgttggccaggctggtcttgaactcctgacctcaagtgataacccgcctcggcctcccaaagtgctgagattacaggcgtgagccaccgcaccccaccagagactttcttaatcaatcaggctatgtggtggggcatagcagcagccagtgacttcgttcattatcacaggatttgattcctttgaaactcaagagaccagggaaagtgacaggaaggaaagggctctttgctgctgtgcttattacaaggaagactgtttgtccagcgtgtatttcaggatatctggatcccttttattgactcacaatttgtggcaccactttctcatcccagaacttcattcttatttctctcctcatctggcctcccaagtgctccgttgagctgatgaaaagttctttgtactccctcaacgtgtcggaaacaggaggccacacagcacagctttgtttggggtgggcaggagtcaggagtcttgagcagatgcatcactgtgaagaagaacgacatgtcggggctgcacctgtcctcccgtcggcatttgacgaaagctccctgaagcggggcagcactctcctcctgagagatttaccatttattgcccctgtgaggaatgtgtgcttgggaactgccaagtcttaccccttctggaagaagaggttttctctgacaagagcctagagcgtcggctctattatgctgggacttgacagaggagccatggggtttaaacagtaggaaagaggggctacgcgcagtggctcacgcctgtaatccca

SEQ ID NO: 7449 - DNA, 1283 bp, Homo sapiens
gcggctgggccgccggggcaggctaggggcgccgcggtgggcttcggggcctttggggccgtgggcttttgctgccgcccgccccttccggctcctccctgtagagcaaagggcacgtgagcgaggcgcccgaagccgtcgcggcggggaccatgttgcttccgaacatcctgctcaccggtacaccaggggttggaaaaaccacactaggcaaagaacttgcgtcaaaatcaggactgaaatacattaatgtgggtgatttagctcgagaagtctgatcatcggatatcatggagtctggcaagacggcttctcccaagagcatgccgaaagatgcacagatgatggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacccctttgccattgatcaagccatattcaggtcctaggttgccacctgatagatactgcttaacagctccaaactataggctgaaatctttacagaaaaaggcatcaacttctgcgggaagaataacagtcccgcggttaagtgttggttcagttactagcagaccaagtactcccacactaggcacaccaaccccacagaccatgtctgtttcaactaaagtagggactcccatgtccctcacaggtcaaaggtttacagtacagatgcctacttctcagtctccagctgtaaaagcttcaattcctgcaacctcagcagttcagaatgttctgattaatccatcattaatcgggtccaaaaacattcttattaccactaatatgatgtcatcacaaaatactgccaatgaatcatcaaatgcattgaaaagaaaacgtgaagatgatgatgatgacgatgatgatgatgatgactatgataatctgtaatctagccttgctgaatgtaacatgtatacttggtcttgaattcattgtactgatattaaacatgcatgctggatgttttcaagttgtgttttagaaaactaataataatgagtaaacacagttaccatacttttcaattgaaatgaaggtttttcatcagccttaaaagtgtaagaaaaataaagttgtcattcattc

SEQ ID NO: 7450 - DNA, 2281 bp, Homo sapiens
gggggcaagtgtcagtcaggacgggagtccggcgggttacagcggaggcctaggtggcagacagggggcccgggccgctgcgtgttgtccacccaagatggagttcctcctggggaacccgttcagcacaccagtggggcagtgcctcgaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagcatgggctgatgcctttcgaagcagtcctgatctcaccggcgttgtgcacatatatgaggagctgaagaggaaaggggttgaatttcccatggcagacttggacgctctgtctcccatacacacaccacagcggagtgtccctgaagtggatccagctgcgaccatgcccaggtcccaatcacagcagaggacaagtgctggttcctattcctcgccgcctcctgctccctactccgcaccgcaggccccagctctgagtgtgactggccccatcacagccaattcagaacagattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggttcgaacgatacaggtctggccgatccgttcaaaatgccagtaatggagtactgaatgaagtaaccgaagacaacttaatagacctggggccagggtctccagccgtggtgagcccaatggtggggaacacagcgcccccatcttccctctcctcccagcttgcaggcttagacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggatccccgttgcgcagccatctgtcatggacgacattgaggtgtggctcaggaccgacctgaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtgagcagctctgtggtttgcctccccagatggcgggtccccgctcgcaccccgtggacaccgggcactggccactcctacatccccagctccacacggcctgcacacctgtgtttccatggaaatgccaccgtgtctgctcccaggcctcccactagtcaggaccagcttcagccacttcttttctctgagtggtgggacaactgcagccagagactctctcccctcccaccatgggcccctctgcccatgtttcctcccaggaagagcgggcagagtggcccagccccaggcagtgcttcctgagcagaccacccggactgtctttcctccacccgcccatggagaaagagcacgcccggccccgccctgtgctcacctctgcctggctcagcgaccttctcaggcattctgccctcctgggcccctctctccctgaaggggctttgtggcatctctggaagagcagggtgtgctgcactcatgggcctggtctcactccttggacttgtcaccttgtgacatttggcttatcagcatttgagaaggctctgctgggtctccatggtgggggtctctcaccttcttgaccctctctccatcattcagctgccagcccaggcttcacacccaagctggctcagcagccgagcctggcaccgagggtccctgcaggctccctgggcagggagagggccaaggacaattgggagggcagcaggcagcccgcagatggtggccatgtggcacgctgctgagacgacactaccaataaaccaaactgccacgcacacactgcaggctcacacccgca

SEQ ID NO: 7451 - DNA, 2418 bp, Homo sapiens
agtcaggacgggagtccggcgggttacagcggaggcctaggtggcagacagggggcccgggccgctgcgtgttgtccacccaagatggagttcctcctggggaacccgttcagcacaccagtggggcagtgcctcgaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagtgctggagacatgtgtgaagaactgtggccaccgcttccacatccttgtggccaaccgagatttcatcgacagtgttctggtcaaaattatatctcccaagaacaaccctcccaccattgtacaggacaaagtgcttgctctgatccaggcatgggctgatgcctttcgaagcagtcctgatctcaccggcgttgtgcacatatatgaggagctgaagaggaaaggggttgaatttcccatggcagacttggacgctctgtctcccatacacacaccacagcggagtgtccctgaagtggatccagctgcgaccatgcccaggtcccaatcacagcagaggacaagtgctggttcctattcctcgccgcctcctgctccctactccgcaccgcaggccccagctctgagtgtgactggccccatcacagccaattcagaacagattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggttcgaacgatacaggtctggccgatccgttcaaaatgccagtaatggagtactgaatgaagtaaccgaagacaacttaatagacctggggccagggtctccagccgtggtgagcccaatggtggggaacacagcgcccccatcttccctctcctcccagcttgcaggcttagacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggatccccgttgcgcagccatctgtcatggacgacattgaggtgtggctcaggaccgacctgaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtgagcagctctgtggtttgcctccccagatggcgggtccccgctcgcaccccgtggacaccgggcactggccactcctacatccccagctccacacggcctgcacacctgtgtttccatggaaatgccaccgtgtctgctcccaggcctcccactagtcaggaccagcttcagccacttcttttctctgagtggtgggacaactgcagccagagactctctcccctcccaccatgggcccctctgcccatgtttcctcccaggaagagcgggcagagtggcccagccccaggcagtgcttcctgagcagaccacccggactgtctttcctccacccgcccatggagaaagagcacgcccggccccgccctgtgctcacctctgcctggctcagcgaccttctcaggcattctgccctcctgggcccctctctccctgaaggggctttgtggcatctctggaagagcagggtgtgctgcactcatgggcctggtctcactccttggacttgtcaccttgtgacatttggcttatcagcatttgagaaggctctgctgggtctccatggtgggggtctctcaccttcttgaccctctctccatcattcagctgccagcccaggcttcacacccaagctggctcagcagccgagcctggcaccgagggtccctgcaggctccctgggcagggagagggccaaggacaattgggagggcagcaggcagcccgcagatggtggccatgtggcacgctgctgagacgacactaccaataaaccaaactgccacgcacacactgcaggctcacacccgca

SEQ ID NO: 7452 - DNA, 1766 bp, Homo sapiens
aagtgtcagtcaggacgggagtccggcgggttacagcggaggcctaggtggcagacagggggcccgggccgctgcgtgttgtccacccaagatggagttcctcctggggaacccgttcagcacaccagtggggcagtgcctcgaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagtgctggagacatgtgtgaagaactgtggccaccgcttccacatccttgtggccaaccgagatttcatcgacagtgttctggtcaaaattatatctcccaagaacaaccctcccaccattgtacaggacaaagtgcttgctctgatccagagtgtccctgaagtggatccagctgcgaccatgcccaggtcccaatcacagcagaggacaagtgctggttcctattcctcgccgcctcctgctccctactccgcaccgcaggccccagctctgagtgtgactggccccatcacagccaattcagaacagattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggttcgaacgatacaggtctggccgatccgttcaaaatgccagtaatggagtactgaatgaagtaaccgaagacaacttaatagacctggggccagggtctccagccgtggtgagcccaatggtggggaacacagcgcccccatcttccctctcctcccagcttgcaggcttagacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggatccccgttgcgcagccatctgtcatggacgacattgaggtgtggctcaggaccgacctgaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtgagcagctctgtggtttgcctccccagatggcgggtccccgctcgcaccccgtggacaccgggcactggccactcctacatccccagctccacacggcctgcacacctgtgtttccatggaaatgccaccgtgtctgctcccaggcctcccactagtcaggaccagcttcagccacttcttttctctgagtggtgggacaactgcagccagagactctctcccctcccaccatgggcccctctgcccatgtttcctcccaggaagagcgggcagagtggcccagcccc

SEQ ID NO: 7453 - DNA, 1748 bp, Homo sapiens
agagtggggagggggcaagtgtcagtcaggacgggagtccggcgggttacagcggaggcctaggtggcagacagggggcccgggccgctgcgtgttgtccacccaagatggagttcctcctggggaacccgttcagcacaccagtggggcagtgcctcgaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagtgctggagacatgtgtgaagaactgtggccaccgcttccacatccttgtggccaaccgagatttcatcgacagtgttctggtcaaaattatatctcccaagaacaaccctcccaccattgtacaggacaaagtgcttgctctgatccaggcatgggctgatgcctttcgaagcagtcctgatctcaccggcgttgtgcacatatatgaggagctgaagaggaaaggggttgaatttcccatggcagacttggacgctctgtctcccatacacacaccacagcggattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggttcgaacgatacaggtctggccgatccgttcaaaatgccagtaatggagtactgaatgaagtaaccgaagacaacttaatagacctggggccagggtctccagccgtggtgagcccaatggtggggaacacagcgcccccatcttccctctcctcccagcttgcaggcttagacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggacttttctgtcctcggcccagaagagaggtagaggtggggagtctgacctggagcccatagacagctggcttataacccaaggaatgatccccgttgcgcagccatctgtcatggacgacattgaggtgtggctcaggaccgacctgaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtgagcagctctgtggtttgcctccccagatggcgggtccccgctcgcaccccgtggacaccgggcactggccactcctacatccccagctccacacggcctgcacacctgtgtttccatggaaatgccaccgtgtctgctcccaggcctcccactagtcaggaccagcttcagccacttcttttctctgagt

SEQ ID NO: 7454 - DNA, 991 bp, Homo sapiens
agagacgcggcaagggggcggggccaaaggccctaagctcggcgttccagagagtggggagggggcaagtgtcagtcaggacgggagtccggcgggttacagcggaggcctaggtggcagacagggggcccgggccgctgcgtgttgtccacccaagatggagttcctcctggggaacccgttcagcacaccagtggggcagtgcctcgaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagcatgggctgatgcctttcgaagcagtcctgatctcaccggcgttgtgcacatatatgaggagctgaagaggaaaggggttgaatttcccatggcagacttggacgctctgtctcccatacacacaccacagcggagtgtccctgaagtggatccagctgcgaccatgcccaggtcccaatcacagcagaggacaagtgctggttcctattcctcgccgcctcctgctccctactccgcaccgcaggccccagctctgagtgtgactggccccatcacagccaattcagaacagattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggtgggagccggatttctttttttttttttttcttgaaaagattgttgccataacagagggatttctttcataa

SEQ ID NO: 7455 - DNA, 1420 bp, Homo sapiens
agtcaggacgggagtccggcgggttacagcggaggcctaggtggcagacagggggcccgggccgctgcgtgttgtccacccaagatggagttcctcctggggaacccgttcagcacaccagtggggcagtgcctcgaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagtgctggagacatgtgtgaagaactgtggccaccgcttccacatccttgtggccaaccgagatttcatcgacagtgttctggtcaaaattatatctcccaagaacaaccctcccaccattgtacaggacaaagtgcttgctctgatccagattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggttcgaacgatacaggtctggccgatccgttcaaaatgccagtaatggagtactgaatgaagtaaccgaagacaacttaatagacctggggccagggtctccagccgtggtgagcccaatggtggggaacacagcgcccccatcttccctctcctcccagcttgcaggcttagacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtgagcagctctgtggtttgcctccccagatggcgggtccccgctcgcaccccgtggacaccgggcactggccactcctacatccccagctccacacggcctgcacacctgtgtttccatggaaatgccaccgtgtctgctcccaggcctcccactagtcaggaccagct

SEQ ID NO: 7456 - DNA, 1320 bp, Homo sapiens
gtcagtcaggacgggagtccggcgggttacagcggaggcctaggtggcagacagggggcccgggccgctgcgtgttgtccacccaagatggagttcctcctggggaacccgttcagcacaccagtggggcagtgcctcgaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacaattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggttcgaacgatacaggtctggccgatccgttcaaaatgccagtaatggagtactgaatgaagtaaccgaagacaacttaatagacctggggccagggtctccagccgtggtgagcccaatggtggggaacacagcgcccccatcttccctctcctcccagcttgcaggcttagacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggacttttctgtcctcggcccagaagagaggtagaggtggggagtctgacctggagcccatagacagctggcttataacccaaggaatgatccccgttgcgcagccatctgtcatggacgacattgaggtgtggctcaggaccgacctgaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtgagcagctctgtggtttgcctccccagatggcgggtccccgctcgcaccccgtggacaccgggcactg

SEQ ID NO: 7457 - DNA, 5592 bp, Homo sapiens
gggggcaagtgtcagtcaggacgggagtccggcgggttacagcggaggcctaggtggcagacagggggcccgggccgctgcgtgttgtccacccaagatggagttcctcctggggaacccgttcagcacaccagtggggcagtgcctcgaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagcatgggctgatgcctttcgaagcagtcctgatctcaccggcgttgtgcacatatatgaggagctgaagaggaaaggggttgaatttcccatggcagacttggacgctctgtctcccatacacacaccacagcggagtgtccctgaagtggatccagctgcgaccatgcccaggtcccaatcacagcagaggacaagtgctggttcctattcctcgccgcctcctgctccctactccgcaccgcaggccccagctctgagtgtgactggccccatcacagccaattcagaacagattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggttcgaacgatacaggtctggccgatccgttcaaaatgccagtaatggagtactgaatgaagtaaccgaagacaacttaatagacctggggccagggtctccagccgtggtgagcccaatggtggggaacacagcgcccccatcttccctctcctcccagcttgcaggcttagacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggatccccgttgcgcagccatctgtcatggacgacattgaggtgtggctcaggaccgacctgaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtgagcagctctgtggtttgcctccccagatggcgggtccccgctcgcaccccgtggacaccgggcactggccactcctacatccccagctccacacggcctgcacacctgtgtttccatggaaatgccaccgtgtctgctcccaggcctcccactagtcaggaccagcttcagccacttcttttctctgagtggtgggacaactgcagccagagactctctcccctcccaccatgggcccctctgcccatgtttcctcccaggaagagcgggcagagtggcccagccccaggcagtgcttcctgagcagaccacccggactgtctttcctccacccgcccatggagaaagagcacgcccggccccgccctgtgctcacctctgcctggctcagcgaccttctcaggcattctgccctcctgggcccctctctccctgaaggggctttgtggcatctctggaagagcagggtgtgctgcactcatgggcctggtctcactccttggacttgtcaccttgtgacatttggcttatcagcatttgagaaggctctgctgggtctccatggtgggggtctctcaccttcttgaccctctctccatcattcagctgccagcccaggcttcacacccaagctggctcagcagccgagcctggcaccgagggtccctgcaggctccctgggcagggagagggccaaggacaattgggagggcagcaggcagcccgcagatggtggccatgtggcacgctgctgagacgacactaccaataaaccaaactgccacgcacacactgcaggctcacacccgcacacctggtcctggcttgtggagggacttgcactggaggtattgctctggcttgcctggggaagtgtcacagatgtgcacatgggccacactcagtgctgtggcctggcctgccgtagcctcacacatctgcctcaagagccagcagcaaacagctttgtggcatccttggaggttcccagtgactgagaggcctgggcagcactaaggcccctgctctgctccctggcataggccttggcctccttgcacagactctcctgacagtctggcctcctcccacctcagaggtcctctggccaccaatttatactctctccccaagctgatcctgaaggcaggcagagcagctaggggctggtaacatgtattcccatcccgtgtcctcactggtgtgtctcctggccatgggcaagggactcgggtcatcccaggccctggtccagccagacacctggccccacacctcccaccaggctgctgttgctcagaaggagaatactgcagctgtatgcatccccgtgtgtcttgggcccagctcgctgggtcagtctgctcctgtcccctccagcatgcactgcctaggtcagcacaggttcctgatccatggtgtagttagcccttcccacctggcaggacggcccagaccaccagccaagcagggaaagggggctgggcttgacgggagaagagaccagcgacatggtcgttggggagcattcaggatggcgacttcagctgggggtcatgctgagcaccaacaggaactattccagtgaagagcaagtgctgcccgacccaggaccctgtgccaggctagcagccctccagctccctccagagaggaaacctctgtctggctgagggtgggactagctgggatgtctcactccagttgctcaggttcacccaggaagctcctccgtggagtggccagcctgattctagccctgtcctctctggcagcacatgccacacctgcctgggccttctgctccctgatgcttgatgagcccctgcctcctcaatgtttctcaaagacagacccccctgaggccagcttgaatgtgaagactgctgaagttagctggcttcacttgagctgcagaaaaggtggctgggatggcccaggtgcacccagaggccccagccctttggctgcctttgggttgtgacttgggttgtctctgaggccctgccagagctgggcctgcgggtggtgggcggtccgacctcgggcagtcagtgctccgcagcctcagcactgcatcccagacccagtgtcctcagagggaagagccagcctccctgcctcatggaaccaggagtcccaaaaagtcaggagcctggaggctctgaaaggagcagggattccatagtgcgtgaagctgaaataggcgccctcctggggagcccccagcaaaactgtttttcatacccactcccagaactgccccgctccagctccagcgccagcgccagctggttgccaggcatcattggagaggcctggctgccccaggggcagcagggagtggtggacctgtatgggctggcaggaggccattggccatgctgacaagtgtcacctgccttcctagcctggagccacccctcaggtggcctgcttgcacctcctatccggaggtagcctgccccacctgtaggcagagggggctcttgcttgaggcctgcacaggaagcaagtatagccccggtgccccagagtgggttccacttagccctggcgagatggcctgtcctgagatctctgctcccagaccccaccatctggggagcacagtccttaggctgcctggtccaggaagggggtgcggctctgtcaggaaacctggactctcaaggcccaccagcctctccgtgagtgttagaaatcacagatacagtatatacttaattacactaaattattgctgggattccttataagcactaattatacctgattataggttaaaatatttattttgtcaaaatattttcttgggaatgtgtttaaccctttctgcgttcattgttgctgagatgtgaaaactaaccattccctcctgcctacctttttggccactgggcggcagagaatggcgctatgtgcagttgggcccctggcaccatgggcctttggcctgcctgctgcagagtagccctgcctgggcagtctccaggcactgagcaggccatctgtggccaggctgagagaatgactggctcgcttaccagcgtgcatgggacaaggagctttggagcctcaaggggttgttgctggcctgggctagagggaaaggtgaccatccgtctgtcctcctgtctttctattagcgcctccatgtgagtgatggtgccttggttcactagccttcccccaccaccccaccatgccacctggtggtcttggggcctgtgctgtcactccagcccctggggaggagaggacccagcccggagagttggggcaagggctccacatggcccaagggcaacagatgctcgcagggcagctgctgccgatgctcacgctcctgcccccctccttcccgctgccacaccccaccctgggcccccgcagacacgcatctctaactcagttgggcccagccttctggatggcttggggtaggccatgggcccacctggggccaggccagcccctggggcagctctggaagagcagtgtggaggagcacttgcttgcagcctggcttcagcctctggcactgctggagtggtccctgggagcttctgcactgtcggctttggggacgtctcacccacttgggttacagtaggccttccccacccagagagaagtgtttccaccccagagacattgtctgtcagcccctgaagtgctcgcctcccccagtgcccgtcaccagcccttcctatctgtggggtccaagtcaggcttcccctgcggccaccagccatagggagcagccatcagcccccgagtcagaactgcttctgtctgtccatacctccaggctctcccggagagggggacggatatttatttcctaaagtttgcacttaattgtgaggattctcaggattgttgggggctactgaaaagaggaatgtgttgaatgtcgcgtttgctgtccactcgtcctagaagtttagtgtttttgtcactgtcatgtgtttctgtgggcagagctggttctggagggtgggtcagtgcacccgaggctcagagcatccatccaccccactggccctccttccagataccctctctctaattgggttcttgcatgtaaaatactccacaataaataaataattgaac

SEQ ID NO: 7458 - DNA, 2977 bp, Homo sapiens
gtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaacatctcctaccgtaatgccctgcggaaaaaacttcattcttcttcctctgtgccaaattttctaaaatttctggctcctgtagatgaaaataacacctctgattttatgaacacaaaaagggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactgacagctctgcaggagagattgcaacaccatcccacactgtccaggccttaactgagagggacagaagacgctggaaggagagaaggaagcgggaagtgtgcttctcagggaggaaaccggcttgccagcaagtagattcttacgaactccaacttgcaattcagggggcatgtcccagtgttttttttgttgtttttagatactaaatcgtcccttctccagtcctgattactgtacacagtagctttagatggcgtggacgtgaataaatgcaacttatgttttcttgttggttcctttttgagtgtcactgtgtttgtaaagagcattcacaatacggtggaatttcaaaagctggaagagctcgagatcatgcctcaggcaaaggcgtgggtccatcgttcttccg

SEQ ID NO: 7459 - DNA, 5383 bp, Homo sapiens
tcctcacttctcagaccgggcagccggtcagagacgctcctcacctcccagacggggtggcggcggggcagagacactcctcagttcccagacagggtcgcggccgggcagaggcgctcttcacatctcagacggggcgacggggcagagatgctccccacatcccagatgatgggcggctgggcagagacgctcctcacttcctagacaggatgacggccgggaagaggccagggctggtcctgctgcgaacggactacccattagcagcgcaggccaggtcctctctcctggaggcaagttagagaaggaagacccctacgatcgcaatcggcgatccccgagtgagtgacccgccacgacgtcactcacatgaagcggaggaccacgggttccgagacagccacagcaggaagcatattatcttagaagacctaggactccaaaaatgtttcccctgaaggacgctgaaatgggagcctttaccttctttgcctcggctctgccacatgatgtttgtggaagcaatggacttcctctcacaccaaattccatcaaaattttagggcgctttcaaatccttaaaaccatcacccatcccagactctgccagtatgtggatatttctaggggaaagcatgaacgactagtggtcgtggctgaacattgtgaacgtagtctggaagacttgcttcgagaaaggaaacctgtgagctgttcaacggttttgtgtatagcatttgaggttcttcagggcttgcagtatatgaacaaacatggtatagtacacagggcattgtctcctcataatatcctgttggaccgaaagggacatattaaattggctaaatttggactttatcacatgacagctcatggtgatgatgttgatttcccaatagggtatccctcgtacttggcccctgaggtaattgcacagggaattttcaaaaccactgatcacatgccaagtaaaaaaccattgccttctggccccaaatcagatgtatggtctcttggaatcattttatttgagctttgtgtgggaagaaaattatttcagagcttggatatttctgaaagactaaaatttttgcttactttggattgtgtagatgacactttaatagttctggctgaagagcatggttgtttggacattataaaggagcttcctgaaactgtgatagatcttttgaataagtgccttaccttccatccttctaagaggccaaccccagatcaattaatgaaggacaaagtattcagtgaggtatcacctttatataccccctttaccaaacctgccagtctgttttcatcttctctgagatgtgctgatttaactctgcctgaggatatcagtcagttgtgtaaagatataaataatgattacctggcagaaagatctattgaagaagtgtattacctttggtgtttggctggaggtgacttggagaaagagcttgtcaacaaggaaatcattcgatccaaaccacctatctgcacactccccaattttctctttgaggatggtgaaagctttggacaaggtcgagatagaagctcgcttttagatgataccactgtgacattgtcgttatgccagctaagaaatagattgaaagatgttggtggagaagcattttacccattacttgaagatgaccagtctaatttacctcattcaaacagcaataatgagttgtctgcagctgccacgctccctttaatcatcagagagaaggatacagagtaccaactaaatagaattattctcttcgacaggctgctaaaggcttatccatataaaaaaaaccaaatctggaaagaagcaagagttgacattcctcctcttatgagaggtttaacctgggctgctcttctgggagttgagggagctattcatgccaagtacgatgcaattgataaagacactccaattcctacagatagacaaattgaagtggatattcctcgctgtcatcagtacgatgaactgttatcatcaccagaaggtcatgcaaaatttaggcgtgtattaaaagcctgggtagtgtctcatcctgatcttgtgtattggcaaggtcttgactcactttgtgctccattcctatatctaaacttcaataatgaagccttggcttatgcatgtatgtctgcttttattcccaaatacctgtataacttcttcttaaaagacaactcacatgtaatacaagagtatctgactgtcttctctcagatgattgcatttcatgatccagagctgagtaatcatctcaatgagattggtttcattccagatctctatgccatcccttggtttcttaccatgtttactcatgtatttccactacacaaaattttccacctctgggataccttactacttgggaattcctctttcccattctgtattggagtagcaattcttcagcagctgcgggaccggcttttggctaatggctttaatgagtgtattcttctcttctccgatttaccagaaattgacattgaacgctgtgtgagagaatctatcaacctgttttgttggactcctaaaagtgctacttacagacagcatgctcaacctccaaagccatcttctgacagcagtggaggcagaagttcggcaccttatttctctgctgagtgtccagatcctccaaagacagatctgtcaagagaatccatcccattaaatgacctgaagtcagaagtatcaccacggatttcagcagaggacctgattgacttgtgtgagctcacagtgacaggccacttcaaaacacccagcaagaaaacaaagtccagtaaaccaaagctcctggtggttgacatccggaatagtgaagactttattcgtggtcacatttcaggaagcatcaacattccattcagtgctgccttcactgcagaaggggagcttacccagggcccttacactgctatgctccagaacttcaaagggaaggtcattgtcatcgtggggcatgtggcaaaacacacagctgagtttgcagctcaccttgtgaagatgaaatatccaagaatctgtattctagatggtggcattaataaaataaagccaacaggcctcctcaccatcccatctcctcaaatatgaagaaccaagagtgtgactgccaaaacttagtgtggcatcagcaccaacagcacagttcttcatatccacgccactctcagacaaaactagatgtccagattgttgcatttccgtaaagtttgtcacgagacattttttaaaatctcataacccacatgttcagttatccatgcaagaaacttgactctacatgtattgctgaaagaattttcttaacagtgaaatctgatcatatatttttaccacactgccacataaagcccaagaaattcagctgacaagacagatttagcattatcaagaaatcccatttgccctgaaaaagctgtcctccattgtactgaacagacagtcctgtcgattgtgttatttagaaacatacactgaatgtgggctgaaatcatcatctttccataatgaaaactgagaaactattcacaatgcattccttataaataaatgctacatttagtaactcatttcacccaaacaagggggatgtgtgtgtgtgtgtgtgtataggaagtggagtttatcccattgcagaaagtggtaatacttactcccagaaaaatgaaatttagaaaccatttatatttgatagaatatttggtcagttcctgtagcaaagacgaatggcttaaacaaattttctagtttctttatcacatgaaagtctgtacagtcagtccagggctagtctactggtttcctgatcattaagaactcattaccttctctcattgctttacaaacctcaatatgtggcatccatctcatggatgaaaatggctcctcagcttctaccatcacatctgctatctagaaggaagagaatgagggaaggagggaggggatgaagagaaaagaaggaacaaaagaaggagggaggaaagaagaaaagaaaggaaaagaagcgaagcacactccttccctttaaggtcataaaccagaagttgcgcacactacctctgcttacatatcattggccagaacttgggtgcatggccacacctagctttaaggaaaactggaaatagagtctttgggtggttgatcatttccccagctaaaaacattcttattactgtgtgggaagaagagagtacatattgaggtacagctaacaacctctgcctctgccacattgtttttaaaatgagtattatatttcattaaatctaagacatctcacaattttaggtaccacaaagaaaaaatgaagccaaatgaattgtgacactttgtcaattaaaagacacattccctgggaggccgaggtcaggagtttgagaccagcctggccaacatggggaaactttgtctctactaaaaatataaaaattagctggtcatagtggcacacgtctgcggtcccagctactcaggaggctgaggcaggagaatcacttgaacctgagaggcagaggttgcaatgagccatgatagggccactgtaccccagcctgggcaacagggctcaccctgccatctcaaaaaaaaaaaaaaaaagaaagatacattcccatttcagaaatctgaaaaaaaaaatgcctcatatatatgaaatatagcatatcctttaattatcttcaattttgttttaactaaaaagtgttcattcatctataacttacattccactccaatgttaagactgcctaggcagaacatttcaataagagcctcaattcagctttctgggccatggttttgttgttgctgctattgtttactttattttattttttctttgcatctactttttaaattgagatatacttaaccataaaattcatccttttaacatgtacagttcagtagtttttagtgtattcacaaagttgtgcaatcagtattatccagaatactttcattgtatgcaattgtctacctgatcagcaggtattccacattaacccctcctaaggtctttgataaatttttgtatatggagtgaggggtccaggttcattcttgcatatgagtatccagttgtcccaggacccctcctgttttgtttgttttattcaatttatttggtcattcaccaaatatgttttgaatacctactatgtatttctaagacactaatataatccatagttatatcatttgtgatccttacctagtttacaaggaaaaaaatgtgagaattaatgagaacaaatatataccaagatttcactaacattgtttttgggccattgtctaccctcttcagagaaatattaaatcctcctgtcctggcaa

SEQ ID NO: 7460 - DNA, 3312 bp, Homo sapiens
aggccaggctgaggggagggtagagggtgaaaagctcggatctgtgtttggggaaggccaggcttgcgctcctcgccgggttccgcgaaggttaaccttggctgacttggctcgcgagcaaagggcagcgtctgagctcccggcgttccaggagtggcctcttttgtaggagcacctgaaatgcagcgtctggtgcactaagccgtagcggcagcagcagccacagcgacagcgctggggccctgtgtagaagctccatcccccttgtctttgtgcttgcctgcgtccccagactcagagattatcttagaagacctaggactccaaaaatgtttcccctgaaggacgctgaaatgggagcctttaccttctttgcctcggctctgccacatgatgtttgtggaagcaatggacttcctctcacaccaaattccatcaaaattttagggcgctttcaaatccttaaaaccatcacccatcccagactctgccagtatgtggatatttctaggggaaagcatgaacgactagtggtcgtggctgaacattgtgaacgtagtctggaagacttgcttcgagaaaggaaacctgtgaggtatccctcgtacttggcccctgaggtaattgcacagggaattttcaaaaccactgatcacatgccaagtaaaaaaccattgccttctggccccaaatcagatgtatggtctcttggaatcattttatttgagctttgtgtgggaagaaaattatttcagagcttggatatttctgaaagactaaaatttttgcttactttggattgtgtagatgacactttaatagttctggctgaagagcatggttgtttggacattataaaggagcttcctgaaactgtgatagatcttttgaataagtgccttaccttccatccttctaagaggccaaccccagatcaattaatgaaggacaaagtattcagtgaggtatcacctttatataccccctttaccaaacctgccagtctgttttcatcttctctgagatgtgctgatttaactctgcctgaggatatcagtcagttgtgtaaagatataaataatgattacctggcagaaagatctattgaagaagtgtattacctttggtgtttggctggaggtgacttggagaaagagcttgtcaacaaggaaatcattcgatccaaaccacctatctgcacactccccaattttctctttgaggatggtgaaagctttggacaaggtcgagatagaagctcgcttttagatgataccactgtgacattgtcgttatgccagctaagaaatagattgaaagatgttggtggagaagcattttacccattacttgaagatgaccagtctaatttacctcattcaaacagcaataatgagttgtctgcagctgccacgctccctttaatcatcagagagaaggatacagagtaccaactaaatagaattattctcttcgacaggctgctaaaggcttatccatataaaaaaaaccaaatctggaaagaagcaagagttgacattcctcctcttatgagaggtttaacctgggctgctcttctgggagttgagggagctattcatgccaagtacgatgcaattgataaagacactccaattcctacagatagacaaattgaagtggatattcctcgctgtcatcagtacgatgaactgttatcatcaccagaaggtcatgcaaaatttaggcgtgtattaaaagcctgggtagtgtctcatcctgatcttgtgtattggcaaggtcttgactcactttgtgctccattcctatatctaaacttcaataatgaagccttggcttatgcatgtatgtctgcttttattcccaaatacctgtataacttcttcttaaaagacaactcacatgtaatacaagagtatctgactgtcttctctcagatgattgcatttcatgatccagagctgagtaatcatctcaatgagattggtttcattccagatctctatgccatcccttggtttcttaccatgtttactcatgtatttccactacacaaaattttccacctctgggataccttactacttgggaattcctctttcccattctgtattggagtagcaattcttcagcagctgcgggaccggcttttggctaatggctttaatgagtgtattcttctcttctccgatttaccagaaattgacattgaacgctgtgtgagagaatctatcaacctgttttgttggactcctaaaagtgctacttacagacagcatgctcaacctccaaagccatcttctgacagcagtggaggcagaagttcggcaccttatttctctgctgagtgtccagatcctccaaagacagatctgtcaagagaatccatcccattaaatgacctgaagtcagaagtatcaccacggatttcagcagaggacctgattgacttgtgtgagctcacagtgacaggccacttcaaaacacccagcaagaaaacaaagtccagtaaaccaaagctcctggtggttgacatccggaatagtgaagactttattcgtggtcacatttcaggaagcatcaacattccattcagtgctgccttcactgcagaaggggagcttacccagggcccttacactgctatgctccagaacttcaaagggaaggtcattgtcatcgtggggcatgtggcaaaacacacagctgagtttgcagctcaccttgtgaagatgaaatatccaagaatctgtattctagatggtggcattaataaaataaagccaacaggcctcctcaccatcccatctcctcaaatatgaagaaccaagagtgtgactgccaaaacttagtgtggcatcagcaccaacagcacagttcttcatatccacgccactctcagacaaaactagatgtccagattgttgcatttccgtaaagtttgtcacgagacattttttaaaatctcataacccacatgttcagttatccatgcaagaaacttgactctacatgtattgctgaaagaattttcttaacagtgaaatctgatcatatatttttaccacactgccacataaagcccaagaaattcagctgacaagacagatttagcattatcaagaaatcccatttgccctgaaaaagctgtcctccattgtactgaacagacagtcctgtcgattgtgttatttagaaacatacactgaatgtgggctgaaatcatcatctttccataatgaaaactgagaaactattcacaatgcattccttataaataaatgctacatttagtaactcatttcacccaaa

SEQ ID NO: 7461 - DNA, 3349 bp, Homo sapiens
gggtgaaaagctcggatctgtgtttggggaaggccaggcttgcgctcctcgccgggttccgcgaaggttaaccttggctgacttggctcgcgagcaaagggcagcgtctgagctcccggcgttccaggagtggcctcttttgtaggagcacctgaaatgcagcgtctggtgcactaagccgtagcggcagcagcagccacagcgacagcgctggggccctgtgtagaagctccatcccccttgtctttgtgcttgcctgcgtccccagactcagagattatcttagaagacctaggactccaaaaatgtttcccctgaaggacgctgaaatgggagcctttaccttctttgcctcggctctgccacatgatgtttgtggaagcaatggacttcctctcacaccaaattccatcaaaattttagggcgctttcaaatccttaaaaccatcacccatcccagactctgccagtatgtggatatttctaggggaaagcatgaacgactagtggtcgtggctgaacattgtgaacgtagtctggaagacttgcttcgagaaaggaaacctgtgagctgttcaacggttttgtgtatagcatttgaggttcttcagggcttgcagtatatgaacaaacatggtatagtacacagggcattgtctcctcataatatcctgttggaccgaaagggacatattaaattggctaaatttggactttatcacatgacagctcatggtgatgatgttgatttcccaatagggtatccctcgtacttggcccctgagggaagaaaattatttcagagcttggatatttctgaaagactaaaatttttgcttactttggattgtgtagatgacactttaatagttctggctgaagagcatggttgtttggacattataaaggagcttcctgaaactgtgatagatcttttgaataagtgccttaccttccatccttctaagaggccaaccccagatcaattaatgaaggacaaagtattcagtgaggtatcacctttatataccccctttaccaaacctgccagtctgttttcatcttctctgagatgtgctgatttaactctgcctgaggatatcagtcagttgtgtaaagatataaataatgattacctggcagaaagatctattgaagaagtgtattacctttggtgtttggctggaggtgacttggagaaagagcttgtcaacaaggaaatcattcgatccaaaccacctatctgcacactccccaattttctctttgaggatggtgaaagctttggacaaggtcgagatagaagctcgcttttagatgataccactgtgacattgtcgttatgccagctaagaaatagattgaaagatgttggtggagaagcattttacccattacttgaagatgaccagtctaatttacctcattcaaacagcaataatgagttgtctgcagctgccacgctccctttaatcatcagagagaaggatacagagtaccaactaaatagaattattctcttcgacaggctgctaaaggcttatccatataaaaaaaaccaaatctggaaagaagcaagagttgacattcctcctcttatgagaggtttaacctgggctgctcttctgggagttgagggagctattcatgccaagtacgatgcaattgataaagacactccaattcctacagatagacaaattgaagtggatattcctcgctgtcatcagtacgatgaactgttatcatcaccagaaggtcatgcaaaatttaggcgtgtattaaaagcctgggtagtgtctcatcctgatcttgtgtattggcaaggtcttgactcactttgtgctccattcctatatctaaacttcaataatgaagccttggcttatgcatgtatgtctgcttttattcccaaatacctgtataacttcttcttaaaagacaactcacatgtaatacaagagtatctgactgtcttctctcagatgattgcatttcatgatccagagctgagtaatcatctcaatgagattggtttcattccagatctctatgccatcccttggtttcttaccatgtttactcatgtatttccactacacaaaattttccacctctgggataccttactacttgggaattcctctttcccattctgtattggagtagcaattcttcagcagctgcgggaccggcttttggctaatggctttaatgagtgtattcttctcttctccgatttaccagaaattgacattgaacgctgtgtgagagaatctatcaacctgttttgttggactcctaaaagtgctacttacagacagcatgctcaacctccaaagccatcttctgacagcagtggaggcagaagttcggcaccttatttctctgctgagtgtccagatcctccaaagacagatctgtcaagagaatccatcccattaaatgacctgaagtcagaagtatcaccacggatttcagcagaggacctgattgacttgtgtgagctcacagtgacaggccacttcaaaacacccagcaagaaaacaaagtccagtaaaccaaagctcctggtggttgacatccggaatagtgaagactttattcgtggtcacatttcaggaagcatcaacattccattcagtgctgccttcactgcagaaggggagcttacccagggcccttacactgctatgctccagaacttcaaagggaaggtcattgtcatcgtggggcatgtggcaaaacacacagctgagtttgcagctcaccttgtgaagatgaaatatccaagaatctgtattctagatggtggcattaataaaataaagccaacaggcctcctcaccatcccatctcctcaaatatgaagaaccaagagtgtgactgccaaaacttagtgtggcatcagcaccaacagcacagttcttcatatccacgccactctcagacaaaactagatgtccagattgttgcatttccgtaaagtttgtcacgagacattttttaaaatctcataacccacatgttcagttatccatgcaagaaacttgactctacatgtattgctgaaagaattttcttaacagtgaaatctgatcatatatttttaccacactgccacataaagcccaagaaattcagctgacaagacagatttagcattatcaagaaatcccatttgccctgaaaaagctgtcctccattgtactgaacagacagtcctgtcgattgtgttatttagaaacatacactgaatgtgggctgaaatcatcatctttccataatgaaaactgagaaactattcacaatgcattccttataaataaatgctacatttagtaactca

SEQ ID NO: 7462 - DNA, 3047 bp, Homo sapiens
agcgttgggtcgcggtggctgtgagggcggaagaaaaggccaggctgaggggagggtagagggtgaaaagctcggatctgtgtttggggaaggccaggcttgcgctcctcgccgggttccgcgaaggttaaccttggctgacttggctcgcgagcaaagggcagcgtctgagctcccggcgttccaggagtggcctcttttgtaggagcacctgaaatgcagcgtctggtgcactaagccgtagcggcagcagcagccacagcgacagcgctggggccctgtgtagaagctccatcccccttgtctttgtgcttgcctgcgtccccagactcagagattatcttagaagacctaggactccaaaaatgtttcccctgaaggacgctgaaatgggagcctttaccttctttgcctcggctctgccacatgatgtttgtggaagcaatggacttcctctcacaccaaattccatcaaaattttagggcgctttcaaatccttaaaaccatcacccatcccagactctgccagtatgtggatatttctaggggaaagcatgaacgactagtggtcgtggctgaacattgtgaacgtagtctggaagacttgcttcgagaaaggaaacctgtgagctgttcaacggttttgtgtatagcatttgaggttcttcagggcttgcagtatatgaacaaacatggtatagtacacagggcattgtctcctcataatatcctgttggaccgaaagggacatattaaattggctaaatttggactttatcacatgacagctcatggtgatgatgttgatttcccaatagggtatccctcgtacttggcccctgaggtaattgcacagggaattttcaaaaccactgatcacatgccaagtaaaaaaccattgccttctggccccaaatcagatgtatggtctcttggaatcattttatttgagctttgtgtgggaagaaaattatttcagagcttggatatttctgaaagactaaaatttttgcttactttggattgtgtagatgacactttaatagttctggctgaagagcatggttgtttggacattataaaggagcttcctgaaactgtgatagatcttttgaataagtgccttaccttccatccttctaagaggccaaccccagatcaattaatgaaggacaaagtattcagtgaggtatcacctttatataccccctttaccaaacctgccagtctgttttcatcttctctgagatgtgctgatttaactctgcctgaggatatcagtcagttgtgtaaagatataaataatgattacctggcagaaagatctattgaagaagtgtattacctttggtgtttggctggaggtgacttggagaaagagcttgtcaacaaggaaatcattcgatccaaaccacctatctgcacactccccaattttctctttgaggatggtgaaagctttggacaaggtcgagatagaagctcgcttttagatgataccactgtgacattgtcgttatgccagctaagaaatagattgaaagatgttggtggagaagcattttacccattacttgaagatgaccagtctaatttacctcattcaaacagcaataatgagttgtctgcagctgccacgctccctttaatcatcagagagaaggatacagagtaccaactaaatagaattattctcttcgacaggctgctaaaggcttatccatataaaaaaaaccaaatctggaaagaagcaagagttgacattcctcctcttatgagaggtttaacctgggctgctcttctgggagttgagggagctattcatgccaagtacgatgcaattgataaagacactccaattcctacagatagacaaattgaagtggatattcctcgctgtcatcagtacgatgaactgttatcatcaccagaaggtcatgcaaaatttaggcgtgtattaaaagcctgggtagtgtctcatcctgatcttgtgtattggcaaggtcttgactcactttgtgctccattcctatatctaaacttcaataatgaagccttggcttatgcatgtatgtctgcttttattcccaaatacctgtataacttcttcttaaaagacaactcacatgtaatacaagagtatctgactgtcttctctcagatgattgcatttcatgatccagagctgagtaatcatctcaatgagattggtttcattccagatctctatgccatcccttggtttcttaccatgtttactcatgtatttccactacacaaaattttccacctctgggataccttactacttgggaattcctctttcccattctgtattggagtagcaattcttcagcagctgcgggaccggcttttggctaatggctttaatgagtgtattcttctcttctccgatttaccagaaattgacattgaacgctgtgtgagagaatctatcaacctgttttgttggactcctaaaagtgctacttacagacagcatgctcaacctccaaagccatcttctgacagcagtggaggcagaagttcggcaccttatttctctgctgagtgtccagatcctccaaagacagatctgtcaagagaatccatcccattaaatgacctgaagtcagaagtatcaccacggatttcagcagaggacctgattgacttgtgtgagctcacagtgacaggccacttcaaaacacccagcaagaaaacaaagtccagtaaaccaaagctcctggtggttgacatccggaatagtgaagactttattcgtggtcacatttcaggaagcatcaacattccattcagtgctgccttcactgcagaaggggagcttacccagggcccttacactgctatgctccagaacttcaaagggaaggtcattgtcatcgtggggcatgtggcaaaacacacagctgagtttgcagctcaccttgtgaagatgaaatatccaagaatctgtattctagatggtggcattaataaaataaagccaacaggcctcctcaccatcccatctcctcaaatatga

SEQ ID NO: 7463 - DNA, 3362 bp, Homo sapiens
attagcagcgcaggccaggtcctctctcctggaggcaagttagagaaggaagacccctacgatcgcaatcggcgatccccgagtgagtgacccgccacgacgtcactcacatgaagcggaggaccacgggttccgagacagccacagcaggaagcatattatcttagaagacctaggactccaaaaatgtttcccctgaaggacgctgaaatgggagcctttaccttctttgcctcggctctgccacatgatgtttgtggaagcaatggacttcctctcacaccaaattccatcaaaattttagggcgctttcaaatccttaaaaccatcacccatcccagactctgccagtatgtggatatttctaggggaaagcatgaacgactagtggtcgtggctgaacattgtgaacgtagtctggaagacttgcttcgagaaaggaaacctgtgagctgttcaacggttttgtgtatagcatttgaggttcttcagggcttgcagtatatgaacaaacatggtatagtacacagggcattgtctcctcataatatcctgttggaccgaaagggacatattaaattggctaaatttggactttatcacatgacagctcatggtgatgatgttgatttcccaatagggtatccctcgtacttggcccctgaggtaattgcacagggaattttcaaaaccactgatcacatgccaagtaaaaaaccattgccttctggccccaaatcagatgtatggtctcttggaatcattttatttgagctttgtgtgggaagaaaattatttcagagcttggatatttctgaaagactaaaatttttgcttactttggattgtgtagatgacactttaatagttctggctgaagagcatggttgtttggacattataaaggagcttcctgaaactgtgatagatcttttgaataagtgccttaccttccatccttctaagaggccaaccccagatcaattaatgaaggacaaagtattcagtgaggtatcacctttatataccccctttaccaaacctgccagtctgttttcatcttctctgagatgtgctgatttaactctgcctgaggatatcagtcagttgtgtaaagatataaataatgattacctggcagaaagatctattgaagaagtgtattacctttggtgtttggctggaggtgacttggagaaagagcttgtcaacaaggaaatcattcgatccaaaccacctatctgcacactccccaattttctctttgaggatggtgaaagctttggacaaggtcgagatagaagctcgcttttagatgataccactgtgacattgtcgttatgccagctaagaaatagattgaaagatgttggtggagaagcattttacccattacttgaagatgaccagtctaatttacctcattcaaacagcaataatgagttgtctgcagctgccacgctccctttaatcatcagagagaaggatacagagtaccaactaaatagaattattctcttcgacaggctgctaaaggcttatccatataaaaaaaaccaaatctggaaagaagcaagagttgacattcctcctcttatgagaggtttaacctgggctgctcttctgggagttgagggagctattcatgccaagtacgatgcaattgataaagacactccaattcctacagatagacaaattgaagtggatattcctcgctgtcatcagtacgatgaactgttatcatcaccagaaggtcatgcaaaatttaggcgtgtattaaaagcctgggtagtgtctcatcctgatcttgtgtattggcaaggtcttgactcactttgtgctccattcctatatctaaacttcaataatgaagccttggcttatgcatgtatgtctgcttttattcccaaatacctgtataacttcttcttaaaagacaactcacatgtaatacaagagtatctgactgtcttctctcagatgattgcatttcatgatccagagctgagtaatcatctcaatgagattggtttcattccagatctctatgccatcccttggtttcttaccatgtttactcatgtatttccactacacaaaattttccacctctgggataccttactacttgggaattcctctttcccattctgtattggagtagcaattcttcagcagctgcgggaccggcttttggctaatggctttaatgagtgtattcttctcttctccgatttaccagaaattgacattgaacgctgtgtgagagaatctatcaacctgttttgttggactcctaaaagtgctacttacagacagcatgctcaacctccaaagccatcttctgacagcagtggaggcagaagttcggcaccttatttctctgctgagtgtccagatcctccaaagacagatctgtcaagagaatccatcccattaaatgacctgaagtcagaagtatcaccacggatttcagcagaggacctgattgacttgtgtgagctcacagtgacaggccacttcaaaacacccagcaagaaaacaaagtccagtaaaccaaagctcctggtggttgacatccggaatagtgaagactttattcgtggtcacatttcaggaagcatcaacattccattcagtgctgccttcactgcagaaggggagcttacccagggcccttacactgctatgctccagaacttcaaagggaaggtcattgtcatcgtggggcatgtggcaaaacacacagctgagtttgcagctcaccttgtgaagatgaaatatccaagaatctgtattctagatggtggcattaataaaataaagccaacaggcctcctcaccatcccatctcctcaaatatgaagaaccaagagtgtgactgccaaaacttagtgtggcatcagcaccaacagcacagttcttcatatccacgccactctcagacaaaactagatgtccagattgttgcatttccgtaaagtttgtcacgagacattttttaaaatctcataacccacatgttcagttatccatgcaagaaacttgactctacatgtattgctgaaagaattttcttaacagtgaaatctgatcatatatttttaccacactgccacataaagcccaagaaattcagctgacaagacagatttagcattatcaagaaatcccatttgccctgaaaaagctgtcctccattgtactgaacagacagtcctgtcgattgtgttatttagaaacatacactgaatgtgggctgaaatcatcatctttccataatgaaaactgagaaactattcacaatgcattccttataaataaatgctacatttagtaactcatttcacccaaacaag

SEQ ID NO: 7464 - DNA, 579 bp, Homo sapiens
agaaaaggccaggctgaggggagggtagagggtgaaaagctcggatctgtgtttggggaaggccaggcttgcgctcctcgccgggttccgcgaaggttaaccttggctgacttggctcgcgagcaaagggcagcgtctgagctcccggcgttccaggagtggcctcttttgtaggagcacctgaaatgcagcgtctggtgcactaagccgtagcggcagcagcagccacagcgacagcgctggggccctgtgtagaagctccatcccccttgtctttgtgcttgcctgcgtccccagactcagaggctactactttacgcaactttggggcaccatttattttggaattatcttagaagacctaggactccaaaaatgtttcccctgaaggacgctgaaatgggagcctttaccttctttgcctcggctctgccacatgatgtttgtggaagcaatggacttcctctcacaccaaattccatcaaaattttagggcgctttcaaatccttaaaaccatcacccatcccagactctgccagtatgtggatatttctaggggaaagcatgaacgactagtg

SEQ ID NO: 7465 - DNA, 848 bp, Homo sapiens
agcgttgggtcgcggtggctgtgagggcggaagaaaaggccaggctgaggggagggtagagggtgaaaagctcggatctgtgtttggggaaggccaggcttgcgctcctcgccgggttccgcgaaggttaaccttggctgacttggctcgcgagcaaagggcagcgtctgagctcccggcgttccaggagtggcctcttttgtaggagcacctgaaatgcagcgtctggtgcactaagccgtagcggcagcagcagccacagcgacagcgctggggccctgtgtagaagctccatcccccttgtctttgtgcttgcctgcgtccccagactcagaggcagattatcttagaagacctaggactccaaaaatgtttcccctgaaggacgctgaaatgggagcctttaccttctttgcctcggctctgccacatgatgtttgtggaagcaatggacttcctctcacaccaaattccatcaaaattttagggcgctttcaaatccttaaaaccatcacccatcccagactctgccagtatgtggatatttctaggggaaagcatgaacgactagtggtcgtggctgaacattgtgaacgtagtctggaagacttgcttcgagaaaggaaacctgtgagctgttcaacggttttgtgtatagcatttgaggttcttcagggcttgcagtatatgaacaaacatggtatagtacacagggcattgtctcctcataatatcctgttggaccgaaagggacatattaaattggctaaatttggactttatcacatgacagctcatggtgatgatgttgatttcccaatagggtatccctcgtacttggcccctga

SEQ ID NO: 7466 - DNA, 600 bp, Homo sapiens
agtgtccatagcaactagtgtagttctcagtttgttcagcttctttagggaagaaccttatctttttctttttttcatggagtgtaaataactgccaatgttgtggggctggtggcagaattgacgcttctaattattcaacacttcacccttctgatttcaaaccctctgactgctgtttaacattgttcccgccttctctgagtctgaagcctctgaatctgaagggaccaaacaaacctcttgactattacagattatcttagaagacctaggactccaaaaatgtttcccctgaaggacgctgaaatgggagcctttaccttctttgcctcggctctgccacatgatgtttgtggaagcaatggacttcctctcacaccaaattccatcaaaattttagggcgctttcaaatccttaaaaccatcacccatcccagactctgccagtatgtggatatttctaggggaaagcatgaacgactagtggtcgtggctgaacattgtgaacgtagtctggaagacttgcttcgagaaaggaaacctgtgagctgttcaacggttttgtgtatagcatttgaggttcttcagggcttgcag

SEQ ID NO: 7467 - DNA, 1866 bp, Homo sapiens
cttgccgtctctatgtctggagctcttagagataagacatagaggtgtctggttctgagaaaaggaagttttgctaagtgagagacacaactgactcaactgactcagaaaactgattatattcctggtccctgaacgatcctatagagacatccagtccctgactccacctgcctccaggtgcccagaacagcccatcgtggggacttcaccctcagcaagtggacgccgtttgtcctgccagggcaggatggagatggatggggacccgtataacctgcctgcccaggggcaaggcaatatcatcattactaagtatgagcagggacaccgagctggggcagcagtggacttggggcatgagcaggttgatgtcagaaaatacaccaataacctcgggattgtgcatgagatggagctgccccacgtcagtgccctggaggtgaagcaaagacgcaaggaaagtaaacgtaccaacaagtggcaaaagatgcttgcagactggacaaaatataggagcaccaagaagctgtctcaaagagtatacaaagtcattcccctggcggtacggggccgggcgtggtcacttttgctagatattgacagaatcaagtcccagaacccaggcaaatataaggtcatgaaggagaagggcaagaggtcctccagaatcatccactgcatccagctagatgtcagccacaccctgcagaaacacatgatgttcatacaaagattcggagtcaagcagcaggaattatgtgacatcctcgtggcctattctgcatataaccctgaggtgggctaccacagggacctgagccgcatcactgccatcctcctcctgtgtctgccagaggaagatgctttctgggcgcttacccagttgctcgctggtgagaggcactccctgtggtattctacagcccaaatactgcctggctcgagaggctcctatcgcaccaggagcaggtgctgcacaagtccttcccaaagatcatgagacacctgggcaaggaagggctgtgcattgagggttccatgctgacgaggctcctccggtgtttccttgatgggaaatccttcgggctcaccctgagactgtgggatgtgttcatcttggagggcgcgcgggtactgacagccatggtgcatgcatcattcaaaatacacaggaagcacctcatgaagctttcctggagcactgtctgggagtttcaggagcgactctctcagagctgggccctggaggacaacgcggtcctcaggaaccttcaaacctctatgaaggaactcacaaaaaaacactgggacctgccacccccagggagcttgctacaaaatgcacattgctataccatagcctggggcttgcaatccaaggctggcaaggattcctgcacgtcaagggcctcaggtgactttcatgcacacccaagtcagaaggctctcctgaatcctggatgtcaccttcctgcccaaaaaaggaggaacgagggtcaaccagcagcagaccagtcacaaaaagagatgaaatgtgagtgcatggccttcctgacacccagacaaaactttgggcacaaagccaggctgcagctctggccactgacttggaccagggatgcccccatgcaggccggtgtgccctggctgctcttgacaccctctggctcctgacaccctctcttcggctgcctgcgttaggaagggagaacctgccagttttcagaagaaaatgtagctttattataacataggaaagactgcaagttattacgggaggaggaggaggcctgaaacagctcctgaaaatgagagggaaaaggaaggtgtaaatatgttggtaataaaatctccaaccacagc

SEQ ID NO: 7468 - DNA, 3018 bp, Homo sapiens
gagcaggcggcaccatggactgagcacctcccaggttccaagccctgggccagactggaacatggggggccagaacccaagaggatcctgaggagacagacggcagcaaacaaaatcatgcacaatggtgaaaggtgctctccctgacccatggggacccatggtaggaccctcgggagggtggcaggttggagggcccgtaagcctccccaggcaacactgatagtaccaaaagctggggagattcagggacctggaaactgtcatccaggtctgctgggaacgtgacatggcacagccactttggcagccagttgggcagtggctcacaaagttcaatggacttgaaccacgcgtccccaaagtgtcacagatattgaacccactgatttgaaaactgacgtccacatgaaacctgcaggccaggttcactgcttgattcctcgtcactcacacacggagccttcggggatggccttcaacacgggaatggggagaacaaggctggtcctcccttcaaacggaagacccagtgagaaaagggaacgagccagtgatgcccgcatgaacgtgggtggatcctaggtgcattttgctaagggaaagaagccagacccaataagctaccaaagtaggattcccattcttaggccattgtggaaaaggccaaaccatagggactgagaagcagtctgggtggccaggggctgacggatcggggagaggctgggtgcataggggccaccctggagacttggaggatgaaggagtcgctccaggaggggctggagtggtagccgggagactctgcacattggtttagaaccatggaggacctgtacacccaaagactgaattggcgtgtgtgcaaactgaaaaaaaaaagatcattcagagtgaaaaggatcaggcaagtcactgtacaactgggctatttgcatgtcacagatgtggattttactgaaacatttcttcaacagtcaaagtccctgaagagctcactgcttatctggtgaatcatctgaacctgaaatgggatttgttgttagggtttgtagacaaagtgaaactaacagcatctgcacaacacaaaccaaagccccctttctctgtttcccaggcagcaggaactattctacatcctcctggcatattcgaagtataacccagtgagtattcctggcagtgaggttcccaggccgtatttccatattcacaggagtgggtgtctggtgggagtgtcgttgcttcttttaaagttagtatttgtgacccaccaggatataggaggtaggattccagctcaccgctggcataaacctccagcaagggggtggtctcaaggggtcaagctgagacacagaggagtcagggcctggactcctggtgtcacctgggcctgaccaccacttatcggaacaagcccctcctcctggggctgccccaaagcccgggagcttggcagcatcacacacagaatggtgctatcaggagacattttggacaaggtgctgaagtgcccgatggatatggctcttgtcatgaaatgaatttgcatcctgaggaagtctcttcttcagaggaagccttcccagtcacctctgccctctccgatgacatgagtcctcccaggtgacctcagccctcccaagtgacttacttccacggtgactctggctgttgcaggtggtgggctactgcagggacctgagccacatcgctgccttgttcctcctttatctgcctgaggaggacacattctgggcactggtgcagctgctggccagtgagaggcactcctgcaggcttgttgggagcctttaggacgtctctgctgacggtcccaaaggaacccggaactgaccccccagagcccaagtcagacgcctttcatccccatcagcagaaggcatctcatcctccccgtggctgccctctgtgtcctggagccacgccctccggctctgattctgtgcagctggctctccgcaacctgagagtcctcctgcccttcagttgctcaggctccagctgcccttggtacccacgaaagggtaccaagcccagatggcagcatctccccatcccgtgtcccttggcccagccccacttccaggagacgaccacaaagcccagcacccaccctgttctggccgccccctgtcgtggcctcaaagtcaggcttgccctcccggcaccctggcccaggaggcctccaggggcacctccagccaggctccaggggatgttcccacccctcctccccagggccaaggccacatggtggggtcaccagatgggagggtgggaggcctcggggtctggggggctctgcagctgcccagctcttccagctgatggctccacatcttgggggaaggctctgatttcatgacgggctgggggcttctcaggattccacagcccaaatggcgggacagttcaggggctccaagaccatcaggagcatgtggtacccacatcacaacccaagaccatggggcatctggacaaggaaggtctatgcacacagggttcctcattcagctggcttctccgggtgctgaatgatgggatctctctcgggctcaccccgtgcctgtgggatatgtatttgctggaaggggaacagatgttgatgctgataacaagcattgcctttaaggttcaaaggagcctctatgaagaaactaacaaggaaacatggggacctgccacccccagggccctcaagggcactggaagagccagacccatttgtgagagcctccactcctccctgcaagcgctgacagcctcagagagcagcagaggcccctcactcctgcagactcctccaagggtgccaggacaacaagccttgagccggggagacaagggaatcagtgtctcattatctctaccatctctaccatctcggagagggagatgtggcaggataatagggtaatagtggggtgagggtcagcaggaaaacatgaacaaatgtctctgtgtcataaacaaggttaaggaaaa

SEQ ID NO: 7469 - DNA, 2594 bp, Homo sapiens
acgccgcctccgtctcccacgcgctcgctcgctcgctcgctcccgccctccccgcctcgagcgatctcctgcctcagccttgcaggctccgcactgcagatgcctgctggcttccctgcgctcggcggctcccgcggtgccccgtaagtccccgtgaccctccagcaccagccggctgtgcgctccctgctcccacgggccggtcagccgcagacactcacccagctccgcgagctcagccgctcagcgagtggggtagcggggaccgagacggacggtagccgtgccagagcccggggcgctctcggatgcggcaggacaagctgaccgggtctctgaggcgcggggggagatgcctgaagcggcagggcggcggcgtgggcaccatcctgagcaatgtgctcaagaagcgcagctgcatttcccggaccgcgccccggctgctgtgcaccctggagccgggagttgataccaagttgaaattcactcttgagccatctttaggtcaaaatggttttcagcagtggtacgatgctctcaaggcagttgccaggctatccacaggaataccaaaggaatggaggagaaaggtttggttgaccttggcagatcattatttgcacagtatagccattgactgggacaaaaccatgcgcttcactttcaatgaaaggagtaatcctgatgatgactccatgggaattcagatagtcaaggaccttcaccgcacaggctgtagttcttactgtggccaggaggctgagcaggacagggttgtgttgaagcgggtgctgctggcctatgcccgatggaacaaaactgttgggtactgccaaggctttaacatcctggctgcactaattctggaagtgatggaaggcaatgaaggggatgccctgaaaattatgatttaccttattgataaggtacttcccgaaagctatttcgtcaataatctccgggcattgtctgtggatatggctgtcttcagagaccttttaagaatgaagctgccggaattatctcagcacctggatactcttcagagaactgcaaacaaagaaagtggaggtggatatgagcccccacttacaaatgtcttcacgatgcagtggtttctgactctctttgccacatgcctccctaatcagaccgttttaaagatctgggattcagtcttctttgaaggttcagaaatcatcctaagggtgtcgctggctatctgggcaaaattaggagagcagatagaatgttgtgaaacagcagatgaattctacagcaccatggggcgccttacccaggagatgctagagaatgatcttctgcaaagccatgaactcatgcagactgtttattccatggctccgttccctttcccacaattggcagagttgagggaaaaatacacctacaacattacaccgttcccagccacagttaaacccacctcagtttctggacgacatagtaaggccagagacagtgatgaagagaatgacccagacgatgaggatgctgtcgttaatgcagtggggtgtcttggaccttttagtgggttcctggctcctgaactgcagaagtaccaaaaacaaattaaagagccaaatgaggagcagagtctgagatctaataacattgcagagctgagtccaggagcaatcaattcctgtcgaagtgaataccatgcagcttttaacagtatgatgatggaacgcatgaccacagatatcaatgcactgaagcggcagtactctcgaattaaaaagaagcaacagcagcaggttcatcaggtgtacatcagggcagacaaagggccagtgaccagcattctcccgtctcaggtaaacagttctccagttataaaccaccttcttttaggaaagaagatgaaaatgactaacagagctgccaagaatgctgtcatccacatccctggtcacacaggagggaaaatatctcctgtcccctacgaagaccttaagacgaagctcaactccccgtggcgaactcacatccgagtccacaaaaagaacatgccaaggaccaagagtcatccgggctgtggggacaccgtagggctgatagatgagcagaacgaggccagcaagaccaatgggctgggggcagcagaggcattcccctctggttgtacagcgacagctgggagagaaggcagcagccctgaaggcagtaccaggaggacgatcgaggggcagtctccggagccggtgttcggagatgctgatgtggatgtgtctgcagttcaggcgaagttgggagccctggaactgaaccagagggatgctgcagctgaaactgagctcagggtgcacccaccctgccagcggcactgcccagagccgccgagtgcacccgaagaaaacaaagccaccagcaaagctccccaaggcagcaactcaaaaacccccatctttagcccttttcccagcgtcaagcccctgcggaaatctgctactgccaggaacttgggattatatggccctacagaaagaaccccaactgtgcactttcctcaaatgagtaggagcttcagcaaacccggcggtggaaacagtggcactaaaaaacgatga

SEQ ID NO: 7470 - DNA, 3124 bp, Homo sapiens
gtattgagtcaccataagtggacaaggaaggagcttctaacagacctcattgtacatacaaaattacaatcatgaatgtaaaggaaagcacactggaactgcttgcagctgactgcgaccttgagtctcagcttctgcatctgtgaaatgaagatactggtctgtgatatcagtatcaagataaaagtttggaatgggagaaaaattctcaaagcctgaaagaaaatctgtagttacttttggtgacgctgtccagttcccacaatgtatcattccttatctgaaactagacatcctctgcagccagaagaacaagaagtaggcattgaccccttgtccagttactctaacaagtctggaggagattcaaataaaaatggaagaagaacaagttctactttagactctgaagggacttttaattcctataggaaagaatgggaagaactatttgtaaacaacaattacttggcaacaataaggcagaaggggattaatgggcagctgagaagcagcaggttccgcagcatttgctggaagctatttctttgtgttcttcctcaagacaaaagtcaatggataagtagaattgaagaattaagagcatggtatagcaacattaaagaaatacatattaccaacccgaggaaggttgttggccaacaagatttgatgatcaataatcctctttcacaggatgaagggagtctttggaacaaattcttccaagataaagaacttcgatcaatgattgaacaagatgtcaaaagaacgtttcctgaaatgcagtttttccagcaagaaaatgtgagaaaaattcttacagatgttcttttctgttatgccagagaaaacgagcagttgctttataaacagggcatgcacgaactgttagcacctatagtctttgtccttcactgtgaccaccaagcttttctacatgccagtgagtctgcacagcccagtgaggaaatgaaaactgtcttgaaccctgagtatctggaacatgatgcctatgcagtgttctcacaacttatggaaactgctgaaccttggttttcaacttttgagcatgatggtcagaaggggaaagaaacactgatgactcccattccctttgctagaccacaagatttagggccaacaattgctattgttactaaagtcaaccagatccaggatcatctactgaagaagcatgatattgagctttacatgcacttgaacagactagaaattgcaccacagatatatgggttaaggtgggtgcggctgctatttggacgagagttccccctgcaggaccttctggtggtctgggatgccttgtttgcagacggcctcagcctgggtttagtagattatatcttcgtagccatgttactttacatccgagatgctttgatctctagtaactaccagacctgtctcggccttctgatgcattacccattcatcggggatgtacactcactgattcttaaggctctgttccttagagatccaaagagaaatccaagaccagtgacttatcaattccatccaaatttagattattacaaagcacgaggagcagacctcatgaataaaagccggaccaatgccaaaggtgctcccctgaatataaataaggtctctaatagcctgattaattttggaagaaagttgatttccccagcaatggctccaggcagtgcaggtggccctgtacctggaggcaacagcagtagctcctcctctgttgtaattcctaccaggacctcagcagaggccccaagccatcacttgcaacagcaacagcagcagcagaggctgatgaaatcagaaagcatgcctgtgcaattgaacaaaggcgatgtagttacaggaagcgatgctcaggtttctgttcctgtccagactctaactgacctccaagggctaagttctaaaaacatcagttcatctccaagcgttgagagtttgcctggaggaagagaattcactggctctccaccttcatctgctactaaaaaagattccttttttagcaacatctcacgttctcgctcacacagcaaaactatgggcagaaaagaatctgaagaagaattagaagcccaaatttccttccttcaagggcagttgaatgacctggatgccatgtgcaaatactgtgcaaaggtgatggacactcatcttgtaaatattcaagatgtgatattacaagaaaatttggaaaaagaagatcaaattctggtttccctggcaggattaaaacagatcaaagacattctaaaaggttccctgcgttttaaccagagccagctagaggccgaagagaacgaacagatcaccattgcggacaaccactactgctccagcggccagggccagggccgaggccaaggccagagcgttcaaatgtcaggggccattaaacaggcctcttcagaaacgccagggtgcactgatagagggaattccgatgacttcatcctgatttccaaagatgatgatgggagcagtgccaggggctccttctccggccaggcccagcctcttcgcaccctcagaagcacctctgggaaaagccaggccccagtctgctccccactggtgttctcagatccactgatgggcccagcctcagcttcctccagcaaccccagctccagtcctgatgacgacagcagcaaggactctggcttcaccattgtgagtcccctggacatctgaccacagtgcccagtcctgccccacagggatctagccacccttcagtggccccaaggccagactgaggctcatccagtggagaaccttcttaaaccactgcttccttcccggcatgcattttgcattggtccagccctttgaaaccccttagagagaagcatatatggccacaaagcacagaggcttaggtttgccacatgcagacagggctttctgggcccttacctaatccccacccgactcttgctctgagttagagctgagttacgtacccagtatcacactcacagttagaaaagaccgaatcacaatttagaatcacttttcctctgtccccttctccccagctaagaatgtgtggcacctccatcagttatacttagaaggagcagaaatagttattttc

SEQ ID NO: 7471 - DNA, 5272 bp, Homo sapiens
gaacgttgcggcggctgtcgccgcggccccagcacccagagctgttctctggccaagcctgcgcctgtagtccttctttgcctcctggggcggccgccacccacccccagatggtgggtccggaggatgccggagcctgctcgggaagaaaccccaagttgctcccggtgcctgcgccggaccccgtgggccaggacaggaaggtaatccgggccacgggcggctttggcggaggcgtcggcgctgtggagccgccggaggaggctgacgaggaggaggaggctgacgaggaggaggagacgccgcctcggcagctccttcagcgttacctcgcggcggccggggagcagctggagccggggctctgctactgtccgctccccgctggccaggccggcgccccgccgccctcggcagccccacgatcggacgcctgcctgctgggctcgggctccaaacaccgcggcgcggaggtggctgatggccgcgcgccgcggcacgaaggcatgaccaacggcgactcgggttttctgccgggccgggactgtcgcgatctggaagaggctcgcgggctggcgcgcgccggcggccgggagtcgcgccgccgccgcccctacggccgccttcgcctggaggggcctggcgacgaggacgcggacggcgcgggaagcccgtccgattgggcctctccgcttgaggacccgctgcggagctgctgcctggtggccgcggacgcccaggagcccgagggcgcgggcagcgactcgggggacagccccgccagcagctgcagcagtagcgaggactcagagcagcggggagtcggcgccgggggtcccgaggagggcgcgccccctgccacctcggccgagaggactaatgggggtgcggagccgcgcctgggcttttctgacattcacttcaactctcgcaacacgttccaggtgagccgcggtcagagcgcccgcgatcacctgcccccggcggggccgccggtgcccttgcccgccgcggagcagggtcctgcgggggcttcggcccgggctcgacggagtggcggcttcgcggacttcttcaccagaaacctttttccaaaaaggacaaaggaactcaaatcagttgtccatagtgctcctggttggaaattatttggtaaagtccctcctagagagaatcttcagaaaacatccaaaatcattcagcaggaatatgaagcacgaacggggaggacctgtaaaccaccacctcagtcttcaagacgcaagaattttgaatttgagccgctttctaccactgccttgattcttgaggatcgaccatcaaatcttcctgccaaatctgtggaagaagctttacgtcaccgacaagaatacgatgagatggtggctgaggctaaaaaacgagaaattaaggaagcacataaaagaaaaagaatcatgaaagaacgatttaagcaggaagaaaatattgcaagtgcaatggtaatttggatcaatgaaatactgcccaattgggaagtaatgcgtagtacaagaagagttcgagaattgtggtggcagggattgccccctagtgtccgtgggaaagtttggagtctagctgtaggaaatgaactaaatatcactcctgaactttatgaaatcttcctctcaagagcaaaagaacggtggaaaagtttcagtgaaacaagttcagagaatgatacagaaggtgtatctgttgctgatcgagaggccagtctggaattaattaagttggacatatcccgtacatttccatctctctacatctttcagaagggtggtccatatcatgatgtcttgcatagtattttaggggcatacacatgctacaggcctgatgttggttatgtccaagggatgtccttcattgcagcagtactcattctcaatttggaagaggcagatgcctttatcgcatttgccaatctcctgaataagccatgccagttggccttttttcgtgtggatcacagcatgatgttgaaatattttgcaacatttgaagtattctttgaagaaaatctttccaaattatttcttcacttcaaatcttacagtcttacaccagatatatacttgatagactggatcttcacactatatagcaaatcactaccacttgatctggcctgtcgagtctgggatgtattttgcagagatggggaagaatttttatttaggactggattaggaatcctccgattatatgaagatattctcctgcagatggactttattcatatagcacagtttctaactaaattgccagaagatatcacatcggaaaagctgttcagttgtattgcagccattcagatgcagaatagcaccaaaaaatggactcaggtctttgcatctgtaatgaaggatattaaagaaggagacaagaacagtagtcctgctttgaaaagctagtcttcaaaattgacagactaactgacatagaaaaagtggtttttggataaaggttttttgtttcctatgtaaaaggcgtggaagaaaatgttggagatacctaaaagaatcaagaggtggaaaactgctgattttacattttatggctgaagtaaatgaaataagtaacttattgacagtattaataaactattattttgtaggtagagtcatttttcaaaggaaaaagtttaagtggtgagtttatattccacaatttggagtaaacaaaatgcaataaatttttaaaatagctttgaagatacttcaaatttttacatcttttcttttgtaacagttaccacaaagatattctggaggctagagtaggattgttaaatactactgttaacctccaaagtactatagtacagacattgtttccagttctgaccttttgaagatattatagaccagtaatgaacagatttggttgtaaattatttaagtcactgaagatgtcatttatcttcattcacaagttggggcaaattcgagttacctaggaactggaaatgttggtgggagattgtttattgtttgtttagatgtttttccatagtatggtgtccatttgttttttaagggaaattttttgtcttccttaaggaattcctatcactcagagaattttagccattctggttctagtctaacaaattattcatctaataatttgacattaagaaaactataaataactggtagaaggaaagtgctttgcacttcagtggattgaagacttgactttgagagtaagtccaaaaacatatatgatgtttctcagtgataagagtaaaaagtaatgaatcctgagagttcttaaacagcatgctacttggcaagacttcatattttttagttacaattcttccactgtttaactccagtttgaaatttgaaatctaatatgtagctaaatctgtgacttgtaaaactctatgcataatttttcctaatcagtggaaataagaataaaagaaaaaggtaaagttaattttttttctaagtctacatcctatctcttgattcagttgcctgaagaagctgggtaaggagattagtcttgttattgattcttttatgtgtcagtgccatcttaatctcttcacatggtacactaaatgctgcctataacccatcctcatcttctttactcatcattgctttcttcaaggaaggtcttgatactgccctcgtctacctcactatccgctagtctagatagtgactctttggaaaattggtagcctctgaatgagttatccaacttctgcttcctcacattggccactttgcataggttcgggaacttagcaggttttaaatcatcatgcccatggaggtgaaatactttgaggaatgggaacatctcttcactgtgtttttggatcagccttctctcaaccgccaagaaatgcatgatttccctgccaactctaggaagtagtgctgcatgattgaatcattatttgatgaattctttcattgtaacatagggagtcattttcaaaaaggtagatatgaacttaaattaaattgacttatgaatgctttgcctgtgggcccaacagtgtcatgaccctccaattgaaacatagcatgaattatttttatgtcgagttcttgaactgctaatcaggtgtgtgtttccttgaagtccagagcaggatccaggtcagatgaaggaggtggtatgcctggcttaactgctgaaaatagagcattgaaactcttcacaatgtgctgcattgggtttctgcttggctttctcactgaaaagtaaattggggaaaatgctgcttttactattttgcattttatagcaacattaacagtcttttcccagtcaggtgctgtccagggaacatgtttcccttgggaggtctgaacagagtgacctggcttgatgtatttcctgagctctagtaccatatcatagaattagttaaatgtagtcaacagcaatgtcagaacaattgacattgtctttccaagagtgaatgcattggctttcggaactgctactagagacatacatgaggcagcgaacacatctttaggtgggggcaaggctatatctgattgacagagatctctgatctctaatgacatattgctattgtcctattatgtttaaatttgaacctaaatcacttgagtgttatgagtgatggctatataacatgctgtttggttagatttacagtgtgtttttatgttgcagtttagtttgaaacaacacttaagcacactatttctgttagtgtatatagttttcaaactaacaagcctgcgatccttgttagtgtagtgactgcctctttaggagtatggggccctagggtgtccatatatttttaccccatgggtcattctagtctaaggactactagtagaaccctcaaaaggtaattgctattatagggacttacttattggagactggtaatataataaaatattgaaggagtggccatggtcttagcaggttttagaatgaccttttaactccagtaactacttccttggtattggtatccttgatagagggaatataacatctggcagtaatctcattcaggttatactacctgactaaatttaatcatactttcatgtatttgtttcctcagttggacctaagttactgtatttgtttttcttatttttttattattgtacagtttctttacctttcaagtataaatgtgtatataaaatgtaaatacaaagaattcactaaaaaccactcataacaattactgtgtaaataaaactggtaagcagagtaa

SEQ ID NO: 7472 - DNA, 3378 bp, Homo sapiens
acaccatgtcaagtctgcacaagagccgaattgcagatttccaggatgtcctgaaggagccctcaattgcattggaaaagctgcgggaactcagctttagtggcatcccctgtgagggcggactgcggtgcctctgctggaagattctcttgaactaccttcccttggagagagcctcatggacctccatcctggccaagcagagggagctgtatgcccagttcctgagggaaatgatcatccagcctggcattgccaaggccaacatgggtgtgtccagggaggatgtgacttttgaggaccatccactcaaccccaaccctgacagccggtggaacacgtacttcaaggacaacgaggtgctgctgcagatcgacaaagatgtccggaggttgtgcccagacatttccttcttccagagggccactgactacccttgcctcctcatcctggacccccagaatgagtttgaaacccttcgtaagagagtggaacagacaacactgaaatctcagacggtggcccggaaccggagtggggtcacaaatcaagagcagaacatcaagcctcagttctttgccttccgctggctgacactgctgctgtcccaggagttcttgctgcctgacgtcatccgcatctgggactccctcttcgccgatgacaaccgctttgacttcctcctcctcgtctgctgcgccatgctcatgctgatccgggagcagttgctggaaggggacttcactgtgaatatgcggctgctgcaggactaccccatcacagatgtctgccagatcctgcagaaagccaaggagctccaagactcaaagtagcccggcggcaagaggcccatgttccggagagaagcctcccgaccctgtgccctggctcccgggacacatagaaacctgtaggaacccagcctgaggggaagccacaggatcggcccgagacccaggccatgcccactggggacacactgtgccgtgctccttctgccgccacgcccagctccccacctgccctgcactctgccctctttgcccaggatactgaggagggctggagctcgggaagttgtccttcctgggccagggccgtttctggcactgggaggctggcaggggcccctccctgcctcggctctgccgccccagcctcagttcctgcttctggtcttctcctgggctccactcaggggaggtgcttggccaatgggccagaaaccgcttctgagcggggcacttcggctgctccacagggaaggcgacactgaaagctgagtcctgccgtctgtctcacccacagatgtctgtagtcggtcggtgtgaatgtgggcccaagtccccaggcatcttctccgtgtgtgtgtgtgtgtgtgtgtgtgtgtgtgtgtgtgtgtgtgtgtgttagggagtgagggtctctcaggcctccaggtctcccagcccctccttctctgtctctacctctctgcctgtctccttccacctccttcccagagtgggactgtgtcttgcttcatgattcctctctccattactctccctgcccttctctgttggggtgccttatcctgagccacctcctctccccgcttgcctctgctcccctgaacctgggagacagatgaggagactggctcagcaaggcccctggaggtcaagcttggcctttgcctcctgttcccatcccccagccctggctcctaggtcctcccaactgggagggagtcctccgtgcctcacttagagggttctgaacccgttccctacacagaaatcttggaaaccaaatgctgctgagtaaggatgaagctttgagcctcctgcccctgctttctgcccagggagggagaaggaagagggggagctggtttttctggaggttcccccagaggccctcctgtccgaaaagaaaaggaccttgattctgagcccagggtcggaacccattgcttcagaagagttgtcattccctcggcttccaggtcccaacccagggttgggttgagtgagtcccacaaagggcaagtggggcccgaggaagcctctctggggccaggggtagctgagcttaaaggccctgggtcctgccagttccaggagggccatgtctgtgcctctgtgtacccctccacccgctgcgggctgagggaggtgcagggccttctctgacccctgcctgagctgttcccagggctggagcaggtgtaccctgagcaggggcagctggccactcccagttctcaccaagtcacctccctccttgtacaaggtttgcgtccggaagccgggtgccatagtgaggaccctcgtcctccagactggctggcaggagtcaggccccagcagccctcctgcccccaaagctttccgagtctggtgggcaggacttctcgctgcccttccaagcccggctttgggccaggaaaggcttccccaggtggctcttctaccaggcttttcctttgatgccgcctggatttccgcacctgcctgtctcctctcccagagcacagtatttgggagactttgactatttattcagactcctggctatgtattgcacattggcaagtgctctggggatgaggcatgggtataggaagggagaaaggagttggagacaagatcctcttcattttccaagatcaaagtcagcctcttctccccatgcttctaggaactgcctggttttcgagcaggtcctggctgagcgggctctgagttctgtactggaattgagtgtaaagatgggaagagaactgggctgactccaggacctccaggatgaggcagaggcatgatgcttcctgctcacctgggccaccctctctccaggacttgtcagctggtggttcagccccttctccaaccccttcataagcttgggccactgcctgggacccagcagacactgcccaggactctttagtgcactcactcttgtctgccccctaccttccctcctggaaccacactacttgaatcaccattactttgcctcgctggcagagttgggtcaagtgccctctccttgaccttgagatgaaggtcaagagcacagggaccaggccttggttaggctgagctcccagcaggacaccgcctgcagaaaggacctgccctgataatgtcccttccccagattctcaagcagatgcccaagggaggtccccacagagccagagtgcctgaggcttcctgcttgagaacctgccccctggatcttggacacttacagattgagctgtatgaattcagcgggtctcactccagagggtcagaacgtttgctttagttttttcatctgttttgttccttgagtcagtgctgttgatgacgagttgtcttgaataaatcatgtgttctttgc

SEQ ID NO: 7473 - DNA, 3906 bp, Homo sapiens
ggcggtggaacgcgcaggctagtggctgtgtttcccgccggaggcttttgcgcagagccccgcgtccctggggggcggcggcggcggcggcagcgcaggcggcagaggcgcaggcggcggaggcggctggggggtccggaagtcaacaccatgtcaagtctgcacaagagccgaattgcagatttccaggatgtcctgaaggagccctcaattgcattggaaaagctgcgggaactcagctttagtggcatcccctgtgagggcggactgcggtgcctctgctggaagattctcttgaactaccttcccttggagagagcctcatggacctccatcctggccaagcagagggagctgtatgcccagttcctgagggaaatgatcatccagcctggcattgccaaggccaacatgggtgtgtccagggaggatgtgacttttgaggaccatccactcaaccccaaccctgacagccggtggaacacgtacttcaaggacaacgaggtgctgctgcagatcgacaaagatgtccggaggttgtgcccagacatttccttcttccagagggccactgactacccttgcctcctcatcctggacccccagaatgagtttgaaacccttcgtaagagagtggaacagacaacactgaaatctcagacggtggcccggaaccggagtggggtcacaaatatgagctccccacacaagaactctgtgccatcatccctaaatgagtatgaggtgctgcccaatggctgtgaggcccactgggaggtggtggagcggatcctgttcatctacgccaagctcaaccctggcatcgcttatgtgcaaggcatgaatgaaatcgtggggcccctctactacacctttgccaccgaccccaatagtgagtggaaagagcacgccgaggcagacacctttttctgcttcaccaacctcatggccgagatccgggacaactttatcaagagcctggatgactcgcagtgtggcatcacctacaagatggagaaggtttactccaccttgaaagataaggatgtggagctctacctgaaactgcaagagcagaacatcaagcctcagttctttgccttccgctggctgacactgctgctgtcccaggagttcttgctgcctgacgtcatccgcatctgggactccctcttcgccgatgacaaccgctttgacttcctcctcctcgtctgctgcgccatgctcatgctgatccgggagcagttgctggaaggggacttcactgtgaatatgcggctgctgcaggactaccccatcacagatgtctgccagatcctgcagaaagccaaggagctccaagactcaaagtagcccggcggcaagaggcccatgttccggagagaagcctcccgaccctgtgccctggctcccgggacacatagaaacctgtaggaacccagcctgaggggaagccacaggatcggcccgagacccaggccatgcccactggggacacactgtgccgtgctccttctgccgccacgcccagctccccacctgccctgcactctgccctctttgcccaggatactgaggagggctggagctcgggaagttgtccttcctgggccagggccgtttctggcactgggaggctggcaggggcccctccctgcctcggctctgccgccccagcctcagttcctgcttctggtcttctcctgggctccactcaggggaggtgcttggccaatgggccagaaaccgcttctgagcggggcacttcggctgctccacagggaaggcgacactgaaagctgagtcctgccgtctgtctcacccacagatgtctgtagtcggtcggtgtgaatgtgggcccaagtccccaggcatcttctccgtgtgtgtgtgtgtgtgtgtgtgtgtgtgtgtgtgtgtgtgtgtgtgttagggagtgagggtctctcaggcctccaggtctcccagcccctccttctctgtctctacctctctgcctgtctccttccacctccttcccagagtgggactgtgtcttgcttcatgattcctctctccattactctccctgcccttctctgttggggtgccttatcctgagccacctcctctccccgcttgcctctgctcccctgaacctgggagacagatgaggagactggctcagcaaggcccctggaggtcaagcttggcctttgcctcctgttcccatcccccagccctggctcctaggtcctcccaactgggagggagtcctccgtgcctcacttagagggttctgaacccgttccctacacagaaatcttggaaaccaaatgctgctgagtaaggatgaagctttgagcctcctgcccctgctttctgcccagggagggagaaggaagagggggagctggtttttctggaggttcccccagaggccctcctgtccgaaaagaaaaggaccttgattctgagcccagggtcggaacccattgcttcagaagagttgtcattccctcggcttccaggtcccaacccagggttgggttgagtgagtcccacaaagggcaagtggggcccgaggaagcctctctggggccaggggtagctgagcttaaaggccctgggtcctgccagttccaggagggccatgtctgtgcctctgtgtacccctccacccgctgcgggctgagggaggtgcagggccttctctgacccctgcctgagctgttcccagggctggagcaggtgtaccctgagcaggggcagctggccactcccagttctcaccaagtcacctccctccttgtacaaggtttgcgtccggaagccgggtgccatagtgaggaccctcgtcctccagactggctggcaggagtcaggccccagcagccctcctgcccccaaagctttccgagtctggtgggcaggacttctcgctgcccttccaagcccggctttgggccaggaaaggcttccccaggtggctcttctaccaggcttttcctttgatgccgcctggatttccgcacctgcctgtctcctctcccagagcacagtatttgggagactttgactatttattcagactcctggctatgtattgcacattggcaagtgctctggggatgaggcatgggtataggaagggagaaaggagttggagacaagatcctcttcattttccaagatcaaagtcagcctcttctccccatgcttctaggaactgcctggttttcgagcaggtcctggctgagcgggctctgagttctgtactggaattgagtgtaaagatgggaagagaactgggctgactccaggacctccaggatgaggcagaggcatgatgcttcctgctcacctgggccaccctctctccaggacttgtcagctggtggttcagccccttctccaaccccttcataagcttgggccactgcctgggacccagcagacactgcccaggactctttagtgcactcactcttgtctgccccctaccttccctcctggaaccacactacttgaatcaccattactttgcctcgctggcagagttgggtcaagtgccctctccttgaccttgagatgaaggtcaagagcacagggaccaggccttggttaggctgagctcccagcaggacaccgcctgcagaaaggacctgccctgataatgtcccttccccagattctcaagcagatgcccaagggaggtccccacagagccagagtgcctgaggcttcctgcttgagaacctgccccctggatcttggacacttacagattgagctgtatgaattcagcgggtctcactccagagggtcagaacgtttgctttagttttttcatctgttttgttccttgagtcagtgctgttgatgacgagttgtcttgaataaatcatgtgttctttgcaatgggca

SEQ ID NO: 7474 - DNA, 3509 bp, Homo sapiens
agaggcgcaggcggcggaggcggctggggggtccggaagtcaacaccatgtcaagtctgcacaagagccgaattgcagatttccaggatgtcctgaaggagccctcaattgcattggaaaagctgcgggaactcagctttagtggaggttgtgcccagacatttccttcttccagagggccactgactacccttgcctcctcatcctggacccccagaatgagtttgaaacccttcgtaagagagtggaacagacaacactgaaatctcagacggtggcccggaaccggagtggggtcacaaatatgagctccccacacaagaactctgtgccatcatccctaaatgagtatgaggtgctgcccaatggctgtgaggcccactgggaggtggtggagcggatcctgttcatctacgccaagctcaaccctggcatcgcttatgtgcaaggcatgaatgaaatcgtggggcccctctactacacctttgccaccgaccccaatagtgagtggaaagagcacgccgaggcagacacctttttctgcttcaccaacctcatggccgagatccgggacaactttatcaagagcctggatgactcgcagtgtggcatcacctacaagatggagaaggtttactccaccttgaaagataaggatgtggagctctacctgaaactgcaagagcagaacatcaagcctcagttctttgccttccgctggctgacactgctgctgtcccaggagttcttgctgcctgacgtcatccgcatctgggactccctcttcgccgatgacaaccgctttgacttcctcctcctcgtctgctgcgccatgctcatgctgatccgggagcagttgctggaaggggacttcactgtgaatatgcggctgctgcaggactaccccatcacagatgtctgccagatcctgcagaaagccaaggagctccaagactcaaagtagcccggcggcaagaggcccatgttccggagagaagcctcccgaccctgtgccctggctcccgggacacatagaaacctgtaggaacccagcctgaggggaagccacaggatcggcccgagacccaggccatgcccactggggacacactgtgccgtgctccttctgccgccacgcccagctccccacctgccctgcactctgccctctttgcccaggatactgaggagggctggagctcgggaagttgtccttcctgggccagggccgtttctggcactgggaggctggcaggggcccctccctgcctcggctctgccgccccagcctcagttcctgcttctggtcttctcctgggctccactcaggggaggtgcttggccaatgggccagaaaccgcttctgagcggggcacttcggctgctccacagggaaggcgacactgaaagctgagtcctgccgtctgtctcacccacagatgtctgtagtcggtcggtgtgaatgtgggcccaagtccccaggcatcttctccgtgtgtgtgtgtgtgtgtgtgtgtgtgtgtgtgtgtgtgtgtgtgtgttagggagtgagggtctctcaggcctccaggtctcccagcccctccttctctgtctctacctctctgcctgtctccttccacctccttcccagagtgggactgtgtcttgcttcatgattcctctctccattactctccctgcccttctctgttggggtgccttatcctgagccacctcctctccccgcttgcctctgctcccctgaacctgggagacagatgaggagactggctcagcaaggcccctggaggtcaagcttggcctttgcctcctgttcccatcccccagccctggctcctaggtcctcccaactgggagggagtcctccgtgcctcacttagagggttctgaacccgttccctacacagaaatcttggaaaccaaatgctgctgagtaaggatgaagctttgagcctcctgcccctgctttctgcccagggagggagaaggaagagggggagctggtttttctggaggttcccccagaggccctcctgtccgaaaagaaaaggaccttgattctgagcccagggtcggaacccattgcttcagaagagttgtcattccctcggcttccaggtcccaacccagggttgggttgagtgagtcccacaaagggcaagtggggcccgaggaagcctctctggggccaggggtagctgagcttaaaggccctgggtcctgccagttccaggagggccatgtctgtgcctctgtgtacccctccacccgctgcgggctgagggaggtgcagggccttctctgacccctgcctgagctgttcccagggctggagcaggtgtaccctgagcaggggcagctggccactcccagttctcaccaagtcacctccctccttgtacaaggtttgcgtccggaagccgggtgccatagtgaggaccctcgtcctccagactggctggcaggagtcaggccccagcagccctcctgcccccaaagctttccgagtctggtgggcaggacttctcgctgcccttccaagcccggctttgggccaggaaaggcttccccaggtggctcttctaccaggcttttcctttgatgccgcctggatttccgcacctgcctgtctcctctcccagagcacagtatttgggagactttgactatttattcagactcctggctatgtattgcacattggcaagtgctctggggatgaggcatgggtataggaagggagaaaggagttggagacaagatcctcttcattttccaagatcaaagtcagcctcttctccccatgcttctaggaactgcctggttttcgagcaggtcctggctgagcgggctctgagttctgtactggaattgagtgtaaagatgggaagagaactgggctgactccaggacctccaggatgaggcagaggcatgatgcttcctgctcacctgggccaccctctctccaggacttgtcagctggtggttcagccccttctccaaccccttcataagcttgggccactgcctgggacccagcagacactgcccaggactctttagtgcactcactcttgtctgccccctaccttccctcctggaaccacactacttgaatcaccattactttgcctcgctggcagagttgggtcaagtgccctctccttgaccttgagatgaaggtcaagagcacagggaccaggccttggttaggctgagctcccagcaggacaccgcctgcagaaaggacctgccctgataatgtcccttccccagattctcaagcagatgcccaagggaggtccccacagagccagagtgcctgaggcttcctgcttgagaacctgccccctggatcttggacacttacagattgagctgtatgaattcagcgggtctcactccagagggtcagaacgtttgctttagttttttcatctgttttgttccttgagtcagtgctgttgatgacgagttgtcttgaataaatcatgtgttctttgc

SEQ ID NO: 7475 - DNA, 4925 bp, Homo sapiens
tgcctaccgcgtgcccggcgtcctcgtcgcgcgagttgccggtcccgcggggcctgggctgcgggcccacgggtcccggggatggcgtcggagccgcgctaactccgtttctccttggaccaagatgactgatggaaaactctccacctctacaaatggcgtagccttcatgggtattctggatggtcgaccaggaaacccccttcagaacctgcaacacgtcaatctcaaggcgccccgactcctctccgcgcctgagtacgggcccaagctgaaactcagggctttagaagaccggcacagcctccagtccgtggactcggggattcctaccctggagatcgggaacccggagcctgtaccctgcagcgcggtccacgtgaggaggaagcagtccgactccgacctcatccccgagcgggccttccagagcgcctgcgcgctgccatcctgtgcgccaccagctcctagcagcaccgagcgggaacagagcgtgcgcaaatcctccacgtttcccaggacaggctatgactcggtaaagctctatagcccgacctccaaagccctgacccgcagcgatgatgtctccgtctgcagcgtgtccagtcttgggacagagctgtccaccacgctgtccgtcagcaatgaggacatcttggaccttgtggtcacgagcagctccagtgccattgtgaccctggagaatgacgatgacccacagtttaccaacgtcaccttgagctctatcaaggaaacccgtggcttacaccagcaggactgtgttcatgaagctgaggaggggagtaaattgaaaatattggggccatttagtaacttctttgcaaggaacttgcttgctagaaaacaaagtgcaaggcttgacaaacacaatgacttgggatggaagttatttgggaaagcgccactccgagagaatgcccagaaggattcaaagagaatacagaaggaatatgaagacaaggctggaagacctagcaagccaccctctccaaagcagaatgtgaggaagaatcttgactttgaaccactttccaccaccgcactcatcctcgaggacagaccagcaaatctcccagcaaaaccagctgaagaagctcagaagcacagacagcagtatgaagaaatggtggttcaggccaaaaagcgagagctgaaagaagcccagcgaaggaagaagcagctggaagaaagatgcagagtcgaggaaagcattggaaacgctgtgctcacctggaataatgagatcttacctaactgggaaacaatgtggtgctctagaaaagttcgagatttatggtggcagggaatccctccaagtgtgagaggcaaagtctggagcttagccattggcaacgagttaaatatcacccacgagctctttgacatctgtcttgcccgagccaaggagaggtggcggtcccttagcacaggaggctctgaagtggagaacgaagatgctggtttttcagcagcagacagagaagccagtctggagcttattaaactggacatttctagaacatttcctaatctctgcattttccagcaaggtggtccatatcatgacatgttgcacagtattttgggcgcttatacttgttaccggccagatgtgggttatgtccagggcatgtccttcatagcagcagtgttgatcttgaacttagatactgcagatgcctttattgccttttctaaccttctgaataaaccctgtcaaatggcgttttttagagtggaccatggccttatgttgacttattttgctgcatttgaagtattctttgaagaaaatttgccgaaattatttgcgcatttcaagaagaacaacctaactccagatatctacctaattgattggatctttaccttatatagtaaatctctgcccctcgacctggcctgtcgtatctgggacgtgttctgtcgcgatggggaagagttcctgttccgcacggccctgggcatcctgaagctgttcgaggacatcctgaccaagatggacttcattcacatggcccagttcctgacccggctgcccgaggacctgcccgccgaggagctgtttgcctccatcgccacgatccagatgcagagccgaaacaagaagtgggctcaggtactgactgcattgcagaaagacagccgggaaatggagaagggaagtccgtccctccgacactgaggctgcagcgggaattcgcactcggcaccaatcagagccccatgccgcggcccctctgttgtttcagactgacacccgggcagccgagaagaacagacgctctttaagtttgattcctaacactggagttggccttaaacaaaacaaacacaaaaacttttaaagaattaaaccaaggcttagccttaagcagctcagtggaaggatgagctgctgcggaccacagccagccactgcatctgctgcacagttgaacgatgggcagtggctcacccccactcctttatttcagcaaaagctaattaaattgtaatgtttctatgtcaactactgggaagtatgttacagtcttagccaggatgcatgagagatgttatttgggagacttgagatgctttggctgatatttacatgttttcgataagaaagggatcgctgattgagttattgagatagtttttccagagctggaggtcacgtttctaaaactcacctacgaaagatagcattaaaggaacaggggctctctgaggatggccactgatgtgtgtttgtggatacctgggcatcgacccagcctgcaggtgagctctgggccatgttgccttgacacagtcacagtgtagaggctgcaggtgcacacgtgggctccagtgggactgcgctctgggagactgctccctggcatcggtcctgcggaggtggaaagttcgagaggaggagctatttgcgaggaagccctgtggcaatagagataggcttaaaagcggagagaacacagagtggaatcagccccctgtaagtaaaagggtagagaaagagatgtgtggctgggccctctcccacctgcctgttcagtggaggccagggcagcagcccagaacagcacatgtgggggaggtggccccttgtgccagcagtggctcctctctgcctttgagccctgcacagctggacccatcctaagtgccagtgagtccctcacacatttgactttagaacgtgtgcttcatgacccgttgtacagacggaggagcgagcaacacacgtctaacagcctagacaatctcgtcagatgctcatactggaccatcagcctccccattttagctgactttcccagggtcgttggcaaattttttgttctgtcttttccttgactaattgtagaactttgtgtgaggactttggttatccaaaatcacagaaatgaaccgttttgcagctgcgcagtctaaagggcaggccagtgtctggaagcagggcccacgtggcggtccgctggcaggctggtcctggggagcattctgcggacccggtcacgggcttggttagtcatgcgtacatgtgtgccttggggtgctctgcactccacggcccttctcagccacacttcccaccccagggggtgcccccaggctgatctcatttctgatgttgagggctgtttggctctgtctgtatagcttgtaacaggagccttgggctaggggctggggaaggaaagccgagctggcattcgttctctggactttttatgcctgccatacccgctaatgctcctcgaggtgcaggagcaggttgctgagccagtggctgccccgtgccctccttcccagcactatcatgtgtcacgtttcccggactctgcccctacatctcagctgaatctccagggaggctgcagagcatcgtggagaccactttctgcctcggcctttaaatgctgactcacctcctctcggaggaggcgtcctgtcttcacgggggggtcccggtggcctccagacgtagccatttcctgacatcaagatgttgaatgtaatctggtctgagctgggcctgtgggaggggccgcctgaggcctgtgcgctgttgtcctcgcagatgtacttatttttgttcatgttacgggcgttccgttccttaaagatgtatatattttcttactgtacataaagatgttccttaagtcgtacagaaggtggcgcggcaaagggcctcgtgcagtgtgttcagattgcccctggggatcttctgtgtcttcagcgcccagccctgcgtgttcctggtgaagcagtttcacatcagtctctccagatagcactacgatgtattccgcttctgaacaggatcccatgccagtgtggaacaccttcccaatcttagttcagaagtggcttgtatgacctgttcaggggtcacatgaggtctcgccagtttcctgggtcctcttcagaggccagaaagttctaagttctgagtccccggccagggtcccttaacacctcggcacagaggctgttggcaagtgtagaggctgcctctgtgtgtggtttaagtaaactggaaatgagacattgacgtgctgctcctccagaggtctgcacactccacttcacatgccgttgactctcacagtctaagacttcagggccgggacctttgtccagcctgcacagtagagtgaggctgcctctcccgccaggcattgggatcccatttagaaacggcattcacttcagaaggtactttttaactgctcagtttttgactattttaaatagtttgctgaaaactcctgataacacttgctacatatcatgttttaattgcttgtacagttaacctttaattttatttagtaaagtgtatcaaagtaggacttttttgaattgtaaataggtggttttattaaataaaagtcaatgtaaaattg

SEQ ID NO: 7476 - DNA, 541 bp, Homo sapiens
gaaaagttttcctactccgacgcgaggctcccggcctgagaagaggcgcctcggtgcgccagaccccgaccccggagcccccttccacctcggaccctcagtccccaggcagcggaccctcctccttggagcccctgaccccgctttcatctctgacccctctacccctggagcccctgacccgcgaaaccccctttcatctcggagccctgacctccttggacctccacccacgcgaaccgtctgtccctgggctagggaatctctctgcctccgccttggagcctcccattaccgggccgcgaagaccctggcccggggactgtctcggggccggggtagctgccttgaggatttctccttggaccaagatgactgatggaaaactctccacctctacaaatggcgtagccttcatgggtattctggatggtcgaccaggaaacccccttcagaacctgcaacacgtcaatctcaaggcgccccgactcctctccgcgcctgagtacgggcccaagctgaaactcagggctttagaaga

SEQ ID NO: 7477 - DNA, 663 bp, Homo sapiens
atagattaagagactgaggctggctgggaggacgccacggcgccgctcccaagaccaccgcggcggggcctgagctccggtgtcacgcaaagcttcccttccgcggcggggcccgggccgtctcccgcacaccggccggggcaggggagccccatcgatgcgctccgccgctcggctccctacgcctgagccctgcccgctcgagccccttccccctcccggccgcttcccacttccaagatggctgcgggtggagccgaccagtttctccttggaccaagatgactgatggaaaactctccacctctacaaatggcgtagccttcatgggtattctggatggtcgaccaggaaacccccttcagaacctgcaacacgtcaatctcaaggcgccccgactcctctccgcgcctgagtacgggcccaagctgaaactcagggctttagaagaccggcacagcctccagtccgtggactcggggattcctaccctggagatcgggaacccggagcctgtaccctgcagcgcggtccacgtgaggaggaagcagtccgactccgacctcatccccgagcgggccttccagagcgcctgcgcgctgccatcctgtgcgccaccagctcctagcagcaccgagcgggaacagagcgtgcgcaaatcct

SEQ ID NO: 7478 - DNA, 1469 bp, Homo sapiens
ttacctaactgggaaacaatgtggtgctctagaaaagttcgagatttatggtggcagggaatccctccaagtgtgagaggcaaagtctggagcttagccattggcaacgagttaaatatcacccacgagctctttgacatctgtcttgcccgagccaaggagaggtggcggtcccttagcacaggaggctctgaagtggagaacgaagatgctggtttttcagcagcagacagagaagccagtctggagcttattaaactggacatttctagaacatttcctaatctctgcattttccagcaagttctcatctttgtggatttccgtgtgggtcttcagaaatcttttcagaagaggaaagagagggaatctacaaagctccagcagctttggtcctggtgtctgggtggtccatatcatgacatgttgcacagtattttgggcgcttatacttgttaccggccagatgtgggttatgtccagggcatgtccttcatagcagcagtgttgatcttgaacttagatactgcagatgcctttattgccttttctaaccttctgaataaaccctgtcaaatggcgttttttagagtggaccatggccttatgttgacttattttgctgcatttgaagtattctttgaagaaaatttgccgaaattatttgcgcatttcaagaagaacaacctaactccagatatctacctaattgattggatctttaccttatatagtaaatctctgcccctcgacctggcctgtcgtatctgggacgtgttctgtcgcgatggggaagagttcctgttccgcacggccctgggcatcctgaagctgttcgaggacatcctgaccaagatggacttcattcacatggcccagttcctgacccggctgcccgaggacctgcccgccgaggagctgtttgcctccatcgccacgatccagatgcagagccgaaacaagaagtgggctcaggtactgactgcattgcagaaagacagccgggaaatggagaagggaagtccgtccctccgacactgaggctgcagcgggaattcgcactcggcaccaatcagagccccatgccgcggcccctctgttgtttcagactgacacccgggcagccgagaagaacagacgctctttaagtttgattcctaacactggagttggccttaaacaaaacaaacacaaaaacttttaaagaattaaaccaaggcttagccttaagcagctcagtggaaggatgagctgctgcggaccacagccagccactgcatctgctgcacagttgaacgatgggcagtggctcacccccactcctttatttcagcaaaagctaattaaattgtaatgtttctatgtcaactactgggaagtatgttacagtcttagccaggatgcatgagagatgttatttgggagacttgagatgctttggctgatatttacatgttttcgataagaaa

SEQ ID NO: 7479 - DNA, 4887 bp, Homo sapiens
gagccccttccccctcccggccgcttcccacttccaagatggctgcgggtggagccgaccagtttctccttggaccaagatgactgatggaaaactctccacctctacaaatggcgtagccttcatgggtattctggatggtcgaccaggaaacccccttcagaacctgcaacacgtcaatctcaaggcgccccgactcctctccgcgcctgagtacgggcccaagctgaaactcagggctttagaagaccggcacagcctccagtccgtggactcggggattcctaccctggagatcgggaacccggagcctgtaccctgcagcgcggtccacgtgaggaggaagcagtccgactccgacctcatccccgagcgggccttccagagcgcctgcgcgctgccatcctgtgcgccaccagctcctagcagcaccgagcgggaacagagcgtgcgcaaatcctccacgtttcccaggacaggctatgactcggtaaagctctatagcccgacctccaaagccctgacccgcagcgatgatgtctccgtctgcagcgtgtccagtcttgggacagagctgtccaccacgctgtccgtcagcaatgaggacatcttggaccttgtggtcacgagcagctccagtgccattgtgaccctggagaatgacgatgacccacagtttaccaacgtcaccttgagctctatcaaggaaacccgtggcttacaccagcaggactgtgttcatgaagctgaggaggggagtaaattgaaaatattggggccatttagtaacttctttgcaaggaacttgcttgctagaaaacaaagtgcaaggcttgacaaacacaatgacttgggatggaagttatttgggaaagcgccactccgagagaatgcccagaaggattcaaagagaatacagaaggaatatgaagacaaggctggaagacctagcaagccaccctctccaaagcagaatgtgaggaagaatcttgactttgaaccactttccaccaccgcactcatcctcgaggacagaccagcaaatctcccagcaaaaccagctgaagaagctcagaagcacagacagcagtatgaagaaatggtggttcaggccaaaaagcgagagctgaaagaagcccagcgaaggaagaagcagctggaagaaagatgcagagtcgaggaaagcattggaaacgctgtgctcacctggaataatgagatcttacctaactgggaaacaatgtggtgctctagaaaagttcgagatttatggtggcagggaatccctccaagtgtgagaggcaaagtctggagcttagccattggcaacgagttaaatatcacccacgagctctttgacatctgtcttgcccgagccaaggagaggtggcggtcccttagcacaggaggctctgaagtggagaacgaagatgctggtttttcagcagcagacagagaagccagtctggagcttattaaactggacatttctagaacatttcctaatctctgcattttccagcaaggtggtccatatcatgacatgttgcacagtattttgggcgcttatacttgttaccggccagatgtgggttatgtccagggcatgtccttcatagcagcagtgttgatcttgaacttagatactgcagatgcctttattgccttttctaaccttctgaataaaccctgtcaaatggcgttttttagagtggaccatggccttatgttgacttattttgctgcatttgaagtattctttgaagaaaatttgccgaaattatttgcgcatttcaagaagaacaacctaactccagatatctacctaattgattggatctttaccttatatagtaaatctctgcccctcgacctggcctgtcgtatctgggacgtgttctgtcgcgatggggaagagttcctgttccgcacggccctgggcatcctgaagctgttcgaggacatcctgaccaagatggacttcattcacatggcccagttcctgacccggctgcccgaggacctgcccgccgaggagctgtttgcctccatcgccacgatccagatgcagagccgaaacaagaagtgggctcaggtactgactgcattgcagaaagacagccgggaaatggagaagggaagtccgtccctccgacactgaggctgcagcgggaattcgcactcggcaccaatcagagccccatgccgcggcccctctgttgtttcagactgacacccgggcagccgagaagaacagacgctctttaagtttgattcctaacactggagttggccttaaacaaaacaaacacaaaaacttttaaagaattaaaccaaggcttagccttaagcagctcagtggaaggatgagctgctgcggaccacagccagccactgcatctgctgcacagttgaacgatgggcagtggctcacccccactcctttatttcagcaaaagctaattaaattgtaatgtttctatgtcaactactgggaagtatgttacagtcttagccaggatgcatgagagatgttatttgggagacttgagatgctttggctgatatttacatgttttcgataagaaagggatcgctgattgagttattgagatagtttttccagagctggaggtcacgtttctaaaactcacctacgaaagatagcattaaaggaacaggggctctctgaggatggccactgatgtgtgtttgtggatacctgggcatcgacccagcctgcaggtgagctctgggccatgttgccttgacacagtcacagtgtagaggctgcaggtgcacacgtgggctccagtgggactgcgctctgggagactgctccctggcatcggtcctgcggaggtggaaagttcgagaggaggagctatttgcgaggaagccctgtggcaatagagataggcttaaaagcggagagaacacagagtggaatcagccccctgtaagtaaaagggtagagaaagagatgtgtggctgggccctctcccacctgcctgttcagtggaggccagggcagcagcccagaacagcacatgtgggggaggtggccccttgtgccagcagtggctcctctctgcctttgagccctgcacagctggacccatcctaagtgccagtgagtccctcacacatttgactttagaacgtgtgcttcatgacccgttgtacagacggaggagcgagcaacacacgtctaacagcctagacaatctcgtcagatgctcatactggaccatcagcctccccattttagctgactttcccagggtcgttggcaaattttttgttctgtcttttccttgactaattgtagaactttgtgtgaggactttggttatccaaaatcacagaaatgaaccgttttgcagctgcgcagtctaaagggcaggccagtgtctggaagcagggcccacgtggcggtccgctggcaggctggtcctggggagcattctgcggacccggtcacgggcttggttagtcatgcgtacatgtgtgccttggggtgctctgcactccacggcccttctcagccacacttcccaccccagggggtgcccccaggctgatctcatttctgatgttgagggctgtttggctctgtctgtatagcttgtaacaggagccttgggctaggggctggggaaggaaagccgagctggcattcgttctctggactttttatgcctgccatacccgctaatgctcctcgaggtgcaggagcaggttgctgagccagtggctgccccgtgccctccttcccagcactatcatgtgtcacgtttcccggactctgcccctacatctcagctgaatctccagggaggctgcagagcatcgtggagaccactttctgcctcggcctttaaatgctgactcacctcctctcggaggaggcgtcctgtcttcacgggggggtcccggtggcctccagacgtagccatttcctgacatcaagatgttgaatgtaatctggtctgagctgggcctgtgggaggggccgcctgaggcctgtgcgctgttgtcctcgcagatgtacttatttttgttcatgttacgggcgttccgttccttaaagatgtatatattttcttactgtacataaagatgttccttaagtcgtacagaaggtggcgcggcaaagggcctcgtgcagtgtgttcagattgcccctggggatcttctgtgtcttcagcgcccagccctgcgtgttcctggtgaagcagtttcacatcagtctctccagatagcactacgatgtattccgcttctgaacaggatcccatgccagtgtggaacaccttcccaatcttagttcagaagtggcttgtatgacctgttcaggggtcacatgaggtctcgccagtttcctgggtcctcttcagaggccagaaagttctaagttctgagtccccggccagggtcccttaacacctcggcacagaggctgttggcaagtgtagaggctgcctctgtgtgtggtttaagtaaactggaaatgagacattgacgtgctgctcctccagaggtctgcacactccacttcacatgccgttgactctcacagtctaagacttcagggccgggacctttgtccagcctgcacagtagagtgaggctgcctctcccgccaggcattgggatcccatttagaaacggcattcacttcagaaggtactttttaactgctcagtttttgactattttaaatagtttgctgaaaactcctgataacacttgctacatatcatgttttaattgcttgtacagttaacctttaattttatttagtaaagtgtatcaaagtaggacttttttgaattgtaaataggtggttttattaaataaaagtcaatgtaaaattgttactta

SEQ ID NO: 7480 - DNA, 4149 bp, Homo sapiens
cagcgcggatcgcctcgctgtgtctgcgcgcgattgagcggcctgccgccccgccccgccccgcgagtctgaggagccgccgcgtccgcccgcccgcccgcggtccgggagggagggagggaggccggccctccgctcgctgggcatggagcctccggccgcgcgcctctaaggccccggcgttcatggaatatgaagacaaggctggaagacctagcaagccaccctctccaaagcagaatgtgaggaagaatcttgactttgaaccactttccaccaccgcactcatcctcgaggacagaccagcaaatctcccagcaaaaccagctgaagaagctcagaagcacagacagcagtatgaagaaatggtggttcaggccaaaaagcgagagctgaaagaagcccagcgaaggaagaagcagctggaagaaagatgcagagtcgaggaaagcattggaaacgctgtgctcacctggaataatgagatcttacctaactgggaaacaatgtggtgctctagaaaagttcgagatttatggtggcagggaatccctccaagtgtgagaggcaaagtctggagcttagccattggcaacgagttaaatatcacccacgagctctttgacatctgtcttgcccgagccaaggagaggtggcggtcccttagcacaggaggctctgaagtggagaacgaagatgctggtttttcagcagcagacagagaagccagtctggagcttattaaactggacatttctagaacatttcctaatctctgcattttccagcaaggtggtccatatcatgacatgttgcacagtattttgggcgcttatacttgttaccggccagatgtgggttatgtccagggcatgtccttcatagcagcagtgttgatcttgaacttagatactgcagatgcctttattgccttttctaaccttctgaataaaccctgtcaaatggcgttttttagagtggaccatggccttatgttgacttattttgctgcatttgaagtattctttgaagaaaatttgccgaaattatttgcgcatttcaagaagaacaacctaactccagatatctacctaattgattggatctttaccttatatagtaaatctctgcccctcgacctggcctgtcgtatctgggacgtgttctgtcgcgatggggaagagttcctgttccgcacggccctgggcatcctgaagctgttcgaggacatcctgaccaagatggacttcattcacatggcccagttcctgacccggctgcccgaggacctgcccgccgaggagctgtttgcctccatcgccacgatccagatgcagagccgaaacaagaagtgggctcaggtactgactgcattgcagaaagacagccgggaaatggagaagggaagtccgtccctccgacactgaggctgcagcgggaattcgcactcggcaccaatcagagccccatgccgcggcccctctgttgtttcagactgacacccgggcagccgagaagaacagacgctctttaagtttgattcctaacactggagttggccttaaacaaaacaaacacaaaaacttttaaagaattaaaccaaggcttagccttaagcagctcagtggaaggatgagctgctgcggaccacagccagccactgcatctgctgcacagttgaacgatgggcagtggctcacccccactcctttatttcagcaaaagctaattaaattgtaatgtttctatgtcaactactgggaagtatgttacagtcttagccaggatgcatgagagatgttatttgggagacttgagatgctttggctgatatttacatgttttcgataagaaagggatcgctgattgagttattgagatagtttttccagagctggaggtcacgtttctaaaactcacctacgaaagatagcattaaaggaacaggggctctctgaggatggccactgatgtgtgtttgtggatacctgggcatcgacccagcctgcaggtgagctctgggccatgttgccttgacacagtcacagtgtagaggctgcaggtgcacacgtgggctccagtgggactgcgctctgggagactgctccctggcatcggtcctgcggaggtggaaagttcgagaggaggagctatttgcgaggaagccctgtggcaatagagataggcttaaaagcggagagaacacagagtggaatcagccccctgtaagtaaaagggtagagaaagagatgtgtggctgggccctctcccacctgcctgttcagtggaggccagggcagcagcccagaacagcacatgtgggggaggtggccccttgtgccagcagtggctcctctctgcctttgagccctgcacagctggacccatcctaagtgccagtgagtccctcacacatttgactttagaacgtgtgcttcatgacccgttgtacagacggaggagcgagcaacacacgtctaacagcctagacaatctcgtcagatgctcatactggaccatcagcctccccattttagctgactttcccagggtcgttggcaaattttttgttctgtcttttccttgactaattgtagaactttgtgtgaggactttggttatccaaaatcacagaaatgaaccgttttgcagctgcgcagtctaaagggcaggccagtgtctggaagcagggcccacgtggcggtccgctggcaggctggtcctggggagcattctgcggacccggtcacgggcttggttagtcatgcgtacatgtgtgccttggggtgctctgcactccacggcccttctcagccacacttcccaccccagggggtgcccccaggctgatctcatttctgatgttgagggctgtttggctctgtctgtatagcttgtaacaggagccttgggctaggggctggggaaggaaagccgagctggcattcgttctctggactttttatgcctgccatacccgctaatgctcctcgaggtgcaggagcaggttgctgagccagtggctgccccgtgccctccttcccagcactatcatgtgtcacgtttcccggactctgcccctacatctcagctgaatctccagggaggctgcagagcatcgtggagaccactttctgcctcggcctttaaatgctgactcacctcctctcggaggaggcgtcctgtcttcacgggggggtcccggtggcctccagacgtagccatttcctgacatcaagatgttgaatgtaatctggtctgagctgggcctgtgggaggggccgcctgaggcctgtgcgctgttgtcctcgcagatgtacttatttttgttcatgttacgggcgttccgttccttaaagatgtatatattttcttactgtacataaagatgttccttaagtcgtacagaaggtggcgcggcaaagggcctcgtgcagtgtgttcagattgcccctggggatcttctgtgtcttcagcgcccagccctgcgtgttcctggtgaagcagtttcacatcagtctctccagatagcactacgatgtattccgcttctgaacaggatcccatgccagtgtggaacaccttcccaatcttagttcagaagtggcttgtatgacctgttcaggggtcacatgaggtctcgccagtttcctgggtcctcttcagaggccagaaagttctaagttctgagtccccggccagggtcccttaacacctcggcacagaggctgttggcaagtgtagaggctgcctctgtgtgtggtttaagtaaactggaaatgagacattgacgtgctgctcctccagaggtctgcacactccacttcacatgccgttgactctcacagtctaagacttcagggccgggacctttgtccagcctgcacagtagagtgaggctgcctctcccgccaggcattgggatcccatttagaaacggcattcacttcagaaggtactttttaactgctcagtttttgactattttaaatagtttgctgaaaactcctgataacacttgctacatatcatgttttaattgcttgtacagttaacctttaattttatttagtaaagtgtatcaaagtaggacttttttgaattgtaaataggtggttttattaaataaaagtcaatgtaaaattgtta

SEQ ID NO: 7481 - DNA, 3257 bp, Homo sapiens
gacggtggcggctctcggagccggcgcgaatccggcccccgcagcgggacccgggcaggtcttgacgagccctgcccgggccgacgcatgcggaggatggaaacacttgcccggcaatgtctctgggccgcctccttcgcagggcctcctccaaagcctcggacctcctgaccctcacccccggtggcagcggcagcgggtccccctctgtcctggatggagagatcatctactccaagaacaatgtctgcgtgcacccgccggaggggctgcaggggctgggggagcaccacccaggttacctgtgcttgtacatggagaaggatgagatgctgggagccaccctcatcctggcatgggtccccaactctcgcatccagaggcaggacgaggaggccctgcgctacatcacacccgagagctcccccgttcgcaaggcaccccgccctcggggccggcgcacccggagctcaggagcctcccaccagccctccccgacggagctgcggcctaccctgacccccaaagatgaggacatcctggtggtggcccagagtgttccagaccgcatgctcgccagccctgcgccagaggatgaggagaagctggcgcagggcttgggggtggatggtgcccagccagcctcgcagcctgcttgcagcccctccgggatcttgtcgacggtcagtccgcaggatgtcaccgaggaggggcgggagccgcggcccgaggccggggaggaggatggctctttggaactgtcagccgagggcgtgagcagagacagctcctttgactcagactcagacaccttctcctcgcccttctgcctctcgcccatcagcgcggcgctggccgagagccgcggctccgtgtttctggaaagtgacagcagccccccgtccagctccgacgccggcctgcggttcccggacagcaacggcctcctgcagaccccacgctgggacgagccgcagcgggtgtgcgccctggagcagatttgcggcgtgttccgcgtggacctgggccacatgcgctccctccgccttttcttcagcgacgaggcctgcaccagcggccagctggtcgttgccagccgagagagccagtacaaggttttccacttccaccacggcggcctggacaagctgtctgacgtgttccagcagtggaaatactgcaccgagatgcagctcaaagaccagcaggtcgcccccgataagacatgcatgcagttctccatccgccgccccaagctgccgtcctccgagacgcaccccgaggagagcatgtacaagaggctcggcgtctccgcctggctcaaccacctgaatgagctgggccaggtggaggaggagtacaagctgcggaaggccattttctttggcggtattgatgtgtcaatccgcggggaggtctggcccttcctgctgcgctattacagccacgagtccacgtcggaggagcgggaggcgctgcggctgcagaagcgaaaggagtactctgagatccagcagaaaaggctctccatgactcccgaggagcacagagcgttctggcgtaatgtgcagttcactgtggacaaagacgtggtccggacagatcggaacaaccagttcttccggggggaagacaatcccaatgtggagagcatgaggaggatcctgctgaactacgccgtgtacaaccctgccgtcggctattcccaagggatgtcggacctggtggcgcccatcttggccgaggtcctggatgagtcagacaccttctggtgctttgtgggtttgatgcagaacacgatcttcgtcagctcaccccgggacgaggacatggagaaacaactgctgtacctgcgcgagctgctgcggctgacgcacgtgcgcttctaccagcacctggtctcgctgggcgaggacggcctgcagatgctcttctgccaccgctggctccttctgtgcttcaagcgggagttccccgaggccgaagcgctgcggatctgggaggcctgctgggcccactaccagacggactacttccaccttttcatctgcgtggccatcgtggccatctacggggatgacgtcatcgagcagcagctggccacggaccagatgctcctgcacttcggaaacctggccatgcacatgaacggggagctcgttctccggaaggcgaggagtttgctgtaccagttccgcctcctgccccggatcccctgcagcctgcacgatctgtgtaagctgtgcgggtcaggcatgtgggacagcggctccatgcccgcggtggagtgcaccggccaccatcccggctcggagagctgtccctacgggggcacggtggagatgccttcccccaagtccctgagggaaggcaagaagggcccaaagacgccgcaggacggcttcggcttccgcagataggtcgggcccccgacaccggacaggggttgaggggacctcctcagaggccctgggcacgggagggggtggggctgggcgtgaaggggacaggggacggtagaaacctaaggaaaatgcttttgggcaacatgagaggaaccttttcatattaatgacaaaattagagtctggaagtgacagaagtcagatctacagccacccagaggaaagtcagctcctgaaacgctgcagtggaacgcgcagccaccgcacctgagacgcaggctggctgggctctcctgctggctgccctggaggatttcaacatgtcccaggatttgctccaccctcgagggcagccagacagcgtcgccaggcaatgaggaaagcagagacaggagaggaaggcctcactcacccactgcgtcgagggctgcagaacacagcggggtcctgtccaggcccagggacatctttgcaagccagacacacttcctcttgagacctcgttctctcggagtgagccaaacacacttcccaaaacgtccccagccacagctgggatgccgatggaaaggcatctgccataaaagaaaagcaaaagataaaaagcccaaccgatgtggggatagagaggcggaagagcagtcaggcttgaggagctggcgcttgtaatgtttatccgtttaaacatttcgtcctcctggtacacgaagggaactgtctgcccaggagcctgagcctcaggctgttggagaagcatctgatgcctttttctttgctgggggtcttctacgtgaggttccttggcgttgtttaaggtcaactccaccaaatacagcaaccagctggggcttg

SEQ ID NO: 7482 - DNA, 4245 bp, Homo sapiens
ctggggttggagagagtggggggcggcggcacagtgggccggggaggagagagccgcagagggaaaccgattttaagatgaaggtcgcccccgataagacatgcatgcagttctccatccgccgccccaagctgccgtcctccgagacgcaccccgaggagagcatgtacaagaggctcggcgtctccgcctggctcaaccacctgaatgagctgggccaggtggaggaggagtacaagctgcggaaggccattttctttggcggtattgatgtgtcaatccgcggggaggtctggcccttcctgctgcgctattacagccacgagtccacgtcggaggagcgggaggcgctgcggctgcagaagcgaaaggagtactctgagatccagcagaaaaggctctccatgactcccgaggagcacagagcgttctggcgtaatgtgcagttcactgtggacaaagacgtggtccggacagatcggaacaaccagttcttccggggggaagacaatcccaatgtggagagcatgaggaggatcctgctgaactacgccgtgtacaaccctgccgtcggctattcccaagggatgtcggacctggtggcgcccatcttggccgaggtcctggatgagtcagacaccttctggtgctttgtgggtttgatgcagaacacgatcttcgtcagctcaccccgggacgaggacatggagaaacaactgctgtacctgcgcgagctgctgcggctgacgcacgtgcgcttctaccagcacctggtctcgctgggcgaggacggcctgcagatgctcttctgccaccgctggctccttctgtgcttcaagcgggagttccccgaggccgaagcgctgcggatctgggaggcctgctgggcccactaccagacggactacttccaccttttcatctgcgtggccatcgtggccatctacggggatgacgtcatcgagcagcagctggccacggaccagatgctcctgcacttcggaaacctggccatgcacatgaacggggagctcgttctccggaaggcgaggagtttgctgtaccagttccgcctcctgccccggatcccctgcagcctgcacgatctgtgtaagctgtgcgggtcaggcatgtgggacagcggctccatgcccgcggtggagtgcaccggccaccatcccggctcggagagctgtccctacgggggcacggtggagatgccttcccccaagtccctgagggaaggcaagaagggcccaaagacgccgcaggacggcttcggcttccgcagataggtcgggcccccgacaccggacaggggttgaggggacctcctcagaggccctgggcacgggagggggtggggctgggcgtgaaggggacaggggacggtagaaacctaaggaaaatgcttttgggcaacatgagaggaaccttttcatattaatgacaaaattagagtctggaagtgacagaagtcagatctacagccacccagaggaaagtcagctcctgaaacgctgcagtggaacgcgcagccaccgcacctgagacgcaggctggctgggctctcctgctggctgccctggaggatttcaacatgtcccaggatttgctccaccctcgagggcagccagacagcgtcgccaggcaatgaggaaagcagagacaggagaggaaggcctcactcacccactgcgtcgagggctgcagaacacagcggggtcctgtccaggcccagggacatctttgcaagccagacacacttcctcttgagacctcgttctctcggagtgagccaaacacacttcccaaaacgtccccagccacagctgggatgccgatggaaaggcatctgccataaaagaaaagcaaaagataaaaagcccaaccgatgtggggatagagaggcggaagagcagtcaggcttgaggagctggcgcttgtaatgtttatccgtttaaacatttcgtcctcctggtacacgaagggaactgtctgcccaggagcctgagcctcaggctgttggagaagcatctgatgcctttttctttgctgggggtcttctacgtgaggttccttggcgttgtttaaggtcaactccaccaaatacagcaaccagctggggcttgaatgggtcgatgtgtgcgtgtgtccctgcgtgcatgcatgcatgcacacgtgcgtgcgtgtttgtgtttgcaagatcctctgacaatgatctgctttgtcccagggacgtggtagtgtattagctgaccaaccaagacaaggacacctggaaatagttagactcttccacttcccttcaggacctgtgaactcagatatgtaagtcagcttctcaggtggtcggacgtgagagcgaccacagtgaaggagccagcactcagggctctctgccttctatgtgggaatgaggtcttcccaacagactctccctcttccaaaagattgtgtatcagttgctccttctgggatttagagatggacagaaaagggtgtgcgatctatgctgtgagaactcccagccagcttagaagtgtcgagccatttgcacagaaagccactccttgagcgaggagaccaaatccctcctgaaatcctccatcgcgtccttctggggagaaaaacccttgatgtgctgagaaccatcatggggaccaggatagaaggcttcttcccactcaaagcttttctccctggagggtgggcactgctgggccatgccacttcaaagcagtgttcctcagcaggaaagcggaggtcaccacttaccggcctcctccaccttctcggcttctcttttctccatgaacccaggtcgtccagcaggtacttccaagttcccaggtctgtctgcctaagagccttttgaggagaccgtcctggagccccatcagtgcccagatcctggggtaccgaccattgctgtctagcagtgggggatcctgtggtgggaatggggtgggcttctcatccatgttgcttctgggaagagagggttgcctttctgggctagggaggtggctggagcttctgccctgaccctccgctagaaaccagttatatccattgccacagcaatactgtgtaacaaatccgccaacactcggtggcctgcaacagtcagcactgatctagggcaggagtcagcagtctgggcagggtgattcttctggtctaggctgggcttgtttgtttagggccagtgggttgttaagtcccaggggatgctcatggtgcagaggtcggacctggccctgctctgtggtctcttgcatccctcctgcaggccagccatggcacagccaaaggcacggagggagagacagcaagtgcctttccaagccttggtggacaccacacctgcagctctccccttggccacagcaagtcacgtggctgggctcagcattaaggggtgggggacaggcctgccactttattgtccgctctgcacagtcgggtggcagtaggctgagaatttggagggctaaacaactgggactctggagagtctgtgtcctaataatgcctgctttggagcactccttccccacccgcctgctccaggggaatagcgtccctggtcctagcatttcactagatacctcgtgcctttgaaccgctgtgtttgggagggaggaagaggatagacaggtccagggctcccctcacttgggaaggtcctagtagaaggcattccttctgagtctcctggccctacagcttctcacccctgctgctccccaagacctgacccggaccaatcagctgcatctctgcaccaagtgccacccccaccgtgcactgctcgcacctcacgctccccatgggctggcccggaccccagtgaggtctgcacctctcggaccagccaggacctcggaagccatgagctgggtgttcagggcttggcggaggagacgctgctccgcgggggatggagaagccccgcccctccacaactcccttaatctggatgcaattagaggaaaccagccaaaaaccccgcggcagctgttgccccgggattattcccagccagcgagaggcattagggcgataattcagtcattagacttctagccttcccaccgccagaacgtgcaaataggggataatcagccctgcacggccatcctcagcaatgctgcttatttaacccattttttaaaatgacacttaatgttattggctggcgtacgtgtgtgcgcatacttaaaagttgatgcgtggtgc

SEQ ID NO: 7483 - DNA, 2371 bp, Homo sapiens
aggtggtgcagctctcagaccctcccacttgtttacttcgtggcgagagggcgaacactgcgcctgcgcactctccgtagccggatccaccttcagcgtctgcgccacgtgactccgatccaccctcgaggttccagtggaataacccccttctgaaaaatggtttcacccgctccttctctagaacgggtcgggccgctaccactgtccggcccggaggggaactgttttctccggaagtgacaacacgctgactaggaaaaggaggaggcggggcagtggggccttcggcggcgactatggaaggagccggctacagggtggtgtttgagaagggcggagtgtacctgcacaccagcgctaagaagtatcaggaccgagactctctcatcgctggtgtcatccgtgtcgtggaaaaggacaatgacgtcctcctgcactgggctcctgtagaggaggctggagattccacccaaatcctcttctccaagaaggactccagtgggggtgactcatgtgcttctgaggaggaaccaacctttgaccccgactatgaacctgactgggctgtcatcagcactgtgcggccacagctctgccactcagagcccacgagaggtgcagagcccagctgcccccagggctcctgggccttctcagtgagtctgggggagctaaagtccatccgccgctccaagccaggcctcagctgggcctacctggttctggtgacccaggctggaggttccctgcccgcactgcacttccaccgcgggggcacccgcgccctgctccgcgtcctcagccgctacctgctgttggccagctccccgcaggactcccgcctctaccttgtcttcccccacgactcctctgctctctccaactccttccaccacctgcagctctttgaccaggacagctccaatgtggtgtcacgcttcctccaggatccctactccaccaccttcagcagcttctcccgagtgaccaacttcttccggggtgccctgcagccacagcctgagggagccgcctccgaccttcccccgccacccgacgatgagcccgagcctggattcgaggtcatttcctgtgtggagctggggcctcggccaaccgtggagcggggccctccagttacagaggaggagtgggcacgccacgtgggccctgaaggtcgcctgcagcaggtccctgagctgaagaaccggatcttctcggggggtctgagccccagcctgcggcgcgaggcctggaagttcctcctagggtacctcagctgggaaggcacagctgaggagcacaaggcccacatacgcaagaaaacggatgagtatttccgcatgaagctgcagtggaaatctgtgagccctgagcaggagcggagaaactcacttctgcatggataccgcagcctcatcgaaagggatgtgagccgcactgacaggaccaacaagttctacgagggtcccgagaacccggggctgggcctgctgaacgatatcctcctcacctactgcatgtatcacttcgacctcggctacgtccagggcatgagtgatcttctctccccgatcctctacgtcattcagaacgaggtggatgctttctggtgtttctgtggcttcatggagctcgtgcaagggaactttgaagagagccaggagaccatgaagcggcaactcgggcgactgctgctgctcctgagggtgctggaccccctgctctgcgacttcctggattcccaggactccggctctctctgcttctgtttccggtggctgctcatctggttcaagagggaattccccttcccggatgtccttcggctgtgggaggtgctgtggacagggctccctggccccaatctgcacctgctggtggcctgcgccatcctggacatggagagggacaccctcatgctgtccggcttcggctccaatgagatcctcaagcacatcaacgagctgactatgaagctgagcgtggaggacgtgctgacccgcgccgaggccctgcaccgccagctaaccgcctgccccgagctgccccacaacgtgcaggagatcctggggctggccccgcccgcagagccccacagcccctcgcccaccgcctccccgctgcctctgtcgcccacccgggccccgcccaccccgccgccctccacggacacagccccgcagcccgacagcagcctggagatcctgcccgaggaggaggacgagggcgccgactcctaaccccgccaggcagcctcgttctgcacaggcactttagcccgagccaggcacacctgcgagggggcaggtgtgctccgccgccctgctgataagctggcttcattaaactgacacttctcatgtgc

SEQ ID NO: 7484 - DNA, 2272 bp, Homo sapiens
aggtggtgcagctctcagaccctcccacttgtttacttcgtggcgagagggcgaacactgcgcctgcgcactctccgtagccggatccaccttcagcgtctgcgccacgtgactccgatccaccctcgaggttccagtggaataacccccttctgaaaaatggtttcacccgctccttctctagaacgggtcgggccgctaccactgtccggcccggaggggaactgttttctccggaagtgacaacacgctgactaggaaaaggaggaggcggggcagtggggccttcggcggcgactatggaaggagccggctacagggacaatgacgtcctcctgcactgggctcctgtagaggaggctggagattccacccaaatcctcttctccaagaaggactccagtgggggtgactcatgtgcttctgaggaggaaccaacctttgaccccgactatgaacctgactgggctgtcatcagcactgtgcggccacagctctgccactcagagcccacgagaggtgcagagcccagctgcccccagggctcctgggccttctcagtgagtctgggggagctaaagtccatccgccgctccaagccaggcctcagctgggcctacctggttctggtgacccaggctggaggttccctgcccgcactgcacttccaccgcgggggcacccgcgccctgctccgcgtcctcagccgctacctgctgttggccagctccccgcaggactcccgcctctaccttgtcttcccccacgactcctctgctctctccaactccttccaccacctgcagctctttgaccaggacagctccaatgtggtgtcacgcttcctccaggatccctactccaccaccttcagcagcttctcccgagtgaccaacttcttccggggtgccctgcagccacagcctgagggagccgcctccgaccttcccccgccacccgacgatgagcccgagcctggattcgaggtcatttcctgtgtggagctggggcctcggccaaccgtggagcggggccctccagttacagaggaggagtgggcacgccacgtgggccctgaaggtcgcctgcagcaggtccctgagctgaagaaccggatcttctcggggggtctgagccccagcctgcggcgcgaggcctggaagttcctcctagggtacctcagctgggaaggcacagctgaggagcacaaggcccacatacgcaagaaaacggatgagtatttccgcatgaagctgcagtggaaatctgtgagccctgagcaggagcggagaaactcacttctgcatggataccgcagcctcatcgaaagggatgtgagccgcactgacaggaccaacaagttctacgagggtcccgagaacccggggctgggcctgctgaacgatatcctcctcacctactgcatgtatcacttcgacctcggctacgtccagggcatgagtgatcttctctccccgatcctctacgtcattcagaacgaggtggatgctttctggtgtttctgtggcttcatggagctcgtgcaagggaactttgaagagagccaggagaccatgaagcggcaactcgggcgactgctgctgctcctgagggtgctggaccccctgctctgcgacttcctggattcccaggactccggctctctctgcttctgtttccggtggctgctcatctggttcaagagggaattccccttcccggatgtccttcggctgtgggaggtgctgtggacagggctccctggccccaatctgcacctgctggtggcctgcgccatcctggacatggagagggacaccctcatgctgtccggcttcggctccaatgagatcctcaagcacatcaacgagctgactatgaagctgagcgtggaggacgtgctgacccgcgccgaggccctgcaccgccagctaaccgcctgccccgagctgccccacaacgtgcaggagatcctggggctggccccgcccgcagagccccacagcccctcgcccaccgcctccccgctgcctctgtcgcccacccgggccccgcccaccccgccgccctccacggacacagccccgcagcccgacagcagcctggagatcctgcccgaggaggaggacgagggcgccgactcctaaccccgccaggcagcctcgttctgcacaggcactttagcccgagccaggcacacctgcgagggggcaggtgtgctccgccgccctgctgataagctggcttcattaaactgacacttctcatgtgc

SEQ ID NO: 7485 - DNA, 2263 bp, Homo sapiens
tttcaaccatagacaaggcaggaacaacggtgtgaaaagcgtcctccccgccccggtctttttccgccggcggaacgcagatgctgtggccttcaggcgctgaggggaccagagagggacggacacaaggctcggcagttgcctggtaacgcccgctggaggagtcccagtgtaataaggtcccggagaagtgtcactggccctgagtgggacccggtagcccgttcgctccgcgccggcggcctgtccccgcggcttggcgggctagggcaggggaaatgttgcaggaggagtcggacctctctctcattattgcccagatagtccaaaagctcaagggctccaatttgtactctcagctggaacggcaggcctgggccagtcttcagagacctgagattaaacttgaatcactgaaagaagatattaaggaattctttaaaatatcaggttgggagaagaaacttcagaatgctgtttatagtgaactgagtgtgtttcctttacctagtcatcctgctgcacctcctgaacatcttaaagaacctttggtatacatgaggaaagcacagggaagttgggaaaaaagaattttgaagagtttaaatagtatgtgcactgaactgagtatcccactggcacgaaagaggccagttggagaacagaaagaacttcttaataaatggaatgaaatgggaactgatgaaccagatttaagccttttcagacctgtttatgcacctaaggattttcttgaggtattaattaatcttcgcaacccaaattatgaaaacggtgattctcttagtttcaggactcatttgggtttaattcaagttccactgaaagtaaaagacatccctgaattgaaagaatgctttgtggaacttggcttaaatataggacaactgggtatagatgattctacacaagtgcctcctgaactttttgaaaatgaacatgtacgtattgggcaaaaagttctagcagaacaagatagtgctgctgctcaacagtacatcagacaaggaagtcccacggcactgagagctgaattgtgggctctcattttgaatatttccagccaacctgaggatgtcttgtattatgagcagcttaagaccaatgtgatacaacatgaccttttggtggacagtctaatctataaagatgtgaagttgacagcaagcaatgatgattattattttgtatttgaagattatttatatcaggtattactttgtttttcccgggatacatctgtgttgagtcactttgcattcaacagtgcctcgccaccaaaatcatacataagaggaaaactaggactggaagaatatgctgtcttttacccaccaaatggtgttatcccttttcatggattttcaatgtatgttgcaccactttgttttctataccatgaaccttccaaattgtatcagatattccgtgagatgtatgtgcgttttttcttcagactccattccatctcttctcatccttctggtattgtgtcactctgtctgctgtttgaaactcttcttcaaacttatcttccccaactcttttatcatctacgagaaattggggctcaaccacttcgcatatcatttaagtggatggttcgagctttctctggatacttagctacagatcagctcttgcttttatgggatagaatcctaggatacaactctctggaaattcttgctgtgctggcagctgccgtgtttgctttccgagcagtgaacctgatggaggtgacatcactggctgcagctgaagcagttcttgctgacctttctactttaaaagttatgcctcttcttcagatttttctgtttgctactgtcacctgatcttcttcacagtcactggcaacacatctagtttttcattagaaacaaatcatgaactatgcaaactctgcataaaaccaaaatgaaactttgcatataagccaataaagatcatgttccctcttcagttaaacctaagtagtttctcactttttgaaacaataactctgcaccaaatattgcatcgcatgctgctgattttcaagagagaagcaataaacacaacttctgctaaattgagcattatatatataatattataatatatatataatcctgacttgtcaatggcatgtaataatatatgcaataagaactaaagatactgtaataaacttcaagaggtaatgtagcttcttggataattcttttatgtcagtttataaatttatctctagataatg

SEQ ID NO: 7486 - DNA, 1386 bp, Homo sapiens
atgttgcaggaggagtcggacctctctctcattattgcccagatagtccaaaagctcaagggctccaatttgtactctcagctggaacggcaggcctggggaagttgggaaaaaagaattttgaagagtttaaatagtatgtgcactgaactgagtatcccactggcacgaaagaggccagttggagaacagaaagaacttcttaataaatggaatgaaatgggaactgatgaaccagatttaagccttttcagacctgtttatgcacctaaggattttcttgaggtattaattaatcttcgcaacccaaattatgaaaacggtgattctcttagtttcaggactcatttgggtttaattcaagttccactgaaagtaaaagacatccctgaattgaaagaatgctttgtggaacttggcttaaatataggacaactgggtatagatgattctacacaagtgcctcctgaactttttgaaaatgaacatgtacgtattgggcaaaaagttctagcagaacaagatagtgctgctgctcaacagtacatcagacaaggaagtcccacggcactgagagctgaattgtgggctctcattttgaatatttccagccaacctgaggatgtcttgtattatgagcagcttaagaccaatgtgatacaacatgaccttttggtggacagtctaatctataaagatgtgaagttgacagcaagcaatgatgattattattttgtatttgaagattatttatatcaggtattactttgtttttcccgggatacatctgtgttgagtcactttgcattcaacagtgcctcgccaccaaaatcatacataagaggaaaactaggactggaagaatatgctgtcttttacccaccaaatggtgttatcccttttcatggattttcaatgtatgttgcaccactttgttttctataccatgaaccttccaaattgtatcagatattccgtgagatgtatgtgcgttttttcttcagactccattccatctcttctcatccttctggtattgtgtcactctgtctgctgtttgaaactcttcttcaaacttatcttccccaactcttttatcatctacgagaaattggggctcaaccacttcgcatatcatttaagtggatggttcgagctttctctggatacttagctacagatcagctcttgcttttatgggatagaatcctaggatacaactctctggaaattcttgctgtgctggcagctgccgtgtttgctttccgagcagtgaacctgatggaggtgacatcactggctgcagctgaagcagttcttgctgacctttctactttaaaagttatgcctcttcttcagatttttctgtttgctactgtcacctga

SEQ ID NO: 7487 - DNA, 1207 bp, Homo sapiens
caacccatctccgaaaaggattaagcatcactagggctccaagtgagttctgatcagaggctgttcggaagacagcaggggccatgaccaccctctctcctgaaaacagcctctctgccagacagtcagcctccttcatcctggtgaagagaaaaccacccattgacaagacagaatgggacagcttctttgatgagagtggccacttggccaaatcacgggacttcatttgtgttaacatcctggaaaggggtctgcaccccttcgtgaggactgaagcctggaaattcctcacgggctacttctcatggcagagttcccaggatgagcggctcacggtggacagcatgaggaggaagaactacaaggccttatgccaaatgtatgagaagattcagccccttctggaaaacctgcaccggaacttcacagagactcgcaataacattgcacgtgacattcagaaaatctatgacaaagatcccctgggcaacgtcctcatcgacaagaagaggctagagaagatcctgctcctgagttacgtctgcaacacgcaggcagagtaccagcagggcttccatgagatgatgatgctcttccagctgatggtggagcacgaccacgagaccttctggcttttccagttcttcctgcagaaaacggaacacagctgtgtcatcaacattggcgtggccaagaacctagacatgctcagcaccctgatcaccttcctggaccccgtgtttgctgagcacctaaaagggaagggtgcaggggctgtgcagtccctcttcccctggttctgcttctgcttccagcgtgccttcaagtccttcgatgatgtctggaggctctgggaggttctgctgacggggaagccctgcaggaacttccaggtgctggtggcctacagcatgctgcagatggtgcgggagcaggtgctgcaggaaagcatgggcggggatgacatcctcctggcctgcaacaacctcatcgaccttgatgctgatgagctgatctctgccgcctgcgtggtttatgctgagctcatccagaaggatgttcctcagacattaaaggatttcttcctctgaggacaccaaagcccgcagtggactgatgccttcgatgggcaggatgaaggccaggggcactggagtgagggagtagataaaacagctgcaatataaacagtcctctggaataa

SEQ ID NO: 7488 - DNA, 903 bp, Homo sapiens
atgaccaccctctctcctgaaaacagcctctctgccagacagtcagcctccttcatcctgggtctgcaccccttcgtgaggactgaagcctggaaattcctcacgggctacttctcatggcagagttcccaggatgagcggctcacggtggacagcatgaggaggaagaactacaaggccttatgccaaatgtatgagaagattcagccccttctggaaaacctgcaccggaacttcacagagactcgcaataacattgcacgtgacattcagaaaatctatgacaaagatcccctgggcaacgtcctcatcgacaagaagaggctagagaagatcctgctcctgagttacgtctgcaacacgcaggcagagtaccagcagggcttccatgagatgatgatgctcttccagctgatggtggagcacgaccacgagaccttctggcttttccagttcttcctgcagaaaacggaacacagctgtgtcatcaacattggcgtggccaagaacctagacatgctcagcaccctgatcaccttcctggaccccgtgtttgctgagcacctaaaagggaagggtgcaggggctgtgcagtccctcttcccctggttctgcttctgcttccagcgtgccttcaagtccttcgatgatgtctggaggctctgggaggttctgctgacggggaagccctgcaggaacttccaggtgctggtggcctacagcatgctgcagatggtgcgggagcaggtgctgcaggaaagcatgggcggggatgacatcctcctggcctgcaacaacctcatcgaccttgatgctgatgagctgatctctgccgcctgcgtggtttatgctgagctcatccagaaggatgttcctcagacattaaaggatttcttcctctga

SEQ ID NO: 7489 - DNA, 3787 bp, Homo sapiens
gcgcgtaggcacaacttccggaaggaggcggaagagcttctcggctctaggctctggagtcccgggagcagtgaggggccacccggggcacaggaaagggccgctaggggagggccgggtgcactcggggtgtctgggccgcgggtctgagggatgaggaggggccatggccagcgacggggccaggaagcaattctggaagcgcagcaacagcaagctcccgggcagcatccagcacgtgtatggtgcccagcaccccccctttgatccactgttacatggcactttgctcaggtccacggccaagatgccgaccacaccagtgaaggccaagagggtcagcaccttccaggagtttgagagcaataccagcgatgcctgggacgctggggaggacgacgatgagctcctggccatggcggcggagagcctgaactccgaggtggtcatggagacggccaaccgtgtgctgcgtaaccacagccagcggcaggggcggcccacgctgcaggaggggccagggcttcagcagaagcccaggcccgaggcagagccgccctcaccccccagcggcgacctccggctggtgaagtcggtcagtgagagccacacgtcctgtcctgcagaaagtgccagcgatgccgcccctctgcagaggtcccagtctctcccacactcggccaccgtcacgctgggtggcacatctgaccccagcactctcagcagctcagcgctgagcgaaagagaggcctcccggctcgacaagttcaagcagctgcttgccggccccaacacggaccttgaggaattacggaggttgagctggtccggaatccctaagccagtgcgtccaatgacgtggaagctcctctcaggttaccttcccgccaatgtagaccggagaccagccactctccagagaaaacaaaaagaatattttgcatttattgagcactattacgattctaggaacgacgaagttcaccaggacacatacaggcagatccacatagacatccctcgcatgagccctgaagcgttgatcctgcagcccaaggtgacggagatttttgaaaggatcttgttcatatgggcgatccgccacccagccagtggatacgttcagggtataaatgatctcgtcactcctttctttgtggtcttcatttgtgaatacatagaggcagaggaggtggacacggtggacgtctccggcgtgcccgcagaggtgctgtgcaacatcgaggccgacacctactggtgcatgagcaagctgctggatggcattcaggacaactacacctttgcccaacctgggattcaaatgaaagtgaaaatgttagaagaactcgtgagccggattgatgagcaagtgcaccggcacctggaccaacacgaagtgagatacctgcagtttgccttccgctggatgaacaacctgctgatgagggaggtgcccctgcgttgtaccatccgcctgtgggacacctaccagtctgaaccggacggcttttctcatttccacttgtacgtgtgcgctgcttttctcgtgagatggaggaaggaaatactagaagaaaaagattttcaagagctgctgctcttcctccagaacctgcccacagcccactgggatgatgaggacatcagcctgttgctggccgaggcctaccgcctcaagtttgcttttgccgacgcccccaatcactacaagaaatgagcccaggcccacccgcagctggcctcactgtcccgggtggcgcgccccacctgcctggctggtggtaggcccctgtgagctggtcccgggctgctaaaaggccttgtgaggtggccccaccctccaggggagctggtgaagatgggccacagacctggtctagggctgacaaagacagggacagcctttgttttctgagataccaaagagagccaggggagggccccgggttcggcggccagaggcaggtcaggggtcccctctccctctccctgcaatgtccttgccaaatgactgcctcgtgctgcccctagtccggggcagcctaggaggccgaccctctttggagtcctgctgtctgggtgccagggccggaacgaggtagtggccatctcatacctactctgaaatgcaaaacttctattctgttgagtgaaagaataaaatgtagacaaaatctagaccgagacgttgcgctgacccggggtctctgtgccgcgaggtcccctcacagctgtatttcactgctgctggccctttccctccgtgtgttttcctgcttgcttggtttaaacgtggctgggaagctgaaggctggagtccaagccgtgagcccgccgagtgcctgggaggccgtgggaccaaaggctgggagcagagggaggcctcgccatcgccttactttccaccttgaacctcttttacaagagagaaacccccacctccctgaggtccagggccaagtggccccgccacgcaggtaggcgccggcctcagccagagcccctggaggcccacccaggctgtcgggccatgttgggctggcagacgggcagggggtcgcgtccctgtcatcaaagccctgaaccacagtgctcttctcaccgcagcctggaagcggaatgagcttttggagacttcctgggacttgctgtccttgtccaggtctgccaggtgtaggggaggtgtgactggttccatcatggaccggttcctccatggaccggttcctccgtggaccggttccgccatggaccggttccgccatggaccactcctgccctggaccactcctgccctggaccggttctgccgtggactggttcccgccgtggaccagttcccgctgtatactggttctgccctggactggttcccgctgtggactggttccttggggctctaagtgcggaagggcccagagctggtccctgcccagcgccctgctagggctgtgtccttggctccaggggccttgggactggcttcccagcgttccctcggtgtgtcacaggctgcatgacccctggaatgcgggcagggccacagccacagtctgtctgatccctgagcccaggacaggctcacgtcctcagcgacccactggtgactgacttcccagactctcctctgtccctcaggagcagccgtgtcctctcccaggccctaggacactgccagagactgtgggacatacaggcataagtgatgtgtgtgtttctgcttctgttttaaaaatccagggtcattacacacagcatggaaattagcacaaaatgctgtgcaaacgtcagatgctcccaaaccagcaaagggatgggcttgcttcacatcagatgcgggcacgccttacccctgccttccgtgtccccaccccagggtcaagggttcctcagaccagccatgcctcctcctcctgccgcctccttttctagatggggaggggattccgtcacaagaagagccgcccctcggccgtgtgcaggaagccccatgtcgctttgccgagatcagccctgggaggatccccttctccagctcagatcatgccgtgtggccagaaggctgcggacacaactgacctgcttctcgaggtggttgatgttttaaacaggaagctccacggagttcagccctgtgtgcatttcctcatgtatgtaaacgccaagactgaatgtgagaggtgttggccgcgggccttaagtctgagcagatccatctggaatgttcggggtgtgctgtctggatgtggtgcgctaaaaacacggaataaagatcagtgacaaa

SEQ ID NO: 7490 - DNA, 1886 bp, Homo sapiens
cccgggagcagtgaggggccacccggggcacaggaaagggccgctaggggagggccgggtgcactcggggtgtctgggccgcgggtctgagggatgaggaggggccatggccagcgacggggccaggaagcaattctggaagcgcagcaacagcaagctcccgggcagtttgctcaggtccacggccaagatgccgaccacaccagtgaaggccaagagggtcagcaccttccaggagtttgagagcaataccagcgatgcctgggacgctggggaggacgacgatgagctcctggccatggcggcggagagcctgaactccgaggtggtcatggagacggccaaccgtgtgctgcgtaaccacagccagcggcaggggcggcccacgctgcaggaggggccagggcttcagcagaagcccaggcccgaggcagagccgccctcaccccccagcggcgacctccggctggtgaagtcggtcagtgagagccacacgtcctgtcctgcagaggaattacggaggttgagctggtccggaatccctaagccagtgcgtccaatgacgtggaagctcctctcaggttaccttcccgccaatgtagaccggagaccagccactctccagagaaaacaaaaagaatattttgcatttattgagcactattacgattctaggaacgacgaagttcaccaggacacatacaggcagatccacatagacatccctcgcatgagccctgaagcgttgatcctgcagcccaaggtgacggagatttttgaaaggatcttgttcatatgggcgatccgccacccagccagtggatacgttcagggtataaatgatctcgtcactcctttctttgtggtcttcatttgtgaatacatagaggcagaggaggtggacacggtggacgtctccggcgtgcccgcagaggtgctgtgcaacatcgaggccgacacctactggtgcatgagcaagctgctggatggcattcaggacaactacacctttgcccaacctgggattcaaatgaaagtgaaaatgttagaagaactcgtgagccggattgatgagcaagtgcaccggcacctggaccaacacgaagtgagatacctgcagtttgccttccgctggatgaacaacctgctgatgagggaggtgcccctgcgttgtaccatccgcctgtgggacacctaccagtctgaaccggacggcttttctcatttccacttgtacgtgtgcgctgcttttctcgtgagatggaggaaggaaatactagaagaaaaagattttcaagagctgctgctcttcctccagaacctgcccacagcccactgggatgatgaggacatcagcctgttgctggccgaggcctaccgcctcaagtttgcttttgccgacgcccccaatcactacaagaaatgagcccaggcccacccgcagctggcctcactgtcccgggtggcgcgccccacctgcctggctggtggtaggcccctgtgagctggtcccgggctgctaaaaggccttgtgaggtggccccaccctccaggggagctggtgaagatgggccacagacctggtctagggctgacaaagacagggacagcctttgttttctgagataccaaagagagccaggggagggccccgggttcggcggccagaggcaggtcaggggtcccctctccctctccctgcaatgtccttgccaaatgactgcctcgtgctgcccctagtccggggcagcctaggaggccgaccctctttggagtcctgctgtctgggtgccagggccggaacgaggtagtggccatctcatacctactctgaaatgcaaaacttctattctgttgagtgaaagaataaaatgtagacaaaatct

SEQ ID NO: 7491 - DNA, 1271 bp, Homo sapiens
caacttccggaaggaggcggaagagcttctcggctctaggctctggagtcccgggagcagtgaggggccacccggggcacaggaaagggccgctaggggagggccgggtgcactcggggtgtctgggccgcgggtctgagggatgaggaggggccatggccagcgacggggccaggaagcaattctggaagcgcagcaacagcaagctcccgggcagcatccagcacgtgtatggtgcccagcaccccccctttgatccactgttacatggcactttgctcaggtccacggccaagatgccgaccacaccagtgaaggccaagagggtcagcaccttccaggagtttgagagcaataccagcgatgcctgggacgctggggaggacgacgatgagctcctggccatggcggcggagagcctgaactccgaggtggtcatggagacggccaaccgtgtgctgcgtaaccacagccagcggcaggggcggcccacgctgcaggaggggccagggcttcagcagaagcccaggcccgaggcagagccgccctcaccccccagcggcgacctccggctggtgaagtcggtcagtgagagccacacgtcctgtcctgcagaaagtgccagcgatgccgcccctctgcagaggtcccagtctctcccacactcggccaccgtcacgctgggtggcacatctgaccccagcactctcagcagctcagcgctgagcgaaagagaggcctcccggctcgacaagttcaagcagctgcttgccggccccaacacggaccttgaggaattacggaggttgagctggtccggaatccctaagccagtgcgtccaatgacgtggaagctcctctcaggttaccttcccgccaatgtagaccggagaccagccactctccagagaaaacaaaaagaatattttgcatttattgagcactattacgattctaggaacgacgaagttcaccaggacacatacaggcagatccacatagacatccctcgcatgagccctgaagcgttgatcctgcagcccaaggtgacggagatttttgaaaggatcttgttcatatgggcgatccgccacccagccagtggatacgttcagggtataaatgatctcgtcactcctttctttgtggtcttcatttgtgaatacatagcctttccaggttgtggtcggcctcagattcccatccttgctgtgatctggagagatgagccttacccgaggacagatgaacagattatcctcagaagatga

SEQ ID NO: 7492 - DNA, 2267 bp, Homo sapiens
agaagtctgtgcccttacccatcacagcctcatccttatctcctccattccctaggggacttaacaggtgttgaaattattacagagaaagctgactcactcaccaggaatctgatcctgctgtgggctggcttgggtggaggtgttcctcccgcccccgcacccatcctcctgtttgaactcaggctgctgcctgctgggcctgcctgcccttggagccctgctgagctcagcctgaggcctggctcctccaggctgggggaaaaccaggcttgctgtgctcggcagcagagattcttctggagtgagcatccagcacgtgtatggtgcccagcaccccccctttgatccactgttacatggcactttgctcaggtccacggccaagatgccgaccacaccagtgaaggccaagagggtcagcaccttccaggagtttgagagcaataccagcgatgcctgggacgctggggaggacgacgatgagctcctggccatggcggcggagagcctgaactccgaggtggtcatggagacggccaaccgtgtgctgcgtaaccacagccagcggcaggggcggcccacgctgcaggaggggccagggcttcagcagaagcccaggcccgaggcagagccgccctcaccccccagcggcgacctccggctggtgaagtcggtcagtgagagccacacgtcctgtcctgcagaaagtgccagcgatgccgcccctctgcagaggtcccagtctctcccacactcggccaccgtcacgctgggtggcacatctgaccccagcactctcagcagctcagcgctgagcgaaagagaggcctcccggctcgacaagttcaagcagctgcttgccggccccaacacggaccttgaggaattacggaggttgagctggtccggaatccctaagccagtgcgtccaatgacgtggaagctcctctcaggttaccttcccgccaatgtagaccggagaccagccactctccagagaaaacaaaaagaatattttgcatttattgagcactattacgattctaggaacgacgaagttcaccaggacacatacaggcagatccacatagacatccctcgcatgagccctgaagcgttgatcctgcagcccaaggtgacggagatttttgaaaggatcttgttcatatgggcgatccgccacccagccagtggatacgttcagggtataaatgatctcgtcactcctttctttgtggtcttcatttgtgaatacatagaggcagaggaggtggacacggtggacgtctccggcgtgcccgcagaggtgctgtgcaacatcgaggccgacacctactggtgcatgagcaagctgctggatggcattcaggacaactacacctttgcccaacctgggattcaaatgaaagtgaaaatgttagaagaactcgtgagccggattgatgagcaagtgcaccggcacctggaccaacacgaagtgagatacctgcagtttgccttccgctggatgaacaacctgctgatgagggaggtgcccctgcgttgtaccatccgcctgtgggacacctaccagtctgaaccggacggcttttctcatttccacttgtacgtgtgcgctgcttttctcgtgagatggaggaaggaaatactagaagaaaaagattttcaagagctgctgctcttcctccagaacctgcccacagcccactgggatgatgaggacatcagcctgttgctggccgaggcctaccgcctcaagtttgcttttgccgacgcccccaatcactacaagaaatgagcccaggcccacccgcagctggcctcactgtcccgggtggcgcgccccacctgcctggctggtggtaggcccctgtgagctggtcccgggctgctaaaaggccttgtgaggtggccccaccctccaggggagctggtgaagatgggccacagacctggtctagggctgacaaagacagggacagcctttgttttctgagataccaaagagagccaggggagggccccgggttcggcggccagaggcaggtcaggggtcccctctccctctccctgcaatgtccttgccaaatgactgcctcgtgctgcccctagtccggggcagcctaggaggccgaccctctttggagtcctgctgtctgggtgccagggccggaacgaggtagtggccatctcatacctactctgaaatgcaaaacttctattctgttgagtgaaagaataaaatgtagacaaaatctagaccg

SEQ ID NO: 7493 - DNA, 1949 bp, Homo sapiens
ctctggagtcccgggagcagtgaggggccacccggggcacaggaaagggccgctaggggagggccgggtgcactcggggtgtctgggccgcgggtctgagggatgaggaggggccatggccagcgacggggccaggaagcaattctggaagcgcagcaacagcaagctcccgggcagcatccagcacgtgtatggtgcccagcaccccccctttgatccactgttacatggcactttgctcaggtccacggccaagatgccgaccacaccagtgaaggccaagagggtcagcaccttccaggagtttgagagcaataccagcgatgcctgggacgctggggaggacgacgatgagctcctggccatggcggcggagagcctgaactccgaggtggtcatggagacggccaaccgtgtgctgcgtaaccacagccagcggcaggggcggcccacgctgcaggaggggccagggcttcagcagaagcccaggcccgaggcagagccgccctcaccccccagcggcgacctccggctggtgaagtcggtcagtgagagccacacgtcctgtcctgcagaggaattacggaggttgagctggtccggaatccctaagccagtgcgtccaatgacgtggaagctcctctcaggttaccttcccgccaatgtagaccggagaccagccactctccagagaaaacaaaaagaatattttgcatttattgagcactattacgattctaggaacgacgaagttcaccaggacacatacaggcagatccacatagacatccctcgcatgagccctgaagcgttgatcctgcagcccaaggtgacggagatttttgaaaggatcttgttcatatgggcgatccgccacccagccagtggatacgttcagggtataaatgatctcgtcactcctttctttgtggtcttcatttgtgaatacatagaggcagaggaggtggacacggtggacgtctccggcgtgcccgcagaggtgctgtgcaacatcgaggccgacacctactggtgcatgagcaagctgctggatggcattcaggacaactacacctttgcccaacctgggattcaaatgaaagtgaaaatgttagaagaactcgtgagccggattgatgagcaagtgcaccggcacctggaccaacacgaagtgagatacctgcagtttgccttccgctggatgaacaacctgctgatgagggaggtgcccctgcgttgtaccatccgcctgtgggacacctaccagtctgaaccggacggcttttctcatttccacttgtacgtgtgcgctgcttttctcgtgagatggaggaaggaaatactagaagaaaaagattttcaagagctgctgctcttcctccagaacctgcccacagcccactgggatgatgaggacatcagcctgttgctggccgaggcctaccgcctcaagtttgcttttgccgacgcccccaatcactacaagaaatgagcccaggcccacccgcagctggcctcactgtcccgggtggcgcgccccacctgcctggctggtggtaggcccctgtgagctggtcccgggctgctaaaaggccttgtgaggtggccccaccctccaggggagctggtgaagatgggccacagacctggtctagggctgacaaagacagggacagcctttgttttctgagataccaaagagagccaggggagggccccgggttcggcggccagaggcaggtcaggggtcccctctccctctccctgcaatgtccttgccaaatgactgcctcgtgctgcccctagtccggggcagcctaggaggccgaccctctttggagtcctgctgtctgggtgccagggccggaacgaggtagtggccatctcatacctactctgaaatgcaaaacttctattctgttgagtgaaagaataaaatgtagacaaaa

SEQ ID NO: 7494 - DNA, 3462 bp, Homo sapiens
acatccaagatggcgtccccaggagctgggagcgggtgaccggcggcggggaagcggcctgggttggccctcagattgcggggtctgggggcatctcgccgggcaaacccttggcccgcctacaaggacttcccccggccagagcaatggccgctgagaacagcaagcagttttggaagaggagcgctaagctgccggggagcattcagcctgtatatggagcacagcatcctcctcttgacccacggctcaccaaaaatttcattaaagaacgatcaaaagtcaacacagttcctctgaagaataagaaggcctccagttttcatgagtttgcacggaataccagtgatgcttgggacattggcgatgatgaggaagaggacttttcctcaccttctttccaaactctgaactcaaaagttgctttggcaactgcagcccaagttctagaaaaccacagcaagctgagagtaaaaccagaacggtcccagtcaacgacatcggacgtccctgccaactacaaggtcataaagtccagcagtgatgcccagctgtccagaaactctagtgatacatgcctgaggaacccactccacaaacagcaatcactccctctccggcccatcatccccctcgttgcccggatctcggatcagaacgcttctggggcccccccaatgactgtccgggagaaaacccgcctagaaaaattccgtcaacttctctccagccagaacactgacttagatgaactgaggaagtgtagctggccaggggttcccagggaggttcgacctataacctggagactcctgtcgggctatctcccagcaaacactgagaggaggaagttgaccctgcagcggaagcgggaggaatattttggcttcattgaacagtattatgactctcgaaacgaggaacatcaccaggatacctacagacagattcacattgacattccaaggacgaatcctctcattccgttgttccagcaaccacttgtacaggagatctttgaaagaattctatttatttgggccatccgccaccctgccagtgggtatgtccagggaattaatgacctggtcactccattctttgtcgtcttcctctcagaatatgtggaagaggatgtggagaactttgacgtgaccaacttgtctcaagacatgctgcgaagcattgaggctgacagcttttggtgcatgagcaagctgctggatggaatccaggataactacacctttgcacaaccaggaatccagaagaaggtgaaggcactggaagagcttgtcagccggattgatgagcaggtacataatcacttcaggaggtacgaggtagaatacctgcagtttgccttccgctggatgaacaacctgcttatgcgggagcttcctcttcgctgcaccatccgcctgtgggacacatatcagtctgaaccagaagggttctcccactttcatctctacgtgtgtgcagccttcttgatcaagtggaggaaagagatcttggatgaggaggattttcagggtctcctcatgctgctacagaacctacctacaatacactggggcaacgaagaaattgggctgcttctcgccgaggcatacagactcaagtacatgtttgccgatgccccaaatcactaccgccgataggtgctgtctcctccggggacccagactgccttcatctctgatggcagtctgatcactgtggccactgtgcgagccgtggaccccggccaggaaccactcctgttgtacaaagctcacacccaccgcccaggtcttaactttctggcatccaccactccatgtctctggatgtgtcacttggaccactgtcagtattccatgccgcgtggatgggcccagttctgggagaggacagaaaaggtggtacagggttgtctgcccctttaaaagaaactggacaaagaaggggaaggctcagggtctcacctcacattgtccctacaaggacaggccccaactgataaccgttgcttttttttttttgtgaacatagtttgatttgatcacaggtcaaaaacgccttatattttcgaaagactcctggcccctcttccctcttcctggtttcctagccgttccccttctgccccagtctgagccagtgaggggtagctttttaaaaccattattctagatggaggaggcactgatgcttgtaactctggaaagaggcctacacccaagggctaggaattttatttttccttttctcaccaggtgtctgcatgtgtgtgtgggtgtgaatgtgtatacatgcccatcagcatttagtcacatgtctgaatttctgtgtccagacgagccccatcaaactagttgggaagggccccagtgaccaagtgtataagcatcccttgaagagggattggggcaggggaggcagaaggggctctccagaccccttttccatgatgacccactccaagatattatgtgtaaattgtgttattatgtatatgggtaaagatgtacaaatatatgtcctctttgtagcagatatgattttatatttataatgtgcatcaacatgtgaaagcaatctaggtcactagcacagaggaagttgccaggaaggtggcttcagcacctccaggttggttctgggtgtcctgctgtgaggggtagaacgggaggctgctgaagtgagtagctgagcagctggagccatcccaagcatcagtgtctcagagtcctcctcgcccctttcttcaccccgccccccaacccccagactttcctggagcatctgccctttgctcctagcagcctccccaggaagggactgcagaggcgggcaagccctctctatgtgtttttatccccaccttccccggaatctggggagggcttttgtttttacgttttcaagttcagcattgtattcggacagaagctgtgactgaagactcagtgccaaggaaaggggcttcttgtgtgtccctcgggtttggggctcttctcagagagcagcactccatatcccttactgtcaccttcactccccacacagctcatgagatgtgtgacccctgtttgagttttggtatttggtagtggagggtggggggatgggggccagcagctgtcatcctcctgggaagccgagcagtgtccctggtgggtaacaccctcaagtctctttgccagtgaggccccaccacatcggtgtgagttaggtttctcatctggagctgtttctcaggcattcttcccaaccctcttccttttccccttcggtgtgcctcagtggtctccttcatagagtgagagggcttgagaccctccctcaaccggactaattaaagaaagacacttgtgttcccaagtggtggttttatttttttagtttttatgtttgtatgggaaattgtggataaagtgaaaagaattgtaaataaatggtgtatttcctcctcca

SEQ ID NO: 7495 - DNA, 3656 bp, Homo sapiens
acgtggacgtcaacagcaatggcggaaggagaagatgtgccgccgctgccaacgtcgagcggcgacggctgggaaaaagatcttgaagaagctctggaagcaggaggttgtgatcttgaaacgttgagaaatataattcaaggaagaccgctgcctgctgatctgagggccaaagtttggaagattgctctgaatgttgcaggaaaaggtgatagtttggcatcatgggatggtattttagacttgccagaacagaacactattcacaaagattgcctgcagtttattgaccagctttcagtgccagaggagaaggcagcagaattacttttggatattgaatctgtaattaccttttattgtaaatcacgtaacattaaatatagcacatcccttagctggatacatctactgaaaccattggtgcatcttcaactgccacgcagcgatttatacaactgcttttatgccataatgaataagtacattcccagggattgttcccagaaagggagaccatttcatctcttcaggttgctcatccaataccatgagcctgagctttgttcttatcttgatacaaagaaaattactccagactcctatgcactcaactggcttggaagtctttttgcatgttactgttccactgaagtcactcaggcaatatgggatggatatctacaacaagcagatccattttttatttatttcttaatgttaattatccttgttaatgcaaaagaagttattttaacacaagagtcagacagcaaagaagaagttatcaagttcttggaaaatactccatccagtctgaatatagaagatatagaagaccttttctctctggctcagtattattgcagcaaaacaccggcttcttttaggaaggataatcaccatctctttggtagtactttgttgggaattaaggatgatgatgcagatctgagtcaggctctttgtctggccatctccgtgtcagagatccttcaagcgaatcagctacaaggggaaggagtccggttctttgtggtggattgccgtcctgcagaacaatataatgctgggcatttatcaactgctttccacttagattcagacctgatgcttcagaatccatctgagtttgcacagtcagtaaaatccttgctggaagcacagaagcagtccattgagtctggctccatagctggtggggagcacctctgttttatgggcagtggcagggaggaagaagacatgtatatgaacatggtcctggcacactttttacagaaaaacaaagaatatgtgagtattgccagtggaggatttatggcactgcagcagcacctggcagacattaatgtggatggaccagaaaatggatatggccattggattgctagtacctcaggctcaaggagcagtatcaattctgttgatggtgaatctcctaatggctcaagtgatagaggaatgaaatcactagtaaataaaatgactgtggctttgaagacaaaatccgttaatgtcagggaaaaagttatcagttttatagagaatacatcaactcctgtggatcggcatgtgagcagcagtgacagagtgggcaagccttaccgtggcgtaaagcctgttttcagcattggggatgaagaagaatacgacacagatgaaattgacagttcttcaatgtcagatgatgatagaaaagaggttgtaaacattcagacttggataaacaaaccagatgtcaaacatcattttccttgtaaagaagtaaaagaaagtggacacatgtttcccagtcatctgttggttactgcaacacatatgtactgtttaagggagattgtttcacggaaaggattggcttatatacagtctcgacaagcgctgaattctgtagttaaaattacatccaaaaaaaaacatcctgaactcattaccttcaagtatggaaatagcagtgcttcaggaatagaaatcttggcaatcgaaaggtatttgattccaaatgcaggggatgcaactaaagccataaaacagcagatcatgaaagttttggatgctttggaaagttaatataaaagaaaattatataaaaagaaattaagacaaccaagagaaacatggacatatacctcctgactgaatactaactggagacctttcatttgctcatggggctgcttaaatagcaggtctaagaaagtgtaaattattataatcaatctgtggacagtaaactttttaaaaatttttcttctgcattttggttttataaaatgatgtattataaaggtcagttattaaattactttgaagtaactgaccctgtgcccttatggactaagtaagggtacagaatgcagttctgttttgaagagctgttttaagggaacatgcatcactttcgggatcaaaaacaactgtacacatacatatctgcagtgtcttcactgaaaattagagatagaattagttgaagagacttccttaattgctacattgttttactcactgagcaatatcagaaactaaaacatagattaataattcactcactgtttctattcttcttaaaaagagtgaaatctttttaatggaatggttgaagattcctgccaactcaaaatacagtacagctagtaaaatgttgaaacatcagtttctaaatcacctttgctccattagctaattttttggacactaaatgcttcaaagataagaaacttcatcctaatgatttctaaagagcagttaaaagcattaaaataagtaggtaggctgttaagattaaaattaacattttggggacagaattgtgtctgtaaaaatgtcattggttttattacaagcggattattttattcatattttaaaacaaatgtttaagccacattgatttatcctcattgaggattatggtctgtgaccacagtaatatccacttatataaatgccaaataatcagagagcttataaagtacaattgtttttgtcatcattttctgaatttctttctcttcttttggttttgtcctctcattgaagttccagtggtttgaaattagttttggacacattgtcttaatgtactgaaaattgctctgctgtattttgcagcgttcttcatttaatttataatggtccatattagacacatttggtaagagaagtccaggaacacatttagggccatggaatagtattttgtaaaatccatttgggaagttgcaatacccacaatctgacatgtcctaaaatgtaagggattatctctaaggggttgatgggagaaatatttagatgtaccctgttaacagccagtcattttgatttacttatggaaatcaagtgaataaaaggcaacataatttgggaaattttattctaatatctaataaaaacagtttgagtggttgaagacatctgcatgaaattgcacctaggtgcattacttgatataactctcccctaaaactgttgtaattgcattttttcccttttcttggcacccctttagaaatgtactgaagtctcatttttcacccatttcagccatgggacatttttcataatattaatgtaaagatgtttgtgttactgtttataaattacaattgtaaataaattactagtttgcccaaaactttgttcttaaa

SEQ ID NO: 7496 - DNA, 3677 bp, Homo sapiens
aacagcaatggcggaaggagaagatgtgccgccgctgccaacgtcgagcggcgacggctgggaaaaagatcttgaagaagctctggaagcaggaggttgtgatcttgaaacgttgagaaatataattcaaggaagaccgctgcctgctgatctgagggccaaagtttggaagattgctctgaatgttgcaggaaaaggtgatagtttggcatcatgggatggtattttagacttgccagaacagaacactattcacaaagattgcctgcagtttattgaccagctttcagtgccagaggagaaggcagcagaattacttttggatattgaatctgtaattaccttttattgtaaatcacgtaacattaaatatagcacatcccttagctggatacatctactgaaaccattggtgcatcttcaactgccacgcagcgatttatacaactgcttttatgccataatgaataagtacattcccagggattgttcccagaaagggagaccatttcatctcttcaggttgctcatccaataccatgagcctgagctttgttcttatcttgatacaaagaaaattactccagactcctatgcactcaactggcttggaagtctttttgcatgttactgttccactgaagtcactcaggcaatatgggatggatatctacaacaagcagatccattttttatttatttcttaatgttaattatccttgttaatgcaaaagaagttattttaacacaagagtcagacagcaaagaagaagttatcaagttcttggaaaatactccatccagtctgaatatagaagatatagaagaccttttctctctggctcagtattattgcagcaaaacaccggcttcttttaggaaggataatcaccatctctttggtagtactttgttgggaattaaggatgatgatgcagatctgagtcaggctctttgtctggccatctccgtgtcagagatccttcaagcgaatcagctacaaggggaaggagtccggttctttgtggtggattgccgtcctgcagaacaatataatgctgggcatttatcaactgctttccacttagattcagacctgatgcttcagaatccatctgagtttgcacagtcagtaaaatccttgctggaagcacagaagcagtccattgagtctggctccatagctggtggggagcacctctgttttatgggcagtggcagggaggaagaagacatgtatatgaacatggtcctggcacactttttacagaaaaacaaagaatatgtgagtattgccagtggaggatttatggcactgcagcagcacctggcagacattaatgtggatggaccagaaaatggatatggccattggattgctagtacctcaggctcaaggagcagtatcaattctgttgatggtgaatctcctaatggctcaagtgatagaggaatgaaatcactagtaaataaaatgactgtggctttgaagacaaaatccgttaatgtcagggaaaaagttatcagttttatagagaatacatcaactcctgtggatcgaatgtctttcaatcttccttggccagacagatcatgtacagagcggcatgtgagcagcagtgacagagtgggcaagccttaccgtggcgtaaagcctgttttcagcattggggatgaagaagaatacgacacagatgaaattgacagttcttcaatgtcagatgatgatagaaaagaggttgtaaacattcagacttggataaacaaaccagatgtcaaacatcattttccttgtaaagaagtaaaagaaagtggacacatgtttcccagtcatctgttggttactgcaacacatatgtactgtttaagggagattgtttcacggaaaggattggcttatatacagtctcgacaagcgctgaattctgtagttaaaattacatccaaaaaaaaacatcctgaactcattaccttcaagtatggaaatagcagtgcttcaggaatagaaatcttggcaatcgaaaggtatttgattccaaatgcaggggatgcaactaaagccataaaacagcagatcatgaaagttttggatgctttggaaagttaatataaaagaaaattatataaaaagaaattaagacaaccaagagaaacatggacatatacctcctgactgaatactaactggagacctttcatttgctcatggggctgcttaaatagcaggtctaagaaagtgtaaattattataatcaatctgtggacagtaaactttttaaaaatttttcttctgcattttggttttataaaatgatgtattataaaggtcagttattaaattactttgaagtaactgaccctgtgcccttatggactaagtaagggtacagaatgcagttctgttttgaagagctgttttaagggaacatgcatcactttcgggatcaaaaacaactgtacacatacatatctgcagtgtcttcactgaaaattagagatagaattagttgaagagacttccttaattgctacattgttttactcactgagcaatatcagaaactaaaacatagattaataattcactcactgtttctattcttcttaaaaagagtgaaatctttttaatggaatggttgaagattcctgccaactcaaaatacagtacagctagtaaaatgttgaaacatcagtttctaaatcacctttgctccattagctaattttttggacactaaatgcttcaaagataagaaacttcatcctaatgatttctaaagagcagttaaaagcattaaaataagtaggtaggctgttaagattaaaattaacattttggggacagaattgtgtctgtaaaaatgtcattggttttattacaagcggattattttattcatattttaaaacaaatgtttaagccacattgatttatcctcattgaggattatggtctgtgaccacagtaatatccacttatataaatgccaaataatcagagagcttataaagtacaattgtttttgtcatcattttctgaatttctttctcttcttttggttttgtcctctcattgaagttccagtggtttgaaattagttttggacacattgtcttaatgtactgaaaattgctctgctgtattttgcagcgttcttcatttaatttataatggtccatattagacacatttggtaagagaagtccaggaacacatttagggccatggaatagtattttgtaaaatccatttgggaagttgcaatacccacaatctgacatgtcctaaaatgtaagggattatctctaaggggttgatgggagaaatatttagatgtaccctgttaacagccagtcattttgatttacttatggaaatcaagtgaataaaaggcaacataatttgggaaattttattctaatatctaataaaaacagtttgagtggttgaagacatctgcatgaaattgcacctaggtgcattacttgatataactctcccctaaaactgttgtaattgcattttttcccttttcttggcacccctttagaaatgtactgaagtctcatttttcacccatttcagccatgggacatttttcataatattaatgtaaagatgtttgtgttactgtttataaattacaattgtaaataaattactagtttgcccaaaa

SEQ ID NO: 7497 - DNA, 2074 bp, Homo sapiens
aactaagggtaaaatgagagtaaattgactgtatgaagcctgagatttcccacaagaaaacatgctgtgtataccttggcattacattttggttgctgagaacttttgtttcttagacaagcctttaataggccatgcttataaatgaatcttgaataagaaaaagtatgagataaagttcattttaataaataggacttattttttagggaaaaagatcttgaagaagctctggaagcaggaggttgtgatcttgaaacgttgagaaatataattcaaggaagaccgctgcctgctgatctgagggccaaagtttggaagattgctctgaatgttgcaggaaaaggtgatagtttggcatcatgggatggtattttagacttgccagaacagaacactattcacaaagattgcctgcagtttattgggattgttcccagaaagggagaccatttcatctcttcaggttgctcatccaataccatgagcctgagctttgttcttatcttgatacaaagaaaattactccagactcctatgcactcaactggcttggaagtctttttgcatgttactgttccactgaagtcactcaggcaatatgggatggatatctacaacaagcagatccattttttatttatttcttaatgttaattatccttgttaatgcaaaagaagttattttaacacaagagtcagacagcaaagaagaagttatcaagttcttggaaaatactccatccagtctgaatatagaagatatagaagaccttttctctctggctcagtattattgcagcaaaacaccggcttcttttaggaaggataatcaccatctctttggtagtactttgttgggaattaaggatgatgatgcagatctgagtcaggctctttgtctggccatctccgtgtcagagatccttcaagcgaatcagctacaaggggaaggagtccggttctttgtggtggattgccgtcctgcagaacaatataatgctgggcatttatcaactgctttccacttagattcagacctgatgcttcagaatccatctgagtttgcacagtcagtaaaatccttgctggaagcacagaagcagtccattgagtctggctccatagctggtggggagcacctctgttttatgggcagtggcagggaggaagaagacatgtatatgaacatggtcctggcacactttttacagaaaaacaaagaatatgtgagtattgccagtggaggatttatggcactgcagcagcacctggcagacattaatgtggatggaccagaaaatggatatggccattggattgctagtacctcaggctcaaggagcagtatcaattctgttgatggtgaatctcctaatggctcaagtgatagaggaatgaaatcactagtaaataaaatgactgtggctttgaagacaaaatccgttaatgtcagggaaaaagttatcagttttatagagaatacatcaactcctgtggatcgaatgtctttcaatcttccttggccagacagatcatgtacagagcggcatgtgagcagcagtgacagagtgggcaagccttaccgtggcgtaaagcctgttttcagcattggggatgaagaagaatacgacacagatgaaattgacagttcttcaatgtcagatgatgatagaaaagaggttgtaaacattcagacttggataaacaaaccagatgtcaaacatcattttccttgtaaagaagtaaaagaaagtggacacatgtttcccagtcatctgttggttactgcaacacatatgtactgtttaagggagattgtttcacggaaaggattggcttatatacagtctcgacaagcgctgaattctgtagttaaaattacatccaaaaaaaaacatcctgaactcattaccttcaagtatggaaatagcagtgcttcaggaatagaaatcttggcaatcgaaaggtatttgattccaaatgcaggggatgcaactaaagccataaaacagcagatcatgaaagttttggatgctttggaaagttaatataaaagaaaattatataaaaa

SEQ ID NO: 7498 - DNA, 1531 bp, Homo sapiens
gtctctatgtctggagctcttagagataagacatagaggtgtctggttctgagaaaaggaagttttgctaagtgagagacacaactgactcaactgactcagaaaactgattatattcctggtccctgaacgatcctatagagacatccagtccctgactccacctgcctccaggtgcccagaacagcccatcgtggggacttcaccctcagcaagtggacgccgtttgtcctgccagggcaggatggagatggatggggacccgtataacctgcctgcccaggggcaaggcaatatcatcattactaagtatgagcagggacaccgagctggggcagcagtggacttggggcatgagcaggttgatgtcagaaaatacaccaataacctcgggattgtgcatgagatggagctgccccacgtcagtgccctggaggtgaagcaaagacgcaaggaaagtaaacgtaccaacaagtggcaaaagatgcttgcagactggacaaaatataggagcaccaagaagctgtctcaaagagtatacaaagtcattcccctggcggtacggggccgggcgtggtcacttttgctagatattgacagaatcaagtcccagaacccaggcaaatataaggtcatgaaggagaagggcaagaggtcctccagaatcatccactgcatccagctagatgtcagccacaccctgcagaaacacatgatgttcatacaaagattcggagtcaagcagcaggaattatgtgacatcctcgtggcctattctgcatataaccctgaggtgggctaccacagggacctgagccgcatcactgccatcctcctcctgtgtctgccagaggaagatgctttctgggcgcttacccagttgctcgctggtgagaggcactccctgtggtattctacagcccaaatactgcctggctcgagaggctcctatcgcaccaggagcaggtgctgcacaagtccttcccaaagatcatgagacacctgggcaaggaagggctgtgcattgagggttccatgctgacgaggctcctccggtgtttccttgatgggaaatccttcgggctcaccctgagactgtgggatgtgttcatcttggagggcgcgcgggtactgacagccatggtgcatgcatcattcaaaatacacaggaagcacctcatgaagctttcctggagcactgtctgggagtttcaggagcgactctctcagagctgggccctggaggacaacgcggtcctcaggaaccttcaaacctctatgaaggaactcacaaaaaaacactgggacctgccacccccagggagcttgctacaaaatgcacattgctataccatagcctggggcttgcaatccaaggctggcaaggattcctgcacgtcaagggcctcaggtgactttcatgcacacccaagtcagaaggctctcctgaatcctggatgtcaccttcctgcccaaaaaaggaggaacgagggtcaaccagcagcagaccagtcacaaaaagagatgaaat

SEQ ID NO: 7499 - DNA, 2266 bp, Homo sapiens
gaggcagggtctggtcctggaagagccactgggacagagcccctgtgggtggggtggagggtgaaattcttggtccaagtctgtgccctaagcttggtccccacaggaggaggtcactgatggttgctgtgggacccactggacacatggggtccttcatctaggagtggggtggggagccctctgccctcaggcagttgtggaaaatgaaggagccctggagggctgcctggagggtgacaatcgtctctcctggtcaaagaggcttggggactggaaccctcctgcagcgtcccattctctctgtctggtcctctagaggccttgccttccgtttgccccgagtattcctgggggggacggttcccccaggtgttctctaggactaaggccccagcgttctcttgttctttcttggtgacccaggaaaacaaagtcccctcctgtattgacagctgggaattgtggtgtccaccgtcctcgacctgcgacggggtctccatgagcacagaggctgctctggagtcaacagatcatcttttccccaaaccaaactgcttggctggcgttgttcctgaaggggcttcactggccagaagacatccagtccctgactccacctgcctccaggtgcccagaacagcccatcgtggggacttcaccctcagcaagtggacgccgtttgtcctgccagggcaggatggagatggatgaggacccggataacctgcctgcccaggggcaaggcaatatcatcattactaagtatgagcagggacaccgagctggggcagcagtggacttggggcatgagcaggttgatgtcagaaaatacaccaataacctcgggattgtgcatgagatggagctgccccgcgtcagtgccctggaggtgaagcaaagacgcaaggaaagtaaacgtaccaacaagtggcaaaagatgcttgcagactggacaaaatataggagcaccaagaagctgtctcaaagagtatgcaaagtcattcccctggcggtgcggggccgggcgttgtcacttttgctagatattgacaaaatcaagtcccagaacccaggcaaatataaggtcatgaaggagaagggcaagaggtcctccagaatcatccactgcatccagctagatgtcagccacaccctgcagaaacacatgatgttcatacaaagattcggagtcaagcagcaggaattatgtgacatcctcgtggcctattctgcatataaccctgtgagtattcccgggcagcgatattcctggtacctgtgcccatattcacaggcatgggtgtctctcgggggtgttgcaacttcttgaaaattcagcgtttgtccaccaggacgtagtaggcaggacttcagctcgctgctggcagaaaagggttgaagcccagactcctggtctcacatggacccaatcaccacatctcagatgaagaaatgaccttcccctcctggtgttgccccaaagcctaggagcttggcagggtcccacacaggatggtccttgtaggagacaggtttgacaagttgctgaggtgcctgatgggccaggcacttgtcatgaaatgagtttgcatcctgggggagcctcttcttcactggaaacctggcaaggatccaatttcccctttgcctgatccccacaggagcatagcagatagggaggggggtcacccaggtggctcttcctgcttggcccccactttccagaccattccaggcagggagagctgctgagctgactgcatgagctgcccacatggaggacccagccaccccttatgttcggcaggcagcccttgggctgttgcaggaccgtggccagttcttggtattgctcaagtcccctgggccttcagactggcgggtgacttcaagggagcaaccatcctgggcctctcctgggacaaacacttgccttcacccactatcgatgtcttgctcagccctcagaggagcgtggttggcgtggattacttcatgccttgattctgccttcccggaaaccacggtggcagcaggcttggatgtcaccaagtcaccgtgtttcatgctatttctggaggttctcgcctttgtggcctcggaaaggaaggcgatctggtgctttggggaaagccctcgggatgctcctccagatggtcttcttcaggccttttgctcagcattggtctgatcagttctgccagctctgggccatgatctcttggcactggcgcggctttccttcaataattccataaactcc

SEQ ID NO: 7500 - DNA, 1978 bp, Homo sapiens
actggtgctgagcactcgcccacctgtccgcttgccgtctctatgtctggagctcttagagataagacatagaggtgtctggttctgagaaaaggaagttttgctaagtgagagacacaactgactcaactgactcaggaaaacaaagtcccctcctgtattgacagctgggaattgtggtgtccaccgtcctcgacctgcgacggggtctccatgagcacagaggctgctctggagtcaacagatcatcttttccccaaaccaaactgcttggctggcgttgttcctgaaggggcttcactggccagaagacatccagtccctgactccacctgcctccaggtgcccagaacagcccatcgtggggacttcaccctcagcaagtggacgccgtttgtcctgccagggcaggatggagatggatgaggacccggataacctgcctgcccaggggcaaggcaatatcatcattactaagtatgagcagggacaccgagctggggcagcagtggacttggggcatgagcaggttgatgtcagaaaatacaccaataacctcgggattgtgcatgagatggagctgccccgcgtcagtgccctggaggtgaagcaaagacgcaaggaaagtaaacgtaccaacaagtggcaaaagatgcttgcagactggacaaaatataggagcaccaagaagctgtctcaaagagtatgcaaagtcattcccctggcggtgcggggccgggcgttgtcacttttgctagatattgacaaaatcaagtcccagaacccaggcaaatataaggtcatgaaggagaagggcaagaggtcctccagaatcatccactgcatccagctagatgtcagccacaccctgcagaaacacatgatgttcatacaaagattcggagtcaagcagcaggaattatgtgacatcctcgtggcctattctgcatataaccctgtgagtattcccgggcagcgatattcctggtacctgtgcccatattcacaggcatgggtgtctctcgggggtgttgcaacttcttgaaaattcagcgtttgtccaccaggacgtagtaggcaggacttcagctcgctgctggcagaaaagggttgaagcccagactcctggtctcacatggacccaatcaccacatctcagatgaagaaatgaccttcccctcctggtgttgccccaaagcctaggagcttggcagggtcccacacaggatggtccttgtaggagacaggtttgacaagttgctgaggtgcctgatgggccaggcacttgtcatgaaatgagtttgcatcctgggggagcctcttcttcactggaaacctggcaaggatccaatttcccctttgcctgatccccacaggagcatagcagatagggaggggggtcacccaggtggctcttcctgcttggcccccactttccagaccattccaggcagggagagctgctgagctgactgcatgagctgcccacatggaggacccagccaccccttatgttcggcaggcagcccttgggctgttgcaggaccgtggccagttcttggtattgctcaagtcccctgggccttcagactggcgggtgacttcaagggagcaaccatcctgggcctctcctgggacaaacacttgccttcacccactatcgatgtcttgctcagccctcagaggagcgtggttggcgtggattacttcatgccttgattctgccttcccggaaaccacggtggcagcaggcttggatgtcaccaagtcaccgtgtttcatgctatttctggaggttctcgcctttgtggcctcggaaaggaaggcgatctggtgctttggggaaagccctcgggatgctcctccagatggtcttcttcaggccttttgctcagcattggtctgatcagttctgccagctctgggccatgatctcttggcactggcgcggctttccttcaataattccataaactcc

SEQ ID NO: 7501 - DNA, 666 bp, Homo sapiens
ttccagctgatggctccacatcttgggggaaggctctgatttcatgacgggctgggggcttctcaggattccacagcccaaatggcgggacagttcaggggctccaagaccatcaggagcatgtggtacccacatcacaacccaagaccatggggcatctggacaaggaaggtctatgcacacagggttcctcattcagctggcttctccgggtgctgaatgatgggatctctctcgggctcaccccgtgcctgtgggatatgtatttgctggaaggggaacagatgttgatgctgataacaagcattgcctttaaggttcaaaggagcctctatgaagaaactaacaaggaaacatggggacctgccacccccagggccctcaagggcactggaagagccagacccatttgtgagagcctccactcctccctgcaagcgctgacagcctcagagagcagcagaggcccctcactcctgcagactcctccaagggtgccaggacaacaagccttgagccggggagacaagggaatcagtgtctcattatctctaccatctctaccatctcggagagggagatgtggcaggataatagggtaatagtggggtgagggtcagcaggaaaacatgaacaaatgtctctgtgtcataaacaaggttaagg

SEQ ID NO: 7502 - DNA, 602 bp, Homo sapiens
ttccagctgatggctccacatcttgggggaaggctctgatttcatgacgggctgggggcttctcaggattccacagcccaaatggcgggacagttcaggggctccaagaccatcaggagcatgtggtacccacatcacaacccaagaccatggggcatctggacaaggaaggtctatgcacacagggttcctcattcagctggcttctccgggtgctgaatgatgggatctctctcgggctcaccccgtgcctgtgggatatgtatttgctggaaggggaacagatgttgatgctgataacaagcattgcctttaaggttcaaaggaggccctcaagggcactggaagagccagacccatttgtgagagcctccactcctccctgcaagcgctgacagcctcagagagcagcagaggcccctcactcctgcagactcctccaagggtgccaggacaacaagccttgagccggggagacaagggaatcagtgtctcattatctctaccatctctaccatctcggagagggagatgtggcaggataatagggtaatagtggggtgagggtcagcaggaaaacatgaacaaatgtctctgtgtca

SEQ ID NO: 7503 - DNA, 6067 bp, Homo sapiens
atgccgggggccggagcccgggcggaggagggcggcggcggcggcgagggcgcggcgcagggggcggccgcggagcccggggcgggtccggcgcgggagccagcgcggctgtgtggctatctgcagaagctgtcgggcaagggccccctgcgtggctaccgcagccgctggttcgtgttcgacgcgcgccgctgctacctttactatttcaagagtccgcaggacgcgctgcccctcggccacttggacatcgcggacgcctgcttcagctaccagggccccgacgaggcggcggagccgggcacggagccgcccgcgcacttccaggtgcacagcgcgggagccgtcacggtgctcaaggctcccaatcgtcaactcatgacttactggttacaggagcttcagcagaagagatgggaatattgtaacagtcttgacatggtcaagtgggacagcaggacctctccaactcccggggattttcctaagggtcttgtagccagagataacactgatttaatttacccacacccaaatgcttctgcagaaaaagccagaaatgtcctagctgtggagactgtgcctggagagctggtgggagaacaagctgcaaatcagcccgccccagggcatccaaattccattaatttttactctttgaaacagtggggcaatgagctcaagaattcgatgtcttctttccgtcctgggagaggacataatgatagtcggaggactgtgttttataccaatgaagagtgggaacttttagacccaacccctaaggacctagaggagtccatagtacaggaagaaaagaagaagctgacccctgaaggaaacaaaggagtaactggctcaggattcccctttgattttggacgtaacccctacaaaggaaagcgccctttgaaagacataattgggtcgtacaaaaatcgtcacagcagtggtgacccttcaagtgaaggcacatcaggcagtggcagcgtcagcatcaggaagccggcctccgaaatgcaactgcaggtccagagccagcaggaagagctggaacagttaaagaaagacctgtccagtcagaaggagcttgttcgactgctccagcagacagtccggtcatcccagtatgacaagtatttcacaagcagccggctctgtgagggggtcccaaaggacacgctcgagcttctgcaccaaaaggatgatcagattctgggccttaccagccagctggagaggttcagcttggagaaggagagtcttcagcaggaagtaaggacgctgaagagcaaagtgggcgagctcaacgagcagctgggaatgctcatggagaccatccaagccaaggacgaggtcatcatcaagctcagcgagggcgagggcaacgggcctcctcccaccgtggcgcccagctccccttcggttgtgcctgttgccagggaccagctggaactggacaggctgaaagataatctacaggggtacaaaacccaaaacaaatttctaaataaggagattttggaactctcagctctacgaagaaatgcagaaaggagagagagggatctgatggcaaagtattctagcctggaagccaagctctgccagatagaaagtaaatacctgatattgctccaagaaatgaagacaccagtgtgctcagaagaccaggggcccacccgggaggtcatagcccagttgctggaggatgctctgcaggttgagagccaagagcagccggagcaagcatttgttaaacctcatcttgtcagtgaatatgatatttatgggttcaggactgtacctgaggatgatgaggaagagaaattggttgccaaggtccgcgcgttggatctgaagactctctacctcacagaaaaccaggaagtctccactggggtcaagtgggaaaactattttgcaagtacagtgaacagggagatgatgtgctctccagagttaaaaaacctcatccgtgcgggcattccccacgagcaccgttccaaggtgtggaagtggtgtgtggaccgtcacaccaggaagttcaaggacaacactgagcctggccacttccagaccttgctgcagaaggcgctggagaaacagaacccagcctccaagcagattgagctggacttgctgcgaactctgcccaacaacaaacattactcctgccccacctcagaaggcatacagaagttacgcaatgtcctcctcgccttctcctggcggaatccagatatcggctactgtcaaggcctaaacaggttggtggcagtggccctcctgtacctggaacaagaagatgctttctggtgtctcgttaccatagtggaagttttcatgcctcgagactattatacaaagactcttttaggatcccaggtggaccagcgggtgttcagagaccttatgagtgagaagctgcctcggttgcatggccactttgaacagtacaaagtcgactacactctcatcactttcaactggtttctggtggtatttgtggatagtgtcgttagtgacatcctctttaaaatatgggactctttcctttatgaaggaccaaaggttattttccgttttgctctggcactttttaagtacaaggaagaggagattttgaaattgcaagattcgatgtctatatttaagtatctccgctacttcactcgcactatccttgatgctaggaagctgatcagtatctcctttggggacctgaaccctttccccctacgccagatccggaaccgacgcgcctaccacttggagaaagtccggctggagctgaccgagctggaggccatccgtgaggacttcctgcgtgagcgggacaccagccctgacaagggtgagctggtcagtgacgaggaggaggatacctgagtgggctcgggatgctgctcttccttccttcacaaccaaagtgtgcccaaagggtgaaagtgcacttaaaagccagaatgtaacgtgtgtgtcctctggggatctgctgggcagatgtcccaagccaggctgcccttcctcatttcccactgtgcggggggcaggggtgggaggtctaatctgtttacaaccatttccgtgccatgcttttggttacacgtatctcagtcacgctttctgcctggttggtggatcctcaggcttaccagtggctatttgcaagagcctgtttccagcctccgtcagcctgtcggtgctctgaccctctgaaaccttgctttgctgggcatctccccatattctctctcctgtacatagtgggcagtggtgtgtggttttgaatggcagtgctataaaggatgccagctgtgctttaggcacctgtaggccagagggttgctgcctcaggcataaggttggtatgaaaaggggctgccttagaaaagcaggcacatcccttgttcagaaatggccactgtaggaaagcctgtgaacctcccaccagtggctttaagctgccagccatgccccatttctagaatagcctttgctcttccacacgcaacccttccatcagtgtcttccagcctgcatggggagggcctggctgcccagacacccaccctcacttctcatggccagcctgtgtttgcagatcactgggctgctctgtccccagcttgccccgtgccaggcatggctctgtgagattctgtggaatgcccttcttgacttgtggaaatcattcaccaagtacgatgggatgggattccaagtaaacagtggaccgtcatattgcaaagcaggcccacgcctgggctggccttggttgaggggatggaggaatgttttcgggggtgctttgcagggcagtggtgcagccgcagcgtgaacgctcttggacagctgaaaaccatggcctccttggggatggccagtgctcctggtgtctccacctgcctgggttgtgcaggaggccggctgccagtgcctggggctgggaaacttttttgcttggggcaggcttgggtgagctctcccagatgtgtgcccaccccaccactgcctggaacatccttgttctctgccaggatgcaggggcactgttgcctctgacacagcagtttctgggaactcagaggactgcctttctgaaggctggggagaggctttgagcaaggagcttgtttttgcttaatcgctctagaccatccctgatgcgtagatgtgagaggatgttttctggcacagtgttatgaaaatacaagataaatgatctcagtggaatgtttcatattacccgaaaaaaactggaaatcatcctttgttgtgaacacactgagactaagaattgaagcaatgcagttttaagaagtatttttcctattttttgctgtcaactttttggcaatgccacggcaaagttggtgtttcagcacatgctagagtgagctccggcttcgtgtctttaaccaactccactaatgtttcactgggtagacggagctggcctctatatttagccagaagcctttgcctcttttcaggcatcaaaaatgggttttgtcattgtctttgtctttgagagcagcagtttgaggtctgactccttcagttgtcctgtgagctgggcgttgcagtctgctcgaatcaagtgttggaaccccccccacccctcagcccatcgtgaaacgacagctgtcagcctggggggcggctgctgaggaggtgcagcaggaatggggctgggccctgaggttttactttccgagccaatggcccctggaacatgccagcacacactgccatgtcctggggctaagagctgcctttagggacaggctcgtgttgtccagtttgccctgagagatgcacctgaccaggggcccgtcgtggctgcaacccacggtggtatgttagtgtttccaggcagttgtcagcagctgccgggcagtgtgtgtgtgcgacagcaggagagttcctggaggaaagggactggggacactttctcagaggttctcctgcctggaatcaagtgatgcgtgtccagaaggcaagagagggcggctccgcctggttaaagtttgggaacgggacggagccaactcctccttccaggactgtgggccccactcttttgcgctaacacttcccctccctcgggtcactgaggaaagagctgctctgtcccctccagtgccctgaaggtccctggcctccactggctgccatggcagggggcccttctgacaggggctgccccaagctgctgttcctcctctgaaccttcaccccaacacccagcccgtggcccctgcaagggggaccctgccagctgggaaacccaaaggcctgtccaaacgtgcgcaccaggaccgaggggagctccctcccaacacctgctaggaattgccaacttttaaatggatggggttttttatgggttgaacctctgttaatacttttgtacactctcactacagtttatatttttataggctattttctcaaggtgtttctagattccacatatctattttatataacaagttattatgttatgtgtgtgactcccttgtgtgtatctgtgccagcctcagcctccgagttgcttttccctctggccctgactctcactgactcaccgatgtgatgtgcaggcccacttcttaccccagatagcctcgggcgctgcctgtagtcatgctgacagctgtacagtagccgccaagactgctgacagctggagacggttctggtttcaactacggtatattgatatcggaagtattctagacagatcctcggttgggttttctagctacatgtttgtattgcacagatccccacctgccatcctatagtgttgtcttcctgtgtgttccggggcttctgggcagctgggcctgcccggggaagtccttgcaggtgggaggccatacagagacccactgtgtgccactgaacgtcccactgctgctgggcaactggaggactgcagggggcgccaggtgactctctccttttatatcacagcagctcctgtgctgaccttcaagttacgttttggaactgtaatactaaaggaagaaataaactactaatttgtataata

SEQ ID NO: 7504 - DNA, 6086 bp, Homo sapiens
gggggtagggggcgcagcggccgcggcgcggaggcgcagggcgcgggcgcctacggttggcgcgcggtagcgatgccgggggccggagcccgggcggaggagggcggcggcggcggcgagggcgcggcgcagggggcggccgcggagcccggggcgggtccggcgcgggagccagcgcggctgtgtggctatctgcagaagctgtcgggcaagggccccctgcgtggctaccgcagccgctggttcgtgttcgacgcgcgccgctgctacctttactatttcaagagtccgcaggacgcgctgcccctcggccacttggacatcgcggacgcctgcttcagctaccagggccccgacgaggcggcggagccgggcacggagccgcccgcgcacttccaggtgcacagcgcgggagccgtcacggtgctcaaggctcccaatcgtcaactcatgacttactggttacaggagcttcagcagaagagatgggaatattgtaacagtcttgacatggtcaagtgggacagcaggacctctccaactcccggggattttcctaagggtcttgtagccagagataacactgatttaatttacccacacccaaatgcttctgcagaaaaagccagaaatgtcctagctgtggagactgtgcctggagagctggtgggagaacaagctgcaaatcagcccgccccagggcatccaaattccattaatttttactctttgaaacagtggggcaatgagctcaagaattcgatgtcttctttccgtcctgggagaggacataatgatagtcggaggactgtgttttataccaatgaagagtgggaacttttagacccaacccctaaggacctagaggagtccatagtacaggaagaaaagaagaagctgacccctgaaggaaacaaaggagtaactggctcaggattcccctttgattttggacgtaacccctacaaaggaaagcgccctttgaaagacataattgggtcgtacaaaaatcgtcacagcagtggtgacccttcaagtgaaggcacatcaggcagtggcagcgtcagcatcaggaagccggcctccgaaatgcaactgcaggtccagagccagcaggaagagctggaacagttaaagaaagacctgtccagtcagaaggagcttgttcgactgctccagcagacagtccggtcatcccagtatgacaagtatttcacaagcagccggctctgtgagggggtcccaaaggacacgctcgagcttctgcaccaaaaggatgatcagattctgggccttaccagccagctggagaggttcagcttggagaaggagagtcttcagcaggaagtaaggacgctgaagagcaaagtgggcgagctcaacgagcagctgggaatgctcatggagaccatccaagccaaggacgaggtcatcatcaagctcagcgagggcgagggcaacgggcctcctcccaccgtggcgcccagctccccttcggttgtgcctgttgccagggaccagctggaactggacaggctgaaagataatctacaggggtacaaaacccaaaacaaatttctaaataaggagattttggaactctcagctctacgaagaaatgcagaaaggagagagagggatctgatggcaaagtattctagcctggaagccaagctctgccagatagaaagtaaatacctgatattgctccaagaaatgaagacaccagtgtgctcagaagaccaggggcccacccgggaggtcatagcccagttgctggaggatgctctgcaggttgagagccaagagcagccggagcaagcatttgttaaacctcatcttgtcagtgaatatgatatttatgggttcaggactgtacctgaggatgatgaggaagagaaattggttgccaaggtccgcgcgttggatctgaagactctctacctcacagaaaaccaggaagtctccactggggtcaagtgggaaaactattttgcaagtacagtgaacagggagatgatgtgctctccagagttaaaaaacctcatccgtgcgggcattccccacgagcaccgttccaaggtgtggaagtggtgtgtggaccgtcacaccaggaagttcaaggacaacactgagcctggccacttccagaccttgctgcagaaggcgctggagaaacagaacccagcctccaagcagattgagctggacttgctgcgaactctgcccaacaacaaacattactcctgccccacctcagaaggcatacagaagttacgcaatgtcctcctcgccttctcctggcggaatccagatatcggctactgtcaaggcctaaacaggttggtggcagtggccctcctgtacctggaacaagaagatgctttctggtgtctcgttaccatagtggaagttttcatgcctcgagactattatacaaagactcttttaggatcccaggtggaccagcgggtgttcagagaccttatgagtgagaagctgcctcggttgcatggccactttgaacagtacaaagtcgactacactctcatcactttcaactggtttctggtggtatttgtggatagtgtcgttagtgacatcctctttaaaatatgggactctttcctttatgaaggaccaaaggttattttccgttttgctctggcactttttaagtacaaggaagaggagattttgaaattgcaagattcgatgtctatatttaagtatctccgctacttcactcgcactatccttgatgctagatccggaaccgacgcgcctaccacttggagaaagtccggctggagctgaccgagctggaggccatccgtgaggacttcctgcgtgagcgggacaccagccctgacaagggtgagctggtcagtgacgaggaggaggatacctgagtgggctcgggatgctgctcttccttccttcacaaccaaagtgtgcccaaagggtgaaagtgcacttaaaagccagaatgtaacgtgtgtgtcctctggggatctgctgggcagatgtcccaagccaggctgcccttcctcatttcccactgtgcggggggcaggggtgggaggtctaatctgtttacaaccatttccgtgccatgcttttggttacacgtatctcagtcacgctttctgcctggttggtggatcctcaggcttaccagtggctatttgcaagagcctgtttccagcctccgtcagcctgtcggtgctctgaccctctgaaaccttgctttgctgggcatctccccatattctctctcctgtacatagtgggcagtggtgtgtggttttgaatggcagtgctataaaggatgccagctgtgctttaggcacctgtaggccagagggttgctgcctcaggcataaggttggtatgaaaaggggctgccttagaaaagcaggcacatcccttgttcagaaatggccactgtaggaaagcctgtgaacctcccaccagtggctttaagctgccagccatgccccatttctagaatagcctttgctcttccacacgcaacccttccatcagtgtcttccagcctgcatggggagggcctggctgcccagacacccaccctcacttctcatggccagcctgtgtttgcagatcactgggctgctctgtccccagcttgccccgtgccaggcatggctctgtgagattctgtggaatgcccttcttgacttgtggaaatcattcaccaagtacgatgggatgggattccaagtaaacagtggaccgtcatattgcaaagcaggcccacgcctgggctggccttggttgaggggatggaggaatgttttcgggggtgctttgcagggcagtggtgcagccgcagcgtgaacgctcttggacagctgaaaaccatggcctccttggggatggccagtgctcctggtgtctccacctgcctgggttgtgcaggaggccggctgccagtgcctggggctgggaaacttttttgcttggggcaggcttgggtgagctctcccagatgtgtgcccaccccaccactgcctggaacatccttgttctctgccaggatgcaggggcactgttgcctctgacacagcagtttctgggaactcagaggactgcctttctgaaggctggggagaggctttgagcaaggagcttgtttttgcttaatcgctctagaccatccctgatgcgtagatgtgagaggatgttttctggcacagtgttatgaaaatacaagataaatgatctcagtggaatgtttcatattacccgaaaaaaactggaaatcatcctttgttgtgaacacactgagactaagaattgaagcaatgcagttttaagaagtatttttcctattttttgctgtcaactttttggcaatgccacggcaaagttggtgtttcagcacatgctagagtgagctccggcttcgtgtctttaaccaactccactaatgtttcactgggtagacggagctggcctctatatttagccagaagcctttgcctcttttcaggcatcaaaaatgggttttgtcattgtctttgtctttgagagcagcagtttgaggtctgactccttcagttgtcctgtgagctgggcgttgcagtctgctcgaatcaagtgttggaaccccccccacccctcagcccatcgtgaaacgacagctgtcagcctggggggcggctgctgaggaggtgcagcaggaatggggctgggccctgaggttttactttccgagccaatggcccctggaacatgccagcacacactgccatgtcctggggctaagagctgcctttagggacaggctcgtgttgtccagtttgccctgagagatgcacctgaccaggggcccgtcgtggctgcaacccacggtggtatgttagtgtttccaggcagttgtcagcagctgccgggcagtgtgtgtgtgcgacagcaggagagttcctggaggaaagggactggggacactttctcagaggttctcctgcctggaatcaagtgatgcgtgtccagaaggcaagagagggcggctccgcctggttaaagtttgggaacgggacggagccaactcctccttccaggactgtgggccccactcttttgcgctaacacttcccctccctcgggtcactgaggaaagagctgctctgtcccctccagtgccctgaaggtccctggcctccactggctgccatggcagggggcccttctgacaggggctgccccaagctgctgttcctcctctgaaccttcaccccaacacccagcccgtggcccctgcaagggggaccctgccagctgggaaacccaaaggcctgtccaaacgtgcgcaccaggaccgaggggagctccctcccaacacctgctaggaattgccaacttttaaatggatggggttttttatgggttgaacctctgttaatacttttgtacactctcactacagtttatatttttataggctattttctcaaggtgtttctagattccacatatctattttatataacaagttattatgttatgtgtgtgactcccttgtgtgtatctgtgccagcctcagcctccgagttgcttttccctctggccctgactctcactgactcaccgatgtgatgtgcaggcccacttcttaccccagatagcctcgggcgctgcctgtagtcatgctgacagctgtacagtagccgccaagactgctgacagctggagacggttctggtttcaactacggtatattgatatcggaagtattctagacagatcctcggttgggttttctagctacatgtttgtattgcacagatccccacctgccatcctatagtgttgtcttcctgtgtgttccggggcttctgggcagctgggcctgcccggggaagtccttgcaggtgggaggccatacagagacccactgtgtgccactgaacgtcccactgctgctgggcaactggaggactgcagggggcgccaggtgactctctccttttatatcacagcagctcctgtgctgaccttcaagttacgttttggaactgtaatactaaaggaagaaataaactactaatttgtataat

SEQ ID NO: 7505 - DNA, 5290 bp, Homo sapiens
atggacgtccttcccaccggcgggggccgcccggggctccggacggagctggaattccgcggcggcggtggcgaggcgaggctggagagtcaggaggaagaaacgattcctgcagctcccccagccccgcgcctccggggagcggcggagcggccgcggcgctcccgggacacgtgggacggcgatgaggacacggagcccggcgaggcgtgcggcggccgcacaagccgcacggcgtccctggtgagcgggctgctcaacgagctgtacagctgcacagaggaggaggaggcggcgggcgggggccgcggggccgagggccgccggcggcgccgcgacagcctcgacagctccaccgaggcctcgggctccgacgtggtcctgggcggccgcagcggtgccggcgactcccgcgtgctgcaggagctgcaggagcgaccgagccagcggcatcagatgctgtacctgcggcagaaagacgctaatgaactgaagacgatccttcgagagctaaagtacagaattggcatccagtcggccaagttacttcggcatctgaagcagaaagataggcttctgcataaagtgcagaggaactgtgatattgtgactgcctgcttgcaggctgtgtcacagaagagaagagttgataccaagttgaaattcactcttgagccatctttaggtcaaaatggttttcagcagtggtacgatgctctcaaggcagttgccaggctatccacaggaataccaaaggaatggaggagaaaggtttggttgaccttggcagatcattatttgcacagtatagccattgactgggacaaaaccatgcgcttcactttcaatgaaaggagtaatcctgatgatgactccatgggaattcagatagtcaaggaccttcaccgcacaggctgtagttcttactgtggccaggaggctgagcaggacagggttgtgttgaagcgggtgctgctggcctatgcccgatggaacaaaactgttgggtactgccaaggctttaacatcctggctgcactaattctggaagtgatggaaggcaatgaaggggatgccctgaaaattatgatttaccttattgataaggtacttcccgaaagctatttcgtcaataatctccgggcattgtctgtggatatggctgtcttcagagaccttttaagaatgaagctgccggaattatctcagcacctggatactcttcagagaactgcaaacaaagaaagtggaggtggatatgagcccccacttacaaatgtcttcacgatgcagtggtttctgactctctttgccacatgcctccctaatcagaccgttttaaagatctgggattcagtcttctttgaaggttcagaaatcatcctaagggtgtcgctggctatctgggcaaaattaggagagcagatagaatgttgtgaaacagcagatgaattctacagcaccatggggcgccttacccaggagatgctagagaatgatcttctgcaaagccatgaactcatgcagactgtttattccatggctccgttccctttcccacaattggcagagttgagggaaaaatacacctacaacattacaccgttcccagccacagttaaacccacctcagtttctggacgacatagtaaggccagagacagtgatgaagagaatgacccagacgatgaggatgctgtcgttaatgcagtggggtgtcttggaccttttagtgggttcctggctcctgaactgcagaagtaccaaaaacaaattaaagagccaaatgaggagcagagtctgagatctaataacattgcagagctgagtccaggagcaatcaattcctgtcgaagtgaataccatgcagcttttaacagtatgatgatggaacgcatgaccacagatatcaatgcactgaagcggcagtactctcgaattaaaaagaagcaacagcagcaggttcatcaggtgtacatcagggcagacaaagggccagtgaccagcattctcccgtctcaggtaaacagttctccagttataaaccaccttcttttaggaaagaagatgaaaatgactaacagagctgccaagaatgctgtcatccacatccctggtcacacaggagggaaaatatctcctgtcccctacgaagaccttaagacgaagctcaactccccgtggcgaactcacatccgagtccacaaaaagaacatgccaaggaccaagagtcatccgggctgtggggacaccgtagggctgatagatgagcagaacgaggccagcaagaccaatgggctgggggcagcagaggcattcccctctggttgtacagcgacagctgggagagaaggcagcagccctgaaggcagtaccaggaggacgatcgaggggcagtctccggagccggtgttcggagatgctgatgtggatgtgtctgcagttcaggcgaagttgggagccctggaactgaaccagagggatgctgcagctgaaactgagctcagggtgcacccaccctgccagcggcactgcccagagccgccgagtgcacccgaagaaaacaaagccaccagcaaagctccccaaggcagcaactcaaaaacccccatctttagcccttttcccagcgtcaagcccctgcggaaatctgctactgccaggaacttgggattatatggccctacagaaagaaccccaactgtgcactttcctcaaatgagtaggagcttcagcaaacccggcggtggaaacagtggcactaaaaaacgatgatgtctccccgaaactttgtatctggactcaccttttcacagtagtataagggttgcagctgaatggctctaaaagagttttatttgtccagtgaaaatgaataggttcagggatgagcaacagcccataaaaaatgggaactggaagttttataataggagttagaacagggctgttttcccagctacttgctaactgacgaagtggattcttgtggcaaaataaatattgtggttttatagtgtgaagttttcccaatttttcattgtgagctgtttaaaaaagactatatctagattgttaactctcgtccatccttctgttctgggggccttcagagtccctgtgacagcacccccaaaccttccagttctctgggtgttactaatactcaagcatgcacataccagcttgctaggacagaaactgtaaaaagaaagtaagtttcttcgttacaaaaaacttcctgattttccttttcatgctttacggaggggattgtgtcgtgtgagatttcccacagtaccagtttcaaattttttttttattcttatgctaaatcataggagaaaaatctagatagcctttctttaactgtctatttctacctgcaaaatgaagaaaacctttcatctgttgaaatttcaatcgataacccagctgaagatcttatgcacaggacacacttggcatatgctttacgcagttgctccggacagcttgctcgcgccactgagcttttcctgaggtttgtgttcgcctctcaaggagagctttgatcctcagtggtacggatgacttgatgggctccatgcggagcctggcctgcatcccccaccacacagctcactcacccaccagctctagactgcagacgcacaaggcctctgctcagaagccagaacacagcacctgtgactctgttacttgaattttgtgctttttgattggagtcctttgttgagtactttgttaattgaacactgcctttctctggagaaggccccagtgctttctagctccctctcactcctgccctttctagctctctctcacccagcgggtcagggatagcacctcttgtctccactatgcagatgggaactctgagccacacagaggtgaagtagcacttcagttactcaaggtcagtactctcggtattccaagtgacttagccacatttccttcagtgcaataggtgggtttaatgctctttgtacacagatgtattggctacatagcgtgtaaaaaccaagactgggaagccattcactaaaatccctcctgactcaaaggacctgtctccagatggtacagagtcccttgatggcattttacaaaaccagctctgacttccttatcctgaacagggagtttattttaaaaatgcttcatgcacctgttatttggctgaacagaaggctcactcctcaatccccttctcctcgccatcattagaggaatagactcagccttcatgtttgtctctggaagacgattggcgatacttgcaggaatattgttgatgcagccaatattaatttgagctaatggattgttaattctgaaacgaaaactgtaactgtagagcaggcttttactatgagaggtactactttttataatagagaatgtggttgtgtgggctttttttgaacagaaaacacaacaatgacctataccgtgagaaaagccattttatcttcttcgtggtatttttacccccaaaggaactgaagatggaaaatatgactaataagttattgcagttttggtcttgaattctgtgccatctgaagttagcatccagcttcttaaaaagcagccacgcctacagcctgttttttgggaaggctgtaggtggagagatgggcttattttgcataccaccctcagggcccagagacccactgcattttccaaagttaagcaaatgacaccattttcttccatcagctaaactttacagataatagtgtttccacctcatatccttttctttgccccttctcaaatgagtcagaatagtcatgttccccttgagggatgtctgacttgaatggagaattgttctttcctctcttgaatcagctcactagctccctgatggtctgggttcaaggaaatggttaatgaggtagaggccacttatacaagtccttgggattgtaccattgctgtccacaaacttagtatcaacaacacatgctgtgccctgtgaacactctcctctcacctatttccagggttggtcttcctgagaaggggatggatgaggtaacacacagtttgggatacgtatctgttgaatgaatgaataagtgaaaggataatagtcctctgaggtaaaaatggccttgtcagaattttgaaaatccaacagattcctattaaagcactctgtgtaccaataacatgcatgcattgtaccaagtaatcacaatgtgaattggtcaatttatgagccttgcctactttagaaaataaagaaacctgcagtagcctctaccac

SEQ ID NO: 7506 - DNA, 2245 bp, Homo sapiens
gcagatgcctgctggcttccctgcgctcggcggctcccgcggtgccccgtaagtccccgtgaccctccagcaccagccggctgtgcgctccctgctcccacgggccggtcagccgcagacactcacccagctccgcgagctcagccgctcagcgagtggggtagcggggaccgagacggacggtagccgtgccagagcccggggcgctctcggatgcggcaggacaagctgaccgggtctctgaggcgcggggggagatgcctgaagcggcagggcggcggcgtgggcaccatcctgagcaatgtgctcaagaagcgcagctgcatttcccggaccgcgccccggctgctgtgcaccctggagccgggagttgataccaagttgaaattcactcttgagccatctttaggtcaaaatggttttcagcagtggtacgatgctctcaaggcagttgccaggctatccacaggaataccaaaggaatggaggagaaaggaccttcaccgcacaggctgtagttcttactgtggccaggaggctgagcaggacagggttgtgttgaagcgggtgctgctggcctatgcccgatggaacaaaactgttgggtactgccaaggctttaacatcctggctgcactaattctggaagtgatggaaggcaatgaaggggatgccctgaaaattatgatttaccttattgataaggtacttcccgaaagctatttcgtcaataatctccgggcattgtctgtggatatggctgtcttcagagaccttttaagaatgaagctgccggaattatctcagcacctggatactcttcagagaactgcaaacaaagaaagtggaggtggatatgagcccccacttacaaatgtcttcacgatgcagtggtttctgactctctttgccacatgcctccctaatcagaccgttttaaagatctgggattcagtcttctttgaaggttcagaaatcatcctaagggtgtcgctggctatctgggcaaaattaggagagcagatagaatgttgtgaaacagcagatgaattctacagcaccatggggcgccttacccaggagatgctagagaatgatcttctgcaaagccatgaactcatgcagactgtttattccatggctccgttccctttcccacaattggcagagttgagggaaaaatacacctacaacattacaccgttcccagccacagttaaacccacctcagtttctggacgacatagtaaggccagagacagtgatgaagagaatgacccagacgatgaggatgctgtcgttaatgcagtggggtgtcttggaccttttagtgggttcctggctcctgaactgcagaagtaccaaaaacaaattaaagagccaaatgaggagcagagtctgagatctaataacattgcagagctgagtccaggagcaatcaattcctgtcgaagtgaataccatgcagcttttaacagtatgatgatggaacgcatgaccacagatatcaatgcactgaagcggcagtactctcgaattaaaaagaagcaacagcagcaggttcatcaggtgtacatcagggcagacaaagggccagtgaccagcattctcccgtctcaggtaaacagttctccagttataaaccaccttcttttaggaaagaagatgaaaatgactaacagagctgccaagaatgctgtcatccacatccctggtcacacaggagggaaaatatctcctgtcccctacgaagaccttaagacgaagctcaactccccgtggcgaactcacatccgagtccacaaaaagaacatgccaaggaccaagagtcatccgggctgtggggacaccgtagggctgatagatgagcagaacgaggccagcaagaccaatgggctgggggcagcagaggcattcccctctggttgtacagcgggtcagggatagcacctcttgtctccactatgcagatgggaactctgagccacacagaggtgaagtagcacttcagttactcaaggtcagtactctcggtattccaagtgacttagccacatttccttcagtgcaataggtgggtttaatgctctttgtacacagatgtattggctacatagcgtgtaaaaaccaagactgggaagccattcactaaaatccctcctgactcaaaggacctgtctccagatggtacagagtcccttgatggcattttacaaaaccagctctgacttccttatcctgaaca

SEQ ID NO: 7507 - DNA, 2291 bp, Homo sapiens
gagcgatctcctgcctcagccttgcaggctccgcactgcagatgcctgctggcttccctgcgctcggcggctcccgcggtgccccgtaagtccccgtgaccctccagcaccagccggctgtgcgctccctgctcccacgggccggtcagccgcagacactcacccagctccgcgagctcagccgctcagcgagtggggtagcggggaccgagacggacggtagccgtgccagagcccggggcgctctcggatgcggcaggacaagctgaccgggtctctgaggcgcggggggagatgcctgaagcggcagggcggcggcgtgggcaccatcctgagcaatgtgctcaagaagcgcagctgcatttcccggaccgcgccccggctgctgtgcaccctggagccgggagttgataccaagttgaaattcactcttgagccatctttaggtcaaaatggttttcagcagtggtacgatgctctcaaggcagttgccaggctatccacaggaataccaaaggaatggaggagaaaggtttggttgaccttggcagatcattatttgcacagtatagccattgactgggacaaaaccatgcgcttcactttcaatgaaaggagtaatcctgatgatgactccatgggaattcagatagtcaaggaccttcaccgcacaggctgtagttcttactgtggccaggaggctgagcaggacagggttgtgttgaagcgggtgctgctggcctatgcccgatggaacaaaactgttgggtactgccaaggctttaacatcctggctgcactaattctggaagtgatggaaggcaatgaaggggatgccctgaaaattatgatttaccttattgataaggtacttcccgaaagctatttcgtcaataatctccgggcattgtctgtggatatggctgtcttcagagaccttttaagaatgaagctgccggaattatctcagcacctggatactcttcagagaactgcaaacaaagaaagtggaggtggatatgagcccccacttacaaatgtcttcacgatgcagtggtttctgactctctttgccacatgcctccctaatcagaccgttttaaagatctgggattcagtcttctttgaaggttcagaaatcatcctaagggtgtcgctggctatctgggcaaaattaggagagcagatagaatgttgtgaaacagcagatgaattctacagcaccatggggcgccttacccaggagatgctagagaatgatcttctgcaaagccatgaactcatgcagactgtttattccatggctccgttccctttcccacaattggcagagttgagggaaaaatacacctacaacattacaccgttcccagccacagttaaacccacctcagtttctggacgacatagtaaggccagagacagtgatgaagagaatgacccagacgatgaggatgctgtcgttaatgcagtggggtgtcttggaccttttagtgggttcctggctcctgaactgcagaagtaccaaaaacaaattaaagagccaaatgaggagcagagtctgagatctaataacattgcagagctgagtccaggagcaatcaattcctgtcgaagtgaataccatgcagcttttaacagtatgatgatggaacgcatgaccacagatatcaatgcactgaagcggcagtactctcgaattaaaaagaagcaacagcagcaggttcatcaggtgtacatcagggcagacaaagggccagtgaccagcattctcccgtctcaggtaaacagttctccagttataaaccaccttcttttaggaaagaagatgaaaatgactaacagagctgccaagaatgctgtcatccacatccctggtcacacaggagggaaaatatctcctgtcccctacgaagaccttaagacgaagctcaactccccgtggcgaactcacatccgagtccacaaaaagaacatgccaaggaccaagagtcatccgggctgtggggacaccgtagggctgatagatgagcagaacgaggccagcaagaccaatgggctgggggcagcagaggcattcccctctggttgtacagcgacagctgggagagaaggcagcagccctgaaggcagttcctcttacaaaagcctccagatgatctaaatctagttagcaatgtcagcctgtggactgcagctgtttgggacattgtattcctttgtttgtctcttgttgttctgaaggattgtattgatcacaaagctatatgcataaagattctcattgttgt

SEQ ID NO: 7508 - DNA, 6609 bp, Homo sapiens
tgactgcatcacctggtctgtgaattttccattagaagcttggtgtgctgttaggtgaaagacttgctcagctatgcgtcattgggttttatcaacatataggcgaaaaaaatcctggtctctgagtgtacagctgagatgaaaatttcttttattggaggaagtattgagtgtgtgctctcaaatgcggcctcagttgagtagtgcattcctgagttttggaagcaaatttgcaaacaattgagagtcgtacagtgggtgttctaactggattcaggttttttctaatgtaattttttcacacgtaaattaaaaagtttagaaatgtcacacataacttcataacactttatggagaaatggttgtacttttaatttttttctttttatttatactccaactgactgagcagaggttgtacttctaaataactttgtggaagtttttagtaccataatttttataattttcattccagtcctttgatatttatgacagtacttctgaagcgcttactgagtgccggacactgttgtaagtgctttacggaacttgacttttttttttttttgagacggactctcgctctgtcgcccaggctggagtgcagtggtgcagtggctcgatctcggctcactgccacctctccctcatggtttcaaacacttctcctgcctcagcctcccaggtagccaggattatagccgcccgccaccactcccgactaattttattttgtatgttcttttttagtagagacggaggagtttcaccatgttggccaggctggtatcgacctcctgacctcaagtgatgtgtccatctcggcctcccaaggtgctggaattacaggtgtgagccactgtgctcggcctacctttttttttttgttttttgtttttttgaaaaggagtttcgctcttgtccaggctggagtataatggtgcgatctcagctcaccgcaatctccgcctcccagattcaagcgattctcctgcctcagcctcctcaggagctgggattacaggcgcccaccgccatgcccggctaatttttgtatttttagtagagacggggtttcactatattggccaggctggtctcgaactgctgacctcaagtaatccgcctgcctcagcctcccaaagtgctgggattacagacgtgatccaccaggatcacaccaggccgcgcctggcctgctttcattttaaaagtcaaatttgtcatccgcctcagtgcttgtaatcttttctgagtgagatactgaaatttgcagtttcgttttgcttgcacttgttcactggaccagtagtcactgttaaatgtaaaagtatctacttcctctgaaagttttttattcctttatttcctgcctgggcttgtcctccaccctacatgtatgcgtagtagatttagtgtttgttatcctaacctttaggtttagggattgactgggtttctgactttttatttggccaatgaggacgatacagaaaatgaagcattggtcattatcacattttaacgctgaaaaagtaagaaggacaaccccggaataaaatgatatcagtatcaagataaaagtttggaatgggagaaaaattctcaaagcctgaaagaaaatctgtagttacttttggtgacgctgtccagttcccacaatgtatcattccttatctgaaactagacatcctctgcagccagaagaacaagaagtaggcattgaccccttgtccagttactctaacaagtctggaggagattcaaataaaaatggaagaagaacaagttctactttagactctgaagggacttttaattcctataggaaagaatgggaagaactatttgtaaacaacaattacttggcaacaataaggcagaaggggattaatgggcagctgagaagcagcaggttccgcagcatttgctggaagctatttctttgtgttcttcctcaagacaaaagtcaatggataagtagaattgaagaattaagagcatggtatagcaacattaaagaaatacatattaccaacccgaggaaggttgttggccaacaagatttgatgatcaataatcctctttcacaggatgaagggagtctttggaacaaattcttccaagataaagaacttcgatcaatgattgaacaagatgtcaaaagaacgtttcctgaaatgcagtttttccagcaagaaaatgtgagaaaaattcttacagatgttcttttctgttatgccagagaaaacgagcagttgctttataaacagggcatgcacgaactgttagcacctatagtctttgtccttcactgtgaccaccaagcttttctacatgccagtgagtctgcacagcccagtgaggaaatgaaaactgtcttgaaccctgagtatctggaacatgatgcctatgcagtgttctcacaacttatggaaactgctgaaccttggttttcaacttttgagcatgatggtcagaaggggaaagaaacactgatgactcccattccctttgctagaccacaagatttagggccaacaattgctattgttactaaagtcaaccagatccaggatcatctactgaagaagcatgatattgagctttacatgcacttgaacagactagaaattgcaccacagatatatgggttaaggtgggtgcggctgctatttggacgagagttccccctgcaggaccttctggtggtctgggatgccttgtttgcagacggcctcagcctgggtttagtagattatatcttcgtagccatgttactttacatccgagatgctttgatctctagtaactaccagacctgtctcggccttctgatgcattacccattcatcggggatgtacactcactgattcttaaggctctgttccttagagatccaaagagaaatccaagaccagtgacttatcaattccatccaaatttagattattacaaagcacgaggagcagacctcatgaataaaagccggaccaatgccaaaggtgctcccctgaatataaataaggtctctaatagcctgattaattttggaagaaagttgatttccccagcaatggctccaggcagtgcaggtggccctgtacctggaggcaacagcagtagctcctcctctgttgtaattcctaccaggacctcagcagaggccccaagccatcacttgcaacagcaacagcagcagcagaggctgatgaaatcagaaagcatgcctgtgcaattgaacaaagggctaagttctaaaaacatcagttcatctccaagcgttgagagtttgcctggaggaagagaattcactggctctccaccttcatctgctactaaaaaagattccttttttagcaacatctcacgttctcgctcacacagcaaaactatgggcagaaaagaatctgaagaagaattagaagcccaaatttccttccttcaagggcagttgaatgacctggatgccatgtgcaaatactgtgcaaaggtgatggacactcatcttgtaaatattcaagatgtgatattacaagaaaatttggaaaaagaagatcaaattctggtttccctggcaggattaaaacagatcaaagacattctaaaaggttccctgcgttttaaccagagccagctagaggccgaagagaacgaacagatcaccattgcggacaaccactactgctccagcggccagggccagggccgaggccaaggccagagcgttcaaatgtcaggggccattaaacaggcctcttcagaaacgccagggtgcactgatagagggaattccgatgacttcatcctgatttccaaagatgatgatgggagcagtgccaggggctccttctccggccaggcccagcctcttcgcaccctcagaagcacctctgggaaaagccaggccccagtctgctccccactggtgttctcagatccactgatgggcccagcctcagcttcctccagcaaccccagctccagtcctgatgacgacagcagcaaggactctggcttcaccattgtgagtcccctggacatctgaccacagtgcccagtcctgccccacagggatctagccacccttcagtggccccaaggccagactgaggctcatccagtggagaaccttcttaaaccactgcttccttcccggcatgcattttgcattggtccagccctttgaaaccccttagagagaagcatatatggccacaaagcacagaggcttaggtttgccacatgcagacagggctttctgggcccttacctaatccccacccgactcttgctctgagttagagctgagttacgtacccagtatcacactcacagttagaaaagaccgaatcacaatttagaatcacttttcctctgtccccttctccccagctaagaatgtgtggcacctccatcagttatacttagaaggagcagaaatagttattttcgtatcttctatccctcaaagcatcagacatgggaaaattggtttataccaagaaagcttcctctgtggaaatctgtctcagcctactttattcctgcattgggaagccatatcgcagagctaaatgcaatagaatgaaccagaactagtggattccagggctgggggaaaaaaaaaaagaaaaaacctcattactgacctctcaaagttataaggatctctgcaaacaggatctaagcttaggaataatatttaggtgtgatatagtgttagatttttttgatgtattaaagaatgcatctccaatccttaggccatatcaactttggccatcaatatctctccttaaacaattatatttcaccttttagaatctttcatagccagaaaacaagattactgtaagccagttttagctgcactgatttcaaaagatataagaatattactatccttcaaatggaaaatgcgaccttgactttatgggataaacatctttcagacagtcagttttctagtcaggtttctctggtttcagagctgtatatacctgtcaactgaggaataaagggaaaaacccaagttcattcccacccaaagtcagaatccctcattggccttaaggtagcagtcataagacagagaattggacctagagtcccttctgtggggaataaggatacctagagaacattccacatgccaagaggatgcaggatttctacacaaccccttcccttcttggaagtcaagtgtaggtactgcagggcctgtgctcagctgtgaaccccgtatcctgggccccactgccgggaccgggtctgacatgccagtgccttcctgggctgagcacagattagagactctcccccttgtcagtcagcaccttaggaaaccatgatgggcacagagcatcacatgagctgtttctctccttaaagaagatccctggaaaggatgcttttcctctcctttgcctgcgcaggaattctaacaggagtgggtgaggatggcagagggacacagtgcctgtctcgcctccatcagggagagcagccatgccagggatgactagctctttgagcctgtcctcagaggatggcgaggcagccgggcagtggaggccttcatggtaacaaatgaaagctcagtatagaggaacagacactgtttacgtccctcccactgctaaccttatatatctctatagacaaatgtgataatgacatgatttcccacctgccctccaagaaaatggtgactcactctcaagtcagctactgtagagagggttctaattggttctgcaatttgctcttaaactctagcagggaactctcctcttaccacatcagcatgtaaggtgaataataactggttttgccagacagcaggttgtctgaccttcaaccactgggcaattgcctggcagatgcacacagtagctccctggcttctggctctgagtgttcctctcagcacctctgagtaagctgctgccaagcacatatccctatgacaacactttgtaaaagccgcggggcccccatacagcgagtgaccttgcaactgtgcagggttgccattggtcactttctcaccttgggaaggtgtcagtgttttcagttctaaggtaagaggtgtagagctgttcccaccagggctctgggacagactggaaaggaccacagacctggccatccctgggcagcagggccagtgtcacctgctgacctctagtatttcctttgccctagagctagagtcatgatagctgagggtcactcgccctgcaagagtcactaggcacccaccatgccaataaggctctccgctggctccctgcagttggctgggtgtttaatagtcactgaaaactcccagccctgctgcacactagaggcaggtcctctcggtcctctccatcctgtgcttctgtggcccccagcaagctcaccacctccttggaggagagagacatacaaggacagtgggtcatgggtagtaccagcctcaaattcccacaggctcatactcagacaattgtattactgccttatgttttttaagtgtttttttaaattcttcatagttgagtattatttgcaattttattagttacagtgctattaaagaatatgtgctcctttt

SEQ ID NO: 7509 - DNA, 852 bp, Homo sapiens
acgtggccgctggtcaccgccgccaccccctcccgccctgttctctttcaggtcgggccgggcccggccgcttccgcgagcgccctgcagactgagggagagagagagaaagaggaggggaggaggaggaggattcagggaataggagctggggagcccttctgcgccacaggagggagcctgcgagcaaacgaggtggaaactggagtgcacaagtgctggaatgggctgtctgccttccacccctcacgggagggagcgcgcaggtagttacttttggtgacgctgtccagttcccacaatgtatcattccttatctgaaactagacatcctctgcagccagaagaacaagaagtaggcattgaccccttgtccagttactctaacaagtctggaggagattcaaataaaaatggaagaagaacaagttctactttagactctgaagggacttttaattcctataggaaagaatgggaagaactatttgtaaacaacaattacttggcaacaataaggcagaaggggattaatgggcagctgagaagcagcaggttccgcagcatttgctggaagctatttctttgtgttcttcctcaagacaaaagtcaatggataagtagaattgaagaattaagagcatggtatagcaacattaaagaaatacatattaccaacccgaggaaggttgttggccaacaagatttgatgatcaataatcctctttcacaggatgaagggagtctttggaacaaattcttccaagataaagaacttcgatcaatgattgaacaagatgtcaaaagaacgtttcctgaaatgcagtttttccagcaagaaaatgtgagaaa

SEQ ID NO: 7510 - DNA, 3156 bp, Homo sapiens
agcccttctgcgccacagagatggggtctcactctgtcatccaggctggaatatagtggcacaatcatagcccattgtagcctccatctcaaggactcaggggatcctcccttctaggcctcccaagtagctgggattacaggtagttacttttggtgacgctgtccagttcccacaatgtatcattccttatctgaaactagacatcctctgcagccagaagaacaagaagtaggcattgaccccttgtccagttactctaacaagtctggaggagattcaaataaaaatggaagaagaacaagttctactttagactctgaagggacttttaattcctataggaaagaatgggaagaactatttgtaaacaacaattacttggcaacaataaggcagaaggggattaatgggcagctgagaagcagcaggttccgcagcatttgctggaagctatttctttgtgttcttcctcaagacaaaagtcaatggataagtagaattgaagaattaagagcatggtatagcaacattaaagaaatacatattaccaacccgaggaaggttgttggccaacaagatttgatgatcaataatcctctttcacaggatgaagggagtctttggaacaaattcttccaagataaagaacttcgatcaatgattgaacaagatgtcaaaagaacgtttcctgaaatgcagtttttccagcaagaaaatgtgagaaaaattcttacagatgttcttttctgttatgccagagaaaacgagcagttgctttataaacagggcatgcacgaactgttagcacctatagtctttgtccttcactgtgaccaccaagcttttctacatgccagtgagtctgcacagcccagtgaggaaatgaaaactgtcttgaaccctgagtatctggaacatgatgcctatgcagtgttctcacaacttatggaaactgctgaaccttggttttcaacttttgagcatgatggtcagaaggggaaagaaacactgatgactcccattccctttgctagaccacaagatttagggccaacaattgctattgttactaaagtcaaccagatccaggatcatctactgaagaagcatgatattgagctttacatgcacttgaacagactagaaattgcaccacagatatatgggttaaggtgggtgcggctgctatttggacgagagttccccctgcaggaccttctggtggtctgggatgccttgtttgcagacggcctcagcctgggtttagtagattatatcttcgtagccatgttactttacatccgagatgctttgatctctagtaactaccagacctgtctcggccttctgatgcattacccattcatcggggatgtacactcactgattcttaaggctctgttccttagagatccaaagagaaatccaagaccagtgacttatcaattccatccaaatttagattattacaaagcacgaggagcagacctcatgaataaaagccggaccaatgccaaaggtgctcccctgaatataaataaggtctctaatagcctgattaattttggaagaaagttgatttccccagcaatggctccaggcagtgcaggtggccctgtacctggaggcaacagcagtagctcctcctctgttgtaattcctaccaggacctcagcagaggccccaagccatcacttgcaacagcaacagcagcagcagaggctgatgaaatcagaaagcatgcctgtgcaattgaacaaagggctaagttctaaaaacatcagttcatctccaagcgttgagagtttgcctggaggaagagaattcactggctctccaccttcatctgctactaaaaaagattccttttttagcaacatctcacgttctcgctcacacagcaaaactatgggcagaaaagaatctgaagaagaattagaagcccaaatttccttccttcaagggcagttgaatgacctggatgccatgtgcaaatactgtgcaaaggtgatggacactcatcttgtaaatattcaagatgtgatattacaagaaaatttggaaaaagaagatcaaattctggtttccctggcaggattaaaacagatcaaagacattctaaaaggttccctgcgttttaaccagagccagctagaggccgaagagaacgaacagatcaccattgcggacaaccactactgctccagcggccagggccagggccgaggccaaggccagagcgttcaaatgtcaggggccattaaacaggcctcttcagaaacgccagggtgcactgatagagggaattccgatgacttcatcctgatttccaaagatgatgatgggagcagtgccaggggctccttctccggccaggcccagcctcttcgcaccctcagaagcacctctgggaaaagccaggccccagtctgctccccactggtgttctcagatccactgatgggcccagcctcagcttcctccagcaaccccagctccagtcctgatgacgacagcagcaaggactctggcttcaccattgtgagtcccctggacatctgaccacagtgcccagtcctgccccacagggatctagccacccttcagtggccccaaggccagactgaggctcatccagtggagaaccttcttaaaccactgcttccttcccggcatgcattttgcattggtccagccctttgaaaccccttagagagaagcatatatggccacaaagcacagaggcttaggtttgccacatgcagacagggctttctgggcccttacctaatccccacccgactcttgctctgagttagagctgagttacgtacccagtatcacactcacagttagaaaagaccgaatcacaatttagaatcacttttcctctgtccccttctccccagctaagaatgtgtggcacctccatcagttatacttagaaggagcagaaatagttattttcgtatcttctatccctcaaagcatcagacatgggaaaattggtttataccaagaaagcttcctctgtggaaatctgtctcagcctactttattcctgcattgggaagccatatcgcagagctaaatgcaatagaatgaaccagaactagtggattccagggctgggggaaaaaaaaaaagaaaaaa

SEQ ID NO: 7511 - DNA, 578 bp, Homo sapiens
taagtggacaaggaaggagcttctaacagacttgtgtttggagaactctattgtactgagcctaagtcatttttgatctataacaagaacatgcattttcacatgtcaaccggatttgtggaccagtaaagttctcccacaagaaatcttctatgatattgtctcagggaccacctgcagcaggagcccacaaattgaataaatgcaacataaggagaggattttttttttctgttgttgcttgtttcaaaaatgctactatccagattctctattaaggtagttacttttggtgacgctgtccagttcccacaatgtatcattccttatctgaaactagacatcctctgcagccagaagaacaagaagtaggcattgaccccttgtccagttactctaacaagtctggaggagattcaaataaaaatggaagaagaacaagttctactttagactctgaagggacttttaattcctataggaaagaatgggaagaactatttgtaaacaacaattacttggcaacaataaggcagaaggggattaatgggcagctgagaagcagcaggttccgcagc

SEQ ID NO: 7512 - DNA, 3627 bp, Homo sapiens
atgtggctcaagcccgaggaggtgctgctgaagaacgcgctgaagctctgggtgacccagaagagcagctgctacttcatcctgcagcggcgccgcgggcacggcgaggggggcggccgcctcaccggtcgcctggtcggcgctctggatgcagtgttggattccaatgcacgggtcgctccatttcgaattctgcttcaagttcccggctcccaggtttattctcccatagcatgtggtgcaacattagaggaaatcaatcagcactgggactggctggaacaaaatctcctccacaccttgtctgtctttgataataaagatgacattgccagttttgtcaaagggaaggtaaaggctctgatagccgaggagaccagcagcaggctcgccgagcaggaggaggaacccgagaaattccgagaagccctggtgaagttcgaggccaggttcaacttccccgaggcggagaagctggtcacctactactcctgctgctgttggaagggcagggtgccccgccagggctggctgtacctcagcatcaaccacctctgcttctactccttcttcctgggcaaggaacttaaacttgtggttccgtgggttgatatccagaaattagaaagaacgtccaatgtctttctgacggataccatccgaatcaccacgcagaataaggagcgtgacttctccatgttcctgaacctggatgaggtgtttaaggtcatggagcagctggccgacgtgacgctgcgaaggctgctggataatgaggtctttgacctcgaccccgatctgcaggagccgagccagatcaccaagagggacctggaagccagagcacagaatgagttcttccgggctttcttcaggttgccgaggaaggagaagctgcacgcggttgtggactgttcgctctggacgccgttcagtcgctgtcacaccacggggcggatgttcgcctctgacagctacatctgctttgccagcagagaagatggctgctgtaagatcatcctgccactcagagaggtggtgagcatcgagaagatggaggacacgagcctgctgccgcatcccatcattgtcagtatcagaagcaaggtggccttccagttcattgagctccgggaccgagacagcctggtggaggcgctgcttgcgaggttgaagcaggtccacgccaaccaccccgtgcactacgacacctctgcggatgatgacatggcttcactcgtgtttcattcaacaagcatgtgcagtgaccacagatttggggatcttgaaatgatgtcttctcaaaatagcgaggagagtgagaaagagaagagcccgctgatgcaccccgatgccctggtcaccgccttccagcagtcaggcagccagagccctgactcccgaatgtccagagaacagataaaaataagcctgtggaatgaccactttgtggaatacggcagaaccgtgtgtatgtttcgcacagagaagattcggaagctcgtagccatgggcatccctgaatctttgcgagggagactctggcttctcttctcagatgcggtgacggatcttgcctcacaccctggttactacgggaatctggtggaggagtccctggggaaatgctgcctggtaaccgaggagatagaacgagacctgcaccgctccctgccagagcaccccgccttccagaacgaaacgggaattgctgctttgaggagagtcttgacggcctatgcccaccggaaccccaagattggatactgccagtccatgaacatcctgacctccgtgctgctgctgtacaccaaggaggaggaagccttctggctgttggttgctgtgtgtgagcggatgctgcccgattacttcaaccaccgagtgatcggggcacaagttgaccagtctgtcttcgaggagctcatcaagggtcatctcccagagctggcagagcacatgaacgacctctcagccctggcgtccgtctctctctcgtggttcctgaccctgttcctcagcatcatgcctctagagagtgcggtgaatgtggtagactgcttcttctatgatggcatcaaagccatcttccagctgggactggctgtgcttgaggccaatgctgaggacctgtgcagcagcaaggatgatggccaggccttgatgatcctcagcaggtttctagatcacattaagaatgaggacagcccagggcccccagttggcagccaccatgcctttttctccgacgaccaggagccctaccctgtgactgatatttcggacctgatccgggattcctatgagaaatttggagaccagtctgtggagcagatcgagcacctacgttacaagcacaggatcagggtcctccaaggccacgaggacaccacaaagcagaacgtgcttcgagtcgttatcccggaagtctcaattcttcctgaagacctagaggagctctacgacttattcaagagagaacatatgatgagctgttactgggagcagcccaggcccatggcctcacgccacgaccccagccggccctatgctgagcagtaccgcatagatgcccggcagtttgcacacctgtttcagctagtctcgccctggacctgcggggcccacacggagatcctcgccgaaaggacgttcaggctcttggatgacaacatggaccagctcatcgagttcaaagcgtttgtgagctgcctcgatattatgtataatggagaaatgaatgagaagattaaactattatacaggcttcatatccctccagcactcactgaaaatgaccgagacagccagtcgccgttgaggaatcctctgttgtcaacatcgagacccctggttttcgggaaacccaatggtgatgcagttgattatcagaaacagctgaagcagatgattaaggatttagccaaagaaaaagataaaactgagaaagaattgcccaaaatgagccagagagaatttatccagttctgtaaaactctgtacagtatgttccatgaagatccagaagaaaatgatttgtatcaagccatcgccacagtcaccacactgctgctgcagatcggggaggtggggcagcgaggcagcagctctggaagctgctcccaggagtgtggggaggagctgcgggcttcagctccttctcctgaggactcggtttttgcagacactgggaagacgccccaggactcccaggcatttccagaggcggcagaaagggactggactgtctcccttgaacatattttagcttcacttctgactgaacagtcattagtcaacttttttgaaaagccactggacatgaaatccaaacttgaaaatgccaagatcaatcagtacaatctcaaaacttttgaaatgagccaccaatcacaatctgaacttaagctgagtaacttgtagcaagacagcagctgctatgcacactggagtccaccataccaaagcacgaaccagactgtttcttggggtcagccctaaaccgagatttcagtctaccttaccaatggggcatctggctaaacaacctgacaaactgtggccaggggaaccgacacaaccctcaagcatttctatgtattgagaattgtcagtgccctaaggtat

SEQ ID NO: 7513 - DNA, 3803 bp, Homo sapiens
tcagagcgctgggcaccggccgggctgtggtccccgcgcgccgccgtcgcctctcgagcgggctcggctcacagcgaccggcggccggggagatgtgagctggggccggcgggcgcggccggaccgccgcgatgtggctcaagcccgaggaggtgctgctgaagaacgcgctgaagctctgggtgacccagaagagcagctgctacttcatcctgcagcggcgccgcgggcacggcgaggggggcggccgcctcaccggtcgcctggtcggcgctctggatgcagtgttggattccaatgcacgggtcgctccatttcgaattctgcttcaagttcccggctcccaggtttattctcccatagcatgtggtgagttactgaatggatcagacgtttactgggccatagccactggtgcaacattagaggaaatcaatcagcactgggactggctggaacaaaatctcctccacaccttgtctgtctttgataataaagatgacattgccagttttgtcaaagggaaggtaaaggctctgatagccgaggagaccagcagcaggctcgccgagcaggaggaggaacccgagaaattccgagaagccctggtgaagttcgaggccaggttcaacttccccgaggcggagaagctggtcacctactactcctgctgctgttggaagggcagggtgccccgccagggctggctgtacctcagcatcaaccacctctgcttctactccttcttcctgggcaaggaacttaaacttgtggttccgtgggttgatatccagaaattagaaagaacgtccaatgtctttctgacggataccatccgaatcaccacgcagaataaggagcgtgacttctccatgttcctgaacctggatgaggtgtttaaggtcatggagcagctggccgacgtgacgctgcgaaggctgctggataatgaggtctttgacctcgaccccgatctgcaggagccgagccagatcaccaagagggacctggaagccagagcacagaatgagttcttccgggctttcttcaggttgccgaggaaggagaagctgcacgcggttgtggactgttcgctctggacgccgttcagtcgctgtcacaccacggggcggatgttcgcctctgacagctacatctgctttgccagcagagaagatggctgctgtaagatcatcctgccactcagagaggtggtgagcatcgagaagatggaggacacgagcctgctgccgcatcccatcattgtcagtatcagaagcaaggtggccttccagttcattgagctccgggaccgagacagcctggtggaggcgctgcttgcgaggttgaagcaggtccacgccaaccaccccgtgcactacgacacctctgcggatgatgacatggcttcactcgtgtttcattcaacaagcatgtgcagtgaccacagatttggggatcttgaaatgatgtcttctcaaaatagcgaggagagtgagaaagagaagagcccgctgatgcaccccgatgccctggtcaccgccttccagcagtcaggcagccagagccctgactcccgaatgtccagagaacagataaaaataagcctgtggaatgaccactttgtggaatacggcagaaccgtgtgtatgtttcgcacagagaagattcggaagctcgtagccatgggcatccctgaatctttgcgagggagactctggcttctcttctcagatgcggtgacggatcttgcctcacaccctggttactacgggaatctggtggaggagtccctggggaaatgctgcctggtaaccgaggagatagaacgagacctgcaccgctccctgccagagcaccccgccttccagaacgaaacgggaattgctgctttgaggagagtcttgacggcctatgcccaccggaaccccaagattggatactgccagtccatgaacatcctgacctccgtgctgctgctgtacaccaaggaggaggaagccttctggctgttggttgctgtgtgtgagcggatgctgcccgattacttcaaccaccgagtgatcggggcacaagttgaccagtctgtcttcgaggagctcatcaagggtcatctcccagagctggcagagcacatgaacgacctctcagccctggcgtccgtctctctctcgtggttcctgaccctgttcctcagcatcatgcctctagagagtgcggtgaatgtggtagactgcttcttctatgatggcatcaaagccatcttccagctgggactggctgtgcttgaggccaatgctgaggacctgtgcagcagcaaggatgatggccaggccttgatgatcctcagcaggtttctagatcacattaagaatgaggacagcccagggcccccagttggcagccaccatgcctttttctccgacgaccaggagccctaccctgtgactgatatttcggacctgatccgggattcctatgagaaatttggagaccagtctgtggagcagatcgagcacctacgttacaagcacaggatcagggtcctccaaggccacgaggacaccacaaagcagaacgtgcttcgagtcgttatcccggaagtctcaattcttcctgaagacctagaggagctctacgacttattcaagagagaacatatgatgagctgttactgggagcagcccaggcccatggcctcacgccacgaccccagccggccctatgctgagcagtaccgcatagatgcccggcagtttgcacacctgtttcagctagtctcgccctggacctgcggggcccacacggagatcctcgccgaaaggacgttcaggctcttggatgacaacatggaccagctcatcgagttcaaagcgtttgtgagctgcctcgatattatgtataatggagaaatgaatgagaagattaaactattatacaggcttcatatccctccagcactcactgaaaatgaccgagacagccagtcgccgttgaggaatcctctgttgtcaacatcgagacccctggttttcgggaaacccaatggtgatgcagttgattatcagaaacagctgaagcagatgattaaggatttagccaaagaaaaagataaaactgagaaagaattgcccaaaatgagccagagagaatttatccagttctgtaaaactctgtacagtatgttccatgaagatccagaagaaaatgatttgtatcaagccatcgccacagtcaccacactgctgctgcagatcggggaggtggggcagcgaggcagcagctctggaagctgctcccaggagtgtggggaggagctgcgggcttcagctccttctcctgaggactcggtttttgcagacactgggaagacgccccaggactcccaggcatttccagaggcggcagaaagggactggactgtctcccttgaacatattttagcttcacttctgactgaacagtcattagtcaacttttttgaaaagccactggacatgaaatccaaacttgaaaatgccaagatcaatcagtacaatctcaaaacttttgaaatgagccaccaatcacaatctgaacttaagctgagtaacttgtagcaagacagcagctgctatgcacactggagtccaccataccaaagcacgaaccagactgtttcttggggtcagccctaaaccgagatttcagtctaccttaccaatggggcatctggctaaacaacctgacaaactgtggccaggggaaccgacacaaccctcaagcatttctatgtattgagaattgtcagtgccctaaggtat

SEQ ID NO: 7514 - DNA, 2589 bp, Homo sapiens
acgtgggagagaagggagggttgggggaagtgtggaaaacctgaacctgagctgctgtcgcctgaggaagatttggtgggaggagaagcagaggggaagagacgggttgagagtgaggtgaggagggcatctaggtcactgctcccggggggcacaaagttcgcgatgtggctgaagcctgaggaagtgcttctgaaaaatgcgctgaagctgtggctgatggaaaggtccaacgactacttcgtgctgcagcggcgtcggggctacggggaggaaggcggaggggggctcacagggcttctggttgggactcttgattcagtcttggactctactgctaaagtagctccatttcgcatcctacaccagacaccagattctcaagtttacttgtcaattgcatgtggagccaacagagaagaaataaccaagcattgggattggttggaacaaaatattatgaagaccttatctgtatttgattcaaatgaagatattactaattttgtacaaggaaaaataagaggattaattgctgaagagggaaaacattgttttgcaaaagaagatgatcctgagaaatttcgagaagcccttttgaaatttgaaaaatgttttggtttaccagagaaggagaagttagtgacctattattcatgcagttattggaaaggacgggttccttgtcagggttggctttatcttagcaccaactttctgagcttctattcttttttgttgggatcagaaataaaactcattatctcctgggatgaagtctcaaaacttgaaaagacttcaaatgtcatactgacagagagtattcacgtgtgttcccaaggagagaatcactacttttcaatgtttttgcacattaaccaaacataccttcttatggaacagctggcaaactatgccattagaagactttttgataaggaaacatttgataatgacccagtcctttataatcctctacagatcaccaaaagaggtctggaaaatagagcccacagtgagcaatttaatgccttttttaggctgcccaaaggagagagtttgaaagaagtacatgaatgtttcttatgggtaccattcagccacttcaatactcatgggaaaatgtgcatctcagaaaattatatctgctttgctagccaagatggcaatcagtgtagtgtaatcattccactacgagaggtcttagctatagataagacaaatgattccagcaaatctgtcatcattagcatcaaaggaaaaacagcttttcgcttccatgaagttaaagactttgaacaactggtagcaaaactcaggctcagatgcggagcagcttcaactcaatatcatgatattagcacagagcttgctattagttctgagtctacagagccatctgataattttgaggtgcaatctttgacaagtcagagggaatgcagtaaaactgtgaacactgaagccttaatgacagtatttcaccctcagaatttggagactcttaattctaaaatgttgaaagaaaaaatgaaggaacagtcatggaaaatactgtttgcagaatgtggacgtggtgttagtatgtttcgaaccaaaaagactcgagatcttgttgtaagagggattccagaaacattaagaggagaactctggatgcttttttcaggtgctgttaatgacatggctactaatcctgactattatactgaagtggttgagcagtccttagggacctgcaacttggctactgaagaaattgaacgtgatttacgtcgctctctgcctgagcacccagcctttcagagtgatactggcatatctgctctgagaagggtactcacagcttatgcatacaggaatcccaaaattggatactgccaggcaatgaatattttgacttcagtgctgcttctatatgcaaaagaggaagaagctttttggcttctggttgctgtatgtgaacgaatgttgcctgattattttaatcgtcgaattattggttcagatgattttatgccactagtaagaatccaaggacaatgtgttattggggagaagtagaaaaaggaaaatctggggtagcacctggcatgctctttctccaattttctactacttactcctattccccaaattctcccatcaaggaggaaatgaactctgagacagaagatgagttttcctcaaagcttgaccaggatataagtggatgccttattgggcaaagcagagggtaaccaattagaaggccctggcttctcttgattgatagctgagaactcatcagagggatcagtgctttctctgtgtattgctggagtctgaaagtgtgactctcatgtcactgattcatttctgaagtgttaaattcagaataaatttttgataatcaaaatgaacttagagaactttgttgtttggcattgtcaagagtgaagaattctaattatttgtgtatttatcttgtgttatgctagatattaaactccctgaacatgagactatttcattaattggtatagctcttataatacctagtacaggtctctgcatataataaagactcaataaataactcttcaaatg

SEQ ID NO: 7515 - DNA, 5717 bp, Homo sapiens
tctctgcctacgtgggagagaagggagggttgggggaagtgtggaaaacctgaacctgagctgctgtcgcctgaggaagatttggtgggaggagaagcagaggggaagagacgggttgagagtgaggtgaggagggcatctaggtcactgctcccggggggcacaaagttcgcgatgtggctgaagcctgaggaagtgcttctgaaaaatgcgctgaagctgtggctgatggaaaggtccaacgactacttcgtgctgcagcggcgtcggggctacggggaggaaggcggaggggggctcacagggcttctggttgggactcttgattcagtcttggactctactgctaaagtagctccatttcgcatcctacaccagacaccagattctcaagtttacttgtcaattgcatgtggagccaacagagaagaaataaccaagcattgggattggttggaacaaaatattatgaagaccttatctgtatttgattcaaatgaagatattactaattttgtacaaggaaaaataagaggattaattgctgaagagggaaaacattgttttgcaaaagaagatgatcctgagaaatttcgagaagcccttttgaaatttgaaaaatgttttggtttaccagagaaggagaagttagtgacctattattcatgcagttattggaaaggacgggttccttgtcagggttggctttatcttagcaccaactttctgagcttctattcttttttgttgggatcagaaataaaactcattatctcctgggatgaagtctcaaaacttgaaaagacttcaaatgtcatactgacagagagtattcacgtgtgttcccaaggagagaatcactacttttcaatgtttttgcacattaaccaaacataccttcttatggaacagctggcaaactatgccattagaagactttttgataaggaaacatttgataatgacccagtcctttataatcctctacagatcaccaaaagaggtctggaaaatagagcccacagtgagcaatttaatgccttttttaggctgcccaaaggagagagtttgaaagaagtacatgaatgtttcttatgggtaccattcagccacttcaatactcatgggaaaatgtgcatctcagaaaattatatctgctttgctagccaagatggcaatcagtgtagtgtaatcattccactacgagaggtcttagctatagataagacaaatgattccagcaaatctgtcatcattagcatcaaaggaaaaacagcttttcgcttccatgaagttaaagactttgaacaactggtagcaaaactcaggctcagatgcggagcagcttcaactcaatatcatgatattagcacagagcttgctattagttctgagtctacagagccatctgataattttgaggtgcaatctttgacaagtcagagggaatgcagtaaaactgtgaacactgaagccttaatgacagtatttcaccctcagaatttggagactcttaattctaaaatgttgaaagaaaaaatgaaggaacagtcatggaaaatactgtttgcagaatgtggacgtggtgttagtatgtttcgaaccaaaaagactcgagatcttgttgtaagagggattccagaaacattaagaggagaactctggatgcttttttcaggtgctgttaatgacatggctactaatcctgactattatactgaagtggttgagcagtccttagggacctgcaacttggctactgaagaaattgaacgtgatttacgtcgctctctgcctgagcacccagcctttcagagtgatactggcatatctgctctgagaagggtactcacagcttatgcatacaggaatcccaaaattggatactgccaggcaatgaatattttgacttcagtgctgcttctatatgcaaaagaggaagaagctttttggcttctggttgctgtatgtgaacgaatgttgcctgattattttaatcgtcgaattattggtgccttggtggatcaggcagtctttgaagaacttatcagggatcaccttcctcagctgacagaacacatgactgatatgacattcttttcctcagtttctctctcttggtttctcacactttttattagtgtgctacctattgaaagtgcagtgaatgtggtggactgtttcttctatgatggaataaaggccattttgcaactgggattggcaatacttgactataatttagacaaactgctgacttgtaaagatgatgctgaagctgtgacagccttaaacaggttctttgacaatgtcactaataaggatagtccattgccttcaaatgttcagcaaggttcaaatgtgagtgatgaaaaaaccagtcatactagagtggatattacagatttgattagagaatcaaatgagaaatatggtaatattcgctatgaagatatacatagtatgcgctgtcgaaataggttgtatgtgatacagaccctagaggaaacaacaaaacagaatgtgttgcgtgttgtatcacaagatgtgaaattgagccttcaagaattggatgaactttatgtcatctttaagaaagagctgtttttatcttgttattggtgtttgggttgcccagtattgaagcatcatgaccccagtctgccatatttggaacagtatcagattgactgccagcagttcagagcgttgtatcacttgttgagtccctgggctcattctgcaaataaagactcactagctttatggacattcagattgttagatgaaaactctgattgccttataaacttcaaagaattctcctctgcaattgacataatgtacaatggaagttttactgagaagcttaagctgctttttaagctacatattcctccagcttacactgaagtgaaatctaaggatgcttcaaaaggagatgaactttccaaggaagaattactttatttcagtcagctgcatgtttccaagcctgcaaatgagaaggaagcagaatcagcaaaacacagccctgaaaaaggcaaagggaaaattgatattcaagcatatctaagtcaatggcaagatgagcttttcaaaaaagaagaaaacattaaggatttaccaagaatgaatcagtctcagtttattcagttttcaaagaccctctataacttatttcatgaggaccctgaagaagaatcattatatcaagccattgctgttgtaaccagccttttactcaggatggaagaagttggaaggaaactacatagccctacatcatcagccaaaggattctctggtactgtctgtggttctggaggacccagtgaggaaaaaacagggagccacttggagaaagatccttgttcctttagggaggaacctcagtggtcatttgcatttgaacagattcttgcatcgctgttgaatgaaccagcattggtgaggttttttgagaaacccatagatgtaaaagccaagctggaaaatgcaagaatttctcagttaaggtctagaaccaagatgtaaatccctaggaattgcctatcatagacaagtttactaacattcctgtagctgtcagtttgattcctgtgagtagggctcagggatttatcttgttaccaatgtgtctgaaggccaaaatatatatccagaagcacaatgcatcattcctttgttgttgataatgggctttgttagcactttttaaaacaaacaaacaaacaaaacaaaaaagcaaaccacatttgttatctcaaattttgatgatattctcaaatacaaatatacttttttatatttcacaatatatgcaatatcaggggaatatgctaaatgttaccaccagagggcacaagcatatcacttttagtaaggaaattactagcttgtgttgctatttacatatgaattactgattattttgaaaagacggtgttatgcttgggtgttagtgaggctgatatgtcatgtcaatcgataaaccctactttccaaattatctaaaagattaccatttggggcccttgttttcaagttatctaactgaaatattattaatttttttaagttaatctcattcagtcttctagtaataaatgcttttttaagtaccttctacagtcttcctacctgaggggttcagaggctgctgactcacactgctaactctgttactgacaaaagcaaatcaataactctaaattctgggctgatataaagaaaaaaacaatattggatttggatttaatctgggtaaaatcagccttctgagaagggctaagaaacagttcaattaactgtataggtctttcattagaccgagacatcactagaaattctgggcactgctgtttgtggtatttgtctcagagtagcttatgactgttttggttctagctttagattttggattttcaccagtcatgtgttaatttacattagatagtaaagaatggctacactaagactgaattatcttattagtctggcaagcatataaagtatacttgtatgtaatgattgccaaggtaacagaattgctgacatctgtctaaaaagttttgactatccaatttagatgtgtaatttctatatactttatgctgtttatatttcagtcattacaccaagtccatttagagataatgggctttgttagcactttcaaaaaaaaaaaaagcaaaccatacttgtccactgtcctgtgctattcctaccaaggacaatttattaatcaattgacttagaaaatagggggagaaatcattcattggagcttctttctttagaaaagactttggttataagccttttgacttttctagatgtgaaaccatgaaagggcagacctccttcagagtgactcaagaggtctccctttcttggagggagttggtacagtcagcctttgggaagaatccactgtgaacaaagcttaacacatggggcttcatcgctcatagaatatgttattttcaaagaagttcaagaattttcaagttgagcctttgaaaatcccataaattggttttagctaaacacttactagtagtgtctttaaattatttaatcaaccttgtcttttcaaggaaattaccacttaaagagatagttggtaaataaacatctatgccttttctcagaaatgatttgctgaactatgtccatattttacagcttagataatagtttatatggaaactattatacatctgctattgtgcaatgattgttaaattatactgaagtagctctagaaagacacatgtatacaaggcactattgtacacactttgctgaatattttgtcagttgtatttacaaagaaaggtactttcttaagagcatatatgttattaatatttgatatgattttaaagtcagaatagtacagattgctgagtattatactttaggctagattaattaaaattgaatactgaaagagattttttgagttgcaaaaagtttataaatgcaaagcaaaaagaaaacatttattttctgagtctgcaggagaaacaaactaaacattatagttttatagctgctatcttgttaaccaaacaggttgttcataatattaaaaatcttacgtagttgtgttaaactgaaccagttcattataccttatgcattaaattaaatatgttataaggtggctttacttgtctttataaaaataaatatatctactaaacatg

SEQ ID NO: 7516 - DNA, 2291 bp, Homo sapiens
ttcaataggttctttgacaatgtcactaataaggatagtccattgccttcaaatgttcagcaaggttcaaatgtgagtgatgaaaaaaccagtcatactagagtggatattacagatttgattagagaatcaaatgagttgcgtgttgtatcacaagatgtgaaattgagccttcaagaattggatgaactttatgtcatctttaagaaagagctgtttttatcttgttattggtgtttgggttgcccagtattgaagcatcatgaccccagtctgccatatttggaacagtatcagattgactgccagcagttcagagcgttgtatcacttgttgagtccctgggctcattctgcaaataaagactcactagctttatggacattcagattgttagatgaaaactctgattgccttataaacttcaaagaattctcctctgcaattgacataatgtacaatggaagttttactgagaagcttaagctgctttttaagctacatattcctccagcttacactgaagtgaaatctaaggatgcttcaaaaggagatgaactttccaaggaagaattactttatttcagtcagctgcatgtttccaagcctgcaaatgagaaggaagcagaatcagcaaaacacagccctgaaaaaggcaaagggaaaattgatattcaagcatatctaagtcaatggcaagatgagcttttcaaaaaagaagaaaacattaaggatttaccaagaatgaatcagtctcagtttattcagttttcaaagaccctctataacttatttcatgaggaccctgaagaagaatcattatatcaagccattgctgttgtaaccagccttttactcaggatggaagaagttggaaggaaactacatagccctacatcatcagccaaaggattctctggtactgtctgtggttctggaggacccagtgaggaaaaaacagggagccacttggagaaagatccttgttcctttagggaggaacctcagtggtcatttgcatttgaacagattcttgcatcgctgttgaatgaaccagcattggtgaggttttttgagaaacccatagatgtaaaagccaagctggaaaatgcaagaatttctcagttaaggtctagaaccaagatgtaaatccctaggaattgcctatcatagacaagtttactaacattcctgtagctgtcagtttgattcctgtgagtagggctcagggatttatcttgttaccaatgtgtctgaaggccaaaatatatatccagaagcacaatgcatcattcctttgttgttgataatgggctttgttagcactttttaaaacaaacaaacaaacaaaacaaaaaagcaaaccacatttgttatctcaaattttgatgatattctcaaatacaaatatacttttttatatttcacaatatatgcaatatcaggggaatatgctaaatgttaccaccagagggcacaagcatatcacttttagtaaggaaattactagcttgtgttgctatttacatatgaattactgattattttgaaaagacggtgttatgcttgggtgttagtgaggctgatatgtcatgtcaatcgataaaccctactttccaaattatctaaaagattaccatttggggcccttgttttcaagttatctaactgaaatattattaatttttttaagttaatctcattcagtcttctagtaataaatgcttttttaagtaccttctacagtcttcctacctgaggggttcagaggctgctgactcacactgctaactctgttactgacaaaagcaaatcaataactctaaattctgggctgatataaagaaaaaaacaatattggatttggatttaatctgggtaaaatcagccttctgagaagggctaagaaacagttcaattaactgtataggtctttcattagaccgagacatcactagaaattctgggcactgctgtttgtggtatttgtctcagagtagcttatgactgttttggttctagctttagattttggattttcaccagtcatgtgttaatttacattagatagtaaagaatggctacactaagactgaattatcttattagtctggcaagcatataaagtatacttgtatgtaatgattgccaaggtaacagaattgctgacatctgtctaaaaagttttgactatccaatttagatgtgtaatttctatatactttatgctgtttatatttcagtcattacaccaagtccatttagagataatgggctttgttagcactttc

SEQ ID NO: 7517 - DNA, 5306 bp, Homo sapiens
gcgcgcctgtcgcggtggtgggtgcaggactggacccacgggcccattgtgcgcccgcccgcggcagccaggaccatgtgggtgaacccggaggaggtgttgctggccaacgcgctgtggatcaccgagagggccaacccatacttcatcctgcagcggaggaagggccacgccggcgatggaggcggcggcggcggactggcgggcctgctggtgggtacccttgatgttgtgttggactccagcgcccgggtcgctccttaccgaatcttgtaccagactccagactccctggtctactggaccatcgcctgtggtggttccaggaaagaaatcactgaacactgggaatggcttgagcaaaatctcttgcagacactctccatctttgaaaatgagaatgatatcaccacatttgtgagaggaaaaatacagggcatcattgcagaatacaacaaaatcaatgatgtaaaggaagatgatgacacggagaagtttaaagaagccattgtgaaatttcataggctgtttgggatgccagaggaagagaaactcgtcaactattactcttgcagctattggaaggggaaggtcccccgtcagggttggatgtacctcagcattaaccacctttgcttttattcttttcttatgggaagggaagcgaaactggtcatccggtgggtagacatcactcagcttgagaagaatgccaccctgcttctgcctgatgtgatcaaagtgagcacacggtccagtgagcatttcttctctgtattcctcaacatcaacgagaccttcaagttaatggagcagcttgccaacatagccatgaggcaactcttagacaatgagggatttgaacaagatcgatccctgcccaaactcaaaaggaaatctcctaaaaaagtgtctgctctaaaacgtgatcttgatgccagggcaaagagtgagagataccgtgcacttttccggctgcccaaagatgaaaaattagatggccacacagactgcactctctggactccatttaacaaaatgcacattttggggcagatgtttgtgtccacaaattacatctgttttaccagcaaggaggagaacttatgtagcctcattatcccgctccgtgaggtgacaattgtggaaaaggcagacagctccagtgtgctccccagtcccttatccatcagcacccgaaacaggatgaccttcctatttgccaacttgaaagatagagactttctagtgcagaggatctcagatttcctgcaacagactacttccaaaatatattctgacaaggagtttgcaggaagttacaacagttcagatgatgaggtgtactctcgacccagcagcctcgtctcctccagcccccagagaagcacgagctctgatgctgatggagagcgccagtttaacctaaatggcaacagcgtccccacagccacacagaccctgatgaccatgtatcggcggcggtctcccgaggagttcaacccgaaattggccaaagagtttctgaaagagcaagcctggaagattcactttgctgagtatgggcaagggatctgcatgtaccgcacagagaaaacgcgggagctggtgttgaagggcatcccggagagcatgcgtggggagctctggctgctgctgtcaggtgccatcaatgagaaggccacacatcctgggtactatgaagacctagtggagaagtccatggggaagtataatctcgccacggaggagattgagagggatttacaccgctcccttccagaacacccagcttttcagaatgaaatgggcattgctgcactaaggagagtcttaacagcttatgcttttcgaaatcccaacatagggtattgccaggccatgaatattgtcacttcagtgctgctgctttatgccaaagaggaggaagctttctggctgcttgtggctttgtgtgagcgcatgctcccagattactacaacaccagagttgtgggtgcactggtggaccaaggtgtctttgaggagctagcacgagactacgtcccacagctgtacgactgcatgcaagacctgggcgtgatttccaccatctccctgtcttggttcctcacactatttctcagtgtgatgccttttgagagtgcagttgtggttgttgactgtttcttctatgaaggaattaaagtgatattccagttggccctagctgtgctggatgcaaatgtggacaaactgttgaactgcaaggatgatggggaggccatgaccgttttgggaaggtatttagacagtgtgaccaataaagacagcacactgcctcccattcctcacctccactccttgctcagcgatgatgtggaaccttaccctgaggtagacatctttagactcatcagaacttcctacgagaaattcggaactatccgggcagatttgattgaacagatgagattcaaacagagactgaaagtgatccagacgctggaggatactacgaaacgcaacgtggtacgaaccattgtgacagaaacttcctttaccattgatgagctggaagaactttatgctcttttcaaggcagaacatctcaccagctgctactggggcgggagcagcaacgcgctggaccggcatgaccccagcctgccctacctggaacagtatcgcattgacttcgagcagttcaagggaatgtttgctcttctctttccttgggcatgtggaactcactctgacgttctggcctcccgcttgttccagttattagatgaaaatggagactctttgattaacttccgggagtttgtctctgggctaagtgctgcatgccatggggacctcacagagaagctcaaactcctgtacaaaatgcacgtcttgcctgagccatcctctgatcaagatgaaccagattctgcttttgaagcaactcagtacttctttgaagatattaccccagaatgtacacatgttgttggattggatagcagaagcaaacagggtgcagatgatggctttgttacggtgagcctaaagccagacaaagggaagagagcaaattcccaagaaaatcgtaattatttgagactgtggactccagaaaataaatctaagtcaaagaatgcaaaggatttacccaaattaaatcaggggcagttcattgaactgtgtaagacaatgtataacatgttcagcgaagaccccaatgagcaggagctgtaccacgccacggcagcagtgaccagcctcctgctggagattggggaggtcggcaagttgttcgtggcccagcctgcaaaggagggcgggagcggaggcagtgggccgtcctgccaccagggcatcccaggcgtgctcttccccaagaaagggccaggccagccttacgtggtggagtctgttgagcccctgccggccagcctggcccccgacagcgaggaacactcccttggaggacaaatggaggacatcaagctggaggactcctcgccccgggacaacggggcctgctcctccatgctgatctctgacgacgacaccaaggacgacagctccatgtcctcatactcggtgctgagtgccggctcccacgaggaggacaagctgcactgcgaggacatcggagaggacacggtcctggtgcggagcggccagggcacggcggcactgccccggagcaccagcctggaccgggactgggccatcaccttcgagcagttcctggcctccctcttaactgagcctgccctggtcaagtactttgacaagcccgtgtgcatgatggccaggattaccagtgcaaaaaacatccggatgatgggcaagcccctcacctcggccagtgactatgaaatctcggccatgtccggctgacacgggcgccttcccgggggagtgggaggagagggaggggagggattttttatgttcttctgtgttgagttttttctttctttcttttaaattaaatatttattagtacctggcttgaagcctagtgttttcataatgtaattcaatgaaaactgttggagaaatatttaaacacctcaatgtaggtacattacactcttgttgcggggaggggatttaccagaatacagtttatttcgtgaattctaaaaaacaaaaagatgaatctgtcagtgatatgtgtgtattataacttattaatcttgctgttgagctgtatacatggtttaaaaaatagtactgtttaatgctaagtaaggcagcagtcatttgtgtattcaggctttttaaataaaattagagctgtaaggaaaatgaaaagccacaaatgcaagactgttcttaaatggaaggcatagtcagcgagggtaaatcctataccactttaggaagtattaaaaatatttttaagatttgaaatatatttcatagaagtcctctattcaaaatcatattccacagatgttccccttcaaagggaaaacatttggggttctaaacagttatgaaagtaagtgatttttacatgattccagaataacacttgtattgaccaatttagacagataccagaccaattttgcatttaagaaattgttctgattatttacgtcaactcattagaattcagtgaaaagtaacagtcttttgtcacagagaatctgaaagtagcagcaaagacagagggctcatgacaggtttttgcttttgctttgcttttgtttttgaaagagtaaaagtactgatgcttctgatactggatgtttagcttcttactgcaaaaacataagtaaaacagtcaactttaccatttccgtattctccatagattgaagaaatttataccacatatcgcatatgaccatctttccatcaaatcaatgtagagataatgtaaactgaaaaaaaatctgcaagataatgtaactgaatgttttaaaaacagaacttgtcactttatataaaagaatagtatgctctatttcctgaatggatgtggaaatgaaagctagcgcacctgcactttgaattcttgcttcttttttattactgttatgattttgctttttacagatgttggacgattttttcttctgattgttgaattcataatcatggtctcatttcctttgcttctttggaatatttctttcaacacattcctttattttattatacattgtgtcctttttttagctattgctgctgttgttttttattctatttacaggatgatttttaaactgtcaaatgaagtagtgttaacctcaaataggctaaatgtgaacaaataaaatacagcaaatactcagatacagctttttatcttt

SEQ ID NO: 7518 - DNA, 4132 bp, Homo sapiens
gagagaagtacacacgcaccccctcactgcctactcctgctttcgggagcctgagtcattcctgccccctcgtagggttccccatttcccggtgcgcgggcaccctgagacagccttgggaattcgttcgcgtccccttccacctgggtccccttccccagtttgcgccccgtaacactcagccaaggacttcctgtgggtcccaggtcaggggccaaggggtcctggaccgctgccacagccccggtgcgcccgggggaggcgcttccttttcctgaactctgggatcctgcgggaggaagtggggaagttgggcgggggtgcagccgagggcgtgccgactgtggaggggccgaccctcgcgcagctctgggccttccttggggaggagctggggtgccagaggcccaggctgaggagcttggcggcgaggtatttggggaagtaaggcctggggtggagaagcgcggaggaatgggccgggcccggctgggaaggcagccctctcccatccacaggtctccctgggttctggcaggagcctgcccctgctgccggcctggcttacttgtccctacttgtcaacaccctggcagcggggtcttcacctggttccagccccttttccccaaggcggcagagaggatggggctgaggagtctgggaaggggccatgggagtccctgctgagctcggggcaggaagtttctgggttgcatcttagccggccccagggagtgcagagccagggagaggggtaccagggacaaaccctagacagacggccctgtccacggttgctcctgctctcctaggaggccccgtgtgggccgcggcccggccctcaccatggagtccatgttcgaggacgacatcagcatcctgacgcaggaggccctggggcctagtgaggtgtggctggacagtcccggagacccctcgcttgggggcgacatgtgctccgcctcccactttgccctcatcactgcttacggagacatcaaggaacggctggggggcctggagagggagaacgccaccctccgacgccgcctcaaagtctacgagatcaagtacccactgatcagtgactttggagaggagcatggcttttctctgtatgaaatcaaggatggctccctgctggaggtggagaaggtcagcctgcagcaacggctcaaccagttccagcatgagttacagaagaacaaggagcaggaagaacagcttggagagatgatccaggcctacgagaaactctgcgtggagaagagtgacttggagacagagctgagggagatgagggccctggtggagacgcacctgcgtcagatctgtggtttggagcagcagctgcggcaacagcaaggcctccaggatgcagccttctccaacctgagcccaccgccagcccccgcccctccctgcactgatttagacctgcactacctggcactgagagggggatctggcttgagtcatgcaggctggccgggctccacacccagtgtgagtgacctggagcggcggcggctagaagaggctttggaggccgcgcagggagaggcccggggggctcagctccgggaggagcagctccaggccgagtgcgagcggctgcagggggagctgaagcagctgcaggagacccgggcccaggatctggcctccaaccagtcggagcgagacatggcgtgggtgaaaagagttggggatgatcaggtgaatttggcgctggcctacaccgagctgacggaggagctgggccggcttcgggagttgagttccctacaggggagaatcttgaggactctgttgcaggaacaggcccggagtggcggccagaggcactcgccgctgtcacaacgccactccccggccccccagtgcccctccccctccccgcctgcccgagcggctcccccgtgccccccgtgccagtcccccgtcccccagcgccgctctcccgtgcccccgtgcccctcgccgcagcagcgccgctctccggcctcaccctcctgcccgtcgcccgtcccgcagcgccgctcgccggtgccgccgtcgtgccagtcccccagcccgcagcgccgttccccggtgccccccagctgcccggccccgcagccccggccaccgccgccgcccccgccgggcgagaggacgctggccgagcgcgcctacgccaagccgcccagccaccacgtgaaggccggcttccagggccgccgcagctactctgagctggcggagggcgcggcctacgcgggcgcctccccgccctggctgcaggccgaagcggccactctccccaagccccgggcctacggcagcgagctctacggccctggcaggcccctcagcccgcggcgcgccttcgagggcatccggctgcgcttcgagaagcagccgtcggaggaggacgagtgggctgtgcccaccagcccgcccagcccggaggtgggcaccatccgctgcgcctccttctgcgcgggcttccccatccccgagtcgcccgccgccaccgcctacgcccacgccgagcacgcgcagtcctggccgtccatcaacttgctgatggagacggtgggctccgacatccgcagctgccccctctgccagctgggtttccctgtcgggtacccggatgatgccctcatcaaacacattgactcccacctggagaacagcaagatctagggcaccagccccacccactggctgtttctccgtcctctcctatcacccccaaacactcactttgaatgctgcatgaatctcgtggggggtccctgcccttgcgacccccagatacctccacttgctaccgagtcaacgtgtgtgccatcttccctggtccaggcaccactcagctctggctcttcctgggaggtcagccgaggctccccccatgctcctggtttctgcttaggaggtggggacttgggctgggatggggacggcatacccctcccaggcctctccctctgcctttctgttcttaatcagggttggatccaagaaggtgtccagtgcttgggcctggggtggggggaaggtgttagaggactccaggagctcctgcacccctccccaaatgtccatctttctcagacggggctctgtctggggagcacccacaggctgcctttggggtcccagagcctgctctgtgcactgaccccagttcctccatcctgtggccagcctagggctcatggcatgggcccccactgggggagggaggcatcttgtttcttgtggttccctgcaggccagtcctgtcctcctttccctgttctgcccactctggggaatagggaggggaggagaggagaggagagggaggatcctggaggactgggaagatctagcctaaagaggcttctctgagggccagggccctacagcatgcccctacggccaggggactgtctgccagcctcccaggcccatgccctcctggtgcccctggcactgaggcacagatcgtcaaggcaggtaccccctcaacccttcttccactggagcccctgacaccacaggtgccctggagcccttgtgtgactcagcctctgttagctgggtgggtgtcatcagcccctgcctcccaggccagaacctgagaacgggcccagggtgctgtggagatcaacttcaaaagagctaaccccttcccacactccacccacccacctacatttcctctgtgaaatctacctcagagttgtaccctcagaaggacgggtaagcaggaggccagggggtccccagggctgaggtggggagccttctacggcgaaagcctgccaccccacaatgaatccaccctgctccactgcgcgcctctcccaggtctcagctctgggtggggagcagtggccgctaccgacagcgcatgtcccgctcttatccaactcttccaggccccacctccctgcacccctcccctctatagagcaggggagtgaaggggtatgtcaggcggggaaggggccaaggacacgtcattgtaccctgagcgtccccagggagtggaaatggggaagggggcctggagaggggaggcaggggcccctgtgctctctgaacaagttgaaagtccaaataaaacttacctgttccatctgtgctc

SEQ ID NO: 7519 - DNA, 3005 bp, Homo sapiens
gagagaagtacacacgcaccccctcactgcctactcctgctttcgggagcctgagtcattcctgccccctcgtagggttccccatttcccggtgcgcgggcaccctgagacagccttgggaattcgttcgcgtccccttccacctgggtccccttccccagtttgcgccccgtaacactcagccaaggacttcctgtgggtcccaggtcaggggccaaggggtcctggaccgctgccacagccccggtgcgcccgggggaggcgcttccttttcctgaactctgggatcctgcgggaggaagtggggaagttgggcgggggtgcagccgagggcgtgccgactgtggaggggccgaccctcgcgcagctctgggccttccttggggaggagctggggtgccagaggcccaggctgaggagcttggcggcgaggtatttggggaagtaaggcctggggtggagaagcgcggaggaatgggccgggcccggctgggaaggcagccctctcccatccacaggtctccctgggttctggcaggagcctgcccctgctgccggcctggcttacttgtccctacttgtcaacaccctggcagcggggtcttcacctggttccagccccttttccccaaggcggcagagaggatggggctgaggagtctgggaaggggccatgggagtccctgctgagctcggggcaggaagtttctgggttgcatcttagccggccccagggagtgcagagccagggagaggggtaccagggacaaaccctagacagacggccctgtccacggttgctcctgctctcctaggaggccccgtgtgggccgcggcccggccctcaccatggagtccatgttcgaggacgacatcagcatcctgacgcaggaggccctggggcctagtgaggtgtggctggacagtcccggagacccctcgcttgggggcgacatgtgctccgcctcccactttgccctcatcactgcttacggagacatcaaggaacggctggggggcctggagagggagaacgccaccctccgacgccgcctcaaagtctacgagatcaagtacccactgatcagtgactttggagaggagcatggcttttctctgtatgaaatcaaggatggctccctgctggaggtggagaaggtcagcctgcagcaacggctcaaccagttccagcatgagttacagaagaacaaggagcaggaagaacagcttggagagatgatccaggcctacgagaaactctgcgtggagaagagtgacttggagacagagctgagggagatgagggccctggtggagacgcacctgcgtcagatctgtggtttggagcagcagctgcggcaacagcaaggcctccaggatgcagccttctccaacctgagcccaccacgccgagcacgcgcagtcctggccgtccatcaacttgctgatggagacggtgggctccgacatccgcagctgccccctctgccagctgggtttccctgtcgggtacccggatgatgccctcatcaaacacattgactcccacctggagaacagcaagatctagggcaccagccccacccactggctgtttctccgtcctctcctatcacccccaaacactcactttgaatgctgcatgaatctcgtggggggtccctgcccttgcgacccccagatacctccacttgctaccgagtcaacgtgtgtgccatcttccctggtccaggcaccactcagctctggctcttcctgggaggtcagccgaggctccccccatgctcctggtttctgcttaggaggtggggacttgggctgggatggggacggcatacccctcccaggcctctccctctgcctttctgttcttaatcagggttggatccaagaaggtgtccagtgcttgggcctggggtggggggaaggtgttagaggactccaggagctcctgcacccctccccaaatgtccatctttctcagacggggctctgtctggggagcacccacaggctgcctttggggtcccagagcctgctctgtgcactgaccccagttcctccatcctgtggccagcctagggctcatggcatgggcccccactgggggagggaggcatcttgtttcttgtggttccctgcaggccagtcctgtcctcctttccctgttctgcccactctggggaatagggaggggaggagaggagaggagagggaggatcctggaggactgggaagatctagcctaaagaggcttctctgagggccagggccctacagcatgcccctacggccaggggactgtctgccagcctcccaggcccatgccctcctggtgcccctggcactgaggcacagatcgtcaaggcaggtaccccctcaacccttcttccactggagcccctgacaccacaggtgccctggagcccttgtgtgactcagcctctgttagctgggtgggtgtcatcagcccctgcctcccaggccagaacctgagaacgggcccagggtgctgtggagatcaacttcaaaagagctaaccccttcccacactccacccacccacctacatttcctctgtgaaatctacctcagagttgtaccctcagaaggacgggtaagcaggaggccagggggtccccagggctgaggtggggagccttctacggcgaaagcctgccaccccacaatgaatccaccctgctccactgcgcgcctctcccaggtctcagctctgggtggggagcagtggccgctaccgacagcgcatgtcccgctcttatccaactcttccaggccccacctccctgcacccctcccctctatagagcaggggagtgaaggggtatgtcaggcggggaaggggccaaggacacgtcattgtaccctgagcgtccccagggagtggaaatggggaagggggcctggagaggggaggcaggggcccctgtgctctctgaacaagttgaaagtccaaataaaacttacctgttccatctgtgctc

SEQ ID NO: 7520 - DNA, 2185 bp, Homo sapiens
aagacagaaagtccgttggaaccgtcggctgctctctggtctctggagatgaggcgggaggacttggggacagctgtggggacacggcccagatgttctggtcccagcagaagtgactggcggggaccaggatgctggagggtcagctcgaggccagggagcccaaggagggcacccacccagaggacccgtgcccgggagctggggctgccatggagaagacacctgcagcagccgaggtccccagggaggacagcaatgccggggagatgccgtcattacagcagcagatcaccagcctccaccaagagctcgggagacagcagtcgctgtgggctgatattcacagaaaactccagagtcatatggatgccttgaggaagcagaaccgggagctccgagaagagctgagaggcctgcagcggcagcagtgggaagccgggaagaaacccgcagcgtccccacacgcggggcgagaatcacacactctggcattggaacctgcttttggaaaaatttcacctctgtcagctgatgaagagacaacgcccaaatacgctggccgcaagagtcagagtgcgactctcctgggacaaagatggtcatctaaccacttagctcctccaaagccaatgagtttaaagacagaaagaattaactcggggaaaacaccaccacaggaagatagagagaaaagtcctcccgggagacgtcaagacagaagtccagcacccactggaaggccgactcccggtgcagaaagacgggaggtgtctgaagacggaaagattatgcatccatcttcccgaagtctgcaaaactccggtggcagaaaatcaccagtgcaggcttcccaggccgccacgctgcaggagcagacggcagcagccggagttgctgacagaagctcatcagtcttagggagttctgaaggcggatttctcagccgcgttcaagctgaagagttcgccagttcttccccagacagtgcagagcggcagaatcttcctgtaaacccaccatcttccctggaaatagcacaggccatggacactaagatgaaaaaggaggaagtacaggaagaaaaacgacatccaaatggcaaggcagatgactgccggcggtccggtttcccgagtgaatttccaggagctctgcatgccgctccctccagacaggacatggggccctgacctggaggccaggcgtttctagcattgttgactgccagtttattaccagtaaataaagcaatacgcttttcaggaggaagatttgttttaaatacttaaaaaaaaacccaaaactatagcctcaaatatcttccagccaccacattttagcccttgaggagagctcagttccggaaggacgcgtcaaggtggcggtggtcggcattgactcaggaaggggtgggaagaggcacctgctgcggctgcggctgcggctacagtgttttgtgagctccgaggagacccagtcctgcctggggcagcacatcatcgctgcttcttcagctcaacagttcgttcatctcacgcctcttgctggcctgttagaaactgggagtcggcctcaggctagctttgctgagggaactctgcctcagtaaaagcgaattcatgtcttgcaagcggataaagcatttggataaatgaacaacagggaatgctacttgcagtaacagtttgaattcactgaaatgcttttgtctttagcgcagtggttgtagtggtttgtcaggggagaaggaaacccacatcatttgagcacctgaccttgccatccccataggcaggtccatgagacataagtgatgctcctccttggctaagtgcatggagaaaccaatcgctgaagctcatgaaaccacgaagatgaggacacaagaactaggtaacgcgctgtgccctctgctagcgcgatccttcctttctccccacaaccagcggtcacccacctctgcctgctcctacgtctctggctcccccaccctccctcccaggtcttcaacactttcctcttctcgtgactcatcttgcatctacttcttgtgtgtcttgcattggatatgccaaagttctttccttttttgtgttttctttcttttaataatataaactccaaaatagattgtttgattcttttcatgtggaacatttaaaatattatttgtgctttatta

SEQ ID NO: 7521 - DNA, 1572 bp, Homo sapiens
gtgttggacctaatgaaagtggacatggccaactttgctatcagtagcatcaggcctcatctcatgcagcagtcagttgaatacgaaaggaagaagtttcaagagattttggagaggcaaccaaattccctggactttgtcacccagtggctggaagaagcctcagaggaccttatgactcagaagtataaacacgccctgccagtggggggaatggctgctggctctggggacatgcccaggctgagccctgttgctgtccagaattacgcttacctgaagcttctgaagtgggaccacctccagaggccgttccccgaaacagttttaatggaccagtctcgcttccacgagctccagttgcagctggaacaactgaccatcctgggggctgtgttgctggtcaccttcagcatggcagcgccaggaatttccagccaggccgactttgctgagaaactcaagatgattgtgaagattttgctaacagatatgcacctgccctccttccatctgaaggacgtcctcactaccatcggggagaaggtgtgcctggaggtgagcagctgcctctccctgtgtgggtcctctcccttcaccacggacaaggagaccgtgctcaagggccagatccaggccgtggccagtcccgatgaccccattcgcaggatcatggaatctcgaatcctgaccttcttagaaacctaccttgcctcgggtcatcagaagccattgcccacagtccctgggggactcagtccagttcagagagagctggaggaagttgctattaaatttgctcgcctggtcaactataacaagatggtcttctgtccctactacgatgcaatcctgagaaaaagatggatatcttttggcaatttctttgggtccagcaatactgatatgagtccttggaattgtaggactgattatcccatgagtctgcacattagatttccaaagaaccatgtgatagaggcaccaatgacaatacaactttgtttccaagaaccttgtaacaaagcgttgtctcttttaaacataccacttgaggcaaaaggaatcctggacaggagttttctgcagaggcgtttaaaaccctaccgaatccgcttctgctgccgtgctctgtaaatgtcatgaacaggggggacaacggctcccttttcttcatcttcatctgaatcctcgttgggccttttgacggccttgtctctccagagctgttcaatgttgatcatcggattaacacaacctcgttgataaactcttcggacagctgttattctttgattttctgcataagatcctacagcttccctgagattggataagaaatgccatcaattatattataaccaaatctcattcaacccagcaatctcactactggatatctacccaaagaacaactctatggaaaatagtatggagatttctcaaagaactaaaaattatattttagctaaatcaactgtagatgtaaaaaaaaactatacaaatacttacacgccttttaggaaattgatgtaatccacccaaatctaagaaataaaatgaaatgttaat

SEQ ID NO: 7522 - DNA, 2817 bp, Homo sapiens
atgttttccacctctccctgaggaaacacggcgccgcccagctgcgagtcaccgcttactgaaccccttcggcaagcaggggaaagaccctcccgcctttccgtacgaagacatggcgctgccctatattgggctggcgcctcccggccaagagcagtctcctccttcctgatgctgagaagcggccgctctgaccgctgcccacccgagtcgggctgggaggaccgcccgccgcgtggcgagggatgcggcctcggaggggcagaggctgaaccgcccctgcctgccgcgcatccctccggcttccgccgcggcgccagcccgcgcctgattcgcggcgggagcggcaggagggagaacgccgactccgtggcaggaaagtgaataaacttaattgagaatgtctgaaaaccttgacaagtccaatgtaaatgaagcaggaaaatcaaaatccaatgattctgaggaaggcctcgaagatgctgtggaaggtgctgatgaagccttacaaaaagcaataaagtcagactcctccagcccccaaagagtgcagagacctcactctagtcctcctcgctttgtgacagtagaagaacttctagagacagcgagaggtgtcaccaacatggctctagcccatgaaattgtagtaaatggagactttcagattaaaccagttgaattaccagaaaacagcttgaagaagagagtaaaggagattgtacataaagcgttttgggattgcttgagtgtgcagctaagtgaagatcccccagcatatgaccatgctatcaaacttgtaggagaaatcaaagagactctcttatctttcttgctgcctggtcatactagactgagaaaccagataacagaagtcttggatctggatctgataaagcaggaagcagagaatggggcgctagacatttccaagctggcagaattcattattggcatgatggggacactgtgtgcacctgctcgagatgaggaagttaagaaactaaaggacattaaggaaatagtgccccttttcagagaaattttttctgtgttggacctaatgaaagtggacatggccaactttgctatcagtagcatcaggcctcatctcatgcagcagtcagttgaatacgaaaggaagaagtttcaagagattttggagaggcaaccaaattccctggactttgtcacccagtggctggaagaagcctcagaggaccttatgactcagaagtataaacacgccctgccagtggggggaatggctgctggctctggggacatgcccaggctgagccctgttgctgtccagaattacgcttacctgaagcttctgaagtgggaccacctccagaggccgttccccgaaacagttttaatggaccagtctcgcttccacgagctccagttgcagctggaacaactgaccatcctgggggctgtgttgctggtcaccttcagcatggcagcgccaggaatttccagccaggccgactttgctgagaaactcaagatgattgtgaagattttgctaacagatatgcacctgccctccttccatctgaaggacgtcctcactaccatcggggagaaggtgtgcctggaggtgagcagctgcctctccctgtgtgggtcctctcccttcaccacggacaaggagaccgtgctcaagggccagatccaggccgtggccagtcccgatgaccccattcgcaggatcatggaatctcgaatcctgaccttcttagaaacctaccttgcctcgggtcatcagaagccattgcccacagtccctgggggactcagtccagttcagagagagctggaggaagttgctattaaatttgctcgcctggtcaactataacaagatggtcttctgtccctactacgatgcaatcctgagtaagatcctcgtccgatcctaacgtgtatgcaccctacagcagcagtattactcactagccacagaatacctgttctgtactctaatgttgcattggaaaatggctatatagtacatgtctatttaacagcaccgattccaaagggaagaatattgtgtatcactgttgaaaagacttgttgagaaatccactgaattctattttgagagattgtatttatgagtgcaagtttacaaatcaaagaagcattttgttctcgagttttacaggtaacactcagctgttgtctccactcctcccccatcatgtccttccaaggaggctgggacctctctcttctgcaatctgggtagttctttcagatgcctcatgctgagctgacggccatccaagcgcaaaagagaccaagccatggcctcacctcctgccctccctcagacagccttgtccctcacccctcccttctggtatttttgttagaagggctatataacgtcttattgccattttctccccctatttattgcttcctccctgcctggcctagccagggctcccaagcccttttttctagaggagagttatttgtctctctctctttttttttttactttcttttttgtatttaaacattcttttaaccttcccccaaagatacagttattggactttaaaaagcttgttcttttatacaaaattactcctgcatctggttgagagcagttatgacttatgagatctagtgaaaggaaagtctttgactttcaagccttgaaagtcaaggaggaaatgtattgaaaaatagtttactgtaatgtgaacgaagagaaatgtctggaattcttactgaaaaattgaccctgagacaatacacagatgtgatgattgaattaaattctggaattaga

SEQ ID NO: 7523 - DNA, 2633 bp, Homo sapiens
ggcctgaacagctgtttacaacggaatccggacgccgggcgcgagtggagctcagtgccagaggaggggattcccggcgccgggggacagagccccttttttcttttgccgaaagaccctttctgctggggagcctcttgtgtccagcctaggcccgcgtgcagcgccgacggatgaccgtcttcttggcaagaaagtgaataaacttaattgagaatgtctgaaaaccttgacaagtccaatgtaaatgaagcaggaaaatcaaaatccaatgattctgaggaaggcctcgaagatgctgtggaaggtgctgatgaagccttacaaaaagcaataaagtcagactcctccagcccccaaagagtgcagagacctcactctagtcctcctcgctttgtgacagtagaagaacttctagagacagcgagaggtgtcaccaacatggctctagcccatgaaattgtagtaaatggagactttcagattaaaccagttgaattaccagaaaacagcttgaagaagagagtaaaggagattgtacataaagcgttttgggattgcttgagtgtgcagctaagtgaagatcccccagcatatgaccatgctatcaaacttgtaggagaaatcaaagagactctcttatctttcttgctgcctggtcatactagactgagaaaccagataacagaagtcttggatctggatctgataaagcaggaagcagagaatggggcgctagacatttccaagctggcagaattcattattggcatgatggggacactgtgtgcacctgctcgagatgaggaagttaagaaactaaaggacattaaggaaatagtgccccttttcagagaaattttttctgtgttggacctaatgaaagtggacatggccaactttgctatcagtagcatcaggcctcatctcatgcagcagtcagttgaatacgaaaggaagaagtttcaagagattttggagaggcaaccaaattccctggactttgtcacccagtggctggaagaagcctcagaggaccttatgactcagaagtataaacacgccctgccagtggggggaatggctgctggctctggggacatgcccaggctgagccctgttgctgtccagaattacgcttacctgaagcttctgaagtgggaccacctccagaggccgttccccgaaacagttttaatggaccagtctcgcttccacgagctccagttgcagctggaacaactgaccatcctgggggctgtgttgctggtcaccttcagcatggcagcgccaggaatttccagccaggccgactttgctgagaaactcaagatgattgtgaagattttgctaacagatatgcacctgccctccttccatctgaaggacgtcctcactaccatcggggagaaggtgtgcctggaggtgagcagctgcctctccctgtgtgggtcctctcccttcaccacggacaaggagaccgtgctcaagggccagatccaggccgtggccagtcccgatgaccccattcgcaggatcatggaatctcgaatcctgaccttcttagaaacctaccttgcctcgggtcatcagaagccattgcccacagtccctgggggactcagtccagttcagagagagctggaggaagttgctattaaatttgctcgcctggtcaactataacaagatggtcttctgtccctactacgatgcaatcctgagtaagatcctcgtccgatcctaacgtgtatgcaccctacagcagcagtattactcactagccacagaatacctgttctgtactctaatgttgcattggaaaatggctatatagtacatgtctatttaacagcaccgattccaaagggaagaatattgtgtatcactgttgaaaagacttgttgagaaatccactgaattctattttgagagattgtatttatgagtgcaagtttacaaatcaaagaagcattttgttctcgagttttacaggtaacactcagctgttgtctccactcctcccccatcatgtccttccaaggaggctgggacctctctcttctgcaatctgggtagttctttcagatgcctcatgctgagctgacggccatccaagcgcaaaagagaccaagccatggcctcacctcctgccctccctcagacagccttgtccctcacccctcccttctggtatttttgttagaagggctatataacgtcttattgccattttctccccctatttattgcttcctccctgcctggcctagccagggctcccaagcccttttttctagaggagagttatttgtctctctctctttttttttttactttcttttttgtatttaaacattcttttaaccttcccccaaagatacagttattggactttaaaaagcttgttcttttatacaaaattactcctgcatctggttgagagcagttatgacttatgagatctagtgaaaggaaagtctttgactttcaagccttgaaagtcaaggaggaaatgtattgaaaaatagtttactgtaatgtgaacgaagagaaatgtctggaattcttactgaaaaattgaccctgagacaatacacagatgtgatgattgaattaaattctggaattaga

SEQ ID NO: 7524 - DNA, 547 bp, Homo sapiens
gtttacaacggaatccggacgccgggcgcgagtggagctcagtgccagaggaggggattcccggcgccgggggacagagccccttttttcttttgccgaaagaccctttctgctggggagcctcttgtgtccagcctaggcccgcgtgcagcgccgacggatgaccgtcttcttggcaagtgcgaggatcctcctcccctcggctctctttttagacacagtgggggttgaatggatgcgcgcgatataagcaaattaaatggttcgtggccgcatcctagagccctttaattagagttaccatttgtagaaggcctgccgtgcacaatccctcgtttcatctccccccaaaccgagcaggaaagtgaataaacttaattgagaatgtctgaaaaccttgacaagtccaatgtaaatgaagcaggaaaatcaaaatccaatgattctgaggaaggcctcgaagatgctgtggaaggtgctgatgaagccttacaaaaagcaataaagtcagactcctccagcccccaaagagtgcagagacctcact

SEQ ID NO: 7525 - DNA, 905 bp, Homo sapiens
atgttttccacctctccctgaggaaacacggcgccgcccagctgcgagtcaccgcttactgaaccccttcggcaagcaggggaaagaccctcccgcctttccgtacgaagacatggcgctgccctatattgggctggcgcctcccggccaagagcagtctcctccttcctgatgctgagaagcggccgctctgaccgctgcccacccgagtcgggctgggaggaccgcccgccgcgtggcgagggatgcggcctcggaggggcagaggctgaaccgcccctgcctgccgcgcatccctccggcttccgccgcggcgccagcccgcgcctgattcgcggcgggagcggcaggagggagaacgccgactccgtggcagaccctttctgctggggagcctcttgtgtccagcctaggcccgcgtgcagcgccgacggatgaccgtcttcttggaaagtgaataaacttaattgagaatgtctgaaaaccttgacaagtccaatgtaaatgaagcaggaaaatcaaaatccaatgattctgaggaaggcctcgaagatgctgtggaaggtgctgatgaagccttacaaaaagcaataaagtcagactcctccagcccccaaagagtgcagagacctcactctagtcctcctcgctttgtgacagtagaagaacttctagagacagcgagaggtgtcaccaacatggctctagcccatgaaattgtagtaaatggagactttcagattaaaccagttgaattaccagaaaacagcttgaagaagagagtaaaggagattgtacataaagcgttttgggattgcttgagtgtgcagctaagtgaagatcccccagcatatgaccatgctatcaaacttgtaggagaaatcaaagagactctcttatctttc

SEQ ID NO: 7526 - DNA, 2126 bp, Homo sapiens
ggagctggggcggaggctggcggggcccgtccgggaggcgcgcggtccaagtcgcaggcatctcttcgcctcttcccgtcggatcccatcccgggatgtcgggggcaggcgaggaagaggcggggtccgcgggcgggtggagctcacccctcgaggctgtcctctcggcgcgcccgcgtcctcccctactcccggccctgccactccctcgctggcctgaacagctgtttacaacggaatccggacgccgggcgcgagtggagctcagtgccagaggaggggattcccggcgccgggggacagagccccttttttcttttgccgaaagaccctttctgctggggagcctcttgtgtccagcctaggcccgcgtgcagcgccgacggatgaccgtcttcttggcaatgaataaacttaattgagaatgtctgaaaaccttgacaagtccaatgtaaatgaagcaggaaaatcaaaatccaatgattctgaggaaggcctcgaagatgctgtggaaggtgctgatgaagccttacaaaaagcaataaagtcagactcctccagcccccaaagagtgcagagacctcactctagtcctcctcgctttgtgacagtagaagaacttctagagacagcgagaggtgtcaccaacatggctctagcccatgaaattgtagtaaatggagactttcagattaaaccagttgaattaccagaaaacagcttgaagaagagagtaaaggagattgtacataaagcgttttgggattgcttgagtgtgcagctaagtgaagatcccccagcatatgaccatgctatcaaacttgtaggagaaatcaaagagactctcttatctttcttgctgcctggtcatactagactgagaaaccagataacagaagtcttggatctggatctgataaagcaggaagcagagaatggggcgctagacatttccaagctggcagaattcattattggcatgatggggacactgtgtgcacctgctcgagatgaggaagttaagaaactaaaggacattaaggaaatagtgccccttttcagagaaattttttctgtgttggacctaatgaaagtggacatggccaactttgctatcagtagcatcaggcctcatctcatgcagcagtcagttgaatacgaaaggaagaagtttcaagagattttggagaggcaaccaaattccctggactttgtcacccagtggctggaagaagcctcagaggaccttatgactcagaagtataaacacgccctgccagtggggggaatggctgctggctctggggacatgcccaggctgagccctgttgctgtccagaattacgcttacctgaagcttctgaagtgggaccacctccagaggccgttccccgaaacagttttaatggaccagtctcgcttccacgagctccagttgcagctggaacaactgaccatcctgggggctgtgttgctggtcaccttcagcatggcagcgccaggaatttccagccaggccgactttgctgagaaactcaagatgattgtgaagattttgctaacagatatgcacctgccctccttccatctgaaggacgtcctcactaccatcggggagaaggtgtgcctggaggtgagcagctgcctctccctgtgtgggtcctctcccttcaccacggacaaggagaccgtgctcaagggccagatccaggccgtggccagtcccgatgaccccattcgcaggatcatggaatctcgaatcctgaccttcttagaaacctaccttgcctcgggtcatcagaagccattgcccacagtccctgggggactcagtccagttcagagagagctggaggaagttgctattaaatttgctcgcctggtcaactataacaagatggtcttctgtccctactacgatgcaatcctgagtaagatcctcgtccgatcctaacgtgtatgcaccctacagcagcagtattactcactagccacagaatacctgttctgtactctaatgttgcattggaaaatggctatatagtacatgtctatttaacagcaccgattccaaagggaagaatattgtgtatcactgttgaaaagacttgttgagaaatccactg

SEQ ID NO: 7527 - DNA, 2219 bp, Homo sapiens
gggacactggggctgggggggtttgttgggctggtgagttttcgaggtgactgtgctgtgctcggtgaggggacgcccagagagccctgacccggggtcactccgtcgccgttctcctcttgtctacgtgctggacccggtgctacctttttacccacacttaagtgacgcaaaatgcccttcaatggcgagaagcagtgtgtgggagaggaccagccaagcgattctgattcttcccggttttccgaaagcatggcttcgctcagtgactatgaatgctccaggcagagctttgcaagtgactcctccagcaaatccagctctcctgcttcaacaagccctccaagggttgtaacatttgatgaagtgatggctacagcaaggaacttatcaaacttgactcttgctcatgagattgctgtaaatgagaactttcaattgaaacaagaggctctcccagaaaagagtttggctggtcgagtgaagcacattgttcaccaggccttctgggacgtcttggattcagaactaaatgctgaccctcctgagtttgaacatgccatcaaactgtttgaagaaatcagagagattcttctctcttttctcactcccggtggcaaccggcttcgcaaccaaatctgtgaagttttggacacagacctcattaggcagcaggctgagcacagtgctgttgacatccaaggcctggccaactatgtcatcagtacgatgggaaagctgtgtgctcccgtgcgagataatgatatcagagagttaaaggctactggcaacatcgtggaggtgctgagacaaatattccatgtcctggacctcatgcaaatggacatggccaattttacaattatgagtctcagaccgcaccttcaacgccagttggtggaatatgagagaaccaagttccaggaaattttggaagaaactccaagtgctcttgatcagactacagaatggataaaagaatctgtaaatgaagaattattttctctttctgagagtgctttaactcctggggccgaaaatacctccaagccaagcctgagccctactttggtgctaaataatagttacttgaaactgttacagtgggattatcagaaaaaagaattaccagagacacttatgacagatggagcacgtcttcaggaactaacagaaaagctgaatcaattgaaaattattgcctgcctgtccctaattaccaacaacatggtgggtgctattacaggaggcctgcctgagcttgcaagcaggttaacaaggatttcagctgttctacttgaaggcatgaacaaagagacctttaacttgaaggaagtcctgaattctattggtattcagacttgtgttgaggttaacaagaccctgatggaaagaggtttacccactttaaatgctgagattcaagctaatcttataggtcaattttcaagcattgaagaggaggacaatcctatctggtccttgattgataaacgaattaagctttacatgagaaggctactttgtcttccaagccctcaaaaatgcatgcctcctatgccaggaggcctagctgtcattcagcaggagctagaagccctaggctctcaatatgcaaacattgtgaatctcaacaaacaagtgtatggaccattttatgcaaatatacttcgaaagctgctcttcaatgaggaagccatggggaaggtagatgcttcacctcctactaactaaagaagaactgacattggacgagagattggaaatccagtactttggtatccagtccacttccattgatggcattagagatccagcacattctcagtactgtggtgcagtattagcccaaatctgtgtaatgggtaatattagcattacagaagacacacacatcacatagaccctcagaagacgtaaacatcacatagaccctatttgtgcatcattttcaagtttaaaacaaatatttgtaatgaacagaaaacaatttgtaattaattatattacctatataatacttgtaaatgttttcttaaccatttatatttggcttatgacatttaacccctaaggagttgtttttctcacttgttattatcaaacctaatggtttttaattttggtacaactccttaaagggttgaaggttgtgacaataactgagggaactgatgttctgaataaatgatgtgaagtaaacacaattgtatttgaaa

SEQ ID NO: 7528 - DNA, 1067 bp, Homo sapiens
gggtgaggtcgtgcagactgctgctgcgtccccttgccgggacctttggttaaggggaagaggtggagaaaagccgattgggcctgggctcgaacgctgaaccctcaggtgttgcttgtgcttcccaaagctgctactgtaggtggcaccactgggggtaatagcaatgatttgaggtggcatatggatgaacatagttacttgttttcgttactattaagaaaatctgttccattaagtaagcagtttcacaatgatagagtttccttttaaaataaatatatttaaatgcaaaaatctagtcaagatagagacgcggttactaaattatagtaaaggtaaggagggagacgtagaaatagtcatgaagagtggcactcaaacgacttaagtttgggaaatcttagatggttgtcctgctaccttaactgtgaagaaactggacaagttgtccttgtccccagtgggtgtctcagcacccatggtcaccagcccagtcagggactttgctcttcttacctgccaacggataatgagttaatctcagtggttcccacttgaggaggctccctgccgtggtccttttcctctcttctctagggatttcatgcatcaccctgacagccagtggaagttgcctgatttgaagaggcccagggccgaagatacccagtcatgtgtggaagcagcttcaatgccattttgtgagaggttgagggccccagagggggaagcacaggtgctacctttttacccacacttaagtgacgcaaaatgcccttcaatggcgagaagcagtgtgtgggagaggaccagccaagcgattctgattcttcccggttttccgaaagcatggcttcgctcagtgactatgaatgctccaggcagagctttgcaagtgactcctccagcaaatccagctctcctgcttcaacaagccctccaagggttgtaacatttgatgaagtgatggctacagcaaggaacttatcaaacttgactcttgctcatgagattgctgtaaatgagaactttcaattgaaacaagaggctctcccagaaaagag

SEQ ID NO: 7529 - DNA, 544 bp, Homo sapiens
tggcactcaaacgacttaagtttgggaaatcttagatggttgtcctgctaccttaactgtgaagaaactggacaagttgtccttgtccccagtgggtgtctcagcacccatggtcaccagcccagtcagggactttgctcttcttacctgccaacggataatgagttaatctcagtggttcccacttgaggaggctccctgccgtggtccttttcctctcttctctagggatttcatgcatcaccctgacagccagtggaagttgcctgatttgaagaggcccagggccgaagatacccagtcatgtgtggaagcagcttcaatgccattttgtgagaggttgagggccccagagggggaagcacagtgacctgctatcgtgttggaggctttgcttggagtcatcttcagtcttttctgttgactttacctttgaccagtgattaaatcctccaggtgctacctttttacccacacttaagtgacgcaaaatgcccttcaatggcgagaagcagtgtgtgggagaggaccagccaagcgattc

SEQ ID NO: 7530 - DNA, 625 bp, Homo sapiens
aaggcggggtcaggggccatcaagctcggctcctagttcatgtcttcccactccgcgtccccttgtttgacctcgaactgccgtcccgcgtgggagcggggagcggggcaccgagtggccgccccgcgtgtcggggtggacacggacttcgggcctcggaggccgcttcgccgctgtttaaatcctgctggacaggtgctacctttttacccacacttaagtgacgcaaaatgcccttcaatggcgagaagcagtgtgtgggagaggaccagccaagcgattctgattcttcccggttttccgaaagcatggcttcgctcagtgactatgaatgctccaggcagagctttgcaagtgactcctccagcaaatccagctctcctgcttcaacaagccctccaagggttgtaacatttgatgaagtgatggctacagcaaggaacttatcaaacttgactcttgctcatgagattgctgtaaatgagaactttcaattgaaacaagaggctctcccagaaaagagtttggctggtcgagtgaagcacattgttcaccaggccttctgggacgtcttggattcagaactaaatgctgaccctcctgagtttgaacatgccatcaaact

SEQ ID NO: 7531 - DNA, 985 bp, Homo sapiens
ctggtgagttttcgaggtgactgtgctgtgctcggtgaggggacgcccagagagccctgacccggggtcactccgtcgccgttctcctcttgtctacgtgctggacccgggatttcatgcatcaccctgacagccagtggaagttgcctgatttgaagaggcccagggccgaagatacccagtcatgtgtggaagcagcttcaatgccattttgtgagaggttgagggccccagagggggaagcacaggtgctacctttttacccacacttaagtgacgcaaaatgcccttcaatggcgagaagcagtgtgtgggagaggaccagccaagcgattctgattcttcccggttttccgaaagcatggcttcgctcagtgactatgaatgctccaggcagagctttgcaagtgactcctccagcaaatccagctctcctgcttcaacaagccctccaagggttgtaacatttgatgaagtgatggctacagcaaggaacttatcaaacttgactcttgctcatgagattgctgtaaatgagaactttcaattgaaacaagaggctctcccagaaaagagtttggctggtcgagtgaagcacattgttcaccaggccttctgggacgtcttggattcagaactaaatgctgaccctcctgagtttgaacatgccatcaaactgtttgaagaaatcagagagattcttctctcttttctcactcccggtggcaaccggcttcgcaaccaaatctgtgaagttttggacacagacctcattaggcagcaggctgagcacagtgctgttgacatccaaggcctggccaactatgtcatcagtacgatgggaaagctgtgtgctcccgtgcgagataatgatatcagagagttaaaggctactggcaacatcgtggaggtgctgagacaaatattccatgtcctggacctcatgcaaatggacatggccaattttacaattatgagtctcaga

SEQ ID NO: 7532 - DNA, 153 bp, Homo sapiens
acgcacgccaagtcttcagagggcctggatgggtgtgactccaaggagctaatcgtcccgtgcaggtgctacctttttacccacacttaagtgacgcaaaatgcccttcaatggcgagaagcagtgtgtgggagaggaccagccaagcgattc

SEQ ID NO: 7533 - DNA, 2001 bp, Homo sapiens
gagtccagggagagtgcgcgggcggccgccggctgaatgaagcctgggacgcgggagccgcgccgcgcgcagtgtctgcagtgccggaggtctgggaggctccgggcgaagcctccctgctgcaggttatgatgatgtcagacaatgctaaaggcagagcagctcattcatggaagaaaagagggagtatttcttctctaagtaatcatgaattttggcgaaaggaaattcatgggcgcatcaaagattctatgagtactgtgtcttatatggaagaacccagtcagcgtgatgatatctctcgccttacagttcagatggaaaacacctatcagttgggtcctcccaaacattttcctgtggtcaccgtcaatcatattttgaaagatgtagtaaccagctatctacaagtagaagaatatgaaccagagctctgtagacagatgactaaaaccatttctgaggttattaaagcccaggtcaaggacttgatgattccacggtataaactaattgtgattgttcacattggacaactgaacaggcagagcatacttattggaagcagatgcctctgggatcctaaaagtgataccttttcatcttatgttttcagaaattcttctctcttcgctcttgcaaatgtctatgcagtttaccttgagtgattgaaaataagaaatctagctcttacttttgaaaattctgaggcaggctgtatgtctgtacacaaaagttttactgccaaaaactttgagaaagaaacaacactgatatttcaagcaactggaagcttttgaattttttcatattctagtaaagatttggggaggggagggtagccacagaaagaatcttgtttatctaaagcaggaacttgatcttggttttgctggattgctttccatagacatagattcttattaaatatttgttttggtactaattattttaattattctttaattagagtgttacaatttcctgcattgttttttaataaaaagaagctttagaaaaactatggctatataccctgaccaataaatgatagtagaatattcaacatggtatacacaaatgataaataatgtgcctcagtgctgcatataaaagaatactggttttcattttgtacttaataaattgagcagcattcattaagtgcaattattgttacatgtacctgacagttgaaactgctgaggtagaattaatggcttcataacaattatcgtggtcccacgggctgcaagctaaaactagaagctcttgtggcttgcctgcactttacacaattgtgggagaaccgaaagttggctcttcagtaatggaaactataaagtgaataaaggctttttgggacactgaagtagacattgtgatattaaatatacatgatgcttaatactaaatgtgtctgtaacacataaaatcatttattggaaagagacattgcttttaaatatcctaggctaacaaactttttcacaaaatatatggctggcaccttaacaaataaagcatgtgtagttaccattttactcctatgaatttaatactaaagtgacccagtgaggtttttgaatagacgggtgctaaaatttacagggctgaaatagcttattattctgctggttaatgtatcttacgccacggatcatttatttttatgaagctttcaagtctttgtgtgcaagtaaaatgatgttgtggcgttgttcttggatggtaagtggactgcctagaggacatttgttaaaggtcaaagacaaattgtacacatatggagaaaattagcaatgctgtagtcttaaggaaaaaatgatttatcattcatatcaaaaagagtttagcaaatggaaaaccagttaatgctttaattttaaaatgttttggtgtcttacttttccctaaaaatgacatgtagtaaaaaatggatacttttaaaatcccttcccttctgctattttctggcttttaaagtgattattcaaaatg

SEQ ID NO: 7534 - DNA, 673 bp, Homo sapiens
tgtgcggggcgctcgcgggcttcagcgaggcgggagggcggccctgttgccctggagacgctttccctgctgccggccgcgaccgcaacccgctaggccttcatcgcgagctacgcccggaccgagaagccccggcatggccacgtccatcggagtgtccttctcggtgggcgacggggtgcctgaggctgagaagaacgcaggggagcccgagaacacctatattctgcggcctgttttccagcagaggttcaggccctctgtggttaaagactgtatccatgctgtgctcaaggaggaactggcaaatgctgaatattctccagaagaaatgcctcagcttacaaaacatttatcagaaaacattaaagataaattaaaagaaatgggatttgaccgatacaaaatggtggtgcaagtagtgattggagaacaaagaggtgaaggagtattcatggcttctcgctgtttctgggatgctgacactgacaactatactcatgatgttttcatgaatgacagtttattctgcgttgtagcagcatttggctgtttctactactgaatgaatctttgaaaagctggtaaaagacatgaccatgaagaaatctgaactttttaatattgttaaatatcttgacaaaataaagatgttagtagtttgacaactgaa

SEQ ID NO: 7535 - DNA, 388 bp, Homo sapiens
tgtgcggggcgctcgcgggcttcagcgaggcgggagggcggccctgttgccctggagacgctttccctgctgccggccgcgaccgcaacccgctaggccttcatcgcgagctacgcccggaccgagaagccccggcatggccacgtccatcggagtgtccttctcggtgggcgacggggtgcctgaggctgagaagaacgcaggggagcccgagaacacctatattctgcggcctgttttccagcagaggttcaggccctctgtggttaaagactgtatccatgctgtgctcaaggaggaactggcaaatgctgaatattctccagaagaaatgcctcagcttacaaaacatttatcagaaaacattaaagataaaaaaaaaaaaaaa

SEQ ID NO: 7536 - DNA, 1902 bp, Homo sapiens
gcctctggctgctctgttaacgtgtcccgcgagcgaggcgcgtcgcaaaaggtcgcggcggaacttccctgcgcttttcagaccatactctttacggtactaggcactgctgagctgggagatgtcggcggcgtgttgggaggaaccgtggggtcttcccggcggctttgcgaagcgggtcctggtgaccggcggtgctggtttcattgcatcacatatgattgtctctttagtggaagattatccaaactatatgatcataaatctagacaagctggattactgtgcaagcttgaagaatcttgaaaccatttctaacaaacagaactacaaatttatacagggtgacatatgtgattctcactttgtgaaactgctttttgaaacagagaaaatagatatagtactacattttgccgcacaaacacatgtagatctttcattcgtacgtgcctttgagtttacctatgttaatgtttatggcactcacgttttggtaagtgctgctcatgaagccagagtggagaagtttatttatgtcagcacagatgaagtatatggtggcagtcttgataaggaatttgatgaatcttcacccaaacaacctacaaatccttatgcatcatctaaagcagctgctgaatgttttgtacagtcttactgggaacaatataagtttccagttgtcatcacaagaagcagtaatgtttatggaccacatcaatatccagaaaaggttattccaaaatttatatctttgctacagcacaacaggaaatgttgcattcatgggtcagggcttcaaacaagaaacttcctttatgctactgatgttgtagaagcatttctcactgtcctcaaaaaagggaaaccaggtgaaatttataacatcggaaccaattttgaaatgtcagttgtccagcttgccaaagaactaatacaactgatcaaagagaccaattcagagtctgaaatggaaaattgggttgattatgttaatgatagacccaccaatgacatgagatacccaatgaagtcagaaaaaatacatggcttaggatggagacctaaagtgccttggaaagaaggaataaagaaaacaattgaatggtacagagagaattttcacaactggaagaatgtggaaaaggcattagaaccctttccggtataatcaccatttatatagtcgagacagttgtcaaagaagaaagttatcctacctcgccaagtggtatgaaattaagtgaccaaatgaagtgcactcttttcttttggaattagattcatgactttctgtataaaattcaaatgcagaatgcctcaatctttgggagagtttcagtactggcatagaatttaaatgtcaaaattctttctgaaaccctttctcctagaaactaggaaataataggtgtagaagactctccctaagggtagccaggaagaagtctcctgattcggacaaccatgaggggtagtggtgctagggagaaggcaaccttcactggttttgaactcagtgcctaagaaagtctctgaaatgttcgtttttaggcaatataggatgtcttaggccctaattcaccatttcttttttaagatctgatatgctatcattgccttaataatggaacaaaatagaagcatatctaacactttttaaattgataattttgtaaaattgattacgttgaatgctttttaagagaagtgtgtaaagtttttatattttcacaattaacgtatgtaaaaccttgtatcagaaatttatcatgtttactgtttaaaatgattgtatttataaaattgtcaatatcttaatgtatttaatgtagaatattgctttttaaaataatgtttttattttgctgtagaaaaataaaaaaaaatttgattata

SEQ ID NO: 7537 - DNA, 8686 bp, Homo sapiens
cccccggcggagccagctgctgctcttcggtgctggccccggtgccggccccgttgcccagggaacaggctcccggcagcccccgcggcccggagtccatcccgcctcctccggcccggcggggccgacgagtccggaggggctgccgcgggagcccccaggtttccctagatgacaaataaacattccttttcctgcgtgaagatagtctgtggaaaccttggccatggcatcgatatcagagcctgttacattcagagagttctgcccgttgtactatctcctcaatgccattccgacaaagatccagaagggtttccgctctatcgtggtctatctcacggccctcgacaccaacggggactacatcgcggtgggcagcagcatcggcatgctctatctgtactgccggcacctcaaccagatgaggaagtacaactttgaggggaagacggaatctatcactgtggtgaagctgctgagctgctttgatgacctggtggcagcaggcacagcctctggcagggttgcagtttttcaacttgtatcttcattgccagggagaaataaacagcttcggagatttgatgtcactggtattcacaaaaatagcattacagctctggcttggagccccaatggaatgaaattgttctctggagatgacaaaggcaaaattgtttattcttctctggatctagaccaggggctctgtaactcccagctggtgttggaggagccatcttccattgtgcagctggattatagccagaaagtgctgctggtctctactctgcaaagaagtctgctcttttacactgaagaaaagtctgtaaggcaaattggaacacaaccaaggaaaagtactgggaaatttggtgcttgttttataccaggactctgtaagcaaagtgatctaaccttgtatgcgtcacggcccgggctccggctatggaaggctgatgtccacgggactgttcaagccacgtttatcttaaaagatgcttttgccgggggagtcaagccttttgaactgcacccgcgtctggaatcccccaacagtggaagttgcagcttacctgagaggcacctggggcttgtttcatgtttctttcaagaaggctgggtgctgagttggaatgaatatagtatctatctcctagacacagtcaaccaggccacagttgctggtttggaaggatccggtgatattgtgtctgtttcgtgcacagaaaatgaaatatttttcttgaaaggagataggaacattataagaatttcaagcaggcctgaaggattaacatcaacagtgagagatggtctggagatgtctggatgctcagagcgtgtccacgtgcagcaagcggagaagctgccaggggccacagtttctgagacgaggctcagaggctcttccatggccagctccgtggccagcgagccaaggagcaggagcagctcgctcaactccaccgacagcggctccgggctcctgccccctgggctccaggccacccctgagctgggcaagggcagccagcccctgtcacagagattcaacgccatcagctcagaggactttgaccaggagcttgtcgtgaagcctatcaaagtgaaaaggaagaagaagaagaagaagacagaaggtggaagcaggagcacctgtcacagctccctggaatcgacaccctgctccgaatttcctggggacagtccccagtccttgaacacagacttgctgtcgatgacctcaagtgtcctgggcagtagcgtggatcagttaagtgcagagtctccagaccaggaaagcagcttcaatggtgaagtgaacggtgtcccacaggaaaatactgaccccgaaacgtttaatgtcctggaggtgtcaggatcaatgcctgattctctggctgaggaagatgacattagaactgaaatgccacactgtcaccatgcacatgggcgggagctgctcaatggagcgagggaagatgtgggaggcagtgatgtcacgggactcggagatgagccgtgtcctgcagatgatggaccaaatagcacacagttacccttccaagaacaggacagctctcctggggcgcatgatggggaagacatccaacccattggcccccaaagcactttttgtgaagtccccctcctgaactcactcactgtgccttccagcctcagctgggccccaagtgctgaacagtggctgcctgggaccagagctgatgaaggcagccccgtggagcccagccaagagcaggacatcctaaccagcatggaggcctctggccacctcagcacaaatctctggcatgctgtcactgatgatgacacaggtcagaaagaaatacccatttctgaacgtgtcttggggagtgtgggaggacagctgactccggtctctgccttggcagccagcactcacaagccctggcttgagcagcctccacgggatcagacattgacgtccagcgatgaggaggacatctatgcccacgggcttccttcttcatcctcagagacgagtgtgacagagctcggacctagttgctcccagcaggacctgagccggctgggtgcagaggacgccgggctgctcaagccagatcagtttgcagaaagctggatgggctactcgggtcccggctatggcatcctcagcttggtggtctccgagaagtatatctggtgcctggactacaaaggcggcctgttctgcagcgcgttgccgggcgccgggctgcgctggcagaagtttgaagatgctgtccagcaggtggcagtctcgccctcaggagcccttctctggaagattgaacagaaatctaaccgggcttttgcttgtgggaaagtcaccatcaaggggaagcggcactggtacgaagccctgccccaggcagtgtttgtggccctgagcgatgacacggcctggatcatcaggaccagtggggacctatacttgcagacaggtctgagcgtggatcgcccttgtgccagagccgtaaaggtggactgtccctacccgctgtcccagatcacagcccggaacaatgtggtgtgggcgctgacagagcagagggccctcctgtaccgggagggcgtgagcagcttctgtccggaaggcgagcagtggaagtgtgacattgtcagcgaaaggcaagctttagaacccgtctgcataacgctcggggatcagcagactctctgggccctggacatccatgggaacctgtggttcagaactggcattatttccaagaagccccaaggagatgacgaccattggtggcaagtgagcatcacggactatgtggtgtttgaccagtgcagcttatttcagacgataatccatgccactcactcggtggccacagcagcccaagcccccgtagaaaaggtggcagataagctgcgcatggcgttttggtcccagcagcttcagtgccagccaagccttctcggggtcaataacagcggtgtctggatctcctcgggcaagaatgaattccacgtcgctaagggaagtctcataggcacctactggaatcatgtggttccccgtgggacagcttctgctacaaaatgggcctttgtgttggcttctgcagctcccacgaaggaaggaagcttcctgtggctgtgccagagcagcaaggacctgtgcagcgtcagcgcccagagcgcacagtcgcggccctccacggtgcagctgcctcccgaagccgagatgcgcgcctatgccgcctgccaggatgcgctgtgggcgctggacagcctcggccaggtgttcatcaggacgctctccaagagctgccccacgggcatgcactggaccaggctggacctctcccagctaggagctgtaaaattgacaagcttggcatgtggaaatcagcacatctgggcctgtgattccaggggtggagtttacttccgtgtagggactcagcctctcaatcccagtctcatgcttccagcctggataatgattgagccacctgtccagcccgccggggtcagcttggtcagcgtccattccagccccaacgaccagatgctgtgggtgcttgacagcaggtggaacgtgcacgtgcggaccgggatcaccgaggagatgcctgtggggaccgcctgggagcatgtgccagggttgcaggcctgccagctggcgctgagcaccaggaccgtgtgggcccgctgtccaaacggagacctcgcccggcggtacggcgtcacagacaagaaccccgccggggactactggaagaaaattcccggcagcgtgtcgtgtttcacagtgactgcgtcagatgagctgtgggctgtgggcccgcccggctacctcctccaacggctgacaaagacgttcagccactcgcacggcacccagaagagcagccaggccgccatgccccaccctgaggacctggaggacgagtgggaggtcatctgaaggagccctggccgagtcacgcggaggggcccggcgtctgtggcgggcacaggggcttcagagtgactccctggtggacgcgctgcctcaacacttgtccagacacctctggccaggttggacccgcacacttactttcatctatgttggtttctgtctcgttccagaacccacagcctccacccgtggctggcgtgattgctgcagcagtggcgcctcctagctcaggacagtggcgactgcccggctgcatgcactccgattacccacgtgctgccgtcctggtctcatccacagatagctccagcttttgttggtgggagtggtctccggaggcctcccagaaccaagggtagccgggcagctggtttggcccagggcctccttccacattagtagccccagggccagatggagccaaaggtcagctctctgcagcgcgggatgtgctcggtgatggctttgtcccatcataggggggtgtccccccagagacaaagctgcagagcacattccatgccagacgctctggccaggaagctgaggccgggcttgagaggagagcgctggccatgccaggagagaacccacgcacatgcacaccacaacacacaacacacctcacctcacaccacagcacacctcaccacaccacaccgcactgcaccatacctcaccacatctcaccacaccacagcacacctcaccacacaacacaccacaccccacaccgcactgcaccgcaccgcaccgcaccgtacctcgccacatctcaccacaccacaccacaccacacctcactgcccacacacggcgcaggctgcccgcctcctggagagcacacttcagctgaaacagtaaagcctgatgggtgcaaatggaacctggatgtgtgcacgtgtgtcccaggtagggacggcacaggagggtgcatggggcgtgggggagctgagcaagggtcgctcacttagaaatgtctttggaatggtgtttaactaatgctgctggcggacatcctaaaaccagatgcatcctcagaggacgagtctactaattattgcctttgttgttgtattacaaatctgcataaaatacctcatttcaaatcaaatcttacaaatttagaagagagatatgttttccgaaaacagtggaagccctttgttccttcccgggtttgtcctgagcctgcactgtcctcgcctgcagcctcagaggggcaggcatccccgcacagacttgactggcagggcggtcacgggacctgcgggctggctccgagtggcagcccatgccttctgcggggtatgggttgacacttgacaggttgaaaccagtgcctctatggacggctgctgtggccccttcagacaatgggcagtgcccaccccgcccactggcatctgcgtgtgagggctaggccgccctgccacacatcccgccccctcccggaggcagcttcaggacaggacaccaggctggctgctttttttagcctgcccctggcccaggcccagtccttggtgtcagggagcccccaggccgcaggtggagggtgataaaatatgttctctgacaggacccagccagccacataggtggaggttttccatgtccaaatgaggtcaagatgccgaaatcccagatctgacttcacacttcccttttctagaaccttttgtaaaagttggtggcagcagaggcagccccaggccgggctgcatctctctgtgtctgttgtgccttgcccggcgcctcacggatggcaaagctctcctcacccatgggactgtagtgcaattaaacccgcgtctaggtgatgcttttaaagttgtagcttcgtgctttgtacagttttctttctggttttaatttttagttgtgctttgagtcagtgcaataaactagactttttccaaacctggccgagtgtggtgcctgagctgtgagaagtgtcctcagccgacactcacgagggcagtgcaagggagaacctgccagcccagccccaccacagggagagtgcgtcagcagacctgtcctggcctggctggtgttgaaatacacaccggtttgcccaagtggctgttatgggggaatggccgctccagagctggctgtaccccatggtagcctctgaggaggacgctgtggggtgaggtccagggctgcctcctcatggagctgtgtgtgagcaggcgttggaggggttcgagcccctggttctgtatcttcagccagcaaacgaaaccatatcgcaaaccagagctgctggaaaccagcacacgcaaaagatgacgcccagcacagcagcaggacacaccatgtgccaggaaatgacctcagcaagaaacctcaggccgtgtgaagagcagcaaagctttccagaaggcataaaaggaaacttgaataaaggaagatatgttccacattcctggatggaggactacacacattatggaaagacctcattctttccaaaggaatttataggtgtagcttgatttcagttcaaatccccactgggattgttttgttggggcaggcagggaggaataatgttagtacccacaaatgcccatgactgtgcccaatgtgcttctcaccagagccctgcaaggggaagtctcattagccccttgagactcagagaggttaggtaacttgctcaaggtcacacagcactgggactggaagccagctctgtagaactgcagacctgtgctgtttgatgcctcctcactgtcccgtcactcctgggaagaagaaacgggtgagaactgctaagtgatgacaggtggagccccagcaggggccactctattgaatggcatggcccagaccctcggagggccaggcaacaggctagcaaggcccacagggagggagcagaatggagagggcatctcagatgcgcttaaggagcggcgggggcggggcatggggggtgtcacaactaatgtggccactgcttcattctctgggcaaaataatattaaatggattaaagaatctaaaaccagtgggaaaactgtctgatttctggatggcaaaggctttctaaactcaaaagtgataggacaagctacagaggaaaataagtacatagatttgatttctccaaaatacagaaatgctgctgggcacagtgatgtgcagttatagtcccagctacttgggaggccaaggcaggaggattacttgagcccaggagtttgaggctgcaatgaactatgatcacaccactgcactccagcctcggcgacagagcaagaccttgtttctcaaaaataaataaatagaaggaaataaatgtaaaaatgctgcaaattaaaaacctcaaagaagggaaataattgcaacaaatgggaattgatgttgaatatttaccttaaaaacctatacaacaataagaggagtgcgcccttcagcagcatgtatacaaaaattgcaacgatacagagattagcatggcccctgcacaaggatgactcgcaaattcataaagctttccataaatatatttattaaaaaccaataggaggagcacttcgagtcgagtgtaagggcccttcacaaaagcagaaggaacactggcccaaacccccagcaccccggaagcagaggtgagatgggagcagcttgggagccccccattggcgccgccctactggggaagccggtccgtacgtaggccttgcatctcgccacctccacttctgtcctcaagaacaagtcctaggtcaagggaaacagcacagcctgtttataattaggaaacacttaaaacagcctggcatttgggaacagccatgttaacgtgagcaaattcctctcatgaaatagcctgcagctattaagaagcacgtgtgtgcaggaagcggaggcgcaggacctcaccgcgccagcgtgaagttcccgggcatggtcatgaaagcgtggttctgtaagaaatcagagggagaaagggagagaagggggagggagacaacccaaacgttggagggtatttgttgtaaacttcaaacttttggcaggtttgaaatttttcataactccggggaggagcaagaggggtgaaaagaaacaagttctctacttgtgatcagcagctggtcatagtggttgcctggagtatatgcctttttgtatcctttgaatttccagccatgtaaatgtattatttattccaaaaataaagcagatttacattttaaaaattca

SEQ ID NO: 7538 - DNA, 3858 bp, Homo sapiens
gacgcctggccccgagcccctcctcggcctcccccgggccactcttcccttgcctcagccccgcagggtctccatgcccgtccgccccgtctccctcgcccgcggtctcgcccgcgcggagtggcggacactaaatgccacaacacacggagcgcctggctcgccgcccgcagaatccggcggtccgcagcggggaacaggggccgcccgcccctcctcaggcctccgctgcgcgtcccgcgccctcggcccccggccccaccctgcatcccggctgccggtctggccgcgggctctgctccttcgccttaagattgacgtcgtgttctgtcccccactcgcagcccgcgtcccttacatccgcccaccggcgcctggccccaggccttgacactcatccagttggtgttcagtgttcgatgagtggataagtgaatgactcctttcccaatcctatttgaaggcatgggaggcagaataggtagtaagtgttaaaggatggggtgtcctggagtcagagccgggcaggtcccagcggccccttcctagctctgtgctggggcaagtgccctacctcactccgctccagtttcatcaccagtggaatggagatgagaatagtttctacctctggcttgcccccaggtttccctagatgacaaataaacattccttttcctgcgtgaagatagtctgtggaaaccttggccatggcatcgatatcagagcctgttacattcagagagttctgcccgttgtactatctcctcaatgccattccgacaaagatccagaagggtttccgctctatcgtggtctatctcacggccctcgacaccaacggggactacatcgcggtgggcagcagcatcggcatgctctatctgtactgccggcacctcaaccagatgaggaagtacaactttgaggggaagacggaatctatcactgtggtgaagctgctgagctgctttgatgacctggtggcagcaggcacagcctctggcagggttgcagtttttcaacttgtatcttcattgccagggagaaataaacagcttcggagatttgatgtcactggtattcacaaaaatagcattacagctctggcttggagccccaatggaatgaaattgttctctggagatgacaaaggcaaaattgtttattcttctctggatctagaccaggggctctgtaactcccagctggtgttggaggagccatcttccattgtgcagctggattatagccagaaagtgctgctggtctctactctgcaaagaagtctgctcttttacactgaagaaaagtctgtaaggcaaattggaacacaaccaaggaaaagtactgggaaatttggtgcttgttttataccaggactctgtaagcaaagtgatctaaccttgtatgcgtcacggcccgggctccggctatggaaggctgatgtccacgggactgttcaagccacgtttatcttaaaagatgcttttgccgggggagtcaagccttttgaactgcacccgcgtctggaatcccccaacagtggaagttgcagcttacctgagaggcacctggggcttgtttcatgtttctttcaagaaggctgggtgctgagttggaatgaatatagtatctatctcctagacacagtcaaccaggccacagttgctggtttggaaggatccggtgatattgtgtctgtttcgtgcacagaaaatgaaatatttttcttgaaaggagataggaacattataagaatttcaagcaggcctgaaggattaacatcaacagtgagagatggtctggagatgtctggatgctcagagcgtgtccacgtgcagcaagcggagaagctgccaggggccacagtttctgagacgaggctcagaggctcttccatggccagctccgtggccagcgagccaaggagcaggagcagctcgctcaactccaccgacagcggctccgggctcctgccccctgggctccaggccacccctgagctgggcaagggcagccagcccctgtcacagagattcaacgccatcagctcagaggactttgaccaggagcttgtcgtgaagcctatcaaagtgaaaaggaagaagaagaagaagaagacagaaggtggaagcaggagcacctgtcacagctccctggaatcgacaccctgctccgaatttcctggggacagtccccagtccttgaacacagacttgctgtcgatgacctcaagtgtcctgggcagtagcgtggatcagttaagtgcagagtctccagaccaggaaagcagcttcaatggtgaagtgaacggtgtcccacaggaaaatactgaccccgaaacgtttaatgtcctggaggtgtcaggatcaatgcctgattctctggctgaggaagatgacattagaactgaaatgccacactgtcaccatgcacatgggcgggagctgctcaatggagcgagggaagatgtgggaggcagtgatgtcacgggactcggagatgagccgtgtcctgcagatgatggaccaaatagcacaccacaacacacaacacacctcacctcacaccacagcacacctcaccacaccacaccgcactgcaccatacctcaccacatctcaccacaccacagcacacctcaccacacaacacaccacaccccacaccgcactgcaccgcaccgcaccgcaccgtacctcgccacatctcaccacaccacaccacaccacacctcactgcccacacacggcgcaggctgcccgcctcctggagagcacacttcagctgaaacagtaaagcctgatgggtgcaaatggaacctggatgtgtgcacgtgtgtcccaggtagggacggcacaggagggtgcatggggcgtgggggagctgagcaagggtcgctcacttagaaatgtctttggaatggtgtttaactaatgctgctggcggacatcctaaaaccagatgcatcctcagaggacgagtctactaattattgcctttgttgttgtattacaaatctgcataaaatacctcatttcaaatcaaatcttacaaatttagaagagagatatgttttccgaaaacagtggaagccctttgttccttcccgggtttgtcctgagcctgcactgtcctcgcctgcagcctcagaggggcaggcatccccgcacagacttgactggcagggcggtcacgggacctgcgggctggctccgagtggcagcccatgccttctgcggggtatgggttgacacttgacaggttgaaaccagtgcctctatggacggctgctgtggccccttcagacaatgggcagtgcccaccccgcccactggcatctgcgtgtgagggctaggccgccctgccacacatcccgccccctcccggaggcagcttcaggacaggacaccaggctggctgctttttttagcctgcccctggcccaggcccagtccttggtgtcagggagcccccaggccgcaggtggagggtgataaaatatgttctctgacaggacccagccagccacataggtggaggttttccatgtccaaatgaggtcaagatgccgaaatcccagatctgacttcacacttcccttttctagaaccttttgtaaaagttggtggcagcagaggcagccccaggccgggctgcatctctctgtgtctgttgtgccttgcccggcgcctcacggatggcaaagctctcctcacccatgggactgtagtgcaattaaacccgcgtctaggtgatgcttttaaagttgtagcttcgtgctttgtacagttttctttctggttttaatttttagttgtgctttgagtcagtgcaataaactagactttttcc

SEQ ID NO: 7539 - DNA, 4281 bp, Homo sapiens
cggcggggccgacgagtccggaggggctgccgcgggagcccccaggtttccctagatgacaaataaacattccttttcctgcgtgaagatagtctgtggaaaccttggccatggcatcgatatcagagcctgttacattcagagagttctgcccgttgtactatctcctcaatgccattccgacaaagatccagaagggtttccgctctatcgtggtctatctcacggccctcgacaccaacggggactacatcgcggtgggcagcagcatcggcatgctctatctgtactgccggcacctcaaccagatgaggaagtacaactttgaggggaagacggaatctatcactgtggtgaagctgctgagctgctttgatgacctggtggcagcaggcacagcctctggcagggttgcagtttttcaacttgtatcttcattgccagggagaaataaacagcttcggagatttgatgtcactggtattcacaaaaatagcattacagctctggcttggagccccaatggaatgaaattgttctctggagatgacaaaggcaaaattgtttattcttctctggatctagaccaggggctctgtaactcccagctggtgttggaggagccatcttccattgtgcagctggattatagccagaaagtgctgctggtctctactctgcaaagaagtctgctcttttacactgaagaaaagtctgtaaggcaaattggaacacaaccaaggaaaagtactgggaaatttggtgcttgttttataccaggactctgtaagcaaagtgatctaaccttgtatgcgtcacggcccgggctccggctatggaaggctgatgtccacgggactgttcaagccacgtttatcttaaaagatgcttttgccgggggagtcaagccttttgaactgcacccgcgtctggaatcccccaacagtggaagttgcagcttacctgagaggcacctggggcttgtttcatgtttctttcaagaaggctgggtgctgagttggaatgaatatagtatctatctcctagacacagtcaaccaggccacagttgctggtttggaaggatccggtgatattgtgtctgtttcgtgcacagaaaatgaaatatttttcttgaaaggagataggaacattataagaatttcaagcaggcctgaaggattaacatcaacagtgagagatggtctggagatgtctggatgctcagagcgtgtccacgtgcagcaagcggagaagctgccaggggccacagtttctgagacgaggctcagaggctcttccatggccagctccgtggccagcgagccaaggagcaggagcagctcgctcaactccaccgacagcggctccgggctcctgccccctgggctccaggccacccctgagctgggcaagggcagccagcccctgtcacagagattcaacgccatcagctcagaggactttgaccaggagcttgtcgtgaagcctatcaaagtgaaaaggaagaagaagaagaagaagacagaaggtggaagcaggagcacctgtcacagctccctggaatcgacaccctgctccgaatttcctggggacagtccccagtccttgaacacagacttgctgtcgatgacctcaagtgtcctgggcagtagcgtggatcagttaagtgcagagtctccagaccaggaaagcagcttcaatggtgaagtgaacggtgtcccacaggaaaatactgaccccgaaacgtttaatgtcctggaggtgtcaggatcaatgcctgattctctggctgaggaagatgacattagaactgaaatgccacactgtcaccatgcacatgggcgggagctgctcaatggagcgagggaagatgtgggaggcagtgatgtcacgggactcggagatgagccgtgtcctgcagatgatggaccaaatagcacacagttacccttccaagaacaggacagctctcctggggcgcatgatggggaagacatccaacccattggcccccaaagcactttttgtgaagtccccctcctgaactcactcactgtgccttccagcctcagctgggccccaagtgctgaacagtggctgcctgggaccagagctgatgaaggcagccccgtggagcccagccaagagcaggacatcctaaccagcatggaggcctctggccacctcagcacaaatctctggcatgctgtcactgatgatgacacaggtcagaaagaaatacccatttctgaacgtgtcttggggagtgtgggaggacagctgactccggtctctgccttggcagccagcactcacaagccctggcttgagcagcctccacgggatcagacattgacgtccagcgatgaggaggacatctatgcccacgggcttccttcttcatcctcagagacgagtgtgacagagctcggacctagttgctcccagcaggacctgagccggctgggtgcagaggacgccgggctgctcaagccagatcagtttgcagaaagctggatgggctactcgggtcccggctatggcatcctcagcttggtggtctccgagaagtatatctggtgcctggactacaaaggcggcctgttctgcagcgcgttgccgggcgccgggctgcgctggcagaagtttgaagatgctgtccagcaggtggcagtctcgccctcaggagcccttctctggaagattgaacagaaatctaaccgggcttttgcttgtgggaaagtcaccatcaaggggaagcggcactggtacgaagccctgccccaggcagtgtttgtggccctgagcgatgacacggcctggatcatcaggaccagtggggacctatacttgcagacaggtctgagcgtggatcgcccttgtgccagagccgtaaaggtggactgtccctacccgctgtcccagatcacagcccggaacaatgtggtgtgggcgctgacagagcagagggccctcctgtaccgggagggcgtgagcagcttctgtccggaaggcgagcagtggaagtgtgacattgtcagcgaaaggcaagctttagaacccgtctgcataacgctcggggatcagcagactctctgggccctggacatccatgggaacctgtggttcagaactggcattatttccaagaagccccaaggagatgacgaccattggtggcaagtgagcatcacggactatgtggtgtttgaccagtgcagcttatttcagacgataatccatgccactcactcggtggccacagcagcccaagcccccgtagaaaaggtggcagataagctgcgcatggcgttttggtcccagcagcttcagtgccagccaagccttctcggggtcaataacagcggtgtctggatctcctcgggcaagaatgaattccacgtcgctaagggaagtctcataggcacctactggaatcatgtggttccccgtgggacagcttctgctacaaaatgggcctttgtgttggcttctgcagctcccacgaaggaaggaagcttcctgtggctgtgccagagcagcaaggacctgtgcagcgtcagcgcccagagcgcacagtcgcggccctccacggtgcagctgcctcccgaagccgagatgcgcgcctatgccgcctgccaggatgcgctgtgggcgctggacagcctcggccaggtgttcatcaggacgctctccaagagctgccccacgggcatgcactggaccaggctggacctctcccagctaggagctgtaaaattgacaagcttggcatgtggaaatcagcacatctgggcctgtgattccaggggtggagtttacttccgtgtagggactcagcctctcaatcccagtctcatgcttccagcctggataatgattgagccacctgtccaggtaagcagaagttagctggtggaactcactcttcagtaagacagaaactgtgaggatgctggtactgggaaaaaggatctgcacagcctctagaggcctcccagcaaatgcggggagccatgcccccagggtctacacactctcgttcatcaacatcacaactggaattcgggatttgtgaagtttagagctgaacagactgttacagattatgagtcaacacgtatattttctctttcaaaataataatatttcgtttttgactttttactaagtgaatattattttttaaatctgcctatatattggaacctctattttataataataatgataataaatcagtacccagaagtataaagaaggtaaaagttactttgaa

SEQ ID NO: 7540 - DNA, 2571 bp, Homo sapiens
ctcaagccgcggtgtactccagcggccccctgtggcctctccatccgcggcggatctcagaggtgtggacaagcagcctactagggctagagatggacagcaggaaactgtccccccgggggaagaagctggagtcgcacctctcccaagagcacaggcggcccccactgggcctgatagcagcctggggccagcccagtatccagagcagcgttcagcagggactgcagactcaggactgggtgtgcgagccgccggaacgcaggcgcccgggccgccgctggagcgtcagcatcgacgagcgccggcggctggccacgctgggcggccgggagaggccgggcgccgccgggacccagctgcactgcagggacgtcgtgcagatggtagcccagctggtgtcggaggacgtggacaaggacgtgctccttccccacccgctgaggtccaccgagtccaccaacgccttccaggccttcctggcgcgcagtgcgcctttctggcataatgcgactttcgaggcctcgaggtcacccccttcctaagagccccattcagcccattgtctgtcttccagtgcctttccttgggggcccacggtgggggcagcctctgcgccttctttgtgccccaccagggggtcaccacccacccatgttaggaaaacaggccaggcaggacctggctccggacagcctgcagctgctgaggccttggagaccgggctaggggctatgggaggccatctaggggaggggaacactgccccgggtcagtctgagagggccctggcaaggcctgggtagcaggagcttgccctcggggccgctgggaggaggcctggggtacctgggcctgcctgaggtgcactggtgtcctgggaagccccagtggcaggcgctgcctggagactcagctccttggctggcctggtctggggaactgggtatctgcctgcaccaggctgtgagatgggccaggcagagttctccagggggcggggtctcacattgggtcctgcctctgaagacccagaagggcacacgggaccccaggggtgctgtggtggggagcagcaagcccagggacccaatgcagtgcccagcacagagggaggctgtctggaggcagagatgcctcctggcctctggacagcgatgctggtggtggacgagggccaagagggtatcctgcgcagggggtctgagcaactgtgaggagctggctgccgcaggggcctgtgggacatggtccactgggtgactgcctcgtttccaggctgcagggccctcggaagggtgctgagccggggtaacgtgtcccagctgcattttggggacactaagttgcagggggactggattgggaggcggggcaggagagctgtgagcatgggttcccagcccggggtgggtgggggtggggaaagggccctgaactctgtgactgactgttaggggcctgactgggcttctgtggaggtggctaggtggaggaggctttggggcaagcggaggtgatcactcctgggctccaggtgagggcaggagctggacctgtgcggtggcctggaccaccagatacactacatgctggctgtgctgcccacctggcctgtaaccctccccttcccgctgctgagaagccacctgactgcactgccagccacctgctgccctgacacaggatccctggcccgagttgaatcctctgcacctgcctgtctccccttcttactgtaagactcagtgaagttccctcctccttcaggaagccttccaagattacacagccaggtgctccccttctctcccaagtcctctgaatgtcatttggtgcaccctagggatcctctgcatttctcaggagccctagggtaggtggatggagggcagatcctccaggggctagggcaggtgtccttaagggtgtggggagttttgggcagggcactgtccttaagggtgtggggagttttgggtcatgacccaccccctctgaggcccctgatgatgatgtggggaatgggatcctatgggcccagctgcatgccaggcaggcatccccaggtgtaaacagggcagagcggagctgacaggtaagcagttgccatgggggtgatgagctgggcagtcctctgttgctgagtggctttaaagaaccactcgttgttctgtgacttgggggttggctgggctcatcctgccagctctcctgctctcgtttgagtgtctcctgaggctgcagtcagagcgtggtggtccaggatgctggtgatgctgggatggttgccctctctgctccatgaggtctccctacagagcacctcccccatggtggcagcagagacaaaaccctggcctccttcaggctgaggcccagagccagtctcctggtgggtaaggtggccacagggccagctggcagcagggtattggcactgagaggcacaggcctctccaacagaggtggtgccgggacaggggcagtgcctggagaccgcttaggttgtcacaactgggatttgtgtactagttttctgtagctgccataaaaattgccacaaattca

SEQ ID NO: 7541 - DNA, 866 bp, Homo sapiens
attctggagactctgattggctgggcagatgggctgactggctgggcagatgggtgggtgagttccctctccccagagccatcggccaggtaccaaagctcagctgtatggattcccaacaggaggacctgcgcttccctgggatgtgggtctcattgtactttggaatcctggggctgtgttctgtgataactggagggtgcattatctttctgcactggaggaagaacttgaggcgggaagagcatgcccagcagtgggtggaggtgatgagagctgccacattcacctacagcccattgttgtactggattaacaagcgacggcgctacggcatgaatgcagccatcaacacgggccctgcccctgctgtcaccaagactgagactgaggtccagaatccagatgttctgtgggatttggacatccccgaaggcaggagccatgctgaccaagacagcaaccccaaggcggaagcccctgctcccctgcaacctgcactgcagctggctccacagcagccccaggccagatccccattcccacttcccatctttcaggaggtgccctttgccccacccttgtgcaacctaccccccctgctgaaccactctgtctcctatcctttggccacctgtcctgaaaggaatgttctcttccattccctcctgaatctggcccaggaagaccatagcttcaatgccaagccttttccttcagaactgtagcctcctctcactgaaggtgggagctgcaggaatcaggtgcagagtaggaaatggaactaacctcaggaaggtggtattgacagaggtcaggacccacctggatgtcatgctatgaaacattaaaagaaaaaaaaaaaa

SEQ ID NO: 7542 - DNA, 1433 bp, Homo sapiens
gtaaccgcgtcgcagtcgccgaagatggcggggcgaagtctgtgtctcacgagaagcagcgttccagggactccgttcccgccacccgttcagcaaccctctacacctggacccgacctcctcgccttggaggaagaatataagcgtttaaatgcagaattgcaggcaaaaacagctgacgtggttcaacaagctaaggaaataataagagatcggcaagaagtacgatctaggcctgtttcaacacaaatgaaatcatgtgatgacgaagatgattacagtttaagaggtctgttaccatctgaagggatagttcatcttcattcagaaactaagccaaagaccaaaaacattgatcctgtaaacaaggttcaaaacaaattacactctgcaaataaaggaaggaaaacaaattcaagtgttaaattgaaatactctgatgtccaaactgccgacgatgttgccattccagaggatttctcagacttttcccttgcaaaaacaattagcaaaattgaagggcaactggaggaagaaggcttacctgaatatatagatgatattttttctggtgttagtaatgacattggaacagaagcacagatcagatttctaaaggccaaactccatgttatgcaggaggaattggataatgttgtatgtgaatgcaataaaaaggaggatgaaattcagaatttaaagtctcaagtaaaaaattttgaagaagattttatgagacagcagcgaacaattaatatgcaacagtctcaagtagaaaaatacaaaactcttttcgaagaagcaaacaaaaagtatgatggattacagcaacagttgtcttcagtagaaagggaattagaaaataaaagaagactgcaaaaacaggctgcaagtagtcaaagtgccacagaggttcgcttgaatagagctctagaagaagcagaaaagtataaactggagttaagtaaattaaggcaaaataacaaggacatagcaaatgaagaacacaaaaaaattgaagtgttaaaatcagaaaacaagaagctagaaaaacaaaaaggagaattaatgatagggttcaagaaacagttaaaattaattgatgttttaaaaaggcaaaagatgcatattgaagctgccaagatgctatctttcactgaggaggaatttatgaaagcacttgaatggggaaattcataagtgatctacttcagttagtctctatgacaataagaaaactaaggctcagagaaaaagccaaaactagtacttgcatgacacctagtcaagtcctagtagtattcgactttcattttgtggatcaatttttatttggaaaatagcagcaattctcgtaggagtcagattaaaacgtctacaactaccttgaataacttcaactatcaggataattaaaactgcaaaccactgga

SEQ ID NO: 7543 - DNA, 1768 bp, Homo sapiens
gcagtcgccgaagatggcggggcgaagtctgtgtctcacgagaagcagcgttccagggactccgttcccgccacccgttcagcaaccctctacacctggacccgacctcctcgccttggaggaagaatataagtaagaaattcggcggttgaacttttccttctttctttcatctgaatgaggctgcttacaagtacttttttctggagactggctggatcttcgggaccactcactctgcagcattcccttctcgtcatctcgttcacctgccgtttatcctttctttgtctttgatctgagtagttcgcctgcgtattagaagatatttgaagtgggcgaaaatttagcccaagcgtttaaatgcagaattgcaggcaaaaacagctgacgtggttcaacaagctaaggaaataataagagatcggcaagaagtacgatctaggcctgtttcaacacaaatgaaatcatgtgatgacgaagatgattacagtttaagaggtctgttaccatctgaagggatagttcatcttcattcagaaactaagccaaagaccaaaaacattgatcctgtaaacaaggttcaaaacaaattacactctgcaaataaaggaaggaaaacaaattcaagtgttaaattgaaatactctgatgtccaaactgccgacgatgttgccattccagaggatttctcagacttttcccttgcaaaaacaattagcaaaattgaagggcaactggaggaagaaggcttacctgaatatatagatgatattttttctggtgttagtaatgacattggaacagaagcacagatcagatttctaaaggccaaactccatgttatgcaggaggaattggataatgttgtatgtgaatgcaataaaaaggaggatgaaattcagaatttaaagtctcaagtaaaaaattttgaagaagattttatgagacagcagcgaacaattaatatgcaacagtctcaagtagaaaaatacaaaactcttttcgaagaagcaaacaaaaagtatgatggattacagcaacagttgtcttcagtagaaagggaattagaaaataaaagaagactgcaaaaacaggctgcaagtagtcaaagtgccacagaggttcgcttgaatagagctctagaagaagcagaaaagtataaactggagttaagtaaattaaggcaaaataacaaggacatagcaaatgaagaacacaaaaaaattgaagtgttaaaatcagaaaacaagaagctagaaaaacaaaaaggagaattaatgatagggttcaagaaacagttaaaattaattgatgttttaaaaaggcaaaagatgcatattgaagctgccaagatgctatctttcactgaggaggaatttatgaaagcacttgaatggggaaattcataagtgatctacttcagttagtctctatgacaataagaaaactaaggctcagagaaaaagccaaaactagtacttgcatgacacctagtcaagtcctagtagtattcgactttcattttgtggatcaatttttatttggaaaatagcagcaattctcgtaggagtcagattaaaacgtctacaactaccttgaataacttcaactatcaggataattaaaactgcaaaccactggacaaacaggacattgtttgtgctactttctttttcaaaggacagcgctatatggcttagcaaatgaagtctctccaccttttcttatcacctgccacacctaaaggtattcctgttaacagcat

SEQ ID NO: 7544 - DNA, 1372 bp, Homo sapiens
cacaaattccctctgtctcctccagaatccagaaaagaataattacgatattttcaaaatggaaagttcccatgccaaagactttgccttcttcaccaaactatgatttcgtgatgttcttaaaggtagtgtacaccaggtttttacattcttattttgaatgtagttttagtgtttgtgtgatttgtttttcagcctggcctgcagactagcaacccaagacttatactgcccaatttgacagctcatttttattttagtttcaccatatacatgaattggacttacaattccagaaaaattaaaggctcaagaatggggcatgagtacacactgtgtgctaaggaaagaatatttggattgaattgaacccctgcagaacgtggactatttagagacctgaatttggccttgggtgaatacctgccttgggttggccaactagcagtcaacagcaatgagccaaaagagacaaaccaagtttcaaaatggcaaatcaaagacttcagaaaatagctcagctaaacgtgagaaaggaatggttgtcaatagcaaagagatttctgatgcagtcgggcaatcaaaatttgttctagagaaccttcggcattacacagtccatccaaatttggcccagtactataagcctttgaaggccactgccctgcagaaattcctggctcaaaacaggaaaaacaccagcttcatgttaaaagtaacacagtatgaccaggataagacgttactgattatgaccaacaacccacctccctgctcaatcacccagcaagacaaggagagtgcatcaaaatatttttccaaggagttactgctcaaggtcatggaaagtcatcatcagcacaaacccactgagaacctctggctgccccgcatgcctcagaaaaaaaagttaagatctaagctgaaaccaatcttccctttgatactgtcggatgatcccacatccaagcgagaacaatggtttaggttttccactgacaatgatttcaagagcgaagggaagtattcaaaagtctacgctttgaggacacagaagaaaatgtaccctcagctcacctttgctccagtccatgagagagatatgaggaaagatgcttccaagaagtcagcgagtgaaaggccaatttccaaagtgattcgggaaccactgacactcgcatcgctcttggaagacatgcccaccagaaccgcgcccggggagagcgccttccgcaacgggagggccccgcagtggattatcaaaaaggccacggtcatcgggtgaacacagacccctcagtcctcccgcctcgctctcttgagactgaggggtccgcagaagtcgccacccaaataaaaccacattcctgct

SEQ ID NO: 7545 - DNA, 1161 bp, Homo sapiens
ggcccttcgcgcgcagtcccttagggggcgcctggaagcccggcgcatgcgccctgagggctcgctgacctaccgggtgccagagaggctgcggcagggtttctgtggcgtgggtcgggcagcacaggccttggtgtgtgcgagtgccaaggagggcaccgccttcaggatggaggctgtacaggagggggcggccggggtggagagtgagcaggcggctttgggggaggaggcggtgctgctgttggatgacataatggcggaggtggaggtggtggcggaggaggagggcctcgtggagcggcgggaggaggcccagcgggcacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcctgttcatctctgcaagatcatgttgttctttcggagtaacccctacttccagaataaagtgattaccaaggaatatctggtgaacatcacagaatacagggcttctcattccactccaattgagtggtatccggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaacagatcgagtcacaaaaattcaggaagagggggtaaatgtggattgtatggaatgaaaaataaacattctcaagga

SEQ ID NO: 7546 - DNA, 853 bp, Homo sapiens
atgcgccctgagggctcgctgacctaccgggtgccagagaggctgcggcagggtttctgtggcgtgggtcgggcagcacaggccttggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcctgttcatctctgcaagatcatgttgttctttcggagtaacccctacttccagaataaagtgattaccaaggaatatctggtgaacatcacagaatacagggcttctcattccactccaattgagtggtatccggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaacagatcgagtcacaaaaattcaggaagagggggtaaatgtggattgtatggaatgaaaaataaacattctcaagg

SEQ ID NO: 7547 - DNA, 1125 bp, Homo sapiens
atgcgccctgagggctcgctgacctaccgggtgccagagaggctgcggcagggtttctgtggcgtgggtcgggcagcacaggccttggtgtgtgcgagtgccaaggagggcaccgccttcaggatggaggctgtacaggagggggcggccggggtggagagtgagcaggcggctttgggggaggaggcggtgctgctgttggatgacataatggcggaggtggaggtggtggcggaggaggagggcctcgtggagcggcgggaggaggcccagcgggcacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcctgttcatctctgcaagatcatgttgttctttcggagtaacccctacttccagaataaagtgattaccaaggaatatctggtgaacatcacagaatacagggcttctcattccactccaattgagtggtatccggattatgaagtggaggcctatcgccgcagacaccacaacagcagccttaacttcttcaactggttctctgaccacaacttcgcaggatctaacaagattgctgagtcccctgacagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaacagatcgagtcacaaaaattcaggaagagggggtaaatgtggattgtatggaatgaaaaataaacattctcaagg

SEQ ID NO: 7548 - DNA, 1161 bp, Homo sapiens
ggctcttcgcgcgcagtcccttagggggcgcctggaagcccggcgcatgcgccctgagggctcgctgacctaccgggtgccagagaggctgcggcagggttcctgtggcgtgggtcgggcagcacaggccttggtgtgtgcgagtgccaaggagggcaccgccttcaggatggaggctgtgcaggagggggcggccggggtggagagtgagcaggcggctttgggggaggaggcggtgctgctgttggatgacataatggcggaggtggaggtggtggcggaggaggagggcctcgtggagcggcgggaggaggcccagcgggcacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcgtgttcatctctgcaagatcatgttgttctttcggagtaacccctacttccagaataaagtgattaccaaggaatatctggtgaacatcacagaatacagggcttctcattccactccaattgagtggtatccggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacagcagtactcagcatggtcttatgcacaggaactaaaggaaaaagagatcgagtcacaaaaattcaggaagagggggtaaatgtggattgtatggaatgaaaaataaacattctcaagga

SEQ ID NO: 7549 - DNA, 1913 bp, Homo sapiens
atgcgccctgagggctcgctgacctaccgggtgccagagaggctgcggcagggtttctgtggcgtgggtcgggcagcacaggccttggtgtgtgcgagtgccaaggagggcaccgccttcaggatggaggctgtgcaggagggggcggccggggtggagagtgagcaggcggctttgggggaggaggcggtgctgctgttggatgacataatggcggaggtggaggtggtggcggaggtggaggtggtggcggaggaggagggcctcgtggagcggcgggaggaggcccagcgggcacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcctgttcatctctgcaagatcatgttgttctttcggagtaacccctacttccagaataaagtgattaccaaggaatatctggtgaacatcacaggtgacaggtggctcccaggatgggtagtggaaggaagatggtgggtggatcattgccaacgggatccagcccccttcccacaaaaactcctgtctctgtagaatacagggcttctcattccactccaattgagtggtatccggattatgaagtggaggcgtatcgccgcagacaccacaacagcagccttaacttcttcaactggttctctgaccacaacttcgcaggatctaacaagattgctgaggtgagtcctcactgggaaacatgaggaatgaccccgtgtgttcccagctgcttgggtcacctttctgagccctgatgaggcctttcccgattgagtcccctgacagatcctatgtaaggacctgtggcgcaatcccctgcaatactacaagaggatgaagccacctgaagagggaacagagacgtcagaaattccttgagaggaagacagagagtgacagaatccaggacgttcatggcattgggctgaaaaggcacgttagagactgcactgcaaagcgggtgatagctgtggagtcttaagcccagtgaagaatcgtccatttccagaatcaatgagaagtaaagctgaaaatcattcagttcagtctgtggcacttgattccacggctgtcaaccccaccggcagtcatcccaccaaccccatgagattgggctccctgaatgtgcgtcctggtcatccttgccccaaaccacaaaggactgtttagattgatggatttccttaagctgttgccccatcagacttgtgtgtgcttttagggcccagtgcatcttgttagctgactcccctcacagacaatactgggaatggggcagggattgcgcagaacagtttgtaacacgtggtaggaggaagtttaagggatcacaaatggggaagggatatccttttctcagcgggccccacaattgaaacatttcaaagtatggctcagagaaaatgcgttttaacatgagtttgtgtttctctaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattctcaaggatgtgtg

SEQ ID NO: 7550 - DNA, 1634 bp, Homo sapiens
atgcgccctgagggctcgctgacctaccgggtgccagagaggctgcggcagggtttctgtggcgtgggtcgggcagcacaggccttggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcctgttcatctctgcaagatcatgttgttctttcggagtaacccctacttccagaataaagtgattaccaaggaatatctggtgaacatcacaggtgacaggtggctcccaggatgggtagtggaaggaagatggtgggtggatcattgccaacgggatccagcccccttcccacaaaaactcctgtctctgtagaatacagggcttctcattccactccaattgagtggtatccggattatgaagtggaggcgtatcgccgcagacaccacaacagcagccttaacttcttcaactggttctctgaccacaacttcgcaggatctaacaagattgctgaggtgagtcctcactgggaaacatgaggaatgaccccgtgtgttcccagctgcttgggtcacctttctgagccctgatgaggcctttcccgattgagtcccctgacagatcctatgtaaggacctgtggcgcaatcccctgcaatactacaagaggatgaagccacctgaagagggaacagagacgtcagaaattccttgagaggaagacagagagtgacagaatccaggacgttcatggcattgggctgaaaaggcacgttagagactgcactgcaaagcgggtgatagctgtggagtcttaagcccagtgaagaatcgtccatttccagaatcaatgagaagtaaagctgaaaatcattcagttcagtctgtggcacttgattccacggctgtcaaccccaccggcagtcatcccaccaaccccatgagattgggctccctgaatgtgcgtcctggtcatccttgccccaaaccacaaaggactgtttagattgatggatttccttaagctgttgccccatcagacttgtgtgtgcttttagggcccagtgcatcttgttagctgactcccctcacagacaatactgggaatggggcagggattgcgcagaacagtttgtaacacgtggtaggaggaagtttaagggatcacaaatggggaagggatatccttttctcagcgggccccacaattgaaacatttcaaagtatggctcagagaaaatgcgttttaacatgagtttgtgtttctctaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattctcaaggatgtgtg

SEQ ID NO: 7551 - DNA, 1160 bp, Homo sapiens
ggcccttcgcgcgcagtcccttagggggcgcctggaagcccggcgcatgcgccctgagggctcgctgacctaccgggtgccagagaggctgcggcagggtttctgtggcgtgggtcgggcagcacaggccttggtgtgtgcgagtgccaaggagggcaccgccttcaggatggaggctgtacaggagggggcggccggggtggagagtgagcaggcggctttgggggaggaggcggtgctgctgttggatgacataatggcggaggtggaggtggtggcggaggaggagggcctcgtggagcggcgggaggaggcccagcgggcacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcctgttcatctctgcaagatcatgttgttctttcggagtaacccctacttccagaataaagtgattaccaaggaatatctggtgaacatcacagaatacagggcttctcattccactccaattgagtggtatccggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattctcaagg

SEQ ID NO: 7552 - DNA, 1161 bp, Homo sapiens
ggcccttcgcgcgcagtcccttagggggcgcctggaagcccggcgcatgcgccctgagggctcgctgacctaccgggtgccagagaggctgcggcagggtttctgtggcgtgggtcgggcagcacaggccttggtgtgtgcgagtgccaaggagggcaccgccttcaggatggaggctgtacaggagggggcggccggggtggagagtgagcaggcggctttgggggaggaggcggtgctgctgttggatgacataatggcggaggtggaggtggtggcggaggaggagggcctcgtggagcggcgggaggaggcccagcgggcacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcctgttcatctctgcaagatcatgttgttctttcggagtaacccctacttccagaataaagtgattaccaaggaatatctggtgaacatcacagaatacagggcttctcattccactccaattgagtggtatccggattatgaagtggaggcgtatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattctcaagga

SEQ ID NO: 7553 - DNA, 1143 bp, Homo sapiens
atgcgccctgagggctcgctgacctaccgggtgccagagaggctgcggcagggtttctgtggcgtgggtcgggcagcacaggccttggtgtgtgcgagtgccaaggagggcaccgccttcaggatggaggctgtacaggagggggcggccggggtggagagtgagcaggcggctttgggggaggaggcggtgctgctgttggatgacataatggcggaggtggaggtggtggcggaggtggaggtggtggcggaggaggagggcctcgtggagcggcgggaggaggcccagcgggcacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcctgttcatctctgcaagatcatgttgttctttcggagtaacccctacttccagaataaagtgattaccaaggaatatctggtgaacatcacagaatacagggcttctcattccactccaattgagtggtatccggattatgaagtggaggcctatcgccgcagacaccacaacagcagccttaacttcttcaactggttctctgaccacaacttcgcaggatctaacaagattgctgagtcccctgacagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattctcaagg

SEQ ID NO: 7554 - DNA, 1179 bp, Homo sapiens
ggcccttcgcgcgcagtcccttagggggcgcctggaagcccggcgcatgcgccctgagggctcgctgacctaccgggtgccagagaggctgcggcagggtttctgtggcgtgggtcgggcagcacaggccttggtgtgtgcgagtgccaaggagggcaccgccttcaggatggaggctgtacaggagggggcggccggggtggagagtgagcaggcggctttgggggaggaggcggtgctgctgttggatgacataatggcggaggtggaggtggtggcggaggtggaggtggtggcggaggaggagggcctcgtggagcggcgggaggaggcccagcgggcacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcctgttcatctctgcaagatcatgttgttctttcggagtaacccctacttccagaataaagtgattaccaaggaatatctggtgaacatcacagaatacagggcttctcattccactccaattgagtggtatccggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattctcaagga

SEQ ID NO: 7555 - DNA, 1161 bp, Homo sapiens
ggcccttcgcgcgcagtcccttagggggcgcctggaagcccggcgcatgcgccctgagggctcgctgacctactgggtgccagagaggctgcggcagggtttctgtggcgtgggtcgggcagcacaggccttggtgtgtgcgagtgccaaggagggcaccgccttcaggatggaggctgtacaggagggggcggccggggtggagagtgagcaggcggctttgggggaggaggcggtgctgctgttggatgacataatggcggaggtggaggtggtggcggaggaggagggcctcgtggagcggcgggaggaggcccagcgggcacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcctgttcatctctgcaagatcatgttgttctttcggagtaacccctacttccagaataaagtgattaccaaggaatatctggtgaacatcacagaatacagggcttctcattccactccaattgagtggtatctggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattctcaagga

SEQ ID NO: 7556 - DNA, 1129 bp, Homo sapiens
atgcgccctgagggctcgctgacctactgggtgccagagaggctgcggcagggtttctgtggcgtgggtcgggcagcacaggccttggtgtgtgcgagtgccaaggagggcaccgccttcaggatggaggctgtacaggagggggcggccggggtggagagtgagcaggcggctttgggggaggaggcggtgctgctgttggatgacataatggcggaggtggaggtggtggcggaggtggaggtggtggcggaggaggagggcctcgtggagcggcgggaggaggcccagcgggcacagcaggctgtgcctggccctgggcccatgaccccagagtctgcactggaggagctgctggccgttcaggtggagctggagccggttaatgcccaagccaggaaggccttttctcggcagcgggaaaagatggagcggagcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcctgttcatctctgcaagatcatgttgttctttcggagtaacccctacttccagaataaagtgattaccaaggaatatctggtgaacatcacagaatacagggcttctcattccactccaattgagtggtatccggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattctcaagg

SEQ ID NO: 7557 - DNA, 1125 bp, Homo sapiens
atgcgccctgagggctcgctgacctactgggtgccagagaggctgcggcagggtttctgtggcgtgggtcgggcagcacaggccttggtgtgtgcgagtgccaaggagggcaccgccttcaggatggaggctgtacaggagggggcggccggggtggagagtgagcaggcggctttgggggaggaggcggtgctgctgttggatgacataatggcggaggtggaggtggtggcggaggaggagggcctcgtggagcggcgggaggaggcccagcgggcacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcctgttcatctctgcaagatcatgttgttctttcggagtaacccctacttccagaataaagtgattaccaaggaatatctggtgaacatcacagaatacagggcttctcattccactccaattgagtggtatctggattatgaagtggaggcctatcgccgcagacaccacaacagcagccttaacttcttcaactggttctctgaccacaacttcgcaggatctaacaagattgctgagtcccctgacagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattctcaagg

SEQ ID NO: 7558 - DNA, 1160 bp, Homo sapiens
ggcccttcgcgcgcagtcccttagggggcgcctggaagcccggcgcatgcgccctgagggctcgctgacctactgggtgccagagaggctgcggcagggtttctgtggcgtgggtcgggcagcacaggccttggtgtgtgcgagtgccaaggagggcaccgccttcaggatggaggctgtacaggagggggcggccggggtggagagtgagcaggcggctttgggggaggaggcggtgctgctgttggatgacataatggcggaggtggaggtggtggcggaggaggagggcctcgtggagcggcgggaggaggcccagcgggcacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcctgttcatctctgcaagatcatgttgttctttcggagtaacccctacttccagaataaagtgattaccaaggaatatctggtgaacatcacagaatacagggcttctcattccactccaattgagtggtatccggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattctcaagg

SEQ ID NO: 7559 - DNA, 875 bp, Homo sapiens
agggtttctgtggcgtgggtcgggcagcacaggccttggtgtgtgcgagtgccaaggagggcaccgccttcaggatggaggctgtacaggagggggcggccggggtggagagtgagcaggcggctttgggggaggaggcggtgctgctgttggatgacataatggcggaggtggaggtggtggcggaggaggagggcctcgtggagcggcgggaggaggcccagcgggcacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcctgttcatctctgcaagatcatgttgttctttcggagtaacccctacttccagaataaagtgattaccaaggaatatctggtgaacatcacagaatacagggcttctcattccactccaattgagtggtatctggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggtgagccgttagttggcact

SEQ ID NO: 7560 - DNA, 1372 bp, Homo sapiens; identical to SEQ ID NO: 7544

SEQ ID NO: 7561 - DNA, 567 bp, Homo sapiens
attcatcacaaattccctctgtctcctccagaatccagaaaagaataattacgatattttcaaaatggaaagttcccatgccaaagactttgccttcttcaccaaactatgatttcgtgatgttcttaaagcctggcctgcagactagcaacccaagacttatactgcccaatttgacagctcatttttattttagtttcaccatatacatgaattggacttacaattccagaaaaattaaaggctcaagaatggggcatgagtacacactgtgtgctaaggaaagaatatttggattgaattgaacccctgcagaacgtggactatttagagacctgaatttggccttgggtgaatacctgccttgggttggccaactagcagtcaacagcaatgagccaaaagagacaaaccaagtttcaaaatggcaaatcaaagacttcagaaaatagctcagctaaacgtgagaaaggaatggttgtcaatagcaaagagatttctgatgcagtcgggcaatcaaaatttgttctagagaaccttcggcattacacagtccatccaaatttg

SEQ ID NO: 7562 - DNA, 548 bp, Homo sapiens
aaattccctctgtctcctccagaatccagaaaagaataattacgatattttcaaaatggaaagttcccatgccaaagactttgccttcttcaccaaactatgatttcgtgatgttcttaaagtttcaccatatacatgaattggacttacaattccagaaaaattaaaggctcaagaatggggcatgagtacacactgtgtgctaaggaaagaatatttggattgaattgaacccctgcagaacgtggactatttagagacctgaatttggccttgggtgaatacctgccttgggttggccaactagcagtcaacagcaatgagccaaaagagacaaaccaagtttcaaaatggcaaatcaaagacttcagaaaatagctcagctaaacgtgagaaaggaatggttgtcaatagcaaagagatttctgatgcagtcgggcaatcaaaatttgttctagagaaccttcggcattacacagtccatccaaatttggcccagtactataagcctttgaaggccactgccctgcagaaattcctggctcaaa

SEQ ID NO: 7563 - DNA, 2046 bp, Homo sapiens
gaatgcataagatacaaagcactgggaggggggcacaaatatgtttaaaatttacatttccacttttaagggactcacagcttaagaggcagacaagacccgcacataagaaaagtgaaaacagaactacaagacactatacaatgacatgcacaaaacccagtgactatagtctagagtttgggattgcattaatctagaaaatcttctctttaaaggaatgacctgagtagtaacataaagaaagaagattcagggctgggcatggtggctcatgcctgtaatcccagcactttgggaggctgaggtgggtggatcacaaggtcaagagatcgagaccatcctggccaacatggtgaaaccccgtctctactaaaaatacaaaaattagctgggcatggtggcaggcgcctgtagtcccagctactctggaggctgaggcaggaaaatcacttgaaccagggagacagaggttgcagtgaactgagactgtgccactgcactccagccttgtgacagtgtgaggctccgtcagaagaaagagaaggagaaggagaaggagaagattcaaatggctgaagagattggggacagcattttaaaatccagaaaagaataattacgatattttcaaaatggaaagttcccatgccaaagactttgccttcttcaccaaactatgatttcgtgatgttcttaaaggctcaagaatggggcatgagtacacactgtgtgctaaggaaagaatatttggattgaattgaacccctgcagaacgtggactatttagagacctgaatttggccttgggtgaatacctgccttgggttggccaactagcagtcaacagcaatgagccaaaagagacaaaccaagtttcaaaatggcaaatcaaagacttcagaaaatagctcagctaaacgtgagaaaggaatggttgtcaatagcaaagagatttctgatgcagtcgggcaatcaaaatttgttctagagaaccttcggcattacacagtccatccaaatttggcccagtactataagcctttgaaggccactgccctgcagaaattcctggctcaaaacaggaaaaacaccagcttcatgttaaaagtaacacagtatgaccaggataagacgttactgattatgaccaacaacccacctccctgctcaatcacccagcaagacaaggagagtgcatcaaaatatttttccaaggagttactgctcaaggtcatggaaagtcatcatcagcacaaacccactgagaacctctggctgccccgcatgcctcagaaaaaaaagttaagatctaagctgaaaccaatcttccctttgatactgtcggatgatcccacatccaagcgagaacaatggtttaggttttccactgacaatgatttcaagagcgaagggaagtattcaaaagtctacgctttgaggacacagaagaaaatgtaccctcagctcacctttgctccagtccatgagagagatatgaggaaagatgcttccaagaagtcagcgagtgaaaggccaatttccaaagtgattcgggaaccactgacactcgcatcgctcttggaagacatgcccaccagaaccgcgcccggggagagcgccttccgcaacgggagggccccgcagtggattatcaaaaaggccacggtcatcgggtgaacacagacccctcagtcctcccgcctcgctctcttgagactgaggggtccgcagaagtcgccacccaaataaaaccacattcctgctgctgcgggcgtgggctcccgggtcgcaagccgggagggtcgagccgaagtctccggcgggccgcaagaggagaagggggcgtggctgcgtcccgggggccgagggcggccggggagggcgggccttggccccgagtgaaggcgcggcggcccaaccggcgtgagagcgcggggccggccttcctgcagcctcttccgctcgccggctgcggcgcctgggacggttgcggtgggtctgggcgctgggaagtcgtccaagatgattaaaaaattcgacaag

SEQ ID NO: 7564 - DNA, 1374 bp, Homo sapiens
gggagagagatcttcctctctcttcgggcgtgttaagacagcggggttggcctgtacttcctctggccctggctgaagagggctagtgaaaccgttaaacccctaggcgatcatggccttgagacctgaggaccccagtagcgggttccggcatagcaacgtggtggccttcatcaacgagaaaatggccaggcacacgaaaggccccgagttctatcttgagaatatatccttatcctgggagaaggtggaagacaagctgagggccatactggaggacagcgaggtgcccagtgaggtcaaagaggcctgcacctggggcagcctggccttgggagtgcgctttgcccacaggcaggcacagctacaaaggcacagggtgcggtggctgcacggcttcgccaaactgcacaaatcagccgcacaggccttggcatcagacctgaagaagctcagggagcagcaggagacggaacgcaaggaggcggcctcccggctaagaatggcccagaccagcctcgtggaggtgcagaaagagagagacaaggagctggtgtctccccatgagtgggagcagggggcagggtggccaggcctggccactgccggaggggtttgcacagaaggagcagctgaggaggaagaagaggcggcggtggctgctgctggtgctgctggaggaaaaggagcagaagaagagcagagggatgtggaggttgtggctgcccctgtggaggccatggctccccctgtggaggctggggctgcccccatggagacccagttcccccacgtggaggccagggctgcctccatggagaccacagagaagctggagagaatcctcctgcagctccttggagatgctgatcaggaaaagtacacctattgggggcagaaggagggagatctccggtcggtcgaaacagccacatcttatttctctggaaccacgaacccctggtccagagcctcatcagaacctcttcctgtccagctccctgcctcatactcatactcatactcaagccctttttcctccttctcagacatacccactatatcccctccacaagcaacagtcacagcaccagttccgcctcagctgccttccgactgggaggcctttgatactagcctgtggtctgatggggggccccacagaatagaccatcaggagcacccaagagacaggagatactccgaacctcatcagcaaagacctccagtatatcgcaggccaggggactgggactgcccttggtgtaacgctgtgaatttttcacggagggatacttgcttcgactgtgggaagggaatctggctgcaaaaacctcattgagtgcagaaatgcaaaatagaaccgaagcatgt

SEQ ID NO: 7565 - DNA, 4635 bp, Homo sapiens
atggactcagggccagtgtaccatggggactcacggcagctaagcgcctcaggggtgccggtcaatggtgctagagagcccgctggacccagtctgctggggactgggggtccttggcgggtagaccaaaagcccgactgggaggctgccccaggcccagctcatactgctcgcctggaagatgcccacgatctggtggccttttcggctgtggccgaagctgtgtcctcttatggggcccttagcacccggctctatgaaaccttcaaccgtgagatgagtcgtgaggctgggaacaacagcaggggaccccggccagggcctgagggctgctctgctggcagcgaagaccttgacacactgcagacggccctggccctcgcgcggcatggtatgaaaccacccaactgcaactgcgatggcccagaatgccctgactacctcgagtggctggaggggaagatcaagtctgtggtcatggaaggaggggaggagcggcccaggctcccagggcctctgcctcctggtgaggccggcctcccagcaccaagcaccaggccactcctcagctcagaggtgccccagatctctccccaagagggcctgcccctgtcccagagtgccctgagcattgccaaggaaaaaaacatcagcttgcagaccgccattgccattgaggccctcacacagctctcctctgccctcccgcagccttctcattccaccccccaggcttcttgcccccttcctgaggccttgtcacctcctgcccctttcagatctccccagtcttacctccgggctccctcatggcctgtggttcctcctgaagagcactcatcttttgctcctgatagctctgccttccctccagcaactcctagaactgagttccctgaagcctggggcactgacacccctccagcaacgccccggagctcctggcccatgcctcgcccaagccccgatcccatggctgaactggagcagttgttgggcagcgccagtgattacatccagtcagtattcaagcggcctgaggccctgcctaccaagcccaaggtcaaggtggaggcaccctcttcctccccggccccggccccatcccctgtacttcagagggaggctcccacgccatcctcggagcccgacacccaccagaaggcccagaccgccctgcagcagcacctccaccacaagcgcagcctcttcctagaacaggtgcacgacacctccttccctgctccttcagagccttctgctcctggctggtggcccccaccaagttcacctgtcccacggcttccagacagaccacccaaggagaagaagaagaagctcccaacaccagctggaggtcccgtgggaacggagaaagctgcccctgggatcaagcccagtgtccgaaagcccattcagatcaagaagtccaggccccgggaagcacagcccctcttcccacctgtccgacagattgtcctggaagggcttaggtccccagcctcccaggaagtgcaggctcatccaccggcccctctgcctgcctcacagggctctgctgtgcccctgcccccagaaccttctcttgcgctatttgcacctagtccctccagggacagcctgctgccccctactcaggaaatgaggtcccccagccccatgacagccttgcagccaggctccactggccctcttccccctgccgatgacaagctggaagagctcatccggcagtttgaggctgaatttggagatagctttgggcttcccggccccccttctgtgcccattcaggaccccgagaaccagcaaacatgtctcccagcccctgagagcccctttgctacccgttcccccaagcaaatcaagattgagtcttcgggggctgtgactgtgctctcaaccacctgcttccattcagaggagggaggacaggaggccacacccaccaaggctgagaacccactcacacccaccctcagtggcttcttggagtcacctcttaagtacctggacacacccaccaagagtctgctggacacacctgccaagagagcccaggccgagttccccacctgcgattgcgtcgaacaaatagtggagaaagatgaaggtccatattatactcacttgggatctggccccacggtcgcctctatccgggaactcatggaggagcggtatggagagaaggggaaagccatccggatcgagaaggtcatctacacggggaaggagggaaagagctcccgcggttgccccattgcaaagtgggtgatccgcaggcacacgctggaggagaagctactctgcctggtgcggcaccgggcaggccaccactgccagaacgctgtgatcgtcatcctcatcctggcctgggagggcattccccgtagcctcggagacaccctctaccaggagctcaccgacaccctccggaagtatgggaaccccaccagccggagatgcggcctcaacgatgaccggacctgcgcttgccaaggcaaagaccccaacacctgtggtgcctccttctcctttggttgttcctggagcatgtacttcaacggctgcaagtatgctcggagcaagacacctcgcaagttccgcctcgcaggggacaatcccaaagaggaagaagtgctccggaagagtttccaggacctggccaccgaagtcgctcccctgtacaagcgactggcccctcaggcctatcagaaccaggtgaccaacgaggaaatagcgattgactgccgtctggggctgaaggaaggacggcccttcgcgggggtcacggcctgcatggacttctgtgcccacgcccacaaggaccagcataacctctacaatgggtgcaccgtggtctgcaccctgaccaaggaagacaatcgctgcgtgggcaagattcccgaggatgagcagctgcatgttctccccctgtacaagatggccaacacggatgagtttggtagcgaggagaaccagaatgcaaaggtgggcagcggagccatccaggtgctcaccgccttcccccgcgaggtccgacgcctgcccgagcctgccaagtcctgccgccagcggcagctggaagccagaaaggcagcagccgagaagaagaagattcagaaggagaagctgagcactccggagaagatcaagcaggaggccctggagctggcgggcattacgtcggacccaggcctgtctctgaagggtggattgtcccagcaaggcctgaagccctccctcaaggtggagccgcagaaccacttcagctccttcaagtacagcggcaacgcggtggtggagagctactcggtgctgggcaactgccggccctccgacccttacagcatgaacagcgtgtactcctaccactcctactatgcacagcccagcctgacctccgtcaatggcttccactccaagtacgctctcccgtcttttagctactatggctttccatccagcaaccccgtcttcccctctcagttcctgggtcctggtgcctgggggcacagtggcagcagtggcagttttgagaagaagccagacctccacgctctgcacaacagcctgagcccggcctacggtggtgctgagtttgccgagctgcccagccaggctgttcccacagacgcccaccaccccactcctcaccaccagcagcctgcgtacccaggccccaaggagtatctgcttcccaaggcccccctactccactcagtgtccagggacccctccccctttgcccagagctccaactgctacaacagatccatcaagcaagagccagtagacccgctgacccaggctgagcctgtgcccagagacgctggcaagatgggcaagacacctctgtccgaggtgtctcagaatggaggacccagtcacctttggggacagtactcaggaggcccaagcatgtcccccaagaggactaacggtgtgggtggcagctggggtgtgttctcgtctggggagagtcctgccatcgtccctgacaagctcagttcctttggggccagctgcctggccccttcccacttcacagatggccagtgggggctgttccccggtgaggggcagcaggcagcttcccactctggaggacggctgcgaggcaaaccgtggagcccctgcaagtttgggaacagcacctcggccttggctgggcccagcctgactgagaagccgtgggcgctgggggcaggggatttcaactcggccctgaaaggtagtcctgggttccaagacaagctgtggaaccccatgaaaggagaggagggcaggattccagccgcaggggccagccagctggtcttctaccagcacaagaacctcaaccagcccaaccacgggctggccctctgggaagccaagatgaagcagctggcggagagggcacgggcacggcaggaggaggctgcccggctgggcctgggccagcaggaggccaagctctacgggaagaagcgcaagtgggggggcactgtggttgctgagccccagcagaaagagaagaagggggtcgtccccacccggcaggcactggctgtgcccacagactcggcggtcaccgtgtcctcctatgcctacacgaaggtcactggcccctacagccgctggatctag

SEQ ID NO: 7566 - DNA, 5378 bp, Homo sapiens
atggactcagggccagtgtaccatggggactcacggcagctaagcgcctcaggggtgccggtcaatggtgctagagagcccgctggacccagtctgctggggactgggggtccttggcgggtagaccaaaagcccgactgggaggctgccccaggcccagctcatactgctcgcctggaagatgcccacgatctggtggccttttcggctgtggccgaagctgtgtcctcttatggggcccttagcacccggctctatgaaaccttcaaccgtgagatgagtcgtgaggctgggaacaacagcaggggaccccggccagggcctgagggctgctctgctggcagcgaagaccttgacacactgcagacggccctggccctcgcgcggcatggtatgaaaccacccaactgcaactgcgatggcccagaatgccctgactacctcgagtggctggaggggaagatcaagtctgtggtcatggaaggaggggaggagcggcccaggctcccagggcctctgcctcctggtgaggccggcctcccagcaccaagcaccaggccactcctcagctcagaggtgccccagatctctccccaagagggcctgcccctgtcccagagtgccctgagcattgccaaggaaaaaaacatcagcttgcagaccgccattgccattgaggccctcacacagctctcctctgccctcccgcagccttctcattccaccccccaggcttcttgcccccttcctgaggccttgtcacctcctgcccctttcagatctccccagtcttacctccgggctccctcatggcctgtggttcctcctgaagagcactcatcttttgctcctgatagctctgccttccctccagcaactcctagaactgagttccctgaagcctggggcactgacacccctccagcaacgccccggagctcctggcccatgcctcgcccaagccccgatcccatggctgaactggagcagttgttgggcagcgccagtgattacatccagtcagtattcaagcggcctgaggccctgcctaccaagcccaaggtcaaggtggaggcaccctcttcctccccggccccggccccatcccctgtacttcagagggaggctcccacgccatcctcggagcccgacacccaccagaaggcccagaccgccctgcagcagcacctccaccacaagcgcagcctcttcctagaacaggtgcacgacacctccttccctgctccttcagagccttctgctcctggctggtggcccccaccaagttcacctgtcccacggcttccagacagaccacccaaggagaagaagaagaagctcccaacaccagctggaggtcccgtgggaacggagaaagctgcccctgggatcaagcccagtgtccgaaagcccattcagatcaagaagtccaggccccgggaagcacagcccctcttcccacctgtccgacagattgtcctggaagggcttaggtccccagcctcccaggaagtgcaggctcatccaccggcccctctgcctgcctcacagggctctgctgtgcccctgcccccagaaccttctcttgcgctatttgcacctagtccctccagggacagcctgctgccccctactcaggaaatgaggtcccccagccccatgacagccttgcagccaggctccactggccctcttccccctgccgatgacaagctggaagagctcatccggcagtttgaggctgaatttggagatagctttgggcttcccggccccccttctgtgcccattcaggaccccgagaaccagcaaacatgtctcccagcccctgagagcccctttgctacccgttcccccaagcaaatcaagattgagtcttcgggggctgtgactgtgctctcaaccacctgcttccattcagaggagggaggacaggaggccacacccaccaaggctgagaacccactcacacccaccctcagtggcttcttggagtcacctcttaagtacctggacacacccaccaagagtctgctggacacacctgccaagagagcccaggccgagttccccacctgcgattgcgtcgaacaaatagtggagaaagatgaaggtccatattatactcacttgggatctggccccacggtcgcctctatccgggaactcatggaggagcggtatggagagaaggggaaagccatccggatcgagaaggtcatctacacggggaaggagggaaagagctcccgcggttgccccattgcaaagtgggtgatccgcaggcacacgctggaggagaagctactctgcctggtgcggcaccgggcaggccaccactgccagaacgctgtgatcgtcatcctcatcctggcctgggagggcattccccgtagcctcggagacaccctctaccaggagctcaccgacaccctccggaagtatgggaaccccaccagccggagatgcggcctcaacgatgaccggacctgcgcttgccaaggcaaagaccccaacacctgtggtgcctccttctcctttggttgttcctggagcatgtacttcaacggctgcaagtatgctcggagcaagacacctcgcaagttccgcctcgcaggggacaatcccaaagaggaagaagtgctccggaagagtttccaggacctggccaccgaagtcgctcccctgtacaagcgactggcccctcaggcctatcagaaccaggtgaccaacgaggaaatagcgattgactgccgtctggggctgaaggaaggacggcccttcgcgggggtcacggcctgcatggacttctgtgcccacgcccacaaggaccagcataacctctacaatgggtgcaccgtggtctgcaccctgaccaaggaagacaatcgctgcgtgggcaagattcccgaggatgagcagctgcatgttctccccctgtacaagatggccaacacggatgagtttggtagcgaggagaaccagaatgcaaaggtgggcagcggagccatccaggtgctcaccgccttcccccgcgaggtccgacgcctgcccgagcctgccaagtcctgccgccagcggcagctggaagccagaaaggcagcagccgagaagaagaagattcagaaggagaagctgagcactccggagaagatcaagcaggaggccctggagctggcgggcattacgtcggacccaggcctgtctctgaagggtggattgtcccagcaaggcctgaagccctccctcaaggtggagccgcagaaccacttcagctccttcaagtacagcggcaacgcggtggtggagagctactcggtgctgggcaactgccggccctccgacccttacagcatgaacagcgtgtactcctaccactcctactatgcacagcccagcctgacctccgtcaatggcttccactccaagtacgctctcccgtcttttagctactatggctttccatccagcaaccccgtcttcccctctcagttcctgggtcctggtgcctgggggcacagtggcagcagtggcagttttgagaagaagccagacctccacgctctgcacaacagcctgagcccggcctacggtggtgctgagtttgccgagctgcccagccaggctgttcccacagacgcccaccaccccactcctcaccaccagcagcctgcgtacccaggccccaaggagtatctgcttcccaaggcccccctactccactcagtgtccagggacccctccccctttgcccagagctccaactgctacaacagatccatcaagcaagagccagtagacccgctgacccaggctgagcctgtgcccagagacgctggcaagatgggcaagacacctctgtccgaggtgtctcagaatggaggacccagtcacctttggggacagtactcaggaggcccaagcatgtcccccaagaggactaacggtgtgggtggcagctggggtgtgttctcgtctggggagagtcctgccatcgtccctgacaagctcagttcctttggggccagctgcctggccccttcccacttcacagatggccagtgggggctgttccccggtgaggggcagcaggcagcttcccactctggaggacggctgcgaggcaaaccgtggagcccctgcaagtttgggaacagcacctcggccttggctgggcccagcctgactgagaagccgtgggcgctgggggcaggggatttcaactcggccctgaaaggtagtcctgggttccaagacaagctgtggaaccccatgaaaggagaggagggcaggattccagccgcaggggccagccagctggacagggcctggcagtcctttggtctgcccctgggatccagcgagaagctgtttggggctctgaagtcagaggagaagctgtgggaccccttcagcctggaggaggggccggctgaggagccccccagcaagggagcggtgaaggaggagaagggcggtggtggtgcggaggaggaagaggaggagctgtggtcggacagtgaacacaacttcctggacgagaacatcggcggcgtggccgtggccccagcccacggctccatcctcatcgagtgtgcccggcgggagctgcacgccaccacgccgcttaagaagcccaaccgctgccaccccacccgcatctcgctggtcttctaccagcacaagaacctcaaccagcccaaccacgggctggccctctgggaagccaagatgaagcagctggcggagagggcacgggcacggcaggaggaggctgcccggctgggcctgggccagcaggaggccaagctctacgggaagaagcgcaagtgggggggcactgtggttgctgagccccagcagaaagagaagaagggggtcgtccccacccggcaggcactggctgtgcccacagactcggcggtcaccgtgtcctcctatgcctacacgaaggtcactggcccctacagccgctggatctaggtgccagggagccagcgtacctcagcgtcgggcctggcccgagctgtctctgtggtgcttttgccctcatacctgggggcgggttgggggtgcagaagtctttttatctctatatacatatatagatgcgcatatcatatatatgtatttatggtccaaacctcagaactgacccgcccctcccttacccccacttccccagcactttgaagaagaaactacggctgtcgggtgatttttccgtgatcttaatatttatatctccaagttgtcccccccccttgtctggggggtttttatttttattttctctttgtttttaaaactctatccttgtatatcacaataatggaaagaaagtttatagtatcctttcacaaaggagtagttttaaa

SEQ ID NO: 7567 - DNA, 2164 bp, Homo sapiens
aaaatgatggctatgtggacatgagcagcttcaacacctttaagaacaatcagcagagcacagaccaggacgcagaaagacagagtcttgccctgttgcccaggctggagtatagtagtgcagtggtgtgatcatagctcactgtaacttcgaccacctgggctcaaacaatccttcttcctctgcctcccaagtagctgggactacagagcaggacccaggatgcaagaccctaggcatccccaaggccttccactgtccccaggccttccaaagagacagcggcaggaccgcacaatctacaactggaaacagcaggaagtgctagaaaatcactttaaggaggaacagtacccagactatgacacacgacaagagctggcggagatgctcaatctcagggagtaccaagtgcaggtgtggttcaagaatcgccgggccaaacgctctcgggagcggtggttccagaagcagctccagcagctccagaagcatcctcagcagcagcatcctcagcagcagcatccccagcagcagctccagcagcagcagccccagcagcagccccagcagcagcagccccagcagcagccacagcagcagcagccccagcagcagcagctccaccagcagccccagtagcagctctagcagcagcagcagcagccccagcagcagcaactccagtagcagctccagcagcagcagccccagcagtagctccagcagcagcagcagcagccccagtagcagctccagcagccccagtagcagctccagcagcagcagcagcagccccagtagcagctccagcagccccagtagcagctctagcagcagcagctccagcagcagcagtcccagcagcagcagccccagtagcagcggcagcagccccagtagcagcaacagcagccccagtagtagcagcagcagccccagtagcagcagcagcagccccagcccccgtagcagcagccccagcagcagcagctccagcaccagcagtcccagcagcagcagtcccagcagcagcagccccagcagcagctgccccagtgcagccctgggcaggaggccacagagcccacagagctcgcactgtgccccctttccctgaagctgcggcctctgccccccatcagcctggcctcttgggaattctcccacagggagaggccccgtgggtattctcccacaatctgcagcctccaccaggccttgagtagctttgggtgcagagccaggagggcgtttggctgtcctaggtctagcccctggcccaatcccagccccattccaggcccactcaaaagccaaggcccaatcccaggtccaggctcaatcctaggccctggcctgattccaagccaggcttactcccaggcccaggcttagtcctagccccaatcccaggtcctggcccaatcccaaacttaggatccctcccagccccagccctagtccccttgtgacctcagagcacttatgcctccaatttcttgccagacagtcattccctgacttcacagagctcctcccacccctagaccagttcgaggaatccttggtctccaccacgacatctcagtaccaagagggggatggctctatggacaaaaagactcgggccccaagtgattaatggatttatagggggcctgtgtctgcaaagtcctgcggataccagtggacctggagtggctggttggtctacactgctggtgaatgcaccaccaccatttaaccaccctgccgctggtgggcatttgctgtcttcactgtgtggccatcacgactagctctgctatgaatgcacctgccctcatttgagttgagcctgagcatttcgcagctgggattggagtcgctgctcatggggatgtttggcattagtggatgctacttgagagctttgtaaagagctttactcagcacttctgatagtcagcattctccctgacacttaggattgtgagactttttaatgtttgtggatccaatggcttatggcttccctgatgactgagaggttgagaagttctcacatgttaattgaaccttagaaatcctcatatgtgtccatttgtttgcccatttttcttcatttatttgaatgtatttttatattctcttgataattaaagtgctgcaaacacccccc

SEQ ID NO: 7568 - DNA, 2350 bp, Homo sapiens
ctccctgcctgtcgagtctgcacacgggtttcacgccctcccctgtgttctggccaggagactttgcgttcggttggaattgttacagagttcagctggaggtttccttctccctgtggccttttcccagttcctctggcagccctcctcaaggacccctgtgagataagtcagaggtgactttcctggggacccagagaacccacaaggcttttcccactgcttactgtattttgctcggctctctaaattgaatcaattgcagacagagtcttgccctgttgcccaggctggagtatagtagtgcagtggtgtgatcatagctcactgtaacttcgaccacctgggctcaaacaatccttcttcctctgcctcccaagtagctgggactacagagcaggacccaggatgcaagaccctaggcatccccaaggccttccactgtccccaggccttccaaagagacagcggcaggaccgcacaatctacaactggaaacagcaggaagtgctagaaaatcactttaaggaggaacagtacccagactatgacacacgacaagagctggcggagatgctcaatctcagggagtaccaagtgcaggtgtggttcaagaatcgccgggccaaacgctctcgggagcggtggttccagaagcagctccagcagctccagaagcatcctcagcagcagcatcctcagcagcagcatccccagcagcagctccagcagcagcagccccagcagcagccccagcagcagcagccccagcagcagccacagcagcagcagccccagcagcagcagctccaccagcagccccagtagcagctctagcagcagcagcagcagccccagcagcagcaactccagtagcagctccagcagcagcagccccagcagtagctccagcagcagcagcagcagccccagtagcagctccagcagccccagtagcagctccagcagcagcagcagcagccccagtagcagctccagcagccccagtagcagctctagcagcagcagctccagcagcagcagtcccagcagcagcagccccagtagcagcggcagcagccccagtagcagcaacagcagccccagtagtagcagcagcagccccagtagcagcagcagcagccccagcccccgtagcagcagccccagcagcagcagctccagcaccagcagtcccagcagcagcagtcccagcagcagcagccccagcagcagctgccccagtgcagccctgggcaggaggccacagagcccacagagctcgcactgtgccccctttccctgaagctgcggcctctgccccccatcagcctggcctcttgggaattctcccacagggagaggccccgtgggtattctcccacaatctgcagcctccaccaggccttgagtagctttgggtgcagagccaggagggcgtttggctgtcctaggtctagcccctggcccaatcccagccccattccaggcccactcaaaagccaaggcccaatcccaggtccaggctcaatcctaggccctggcctgattccaagccaggcttactcccaggcccaggcttagtcctagccccaatcccaggtcctggcccaatcccaaacttaggatccctcccagccccagccctagtccccttgtgacctcagagcacttatgcctccaatttcttgccagacagtcattccctgacttcacagagctcctcccacccctagaccagttcgaggaatccttggtctccaccacgacatctcagtaccaagagggggatggctctatggacaaaaagactcgggccccaagtgattaatggatttatagggggcctgtgtctgcaaagtcctgcggataccagtggacctggagtggctggttggtctacactgctggtgaatgcaccaccaccatttaaccaccctgccgctggtgggcatttgctgtcttcactgtgtggccatcacgactagctctgctatgaatgcacctgccctcatttgagttgagcctgagcatttcgcagctgggattggagtcgctgctcatggggatgtttggcattagtggatgctacttgagagctttgtaaagagctttactcagcacttctgatagtcagcattctccctgacacttaggattgtgagactttttaatgtttgtggatccaatggcttatggcttccctgatgactgagaggttgagaagttctcacatgttaattgaaccttagaaatcctcatatgtgtccatttgtttgcccatttttcttcatttatttgaatgtatttttatattctcttgataattaaagtgctgcaaacacccccc

SEQ ID NO: 7569 - DNA, 2250 bp, Homo sapiens
ggacccctgtgagataagtcagaggtgactttcctggggacccagagaacccacaaggcttttcccactgcttactgtattttgctcggctctctaaattgaatcaattgcaggtaagtcagggatttcttcttggtttggatccactgctggtgagcagacagagtcttgccctgttgcccaggctggagtatagtagtgcagtggtgtgatcatagctcactgtaacttcgaccacctgggctcaaacaatccttcttcctctgcctcccaagtagctgggactacagaacagagcaggacccaggatgcaagaccctaggcatccccaaggccttccactgtccccaggccttccaaagagacagcggcaggaccgcacaatctacaactggaaacagcaggaagtgctagaaaatcactttaaggaggaacagtacccagactatgacacacgacaagagctggcggagatgctcaatctcagggagtaccaagtgcaggtgtggttcaagaatcgccgggccaaacgctctcgggagcggtggttccagaagcagctccagcagctccagaagcatcctcagcagcagcatcctcagcagcagcatccccagcagcagctccagcagcagcagccccagcagcagccccagcagcagcagccccagcagcagccacagcagcagcagccccagcagcagcagctccaccagcagccccagtagcagctctagcagcagcagcagcagccccagcagcagcaactccagtagcagctccagcagcagcagccccagcagtagctccagcagcagcagcagcagccccagtagcagctccagcagccccagtagcagctccagcagcagcagcagcagccccagtagcagctccagcagccccagtagcagctctagcagcagcagctccagcagcagcagtcccagcagcagcagccccagtagcagcggcagcagccccagtagcagcaacagcagccccagtagtagcagcagcagccccagtagcagcagcagcagccccagcccccgtagcagcagccccagcagcagcagctccagcaccagcagtcccagcagcagcagtcccagcagcagcagccccagcagcagctgccccagtgcagccctgggcaggaggccacagagcccacagagctcgcactgtgccccctttccctgaagctgcggcctctgccccccatcagcctggcctcttgggaattctcccacagggagaggccccgtgggtattctcccacaatctgcagcctccaccaggccttgagtagctttgggtgcagagccaggagggcgtttggctgtcctaggtctagcccctggcccaatcccagccccattccaggcccactcaaaagccaaggcccaatcccaggtccaggctcaatcctaggccctggcctgattccaagccaggcttactcccaggcccaggcttagtcctagccccaatcccaggtcctggcccaatcccaaacttaggatccctcccagccccagccctagtccccttgtgacctcagagcacttatgcctccaatttcttgccagacagtcattccctgacttcacagagctcctcccacccctagaccagttcgaggaatccttggtctccaccacgacatctcagtaccaagagggggatggctctatggacaaaaagactcgggccccaagtgattaatggatttatagggggcctgtgtctgcaaagtcctgcggataccagtggacctggagtggctggttggtctacactgctggtgaatgcaccaccaccatttaaccaccctgccgctggtgggcatttgctgtcttcactgtgtggccatcacgactagctctgctatgaatgcacctgccctcatttgagttgagcctgagcatttcgcagctgggattggagtcgctgctcatggggatgtttggcattagtggatgctacttgagagctttgtaaagagctttactcagcacttctgatagtcagcattctccctgacacttaggattgtgagactttttaatgtttgtggatccaatggcttatggcttccctgatgactgagaggttgagaagttctcacatgttaattgaaccttagaaatcctcatatgtgtccatttgtttgcccatttttcttcatttatttgaatgtatttttatattctcttgataattaaagtgctgcaaacacccccc

SEQ ID NO: 7570 - DNA, 549 bp, Homo sapiens
aaactaaaatgatggctatgtggacatgagcagcttcaacacctttaagaacaatcagcagagcacagaccaggacgcagaaagattatttatgaaaactgcaatagtcatcatttaaagttatggaactgtgtccggaattggtgggttcttggtctcactgacttcaagaatgaagccgcggacccttgcggtaagtcagggatttcttcttggtttggatccactgctggtgagcagaacagagcaggacccaggatgcaagaccctaggcatccccaaggccttccactgtccccaggccttccaaagagacagcggcaggaccgcacaatctacaactggaaacagcaggaagtgctagaaaatcactttaaggaggaacagtacccagactatgacacacgacaagagctggcggagatgctcaatctcagggagtaccaagtgcaggtgtggttcaagaatcgccgggccaaacgctctcgggagcggtggttccagaagcagctccagcagctccagaagcatcctcagcagcagcatcct

SEQ ID NO: 7571 - DNA, 508 bp, Homo sapiens
ttgcataaatgtttcaagtatctaacagacagcttacagtagatgtacacaatggtttgcaataagatctactctccttcctctggttcaaggaaaaaaattatctggatttttgccacttcaagaccaagactgctgccatgctagaaaagggctggggtaagacagagtcttgccctgttgcccaggctggagtatagtagtgcagtggtgtgatcatagctcactgtaacttcgaccacctgggctcaaacaatccttcttcctctgcctcccaagtagctgggactacagagcaggacccaggatgcaagaccctaggcatccccaaggccttccactgtccccaggccttccaaagagacagcggcaggaccgcacaatctacaactggaaacagcaggaagtgctagaaaatcactttaaggaggaacagtacccagactatgacacacgacaagagctggcggagatgctcaatctcagggagtaccaagtgcaggtgtgg

SEQ ID NO: 7572 - DNA, 563 bp, Homo sapiens
ttgttacagagttcagctggaggtttccttctccctgtggccttttcccagttcctctggcagccctcctcaaggacccctgtgagataagtcagaggtgactttcctggggacccagagaacccacaaggcttttcccactgcttactgtattttgctcggctctctaaattgaatcaattgcagagcaggacccaggatgcaagaccctaggcatccccaaggccttccactgtccccaggccttccaaagagacagcggcaggaccgcacaatctacaactggaaacagcaggaagtgctagaaaatcactttaaggaggaacagtacccagactatgacacacgacaagagctggcggagatgctcaatctcagggagtaccaagtgcaggtgtggttcaagaatcgccgggccaaacgctctcgggagcggtggttccagaagcagctccagcagctccagaagcatcctcagcagcagcatcctcagcagcagcatccccagcagcagctccagcagcagcagccccagcagcagccccagcagcagcagccccagc

SEQ ID NO: 7573 - DNA, 597 bp, Homo sapiens
agagtctcgctctgtcgcccaggctggcagcctccctagtagctgggactacaggcacctgccaccacgcctagctaattttttgtatttttttagtagagacggggtttcactgtgttagccaggtctccatctcctgacctcgtgatctgcctgcctcggcatcccaaagtgctgggattacagacagagtcttgccctgttgcccaggctggagtatagtagtgcagtggtgtgatcatagctcactgtaacttcgaccacctgggctcaaacaatccttcttcctctgcctcccaagtagctgggactacagagcaggacccaggatgcaagaccctaggcatccccaaggccttccactgtccccaggccttccaaagagacagcggcaggaccgcacaatctacaactggaaacagcaggaagtgctagaaaatcactttaaggaggaacagtacccagactatgacacacgacaagagctggcggagatgctcaatctcagggagtaccaagtgcaggtgtggttcaagaatcgccgggccaaacgctctcgggagcggtggttccagaagcagctccagcagctccaga

SEQ ID NO: 7574 - DNA, 539 bp, Homo sapiens
gattttttgtataaggtgagagatgaggatccagttttggtctcctacacgtggctagccaattatcccagcaccatttgtggaaaaggatgccctttccccactttatgattttgtttgctttgttgaagatcagttggctacagagtcttgccctgttgcccaggctggagtatagtagtgcagtggtgtgatcatagctcactgtaacttcgaccacctgggctcaaacaatccttcttcctctgcctcccaagtagctgggactacagagcaggacccaggatgcaagaccctaggcatccccaaggccttccactgtccccaggccttccaaagagacagcggcaggaccgcacaatctacaactggaaacagcaggaagtgctagaaaatcactttaaggaggaacagtacccagactatgacacacgacaagagctggcggagatgctcaatctcagggagtaccaagtgcaggtgtggttcaagaatcgccgggccaaacgctctcgggagcggtggttccagaagcagct

SEQ ID NO: 7575 - DNA, 533 bp, Homo sapiens
agagccctgtccacagcaaactaaaatgatggctatgtggacatgagcagcttcaacacctttaagaacaatcagcagagcacagaccaggacgcagaaagattatttatgaaaactgcaatagtcatcatttaaagttatggaactgtgtccggaattggtgggttcttggtctcactgacttcaagaatgaagccgcggacccttgcgacagagtcttgccctgttgcccaggctggagtatagtagtgcagtggtgtgatcatagctcactgtaacttcgaccacctgggctcaaacaatccttcttcctctgcctcccaagtagctgggactacagaacagagcaggacccaggatgcaagaccctaggcatccccaaggccttccactgtccccaggccttccaaagagacagcggcaggaccgcacaatctacaactggaaacagcaggaagtgctagaaaatcactttaaggaggaacagtacccagactatgacacacgacaagagctggcggagatgctcaatc

SEQ ID NO: 7576 - DNA, 771 bp, Homo sapiens
cagcgctgaccattcagactatgagaacattccaaccatgaactcagactatgagaatatccagattctgccctggaggcctgcagggctggtgtgttcaggaagctgtttgaagatcagagcagagccctgtccacagcaaactaaaatgatggctatgtggacatgagcagcttcaacacctttaagaacaatcagcagagcacagaccaggacgcagaaaggagtggacaacacctggccccagctgagtgcctcctagcactgaggaaagcagaaccaagctttgcaacaatgaactctccttgctggaagagaccgcccacctctaacagaattttgtagctggaggaaacttcagacacaagtcctgttacagaagaggaaactggcacagagaggaaatggtgcttgcataaggtctctggacagagtcttgccctgttgcccaggctggagtatagtagtgcagtggtgtgatcatagctcactgtaacttcgaccacctgggctcaaacaatccttcttcctctgcctcccaagtagctgggactacagagcaggacccaggatgcaagaccctaggcatccccaaggccttccactgtccccaggccttccaaagagacagcggcaggaccgcacaatctacaactggaaacagcaggaagtgctagaaaatcactttaaggaggaacagtacccagactatgacacacgacaagagctggcggagatgctcaatctcagggagtaccaagtgcaggtgtg

SEQ ID NO: 7577 - DNA, 932 bp, Homo sapiens
tctggagatctgttttctggttttggctgtgccataaacgattatttatgaaaactgcaatagtcatcatttaaagttatggaactgtgtccggaattggtgggttcttggtctcactgacttcaagaatgaagccgcggacccttgcggtaagtcagggatttcttcttggtttggatccactgctggtgagcagacagagtcttgccctgttgcccaggctggagtatagtagtgcagtggtgtgatcatagctcactgtaacttcgaccacctgggctcaaacaatccttcttcctctgcctcccaagtagctgggactacagaacagagcaggacccaggatgcaagaccctaggcatccccaaggccttccactgtccccaggccttccaaagagacagcggcaggaccgcacaatctacaactggaaacagcaggaagtgctagaaaatcactttaaggaggaacagtacccagactatgacacacgacaagagctggcggagatgctcaatctcagggagtaccaagtgcaggtgtggttcaagaatcgccgggccaaacgctctcgggagcggtggttccagaagcagctccagcagctccagaagcatcctcagcagcagcatcctcagcagcagcatccccagcagcagctccagcagcagcagccccagcagcagccccagcagcagcagccccagcagcagccacagcagcagcagccccagcagcagcagctccaccagcagccccagtagcagctctagcagcagcagcagcagccccagcagcagcaactccagtagcagctccagcagcagcagccccagcagtagctccagcagcagcagcagcagccccagtagcagctccagcagccccagtagcagctccagcagcagcagcagcagccccagtagcagctc

SEQ ID NO: 7578 - DNA, 998 bp, Homo sapiens
tgaaacgaacgcagcatttcagggactggatgaggagcttacggttttttacagaatcatcaatatcttggaagaaaaagaatgttaagaaataacaaaacaataattattaagtactttcttaatctcattaatggagctttcttggttcttggacttttattcatgggatttggtgcatggctcttattagatagaaataattttttaacagcttttgatgaaaataatcacttcatagtacctatttctcaaattttgattggaatgggatcttctactgttcttttttgtctattgggttatataggaattcacaacgaaatcagatggctcctaattgtgtatgcagtattgataacatggacctttgctgttcaggttgtactttcagcattcatcatcacaaagaaagaggaggttcagcaactatggcatgacaaaattgattttgtcatttctgagtatggatctaaagataagcctgaagatataaccaagtggactattctgaatgccttacagaaaacattacagtgttgtggccaacataattacacagactggataaagaataagaacaaagaaaattcaggacaggtgccatgttcttgcacaaagtcaactttaagaaaatggttttgtgatgagccactgaatgcaacttaccttgagggttgtgaaaataaaatcagtgcatggtataatgttaatgtgttaaccttaatcggaattaactttggacttttaacttcagaggttttccaagtctcattaacagtttgtttcttcaaaaacatcaagaatataatccatgcagaaatgtgacctttggatttcaatttgttcagaagaaaccagttaattcttaaaaaatcacattatattattttattccaaaaacgttttgaattgtattaaataacagatgtattcaaattattaattatatgtaatattgaattactgaatactataataaaacattcatgaaatta

SEQ ID NO: 7579 - DNA, 463 bp, Homo sapiens
gaacgcagcatttcagggactggatgaggagcttacggttttttacagagacagggtctccctctgttgcccaggctggagtgcagtggtacaattattgctcactgtagcctccaactcttgtactcaagtaatcctcccgccttggcctcccaaagcactgggattatagaatcatcaatatcttggaagaaaaagaatgttaagaaataacaaaacaataattattaagtactttcttaatctcattaatggagctttcttggttcttggacttttattcatgggatttggtgcatggctcttattagatagaaataattttttaacagcttttgatgaaaataatcacttcatagtacctatttctcaaattttgattggaatgggatcttctactgttcttttttgtctattgggttatataggaattcacaacgaaatcagatggctcctaattgtg

SEQ ID NO: 7580 - DNA, 10481 bp, Homo sapiens
cttggaataggtctgcggctgcacaccgcccggacgccggggttcctgcgtcccccgccccctctgatcgcggctgggtagccgagccgcaggcagctgggggcccccgaacgccgcctctgcatcgcgccgcccctgccccgggctccggtagctttcgggcttccgcactgcccgccgcgccctgcccacagggaagcgcttccccaggcggcggcggtcctggtgcggaccctccggccgcagccatgtgggacccgcgggcagctagggttcccccgagggacttggctgtgctgctgtgcaacaaatcaaatgcatttttcagccttgggaagtggaatgaggcatttgttgctgccaaggaatgtctccaatgggatccaacctacgtgaagggatactaccgagctggttattccttgctgaggttgcaccagccttacgaagccgctcgcatgttttttgagggtctgcgacttgtgcagagaagccaagaccaggcaccggttgctgatttccttgttggagtcttcaccactatgagcagtgactccattgttttgcaaagtttcttgccttgctttgatcatattttcacaactggattcccaacagaagtgtggcaatctgtaatagaaaagttggcaaagaaaggattatggcattcatttctgcttctgtcagcaaaaaaagaccgattaccaagaaatattcatgtcccagagttatcactgaaaagtctctttgagaaatacgttttcattggactttatgagaagatggaacaagtgcccaagttagtccagtggctcatctccattggtgcaagtgttgagactataggaccgtatccccttcatgccctcatgcgactctgtatccaagccagagaaaaccatcttttccggtggttaatggatcacaagcccgagtggaaaggccgcattaaccagaaggatggggatggctgcactgtcctgcacgtcgtcgctgcccactccccaggatacctcgttaagcgacaaacagaggatgtgcagatgctcctgcgctttggggcagatcccactttgctggatcgacagtctcggtctgttgtggatgtcctgaagaggaataagaacttcaaagccatcgagaaaatcaacagtcacttagaaaagctagctacgtgttctaaggacctatcaggattcagcaatggtgatggacccactagtgaaaacgacattttcaggaaggtcttggagcagctggtgaagtatatgaactcaggaaaccggttattgcataaaaactttctgaagcaggaagtagttcagaggttcttgcgtctcctttctactctgcaagaaattcctcctgacctggtctgtgatattaatcaagactgtgccaccaccgtcttcaaattcttattggaaaaacagagatggcctgaggtgcttctgctgctgacccgcaaagtaagtggagaaccaccgcttggggattgcctcatcaaagactgcaacttctcagacctcgacatctgtaccatcatcccccatctcagcacctgggaccagcggaagaaacagcttctgggctgcctgatagacagtggagccttgcctgatggtcttcaggagagccaggagaggccagttgtcacgtgcctgaaacatgaggacttcgagttggctttccttctcttgaccaagggcgcagacccccgtgctatttctctcacggaaggtgatactcctttgcatgcagcactccacatctttctagagattaaagctgacattggttttagcttcctcagccatctgttggatctgttttggtccaaccccactgaattcgactacctcaaccccaatgtccaggacagcaatgggaacacgctgatgcacatcctcttccagaagggcatgctaaagcgcgtgaagaagctgttagacctgctggtgaagtttgacatcaacttcaatctgaagaacaaagagggcaaagatgcacggcaccggattaagaagaacgactctctgctcttggcctggaacaaagctctgatggagaacaggaggaggagccggcaggactctgctgcccacctggggaagctctcaaagtccactgcccctggtcacacatctcagctcaagtcccagggttcattcaagtcagtgccatgtggtgccactgccagaacactgcctgaaggaagtgcagtccctgacagctgggagactctcccaggtacccaggtgaccaggaaggagcctggagctctcaggccctgctcgctgagagactgccttatgcaggacatcacagttttgattcagcaggttgaagtggatccgtctttcccagaggactgtcttcagagctctgagcctctggaggcaggagctggcaaagaaggaaagaaagatgacaagccgactctgggtgcaggggcccctgactgtagtgaggtgggggaaggacatgctcaggtgggccttggggccttgcagcttgtgcctgatgataacagggggaaggagggcaatgatgatcaggatgactggagcacgcaggagattgaggcctgcctccaggacttcgataacatgacctgggagatcgagtgcacttcagaaatgctgaagaagctgtctagtaaggtaatgaccaaggtcatcaagaagaaaatcatccttgccattcagcagctgggaaatggcgagtggacccagggcctgcagaagcgactgaagcacctgaaaggaagcatccagctcttcgaagctaagctggacaaaggagcccggatgctctgggagctcgccattgacttctcccctcgatgcagtgagaaccctgagaagatcattgccacggagcagaacacgtgtgcaatggagaaatcagggcggatctacacggaaatcatccggatttgggacatcgtcttagatcactgcaaactggctgattccatcaaggccatctgcaatgcctacaaccggggcttgtcctgtgtcctgcggaagaagctgaaaggtatcaataaaggccaagtgtcagctaacatgaaaattcaaaagcgtatacctcgctgctatgtggaggacacagaggccgagaagggcagggagcatgtcaatcctgagtactttcccccagccagtgcagtggagacagaatataacatcatgaagttccacagcttcagcaccaacatggcctttaacatcctcaatgacacgacagccacagtggagtaccccttccgggtgggtgagcttgagtacgcggtgatcgacctcaatcccaggccactggagcccatcatccttattgggcgaagtggcactgggaagacaacctgctgcttgtacagattgtggaagaaattccacgtttactgggaaaaagctgagcaggcaggaagcccattgctggccaaacaggtctggctgaagagaaggttggaagtggaacccggaaaagagagtccaggtggggaggaagaggaggaggaagaggacgaggaagaggaagattctattgaagtggaaacagtagaaagcatagatgagcaggagtatgaagcctgcgcaggaggagccggtgtggagccagcaggggacggccaagctgcagaagtatgtgcaccagaacatccccaccagctggagcatttacatcagatctttgtgaccaagaaccatgtgctgtgccaggaggtacaaaggaatttcattgagctttccaagtccaccaaggccactagtcattacaaaccactggaccccaacattcacaaactccaggacctgagggacgagaactttcctctgtttgtcacttccaagcagctgcttcttctgcttgatgcttctctgcccaaaccattttttctgagaaacgaagatggaagcttgaaaagaaccatcataggatggtctgcacaggaagagtcaaccattcctagttggcaagaggatgaagaggaggctgaggtggatggggactacagtgaggaggataaagctgtagaaatgcgtacgggtgacagtgacccccgggtgtacgtgacgtttgaggtgttcaaaaatgaaatatggcccaaaatgaccaaagggaggactgcctacaaccctgcactgatttggaaagaaataaaatcttttctaaagggttcttttgaggccctcagctgtccccatgggagactcactgaagaagtatataagaaattagggaggaaacggtgccccaatttcaaggaagaccggagtgagatctacagcctcttcagtctgtatcagcaaatcaggtcccagaaaggttattttgatgaagaggatgttctgtacaacatatcccggaggctgtcgaagctcagggtgctcccatggtccatccacgagctctatggtgatgagattcaagactttacccaggccgagctggcgctgctgatgaaatgcatcaatgaccccaactctatgttcctcacgggggacacggcccagagcatcatgaagggcgtggccttccgcttcagcgatctgcgctctctgttccattatgccagcagaaacaccatagacaagcagtgtgctgtccggaagcccaagaagatccaccagctgtaccagaattacaggtcccactcaggaatcctcaatctggcatctggagtggtggatttacttcagttctatttcccagaatcttttgatcgccttccaagggattctggcctctttgatggtcctaagccaactgttctggagtcttgtagtgtaagcgacttggcaattttgctacgagggaataaaaggaaaactcagcccattgaatttggagcccaccaggtaatccttgtggccaatgaaacggcaaaggagaaaattccagaagagctggggttagcacttgtgctaacaatttatgaagcaaaaggcttagaatttgatgatgtcctcctttacaacttttttactgattctgaggcttataaggaatggaagatcatttcctcattcacacctacctcaactgactccagagaggaaaaccggccattggttgaagtacccctggacaaaccaggctcttctcagggtcgatctctcatggtgaatccagaaatgtacaagctcctcaacggagagctgaagcagctgtacaccgccatcacacgggctcgggtcaacctctggatctttgatgaaaaccgagagaaacgggctcccgcattcaaatatttcattagaagagattttgtccaagttgtaaagacagatgaaaataaagactttgatgatagcatgttcgttaagacctcaactcctgcggagtggattgcacagggagattactacgccaagcaccagtgctggaaggttgcagccaagtgttaccagaaaggaggtgcatttgagaaggagaagttggccctggcccatgacactgccctgagcatgaaatccaagaaagtcagccccaaggaaaagcagttggaatatttggaattggctaagacctatttggagtgcaaagagccaacactgtcccttaagtgtctgagctatgccaaggagttccagctctctgcccagctgtgcgagaggctgggaaagataagagatgctgcctatttctataagcgaagccagtgctacaaagacgctttcagatgctttgagcagattcaggaatttgatctagcactcaaaatgtactgccaagaggagctttttgaagaagctgctattgcagtggaaaagtatgaagaaatgctaaagactaagacccttcccatttccaagctctcctattctgccagtcagttttacttggaagctgcagcaaagtatctgagtgcaaataagatgaaggaaatgatggctgtcctctcaaagctagacatagaagaccagctggtgttcttgaagtctcggaaacgcttagcagaagctgcagacctgctgaacagggaaggtaggagagaagaggctgccctgctgatgaagcaacatggctgcctcctggaggctgccaggctcactgccgacaaggacttccaggcctcatgtctgctgggggccgcccgcctcaatgtggccagggattccgacatagaacacaccaaggacattctgagagaagcacttgatatctgctatcaaactggccagttgtctggcattgcggaggcccacttcctgcaaggggtaatcctgagagactttcagaagctcagggatgccttcttcaagtttgacacgctcaaccactcagctggagtggtggaagcactctacgaagcagccagccagtgtgaggccgagcctgagaagattctgggcctggctccagggggcttggaaatcctcctcagtctggtcagggctctcaaaagagtgaccaacaatgctgagaaggaaatggtcaaatcttgctttgagttttttgggatttcccaggtggatgccaagtattgccagatagctcagaatgaccctgggcccatattaagaataatttttgacctggatttgaacttgagagagaaaaaaacaaaagatcattttttgataatgactgaccaagtgaaattagccctaaacaaacaccttttgggcaggctgtgtcagatcacacggagcctgcttgggaagacctaccgaggagtctgcatgaggtttattgtaggcttaaaatgtgaggatgaaaactgtgaacattttcacaggcctctgcggcgttgtgaagccaagtgtttagttcagtcgaaaatgaacttggtggcaatcaacgggttgcttttggaagccaaaaaagtattccctaaaatcttagcagaagaacttaaagaaattgattatattttgtctacagatatgtatggcctttgcaagtccattctggatgtccttttccctaagcatttccatcagagagtgttgtcagaaaaccccatggcatgcaaagaaatcctcaaaccaaattacaaatccttccggttctacagatttgctttgaaggagtacatccactttctgtttgaaaatgaaagcgcacgcaaccgccgggaatccacagacctgtggctgagtgccatgcaagctttccttctctcttccaactacccggaggagtttgaaaagctgctccaccaggaggaggacaactacaacagggaactcaaagctctagagtctgaaaaggatgaaaggggcagggggagaggcagcaggataaaaggaatagaagggaaatttggcatgctggcacccaacagggatgatgaaaatatggacaagacccacctgtgcttcatccggcttctggagaattgcattgatcaattctacgtgtacaggaacccagaagactacaagaggctctttttccgtttcatgaatgtcctcatcaagaggtgcaaagaaccactcatccccagcattggaaacacagtagccctcctggagttccagttcatccactgtggggtggtgctggcccgcctctggaagaatgtcattctatgcctccccaagagctacattgcactcttgcactactgggagttcctgtttagcaagaaggacaaggagcttggggatgtgttctccatcattcaggaatacaaacccaaggacgtgacaagagccattcaggatttccggttccatctctcctacctcgccaaggtgctatgtggctatgagaatgtgaacttcaacgtcctgcttgatgccttcagtgaaatagactatgtggtctcgggtgaggctgagcggacactggtgctgtgcttggtgatgctagtgaatgctgaggagatcctgcagccatactgcaagcctctcctgtatcgccacttccgggagattgagtcaaggctgcagctcatgagcatggactgccctggccaggttcccgagaggctcctgaaggtggtgaagcgggtcttggtggcagtcaatgtgaagtctgtggctgaggcactgcaggacctgctctttgagcgggatgaagagtacctaatggactgtgactggcggtgggaccctgtgcacaccaaagggtccatagtccgtggcctctattatgaggaggtcagactaaaccgcctgctctgtttggaccctgtggactactttgctgaacctgagtgtgagtttggccaggatgagatggatgaactggcattagaagaccgagaccacgtcctggccaccattctttcccaaaagcaacggaaggcctccatacagcggaagttgaggagggcatgcctggtggtgtctctgtgcatcagttggaggagaagagtgggcacccagatggagcgtgtcagggaggaggccagggagcccagggctgggaacttcaaaaaggcagacgtggacaggacccagtgtgacctatgtggagtgaagtttacccgtggcccagagaactatttcagccccagcaaagcgtttgagggggcagcttccgaggtggcagtcctttccagggctgagctggaaagggaggagtgtcaggagaggaacagcgagtcttacgagcagcatatccatctagaacaccaccagaggcagcaagtggcctaccagaaatactcagaatttttccacgagaaggtggacccggccattgatgaaggcaagctggtggtgcaggacatcgagcaaagtgtatggatccacagtcacgtgggctccaaggagcacagccacatgctgcagaaggtccaggagcacatcaagagggtttcggatatggtggaggacctctacaggcggaaggcctgggctggcgcggaggaggcgatgactcggctggtcaacattctgatcctgtcagtcagggatgcacgagactggttgatgaaaacagagacccgcttaaagaaggaaggtattgttcaggaagatgattatgaaaatgaagttgaagactttggtgagcttcggcctagaaggcgttctcggaaatgtggaaagcagagaaaatactaatgtccacacagctgcagcctcctcatccttcggaacattccattctgacttagaattctgagcgctggggcagaagacaaaaagaatgtgaattagcattttaaaaataggggagtctaacaacaccattgctttttattctcattacttctctttcagtggcttaggatctgattgctccctcacctctaaagtgtttccaagtagagtctggcagtattagtttcccccacaaacaaattcaggtagagaagttgtagtcgaagggaatgttgggactcctcactgcatggtccctggggtgtctggctcatccccatcatgacatgagttggtagcagaggactaggtgttaggacagactctcctcacctcagttgctgctgctctgggccaggaaatctctctatggattccctcatctcctgccacactgctgcagcatcaagtgtgctatgagagctgtatgtgcccaggggtgggccctgccactggccaccccgagcccaggacgcattctggtcatctctgagcccacttgtagtgtagcttcttctgttagagatgttagccttttctctctgtggcgacttttctgccttcccttcttctgttttttgtgatcattcttagctacctgtgccaagtcacagttagactacctcagaatgtagtcaagaattcacccagtgttctttggatgtcccttccctagggggaaaggctggggaatgttgctgggagcattcccagctgcctctccaaagtggtcctaactctgccttggctatggtgcagacattccaaaaagtgttttgtatacagccctgtacatctagttttcttggttctccctggcaagttcgctaccctagcttaggctgacgttctgatgagtctctgcttgctgagctcatcactgtgggatggtgacctgcagagctgcagattggagcaagtggacagaggagggagccagctaagccaaatccgtcactgccacttggctggcaggccttataagagggcggatctgggcccgtttgcaggaggccattgcctaccctctccccacagtgagccagcagccatcagctgatcccacctgggaaaccttcatgcctctctgatggttactgcccacccttaccccacccctcagctcagcctggtatggaaagcaaggtgcacgttggtctttgattgttctgtcctcacagcagagccagctttccccccatgttgctgctgcttttgctgctcatgctgcttgttgttttctcttccttatctttccaaattgtttccttgaaatgcttgtttccaatttttcttagattatgtttctaatttttattccaggtgtttttttttcttacttgacagaaaaaaagaaaaccccaacaatatcttgctgtattatcacattttttataaagttaaagcatttctctt

SEQ ID NO: 7581 - DNA, 8859 bp, Homo sapiens
ggtcttcaggagagccaggagaggccagttgtcacgtgcctgaaacatgaggacttcgagttggctttccttctcttgaccaagggcgcagacccccgtgctatttctctcacggaaggtgatactcctttgcatgcagcactccacatctttctagagattaaagctgacattggttttagcttcctcagccatctgttggatctgttttggtccaaccccactgaattcgactacctcaaccccaatgtccaggacagcaatgggaacacgctgatgcacatcctcttccagaagggcatgctaaagcgcgtgaagaagctgttagacctgctggtgaagtttgacatcaacttcaatctgaagaacaaagagggcaaagatgcacggcaccggattaagaagaacgactctctgctcttggcctggaacaaagctctgatggagaacaggaggaggagccggcaggactctgctgcccacctggggaagctctcaaagtccactgcccctggtcacacatctcagctcaagtcccagggttcattcaagtcagtgccatgtggtgccactgccagaacactgcctgaaggaagtgcagtccctgacagctgggagactctcccaggtacccaggtgaccaggaaggagcctggagctctcaggccctgctcgctgagagactgccttatgcaggacatcacagttttgattcagcaggttgaagtggatccgtctttcccagaggactgtcttcagagctctgagcctctggaggcaggagctggcaaagaaggaaagaaagatgacaagccgactctgggtgcaggggcccctgactgtagtgaggtgggggaaggacatgctcaggtgggccttggggccttgcagcttgtgcctgatgataacagggggaaggagggcaatgatgatcaggatgactggagcacgcaggagattgaggcctgcctccaggacttcgataacatgacctgggagatcgagtgcacttcagaaatgctgaagaagctgtctagtaaggtaatgaccaaggtcatcaagaagaaaatcatccttgccattcagcagctgggaaatggcgagtggacccagggcctgcagaagcgactgaagcacctgaaaggaagcatccagctcttcgaagctaagctggacaaaggagcccggatgctctgggagctcgccattgacttctcccctcgatgcagtgagaaccctgagaagatcattgccacggagcagaacacgtgtgcaatggagaaatcagggcggatctacacggaaatcatccggatttgggacatcgtcttagatcactgcaaactggctgattccatcaaggccatctgcaatgcctacaaccggggcttgtcctgtgtcctgcggaagaagctgaaaggtatcaataaaggccaagtgtcagctaacatgaaaattcaaaagcgtatacctcgctgctatgtggaggacacagaggccgagaagggcagggagcatgtcaatcctgagtactttcccccagccagtgcagtggagacagaatataacatcatgaagttccacagcttcagcaccaacatggcctttaacatcctcaatgacacgacagccacagtggagtaccccttccgggtgggtgagcttgagtacgcggtgatcgacctcaatcccaggccactggagcccatcatccttattgggcgaagtggcactgggaagacaacctgctgcttgtacagattgtggaagaaattccacgtttactgggaaaaagctgagcaggcaggaagcccattgctggccaaacaggtctggctgaagagaaggttggaagtggaacccggaaaagagagtccaggtggggaggaagaggaggaggaagaggacgaggaagaggaagattctattgaagtggaaacagtagaaagcatagatgagcaggagtatgaagcctgcgcaggaggagccggtgtggagccagcaggggacggccaagctgcagaagtatgtgcaccagaacatccccaccagctggagcatttacatcagatctttgtgaccaagaaccatgtgctgtgccaggaggtacaaaggaatttcattgagctttccaagtccaccaaggccactagtcattacaaaccactggaccccaacattcacaaactccaggacctgagggacgagaactttcctctgtttgtcacttccaagcagctgcttcttctgcttgatgcttctctgcccaaaccattttttctgagaaacgaagatggaagcttgaaaagaaccatcataggatggtctgcacaggaagagtcaaccattcctagttggcaagaggatgaagaggaggctgaggtggatggggactacagtgaggaggataaagctgtagaaatgcgtacgggtgacagtgacccccgggtgtacgtgacgtttgaggtgttcaaaaatgaaatatggcccaaaatgaccaaagggaggactgcctacaaccctgcactgatttggaaagaaataaaatcttttctaaagggttcttttgaggccctcagctgtccccatgggagactcactgaagaagtatataagaaattagggaggaaacggtgccccaatttcaaggaagaccggagtgagatctacagcctcttcagtctgtatcagcaaatcaggtcccagaaaggttattttgatgaagaggatgttctgtacaacatatcccggaggctgtcgaagctcagggtgctcccatggtccatccacgagctctatggtgatgagattcaagactttacccaggccgagctggcgctgctgatgaaatgcatcaatgaccccaactctatgttcctcacgggggacacggcccagagcatcatgaagggcgtggccttccgcttcagcgatctgcgctctctgttccattatgccagcagaaacaccatagacaagcagtgtgctgtccggaagcccaagaagatccaccagctgtaccagaattacaggtcccactcaggaatcctcaatctggcatctggagtggtggatttacttcagttctatttcccagaatcttttgatcgccttccaagggattctggcctctttgatggtcctaagccaactgttctggagtcttgtagtgtaagcgacttggcaattttgctacgagggaataaaaggaaaactcagcccattgaatttggagcccaccaggtaatccttgtggccaatgaaacggcaaaggagaaaattccagaagagctggggttagcacttgtgctaacaatttatgaagcaaaaggcttagaatttgatgatgtcctcctttacaacttttttactgattctgaggcttataaggaatggaagatcatttcctcattcacacctacctcaactgactccagagaggaaaaccggccattggttgaagtacccctggacaaaccaggctcttctcagggtcgatctctcatggtgaatccagaaatgtacaagctcctcaacggagagctgaagcagctgtacaccgccatcacacgggctcgggtcaacctctggatctttgatgaaaaccgagagaaacgggctcccgcattcaaatatttcattagaagagattttgtccaagttgtaaagacagatgaaaataaagactttgatgatagcatgttcgttaagacctcaactcctgcggagtggattgcacagggagattactacgccaagcaccagtgctggaaggttgcagccaagtgttaccagaaaggaggtgcatttgagaaggagaagttggccctggcccatgacactgccctgagcatgaaatccaagaaagtcagccccaaggaaaagcagttggaatatttggaattggctaagacctatttggagtgcaaagagccaacactgtcccttaagtgtctgagctatgccaaggagttccagctctctgcccagctgtgcgagaggctgggaaagataagagatgctgcctatttctataagcgaagccagtgctacaaagacgctttcagatgctttgagcagattcaggaatttgatctagcactcaaaatgtactgccaagaggagctttttgaagaagctgctattgcagtggaaaagtatgaagaaatgctaaagactaagacccttcccatttccaagctctcctattctgccagtcagttttacttggaagctgcagcaaagtatctgagtgcaaataagatgaaggaaatgatggctgtcctctcaaagctagacatagaagaccagctggtgttcttgaagtctcggaaacgcttagcagaagctgcagacctgctgaacagggaaggtaggagagaagaggctgccctgctgatgaagcaacatggctgcctcctggaggctgccaggctcactgccgacaaggacttccaggcctcatgtctgctgggggccgcccgcctcaatgtggccagggattccgacatagaacacaccaaggacattctgagagaagcacttgatatctgctatcaaactggccagttgtctggcattgcggaggcccacttcctgcaaggggtaatcctgagagactttcagaagctcagggatgccttcttcaagtttgacacgctcaaccactcagctggagtggtggaagcactctacgaagcagccagccagtgtgaggccgagcctgagaagattctgggcctggctccagggggcttggaaatcctcctcagtctggtcagggctctcaaaagagtgaccaacaatgctgagaaggaaatggtcaaatcttgctttgagttttttgggatttcccaggtggatgccaagtattgccagatagctcagaatgaccctgggcccatattaagaataatttttgacctggatttgaacttgagagagaaaaaaacaaaagatcattttttgataatgactgaccaagtgaaattagccctaaacaaacaccttttgggcaggctgtgtcagatcacacggagcctgcttgggaagacctaccgaggagtctgcatgaggtttattgtaggcttaaaatgtgaggatgaaaactgtgaacattttcacaggcctctgcggcgttgtgaagccaagtgtttagttcagtcgaaaatgaacttggtggcaatcaacgggttgcttttggaagccaaaaaagtattccctaaaatcttagcagaagaacttaaagaaattgattatattttgtctacagatatgtatggcctttgcaagtccattctggatgtccttttccctaagcatttccatcagagagtgttgtcagaaaaccccatggcatgcaaagaaatcctcaaaccaaattacaaatccttccggttctacagatttgctttgaaggagtacatccactttctgtttgaaaatgaaagcgcacgcaaccgccgggaatccacagacctgtggctgagtgccatgcaagctttccttctctcttccaactacccggaggagtttgaaaagctgctccaccaggaggaggacaactacaacagggaactcaaagctctagagtctgaaaaggatgaaaggggcagggggagaggcagcaggataaaaggaatagaagggaaatttggcatgctggcacccaacagggatgatgaaaatatggacaagacccacctgtgcttcatccggcttctggagaattgcattgatcaattctacgtgtacaggaacccagaagactacaagaggctctttttccgtttcatgaatgtcctcatcaagaggtgcaaagaaccactcatccccagcattggaaacacagtagccctcctggagttccagttcatccactgtggggtggtgctggcccgcctctggaagaatgtcattctatgcctccccaagagctacattgcactcttgcactactgggagttcctgtttagcaagaaggacaaggagcttggggatgtgttctccatcattcaggaatacaaacccaaggacgtgacaagagccattcaggatttccggttccatctctcctacctcgccaaggtgctatgtggctatgagaatgtgaacttcaacgtcctgcttgatgccttcagtgaaatagactatgtggtctcgggtgaggctgagcggacactggtgctgtgcttggtgatgctagtgaatgctgaggagatcctgcagccatactgcaagcctctcctgtatcgccacttccgggagattgagtcaaggctgcagctcatgagcatggactgccctggccaggttcccgagaggctcctgaaggtggtgaagcgggtcttggtggcagtcaatgtgaagtctgtggctgaggcactgcaggacctgctctttgagcgggatgaagagtacctaatggactgtgactggcggtgggaccctgtgcacaccaaagggtccatagtccgtggcctctattatgaggaggtcagactaaaccgcctgctctgtttggaccctgtggactactttgctgaacctgagtgtgagtttggccaggatgagatggatgaactggcattagaagaccgagaccacgtcctggccaccattctttcccaaaagcaacggaaggcctccatacagcggaagttgaggagggcatgcctggtggtgtctctgtgcatcagttggaggagaagagtgggcacccagatggagcgtgtcagggaggaggccagggagcccagggctgggaacttcaaaaaggcagacgtggacaggacccagtgtgacctatgtggagtgaagtttacccgtggcccagagaactatttcagccccagcaaagcgtttgagggggcagcttccgaggtggcagtcctttccagggctgagctggaaagggaggagtgtcaggagaggaacagcgagtcttacgagcagcatatccatctagaacaccaccagaggcagcaagtggcctaccagaaatactcagaatttttccacgagaaggtggacccggccattgatgaaggcaagctggtggtgcaggacatcgagcaaagtgtatggatccacagtcacgtgggctccaaggagcacagccacatgctgcagaaggtccaggagcacatcaagagggtttcggatatggtggaggacctctacaggcggaaggcctgggctggcgcggaggaggcgatgactcggctggtcaacattctgatcctgtcagtcagggatgcacgagactggttgatgaaaacagagacccgcttaaagaaggaaggtattgttcaggaagatgattatgaaaatgaagttgaagactttggtgagcttcggcctagaaggcgttctcggaaatgtggaaagcagagaaaatactaatgtccacacagctgcagcctcctcatccttcggaacattccattctgacttagaattctgagcgctggggcagaagacaaaaagaatgtgaattagcattttaaaaataggggagtctaacaacaccattgctttttattctcattacttctctttcagtggcttaggatctgattgctccctcacctctaaagtgtttccaagtagagtctggcagtattagtttcccccacaaacaaattcaggtagagaagttgtagtcgaagggaatgttgggactcctcactgcatggtccctggggtgtctggctcatccccatcatgacatgagttggtagcagaggactaggtgttaggacagactctcctcacctcagttgctgctgctctgggccaggaaatctctctatggattccctcatctcctgccacactgctgcagcatcaagtgtgctatgagagctgtatgtgcccaggggtgggccctgccactggccaccccgagcccaggacgcattctggtcatctctgagcccacttgtagtgtagcttcttctgttagagatgttagccttttctctctgtggcgacttttctgccttcccttcttctgttttttgtgatcattcttagctacctgtgccaagtcacagttagactacctcagaatgtagtcaagaattcacccagtgttctttggatgtcccttccctagggggaaaggctggggaatgttgctgggagcattcccagctgcctctccaaagtggtcctaactctgccttggctatggtgcagacattccaaaaagtgttttgtatacagccctgtacatctagttttcttggttctccctggcaagttcgctaccctagcttaggctgacgttctgatgagtctctgcttgctgagctcatcactgtgggatggtgacctgcagagctgcagattggagcaagtggacagaggagggagccagctaagccaaatccgtcactgccacttggctggcaggccttataagagggcggatctgggcccgtttgcaggaggccattgcctaccctctccccacagtgagccagcagccatcagctgatcccacctgggaaaccttcatgcctctctgatggttactgcccacccttaccccacccctcagctcagcctggtatggaaagcaaggtgcacgttggtctttgattgttctgtcctcacagcagagccagctttccccccatgttgctgctgcttttgctgctcatgctgcttgttgttttctcttccttatctttccaaattgtttccttgaaatgcttgtttccaatttttcttagattatgtttctaatttttattccaggtgtttttttttcttacttgacagaaaaaaagaaaaccccaacaatatcttgctgtattatcacattttttataaagttaaagcatttctctt

SEQ ID NO: 7582 - DNA, 10481 bp, Homo sapiens; identical to SEQ ID NO: 7580

SEQ ID NO: 7583 - DNA, 3253 bp, Homo sapiens
gagggaagatggcacctgccggctgctgctgctgctgctgcttctggggcggcgctgtggccgccgcgggcgccgcccggcgtgtcctgctgctgctgctgctgggggtcctgtccgccgggctgcggccaggcgccctggccaccgagcactactcgccgctctccctgctcaagcaggagctgcagcaccggcagcagcaggaggccccggcgggcggcggcggctgcagcccgcagtccggggactggggggaccagtactctgccgagtgcggcgagtcatcctttttgaacttccatgactcagactgcgaacccaagggatcatcaccctgtgactccttgctttccctcaacactgagaagattctgagccaggccaagtctattgcagaacagaagagattcccgtttgccactgataatgacagcacaaatgaagagttagctattgcttatgtcttgattggcagtggtctgtatgatgaagcaatacggcatttttcaacaatgcttcaggaggagcctgatctggttagtgcaatttatggccgagggatagcctatggaaagaagggactacatgacattaagaatgctgagcttgctctgttcgaactgagccgagtaattaccttggaaccagatcgtccagaggtatttgagcagcgagcagaaattctgtcccctctgggacgaattaatgaagcagtgaatgacctcactaaagctatccaactgcagccctcagcacggctgtacagacatcggggaaccctgtacttcatatcagaggactatgcaacagcccatgaagactttcagcagtccttagaactgaacaaaaaccagcctatagctatgctatacaaaggtttaactttctttcacagaggacttctgaaggaagctattgaatccttcaaagaagctttgaagcagaaagttgactttattgatgcatataaaagtctagggcaggcatatagagaactgggcaattttgaagcagccactgagagctttcaaaaggcactgttgctcaaccaaaatcatgtgcaaaccctccagctccggggaatgatgctctaccaccacggcagcttacaggaagcccttaagaactttaagcggtgtctgcagctagagccatataatgaagtgtgccagtatatgaaagggctcagccatgttgccatgggacagttttatgaagggataaaagcacaaacaaaagttatgctgaatgatcctctcccaggccagaaggctagccctgagtatcttaaagtaaagtatctccgagagtattctcgatatcttcatgcacaccttgataccccccttacggaatataacattgatgtggatctgcctggaagctttaaggaccactgggctaaaaatttgcctttcctcatagaagactacgaagagcagccagggttgcaaccccacataaaagatgtgttacatcagaattttgagagttataagcctgaagtacaggagctgatttgtgtggctgatcgtttgggatccctgatgcaatatgaaacacctggtttcctgccaaacaagagaatacacagagctatgggtttggccgcattggaggtcatgcaagccgtgcagcgtacatggaccaactcgaaagttcgaatgaatgggaagacacggttgatgcagtggagagacatgtttgacattgcagttaaatggagaaggattgctgacccagaccagcccgtgctgtggttagatcaaatgccagcacgaagtcttagcagaggttttaacaaccacattaatttaatcaggggtcaggtgatcaacatgagatacctagaatattttgagaaaatacttcattttattaaagacagaattcttgtttatcatggagctaataatcctaaaggattgctggaagttcgggaagccctggaaaaggtacacaaagtagaagaccttcttccgattatgaagcagtttaatactaaaacgaaggatgggttcaccgtgaacacaaaagttcccagccttaaagaccaagggaaggaatatgatggattcacaatcacgattacaggagacaaagttggcaatatattattttctgtggaaactcaaaccacggaagaaaggacacaattatatcatgctgaaatagatgcactttataaagatttgacagcaaaaggaaaagtattgattctttcatcagaatttggggaggctgatgctgtctgcaacttaatcttatccttagtttattacttttataatttaatgccactctctcgaggatccagtgtaattgcttactcggtcatcgtgggagcactgatggcaagtggaaaagaagtagcaggaaaaattcccaaagggaagttagtcgactttgaagctatgacagcccctggttcagaggcctttagcaaagtcgccaaaagctggatgaacttgaaaagtatttcaccttcttataagactcttccatcagtatcagaaacgtttccaacgttaagatcgatgattgaggtgctaaacacagactcttctccacgttgtcttaagaaactctagttctgctgctgtatttatacaagtaaagggccggacctcttgcttcttaagttattttttaaaacatggaattataaagaaattaggtcctctattacttttgataccaatttttataggaattgaatacttgaaatcattttctttacttttctgaaccataatgaaaatcatgaaagaggctttcggggggaaaaagctacttgacttggagggaaagcgtatgtattagccggcagcctgttggttcccacttataaagtcatataactccttccttacagtaaaaaaaattttcctcaacaactaaaatataatactgaagatgaacaaaaacaaaaccaaataggagtgtttgtattcctttagagatctggatatttttcaaagacttgctttttacgcacattgtgatagagcatcttttgttgactcacgtaacctccatgtgtgggtcctttgttttattagaaccatggaagaaggttcctgggccatcagtatgtgttgcagagctcacagccaggaacacttattttgaacaatgcagacagtacttgccagagtcccaaatgctgaattattgaaccatgtttttttttcctttgttgaaaaaaataaaccagggtgatttctataaatcaccagtttttggcattgga

SEQ ID NO: 7584 - DNA, 3112 bp, Homo sapiens
gggctgtcgcgcatgcgccttgagggaagatggcacctgccggctgctgctgctgctgctgcttctggggcggcgctgtggccgccgcgggcgccgcccggcgtgtcctgctgctgctgctgctgggggtcctgtccgccgggctgcggccaggcgccctggccaccgagcactactcgccgctctccctgctcaagcaggagctgcagcaccggcagcagcaggaggccccggcgggcggcggcggctgcagcccgcagtccggggactggggggaccagtactctgccgagtgcggcgagtcatcctttttgaacttccatgactcagactgcgaacccaagggatcatcaccctgtgactccttgctttccctcaacactgagaagattctgagccaggccaagtctattgcagaacagaagagattcccgtttgccactgataatgacagcacaaatgaagagttagctattgcttatgtcttgattggcagtggtctgtatgatgaagcaatacggcatttttcaacaatgcttcagattctgtcccctctgggacgaattaatgaagcagtgaatgacctcactaaagctatccaactgcagccctcagcacggctgtacagacatcggggaaccctgtacttcatatcagaggactatgcaacagcccatgaagactttcagcagtccttagaactgaacaaaaaccagcctatagctatgctatacaaaggtttaactttctttcacagaggacttctgaaggaagctattgaatccttcaaagaagctttgaagcagaaagttgactttattgatgcatataaaagtctagggcaggcatatagagaactgggcaattttgaagcagccactgagagctttcaaaaggcactgttgctcaaccaaaatcatgtgcaaaccctccagctccggggaatgatgctctaccaccacggcagcttacaggaagcccttaagaactttaagcggtgtctgcagctagagccatataatgaagtgtgccagtatatgaaagggctcagccatgttgccatgggacagttttatgaagggataaaagcacaaacaaaagttatgctgaatgatcctctcccaggccagaaggctagccctgagtatcttaaagtaaagtatctccgagagtattctcgatatcttcatgcacaccttgataccccccttacggaatataacattgatgtggatctgcctggaagctttaaggaccactgggctaaaaatttgcctttcctcatagaagactacgaagagcagccagggttgcaaccccacataaaagatgtgttacatcagaattttgagagttataagcctgaagtacaggagctgatttgtgtggctgatcgtttgggatccctgatgcaatatgaaacacctggtttcctgccaaacaagagaatacacagagctatgggtttggccgcattggaggtcatgcaagccgtgcagcgtacatggaccaactcgaaagttcgaatgaatgggaagacacggttgatgcagtggagagacatgtttgacattgcagttaaatggagaaggattgctgacccagaccagcccgtgctgtggttagatcaaatgccagcacgaagtcttagcagaggttttaacaaccacattaatttaatcaggggtcaggtgatcaacatgagatacctagaatattttgagaaaatacttcattttattaaagacagaattcttgtttatcatggagctaataatcctaaaggattgctggaagttcgggaagccctggaaaaggtacacaaagtagaagaccttcttccgattatgaagtttaatactaaaacgaaggatgggttcaccgtgaacacaaaagttcccagccttaaagaccaagggaaggaatatgatggattcacaatcacgattacaggagacaaagttggcaatatattattttctgtggaaactcaaaccacggaagaaaggacacaattatatcatgctgaaatagatgcactttataaagatttgacagcaaaaggaaaagtattgattctttcatcagaatttggggaggctgatgctgtctgcaacttaatcttatccttagtttattacttttataatttaatgccactctctcgaggatccagtgtaattgcttactcggtcatcgtgggagcactgatggcaagtggaaaagaagtagcaggaaaaattcccaaagggaagttagtcgactttgaagctatgacagcccctggttcagaggcctttagcaaagtcgccaaaagctggatgaacttgaaaagtatttcaccttcttataagactcttccatcagtatcagaaacgtttccaacgttaagatcgatgattgaggtgctaaacacagactcttctccacgttgtcttaagaaactctagttctgctgctgtatttatacaagtaaagggccggacctcttgcttcttaagttattttttaaaacatggaattataaagaaattaggtcctctattacttttgataccaatttttataggaattgaatacttgaaatcattttctttacttttctgaaccataatgaaaatcatgaaagaggctttcggggggaaaaagctacttgacttggagggaaagcgtatgtattagccggcagcctgttggttcccacttataaagtcatataactccttccttacagtaaaaaaaattttcctcaacaactaaaatataatactgaagatgaacaaaaacaaaaccaaataggagtgtttgtattcctttagagatctggatatttttcaaagacttgctttttacgcacattgtgatagagcatcttttgttgactcacgtaacctccatgtgtgggtcctttgttttattagaaccatggaagaaggttcctgggccatcagtatgtgttgcagagctcacagccaggaacacttattttgaacaatgcagacagtacttgccagagtcccaaatgctgaattattgaaccatgtttttttttcctttgttgaaaaaaataaaccagggtgatttctataaatcaccagtttttggcattgga

SEQ ID NO: 7585 - DNA, 3116 bp, Homo sapiens
aagggctgtcgcgcatgcgccttgagggaagatggcacctgccggctgctgctgctgctgctgcttctggggcggcgctgtggccgccgcgggcgccgcccggcgtgtcctgctgctgctgctgctgggggtcctgtccgccgggctgcggccaggcgccctggccaccgagcactactcgccgctctccctgctcaagcaggagctgcagcaccggcagcagcaggaggccccggcgggcggcggcggctgcagcccgcagtccggggactggggggaccagtactctgccgagtgcggcgagtcatcctttttgaacttccatgactcagactgcgaacccaagggatcatcaccctgtgactccttgctttccctcaacactgagaagattctgagccaggccaagtctattgcagaacagaagagattcccgtttgccactgataatgacagcacaaatgaagagttagctattgcttatgtcttgattggcagtggtctgtatgatgaagcaatacggcatttttcaacaatgcttcagattctgtcccctctgggacgaattaatgaagcagtgaatgacctcactaaagctatccaactgcagccctcagcacggctgtacagacatcggggaaccctgtacttcatatcagaggactatgcaacagcccatgaagactttcagcagtccttagaactgaacaaaaaccagcctatagctatgctatacaaaggtttaactttctttcacagaggacttctgaaggaagctattgaatccttcaaagaagctttgaagcagaaagttgactttattgatgcatataaaagtctagggcaggcatatagagaactgggcaattttgaagcagccactgagagctttcaaaaggcactgttgctcaaccaaaatcatgtgcaaaccctccagctccggggaatgatgctctaccaccacggcagcttacaggaagcccttaagaactttaagcggtgtctgcagctagagccatataatgaagtgtgccagtatatgaaagggctcagccatgttgccatgggacagttttatgaagggataaaagcacaaacaaaagttatgctgaatgatcctctcccaggccagaaggctagccctgagtatcttaaagtaaagtatctccgagagtattctcgatatcttcatgcacaccttgataccccccttacggaatataacattgatgtggatctgcctggaagctttaaggaccactgggctaaaaatttgcctttcctcatagaagactacgaagagcagccagggttgcaaccccacataaaagatgtgttacatcagaattttgagagttataagcctgaagtacaggagctgatttgtgtggctgatcgtttgggatccctgatgcaatatgaaacacctggtttcctgccaaacaagagaatacacagagctatgggtttggccgcattggaggtcatgcaagccgtgcagcgtacatggaccaactcgaaagttcgaatgaatgggaagacacggttgatgcagtggagagacatgtttgacattgcagttaaatggagaaggattgctgacccagaccagcccgtgctgtggttagatcaaatgccagcacgaagtcttagcagaggttttaacaaccacattaatttaatcaggggtcaggtgatcaacatgagatacctagaatattttgagaaaatacttcattttattaaagacagaattcttgtttatcatggagctaataatcctaaaggattgctggaagttcgggaagccctggaaaaggtacacaaagtagaagaccttcttccgattatgaagcagtttaatactaaaacgaaggatgggttcaccgtgaacacaaaagttcccagccttaaagaccaagggaaggaatatgatggattcacaatcacgattacaggagacaaagttggcaatatattattttctgtggaaactcaaaccacggaagaaaggacacaattatatcatgctgaaatagatgcactttataaagatttgacagcaaaaggaaaagtattgattctttcatcagaatttggggaggctgatgctgtctgcaacttaatcttatccttagtttattacttttataatttaatgccactctctcgaggatccagtgtaattgcttactcggtcatcgtgggagcactgatggcaagtggaaaagaagtagcaggaaaaattcccaaagggaagttagtcgactttgaagctatgacagcccctggttcagaggcctttagcaaagtcgccaaaagctggatgaacttgaaaagtatttcaccttcttataagactcttccatcagtatcagaaacgtttccaacgttaagatcgatgattgaggtgctaaacacagactcttctccacgttgtcttaagaaactctagttctgctgctgtatttatacaagtaaagggccggacctcttgcttcttaagttattttttaaaacatggaattataaagaaattaggtcctctattacttttgataccaatttttataggaattgaatacttgaaatcattttctttacttttctgaaccataatgaaaatcatgaaagaggctttcggggggaaaaagctacttgacttggagggaaagcgtatgtattagccggcagcctgttggttcccacttataaagtcatataactccttccttacagtaaaaaaaattttcctcaacaactaaaatataatactgaagatgaacaaaaacaaaaccaaataggagtgtttgtattcctttagagatctggatatttttcaaagacttgctttttacgcacattgtgatagagcatcttttgttgactcacgtaacctccatgtgtgggtcctttgttttattagaaccatggaagaaggttcctgggccatcagtatgtgttgcagagctcacagccaggaacacttattttgaacaatgcagacagtacttgccagagtcccaaatgctgaattattgaaccatgtttttttttcctttgttgaaaaaaataaaccagggtgatttctataaatcaccagtttttggcattgg

SEQ ID NO: 7586 - DNA, 2881 bp, Homo sapiens
ggttgtgctgtctgtgtacttccggcagcctccagacagtttcttccgcttcctgtaccacccggctcaagtagcggacacggaacagggaactatcagcccgtcggcctccgggccctgcattctctagccatggaccgggaccttttgcggcagtcgctaaattgccacgggtcgtctttgctctctctacttcggagcgaacagcaggacaatccacacttccgtagcctcctggggtcggccgccgagccagcccggggcccgccgccccagcacccgttgcagggcagaaaagagaagagagttgacaacatcgagatacagaaattcatctccaaaaaagcggatctgctttttgcactttcctggaaatcagatgcacctgcaacttctgaaattaatgaagacagtgaagatcattatgcaatcatgccacctttagagcaattcatggagatacctagtatggatcggagagagctgtttttccgagatattgagcgtggtgatatagtgattggaagaattagttctattcgggaattcggttttttcatggtgttgatctgtttaggaagtggtatcatgagagatatagcccacttagaaatcacagctctttgtcccttaagagatgtgccttctcacagtaaccatggggatcctttatcatattaccaaactggtgacatcattcgagctggaatcaaggatattgacagataccatgaaaagctagcagtatctctgtatagctcttctcttccaccacacctatctggtattaaattaggtgtaattagctctgaagagcttcctttatactacaggagaagtgttgagctaaatagcaattctttggagtcctatgaaaatgtcatgcagagttccttgggatttgttaatccaggagtagttgaattccttctagaaaaactaggaatagatgaatctaatccaccatctttaatgagaggcctacaaagcaaaaatttctctgaagatgattttgcttctgcattgagaaaaaaacaatccgcatcttgggctttaaaatgtgtgaagatcggagttgactattttaaagttggacgccatgtggatgctatgaatgaatacaataaagctttggaaatagacaaacaaaacgtggaagctttggtagctcgtggagcattatatgcgacaaaaggaagtttgaacaaagcaatagaagattttgagcttgcattagaaaactgtccaactcacagaaatgcaagaaaatacctctgccagacacttgtagagagaggaggacagttagaagaagaagaaaagtttttaaatgctgaaagttactataagaaagctttggctttggatgagacttttaaagatgcagaggatgctttgcagaaacttcataaatatatgcagaaatctttggaattaagagaaaaacaagctgaaaaggaagaaaagcagaaaacaaagaaaatagaaacaagtgcagaaaagttgcgtaagctcttaaaagaagagaagaggctaaagaagaaaagaagaaaatcaacttcttcttcaagtgtttcttctgctgatgaatcagtgtcttcatcatcatcctcttcctcttctggtcacaaaaggcataagaaacataagaggaaccgttcagagtcttctcgcagttccagaaggcattcatctagggcatcctcaaatcagatagatcagaataggaaagatgagtgctacccagttccagctaatacttcagcatcttttcttaaccataaacaagaagtggagaaactactggggaagcaggataggttacagtatgaaaagacacagataaaagagaaagatagatgccctctctcttcatcttcacttgaaataccggatgattttggaggtaggtctgaagatccaagagatttttataacagctataaaacccaagcaggtagtagcaaaacagaaaagccatataaatcagaaagacatttttccagtagaagaaattcctcagattccttctgtaggaattcagaggacaagatttatggttataggagatttgaaaaggatatagagggaagaaaagagcactatagaaggtgggaaccaggttctgtgaggcattctacctcaccagcaagctcagaatactcttggaagtcagttgagaaatacaaaaaatacgctcactctggatcacgtgatttcagtagacatgagcaaagataccgtttaaatacaaatcaaggagaatatgaaagagaggacaattatggggaggatatcaaaacagaggttccagaagaagatgcactaagtagcaaagaacactcagaaagcagtgttaagaaaaatttacctcagaatttactgaatatatttaatcagatagctgaatttgaaaaagaaaaaggaaataagtcaaaaaattaatacaccaaggatatcggcaccattacacaaaatgccattaagtgaagtttttggttgtattagtcataacagttgagtgcagaaatctctgcttctaaaattatttgtagagattacaggaaacaaatgcttttaagtaagtttttctcaaattttgtttcagttctaggtcccttgtcacagcttggtttttagactttttatgtatatgtttatgtacagtatattactcttgacagtttgaatttcttcacctaaagataattctctgaaagtactgtttcttcattctattgcggtatatgagaattcctgggtgcatcttattctgctgtttgagagaaaaatttgtgcattgaacacttggatcatttttataaaaattaatttcattttcttttctgttaaattaaaaatcgtcagcttttgaaagatt

SEQ ID NO: 7587 - DNA, 2274 bp, Homo sapiens
ggaacagggaactatcagcccgtcggcctccgggccctgcattctctagccatggaccgggaccttttgcggcagtcgctaaattgccacgggtcgtctttgctctctctacttcggagcgaacagcaggacaatccacacttccgtagcctcctggggtcggccgccgagccagcccggggcccgccgccccagcacccgttgcagggcagaaaagagaagagagttgacaacatcgagatacagaaattcatctccaaaaaagcggatctgctttttgcactttcctggaaatcagatgcacctgcaacttctgaaattaatgaagacagtgaagatcattatgcaatcatgccacctttagagcaattcatggagatacctagtatggatcggagagagctgtttttccgagatattgagcgtggtgatatagtgattggaagaattagttctattcgggaattcggttttttcatggtgttgatctgtttaggaagtggtatcatgagagatatagcccacttagaaatcacagctctttgtcccttaagagatgtgccttctcacagtaaccatggggatcctttatcatattaccaaactggtgacatcattcgagctggaatcaaggatattgacagataccatgaaaagctagcagtatctctgtatagctcttctcttccaccacacctatctggtattaaattaggtgtaattagctctgaagagcttcctttatactacaggagaagtgttgagctaaatagcaattctttggagtcctatgaaaatgtcatgcagagttccttgggatttgttaatccaggagtagttgaattccttctagaaaaactaggaatagatgaatctaatccaccatctttaatgagaggcctacaaagcaaaaatttctctgaagatgattttgcttctgcattgagaaaaaaacaatccgcatcttgggctttaaaatgtgtgaagatcggagttgactattttaaagttggacgccatgtggatgctatgaatgaatacaataaagctttggaaatagacaaacaaaacgtggaagctttggtagctcgtggagcattatatgcgacaaaaggaagtttgaacaaagcaatagaagattttgagcttgcattagaaaactgtccaactcacagaaatgcaagaaaatacctctgccagacacttgtagagagaggaggacagttagaagaagaagaaaagtttttaaatgctgaaagttactataagaaagctttggctttggatgagacttttaaagatgcagaggatgctttgcagaaacttcataaatatatgcagaaatctttggaattaagagaaaaacaagctgaaaaggaagaaaagcagaaaacaaagaaaatagaaacaagtgcagaaaagttgcgtaagctcttaaaagaagagaagaggctaaagaagaaaagaagaaaatcaacttcttcttcaagtgtttcttctgctgatgaatcagtgtcttcatcatcatcctcttcctcttctggtcacaaaaggcataagaaacataagaggaaccgttcagagtcttctcgcagttccagaaggcattcatctagggcatcctcaaatcagatagatcagaataggaaagatgagtgctacccagttccagctaatacttcagcatcttttcttaaccataaacaagaagtggagaaactactggggaagcaggataggttacagtatgaaaagacacagataaaagagaaagatagatgccctctctcttcatcttcacttgaaataccggatgattttggagtgtactcctatttatttaaaaagttaactataaaacagcctcaggcaggtccttcaggagatattccagaagagggcattgttatcatagatgacagctccattcatgttactgaccctgaagaccttcaagtgggacaagatatggaggtggaagacagtggtattgatgatcctgaccacgggtaggcttaggtttatgtgtgtgtatgtgtcttagtttttaacaaaaaaattaaaaagtaaaaaaactaaaaatagaaaaatgcttagagaataaggatataaagaatatttttgtgcagttgaacaatgagtgcttaagctaaatgtcatcacaaaagagtaaaaaaattttacaaaattaaaaatgtttaaagttaaaaagctctaggaagctaaggtcaatttattattggagaaataaaattatttttatgaatttactgt

SEQ ID NO: 7588 - DNA, 4568 bp, Homo sapiens
ggctcaagtagcggacacggaacagggaactatcagcccgtcggcctccgggccctgcattctctagccatggaccgggaccttttgcggcagtcgctaaattgccacgggtcgtctttgctctctctacttcggagcgaacagcaggacaatccacacttccgtagcctcctggggtcggccgccgagccagcccggggcccgccgccccagcacccgttgcagggcagaaaagagaagagagttgacaacatcgagatacagaaattcatctccaaaaaagcggatctgctttttgcactttcctggaaatcagatgcacctgcaacttctgaaattaatgaagacagtgaagatcattatgcaatcatgccacctttagagcaattcatggagatacctagtatggatcggagagagctgtttttccgagatattgagcgtggtgatatagtgattggaagaattagttctattcgggaattcggttttttcatggtgttgatctgtttaggaagtggtatcatgagagatatagcccacttagaaatcacagctctttgtcccttaagagatgtgccttctcacagtaaccatggggatcctttatcatattaccaaactggtgacatcattcgagctggaatcaaggatattgacagataccatgaaaagctagcagtatctctgtatagctcttctcttccaccacacctatctggtattaaattaggtgtaattagctctgaagagcttcctttatactacaggagaagtgttgagctaaatagcaattctttggagtcctatgaaaatgtcatgcagagttccttgggatttgttaatccaggagtagttgaattccttctagaaaaactaggaatagatgaatctaatccaccatctttaatgagaggcctacaaagcaaaaatttctctgaagatgattttgcttctgcattgagaaaaaaacaatccgcatcttgggctttaaaatgtgtgaagatcggagttgactattttaaagttggacgccatgtggatgctatgaatgaatacaataaagctttggaaatagacaaacaaaacgtggaagctttggtagctcgtggagcattatatgcgacaaaaggaagtttgaacaaagcaatagaagattttgagcttgcattagaaaactgtccaactcacagaaatgcaagaaaatacctctgccagacacttgtagagagaggaggacagttagaagaagaagaaaagtttttaaatgctgaaagttactataagaaagctttggctttggatgagacttttaaagatgcagaggatgctttgcagaaacttcataaatatatgcaggtgattccttatttcctcttagaaatttagtgatatttgaaataatgcccaaacttaattttctcctgaggaaaactattctacattacttaagtaaggcattatgaaaagtttctttttaggtatagtttttcctaattgggtttgacattgcttcatagtgcctctgtttttgtccataatcgaaagtaaagatagctgtgagaaaactattacctaaatttggtatgttgttttgagaaatgtccttatagggagctcacctggtggtttttaaattattgttgctactataattgagctaattataaaaacctttttgagacatattttaaattgtcttttcctgtaatactgatgatgatgttttctcatgcattttcttctgaattggaccattgctgctgtgtctgtgacatctggtgctgctcatccccatccacaaactggaaaatgatttcctatgtaatcatgcatccaactgggctgtgctatttttttaaatggtttgtatttgaacatggtgattcctccttcacttcaccttaacggaatgtctttatttgaattttatttgtaaaatgtgtcctgtttaaatttttcaatctttaaaaataatttttatgtactttttttttttttttaacctttcttgcactctgggtcatgggtaccactgcaatggcttcccctttttttatgggataccaactgcaatatggtcctcaatgctgttctggccatttcaatgactaatgccaaacatctgtatgactaatttttttatgttaaaaaaatactgtttaatgctggctctatggtgatttggttttactaaattgggtttctcgttgggggtggtcttttgaatactgggttttatatattctgctatttttaacgtgtggtttttttcgatatctgggttctaaaagaaatctttggaattaagagaaaaacaagctgaaaaggaagaaaagcagaaaacaaagaaaatagaaacaagtgcagaaaagttgcgtaagctcttaaaagaagagaagaggtaaactataatattcagtatttttaaacttaaggcaactactgaattgaacccaaagtgccatactggaggtaaagtaaataaaaatatgaaagtatttcaagtgccaatcagtgactgttaagaatctttagcaaatatgtgttccatgtattttcttattaaagagatgaagtggaatttaaggctagaattctacaaaaaaagagtatcttagaattaaaatatagaataagttactttaattatgttttaggaagaaatattttagaactagagcagtggttctcaactaggggtggatttattcacccggggacatttgacaagatgtggagacatttttgattgccataactgatagggtgctactgcatctagtgtataatggtcagggatgctcttaaacattctgtaatgcacaggtcagctcccacccgcacccccaccccctaccaagaattatttggctgaaaataccaataatcaggtgaagaaaccatgaactagaggtagccaaataaaaaagttgagttctcctttatgtgttcagtagtcttaagtttttaaggtagtgttgaaaaaagtctgtctttcagagatgatggatttgcttacaatgatacctgtctgcaagcattttttcccccaaaagtgcttaatagtaaaattagatcttgtagtagccgagattattgtatcatttatctgaaccacagcttttataaaatctttaaaggaaacaaatagggcccacatctttatgaataatttagaaacatttttgtatatatatgacaaatgaactgttttttttaggctaaagaagaaaagaagaaaatcaacttcttcttcaagtgtttcttctgctgatgaatcagtgtcttcatcatcatcctcttcctcttctggtcacaaaaggcataagaaacataagaggaaccgttcagagtcttctcgcagttccagaaggcattcatctagggcatcctcaaatcagatagatcagaataggaaagatgagtgctacccagttccagctaatacttcagcatcttttcttaaccataaacaagaagtggagaaactactggggaagcaggataggttacagtatgaaaagacacagataaaagagaaagatagatgccctctctcttcatcttcacttgaaataccggatgattttggaggtaggtctgaagatccaagagatttttataacagctataaaacccaagcaggtagtagcaaaacagaaaagccatataaatcagaaagacatttttccagtagaagaaattcctcagattccttctgtaggaattcagaggacaagatttatggttataggagatttgaaaaggatatagagggaagaaaagagcactatagaaggtgggaaccaggttctgtgaggcattctacctcaccagcaagctcagaatactcttggaagtcagttgagaaatacaaaaaatacgctcactctggatcacgtgatttcagtagacatgagcaaagataccgtttaaatacaaatcaaggagaatatgaaagagaggacaattatggggaggatatcaaaacagaggttccagaagaagatgcactaagtagcaaagaacactcagaaagcagtgttaagaaaaatttacctcagaatttactgaatatatttaatcagatagctgaatttgaaaaagaaaaaggaaataagtcaaaaaattaatacaccaaggatatcggcaccattacacaaaatgccattaagtgaagtttttggttgtattagtcataacagttgagtgcagaaatctctgcttctaaaattatttgtagagattacaggaaacaaatgcttttaagtaagtttttctcaaattttgtttcagttctaggtcccttgtcacagcttggtttttagactttttatgtatatgtttatgtacagtatattactcttgacagtttgaatttcttcacctaaagataattctctgaaagtactgtttcttcattctattgcggtatatgagaattcctgggtgcatcttattctgctgtttgagagaaaaatttgtgcattgaacacttggatcatttttataaaaattaatttcattttcttttctgttaaattaaaaatcgtcagcttttgaaa

SEQ ID NO: 7589 - DNA, 2369 bp, Homo sapiens
aacagtgcccctcaaagtcagggaatagtgagtgactaccttgctttggggtcccaggttcctgcccgacacagccattcacatgctgtgcagctttgagccacttactctcttcaggcctcagtgaactcaactgtctaatggggctcttccacctcagtgggaacgaggctgatggcctggctggactccaggaacaccagcctgccctccctgggcttctgtctactcctcctgcctctccacccagctcccttgcttcccacaacccccaccccagccctatgccctgggctggtccacagtcagggccacccctctgcctgtccccactttccccacagctactccagaggccagcagtgcttggagcaggcagactgggagacagctgtgctgctcttctcccgcgcactccacctggacccacagctgggacaatgcctttttgagcagtgtgccttcctggatgccctgaatgtcttctcacatgctgctgagctccagcctgagaaaccatgcttccgttaccgatgcatggcctgtctcctggccctcaagcagcatcaggcctgcctcacgctcatcaccaacgagctgaagcaggacaccaccaacgccgatgtctacatcttccgggccagactctacaactttctccagaagccccacctctgctaccgggacctgcacagcgccttgctgttgaatcccaagcacccgcaggccaggatgctgctccagaagatggtggcccaggcccagcaggcgcgccaagatgcggggatcctggctgtgcagggcaagctggcacgcactgcagcggatcaaccgtgccatcgagaacaaccctctggaccccagtctcttcctcttccggggcaccatgtaccgacggctccaggagttcgatggggcagtggaggacttcctgaaggtgctggacatggtgaccgaggaccaggaggacatggtgcggcaggcacagcgccagctgttgctgacctacaacgactttgccgtgcactgctacaggcagggcgcctaccaggagggcgtgctgctgctgaacaaggccctccgggacgagcagcaggagaaaggactctacatcaaccgaggcggcagttccagaaggcagagaaccacttctccacggccatccggcacaacccccagaaggcccagtactacctgtaccgggccaagagccggcagctgctgcagaacatttttggggcccgccaggatgtggccactgtcctgctcctcaaccccaagcaaccaaaggatgcttaaacggcacgagttggagcgccagaaggccttggccctgcagcactcatggaagcagggggagcctttgattgcgacctccgaggagctgaaggccacccctgagattccgcaggtaaaaccgggaagctcagagggagaggctgaggcccctgaggaggaggaagaaaaggagaaggagaaaaaagagtcaggaccacaggcacctcagagactgagatgtcggctatctgccaggaatacaggagcacctcagccaccgccgtgacattctctgactcgtcactgttgaagacgcaatcctcggactctgggaacaacagggaggcactaagccatggtcccagaaaaatcaaggccacccagggccagaggcagagccttagcaagactgagcccacccagagccagaggcggaactccagcaagaccaaggccactatacacaagaggaactccagcaagaccaaggccacccaaagccagaggcggaactccagcaagaccagggccacccagggccaggggcagagctccagcaagactgaggccactcagggccagaggcagagctccagcgagattgaggccacccagggcccaaggcaggagcccagcaagaccaagaccacccggagcccaaggcagaggcccagaaaggtcaaggctgctcgtggccggagctggagacccagcaaggttgatgccacccagggccgaagcaggggactgctccgaagttccaccaagactgaggctttctatgactcaaactggagcctcagcaaaactgagtatgcccaaggccagggccagaggtccagcaaggctgagggtgcccagggcaagagccagggcatgagctcaacttccagcaaggccgagtccacctggggacccagcccaagtctcagcaaaactgaggttgatcaggacctcacctactatgaagctgtctgaagggaccatccagaccctcccttcttgctggggaggggacgagttctacccacctccccacactggcactcagccagctgcctccttccagagcaattaaaagtcttagcaac

SEQ ID NO: 7590 - DNA, 1834 bp, Homo sapiens
ggtgatggtgcctagcaacgtcagggccagggccgcgaggtagttggcagaggcctcggggtcctcctggaaggggcctcatgacagattcggacgaggatgccctgaaggttgaccagggcccctcacgggacatcccaaagccatgggtgattccagcccccaaagggatcctgcagcacatctttgggaccagccacgtgttccaaagcatctgtgatgtaaaaccaaaggtcacagggttaacagtgcccctcaaagtcagggaatactactccagaggccagcagtgcttggagcaggcagactgggagacagctgtgctgctcttctcccgcgcactccacctggacccacagctggtggacttctatgccttacgggctgaggcctacctccagctctgtgacttctcctcggccgcccagaacctgcgaagggcctactcattacagcaggacaactgcaagcacctggagcgcctcacctttgtgctctacctacagggacaatgcctttttgagcagtgtgccttcctggatgccctgaatgtcttctcacatgctgctgagctccagcctgagaaaccatgcttccgttaccgatgcatggcctgtctcctggccctcaagcagcatcaggcctgcctcacgctcatcaccaacgagctgaagcaggacaccaccaacgccgatgtctacatcttccgggccagactctacaactttctccagaagccccacctctgctaccgggacctgcacagcgccttgctgttgaatcccaagcacccgcaggccaggatgctgctccagaagatggtggcccaggcccagcaggcgcgccaagatgcggggatcctggctgtgcagggcaagctgcagcacgcactgcagcggatcaaccgtgccatcgagaacaaccctctggaccccagtctcttcctcttccggggcaccatgtaccgacggctccaggagttcgatggggcagtggaggacttcctgaaggtgctggacatggtgaccgaggaccaggaggacatggtgcggcaggcacagcgccagctgttgctgacctacaacgactttgccgtgcactgctacaggcagggcgcctaccaggagggcgtgctgctgctgaacaaggccctccgggacgagcagcaggagaaaggactctacatcaaccgaggcggcagttccagaaggcagagaaccacttctccacggccatccggcacaacccccagaaggcccagtactacctgtaccgggccaagagccggcagctgctgcagaacatttttggggcccgccaggatgtggccactgtcctgctcctcaaccccaagcaaccaaagctgtccctgctgatgaccaacctcttcccgggcatgtcggtggaggaggtgcttagcacccagatagcccacctggccaggctgcagctggagcagatggtggagggcagcctgcaggccggcagcccacaaggcattgtggggatgcttaaacggcacgagttggagcgccagaaggccttggccctgcagcactcatggaagcagggggagcctttgattgcgacctccgaggagctgaaggccacccctgagattccgcaggtaaaaccgggaagctcagagggagaggctgaggcccctgaggaggaggaagaaaaggagaaggagaaaaaagaggtaagtggagtacaggccagggctcggagcccttggggtctggggcacagcgtaccccagcccagggctgaaggatgcaggccagtggagtctggcttccaggcctggctctgcactccctcagctgtgtga

SEQ ID NO: 7591 - DNA, 2897 bp, Homo sapiens
ggtgatggtgcctagcaacgtcagggccagggccgcgaggtagttggcagaggcctcggggtcctcctggaaggggcctcatgacagattcggacgaggatgccctgaaggttgaccagggcccctcacgggacatcccaaagccatgggtgattccagcccccaaagggatcctgcagcacatctttgggaccagccacgtgttccaaagcatctgtgatgtaaaaccaaaggtcacagggttaacagtgcccctcaaagtcagggaatactactccagaggccagcagtgcttggagcaggcagactgggagacagctgtgctgctcttctcccgcgcactccacctggacccacagctggtggacttctatgccttacgggctgaggcctacctccagctctgtgacttctcctcggccgcccagaacctgcgaagggcctactcattacagcaggacaactgcaagcacctggagcgcctcacctttgtgctctacctacagggacaatgcctttttgagcagtgtgccttcctggatgccctgaatgtcttctcacatgctgctgagctccagcctgagaaaccatgcttccgttaccgatgcatggcctgtctcctggccctcaagcagcatcaggcctgcctcacgctcatcaccaacgagctgaagcaggacaccaccaacgccgatgtctacatcttccgggccagactctacaactttctccagaagccccacctctgctaccgggacctgcacagcgccttgctgttgaatcccaagcacccgcaggccaggatgctgctccagaagatggtggcccaggcccagcaggcgcgccaagatgcggggatcctggctgtgcagggcaagctgcagcacgcactgcagcggatcaaccgtgccatcgagaacaaccctctggaccccagtctcttcctcttccggggcaccatgtaccgacggctccaggagttcgatggggcagtggaggacttcctgaaggtgctggacatggtgaccgaggaccaggaggacatggtgcggcaggcacagcgccagctgttgctgacctacaacgactttgccgtgcactgctacaggcagggcgcctaccaggagggcgtgctgctgctgaacaaggccctccgggacgagcagcaggagaaaggactctacatcaaccgaggcgattgcttcttccagctgggcaacctggcctttgccgaggcggactaccagcaggcgctggcgctgagccctcaggacgagggcgccaacacgcgcatgggcctgctgcaggagaagatgggcttctgcgagcagaggcgcaagcagttccagaaggcagagaaccacttctccacggccatccggcacaacccccagaaggcccagtactacctgtaccgggccaagagccggcagctgctgcagaacatttttggggcccgccaggatgtggccactgtcctgctcctcaaccccaagcaaccaaagctgtccctgctgatgaccaacctcttcccgggcatgtcggtggaggaggtgcttagcacccagatagcccacctggccaggctgcagctggagcagatggtggagggcagcctgcaggccggcagcccacaaggcattgtggggatgcttaaacggcacgagttggagcgccagaaggccttggccctgcagcactcatggaagcagggggagcctttgattgcgacctccgaggagctgaaggccacccctgagattccgcaggtaaaaccgggaagctcagagggagaggctgaggcccctgaggaggaggaagaaaaggagaaggagaaaaaagaggagaaaaaatcagagctcatacctagcaaggtggcgtccctgtctgacagctaccttgaccagacctcttcagcctccagcatgagcttcaggaccacaggcacctcagagactgagatgtcggctatctgccaggaatacaggagcacctcagccaccgccgtgacattctctgactcgtcactgttgaagacgcaatcctcggactctgggaacaacagggaggcactaagccatggtcccagaaaaatcaaggccacccagggccagaggcagagccttagcaagactgagcccacccagagccagaggcggaactccagcaagaccaaggccactatacacaagaggaactccagcaagaccaaggccacccaaagccagaggcggaactccagcaagaccagggccacccagggccaggggcagagctccagcaagactgaggccactcagggccagaggcagagctccagcgagattgaggccacccagggcccaaggcaggagcccagcaagaccaagaccacccggagcccaaggcagaggcccagaaaggtcaaggctgctcgtggccggagctggagacccagcaaggttgatgccacccagggccgaagcaggggactgctccgaagttccaccaagactgaggctttctatgactcaaactggagcctcagcaaaactgagtatgcccaaggccagggccagaggtccagcaaggctgagggtgcccagggcaagagccagggcatgagctcaacttccagcaaggccgagtccacctggggacccagcccaagtctcagcaaaactgaggttgatcaggacctcacctactatgaagctgtctgaagggaccatccagaccctcccttcttgctggggaggggacgagttctacccacctccccacactggcactcagccagctgcctccttccagagcaattaaaagtcttagcaacagtcctctggtcccacagctgagtttattatacttgttttcttttacaaaattaaaaacatctaaaaccaggcccaagtggc

SEQ ID NO: 7592 - DNA, 1608 bp, Homo sapiens
agcaacgtcagggccagggccgcgaggtagttggcagaggcctcggggtcctcctggaaggggcctcatgacagattcggacgagctactccagaggccagcagtgcttggagcaggcagactgggagacagctgtgctgctcttctcccgcgcactccacctggacccacagctggtggacttctatgccttacgggctgaggcctacctccagctctgtgacttctcctcggccgcccagaacctgcgaagggcctactcattacagcaggacaactgcaagcacctggagcgcctcacctttgtgctctacctacagggacaatgcctttttgagcagtgtgccttcctggatgccctgaatgtcttctcacatgctgctgagctccagcctgagaaaccatgcttccgttaccgatgcatggcctgtctcctggccctcaagcagcatcaggcctgcctcacgctcatcaccaacgagctgaagcaggacaccaccaacgccgatgtctacatcttccgggccagactctacaactttctccagaagccccacctctgctaccgggacctgcacagcgccttgctgttgaatcccaagcacccgcaggccaggatgctgctccagaagatggtggcccaggcccagcaggcgcgccaagatgcggggatcctggctgtgcagggcaagctgcagcacgcactgcagcggatcaaccgtgccatcgagaacaaccctctggaccccagtctcttcctcttccggggcaccatgtaccgacggctccaggagttcgatggggcagtggaggacttcctgaaggtgctggacatggtgaccgaggaccaggaggacatggtgcggcaggcacagcgccagctgttgctgacctacaacgactttgccgtgcactgctacaggcagggcgcctaccaggagggcgtgctgctgctgaacaaggccctccgggacgagcagcaggagaaaggactctacatcaaccgaggcggtgcgcagcgaccagggcactggggagggggggtgcgggggagcctcgccatctctaaggcccccactgggcacttgaggcccctggggggaaggaggaagggagagaggaaggaagcaagggaagaggaaatgtaatagtctcagtatcccaggaacacactttgggaaatgttgccttagacaaactggctccagactccttaaaatgctcaaaacaggcagctggggaacagtgcccagacgcccagaaaactagagaggacggagactgcggcggggggttatcagccaccagtttcaggccctggcccccgggctggagccggctgggctggggctcccgggcactgggagttgggggtccactcacccccgcctccggaccctagattgcttcttccagctgggcaacctggcctttgccgaggcggactaccagcaggcgctggcgctgagccctcaggacgagggcgccaacacgcgcatgggcctgctgcaggagaagatgggcttctgcgagcagaggcgcaagcagttccagaaggcagagaaccacttctccacggccatccggcacaacccccagaaggcccag

SEQ ID NO: 7593 - DNA, 4469 bp, Homo sapiens
gccgggggggcaagatggcggcggcagtaggggttcgtggccggtacgagctgccgccttgctccggcccaggctggctcctcagcctttccgccttgctgagtgtggcggcacgaggggccttcgccaccacgcactgggtcgtcacggaggacgggaaaatccagcagcaggtggattcaccaatgaacttgaagcatcctcatgacctagtcatattaatgagacaagaagcaacagttaactacctcaaagaattagagaaacaattagttgctcaaaaaattcacatagaagagaatgaggacagagacacaggactggaacagagacataataaagaagacccagactgcatcaaagccaaggtgcccttaggggacctggatctatatgatggcacatacataactttggagagcaaagacatcagtcctgaagattatatagacacagaatctcctgtccctccagacccagagcaacctgattgtactaaaattctagaacttccatatagtatacatgcttttcagcacttgagaggtgtacaggagagagttaatctttctgcacctctgctacctaaagaagacccaatcttcacatatttatctaaacggttaggaaggagtatagatgacataggtcacctcattcatgaaggcctacagaagaacacttcctcgtgggtactgtataacatggcttcattttactggagaattaagaatgagccatatcaggtagtagaatgtgccatgcgagcacttcacttctcttccaggcacaataaagacattgccctggtcaacctggcaaacgttctacacagagcacacttctctgctgatgctgctgtcgtggtccatgcagctctggatgacagtgacttcttcaccagctattacactttggggaatatatatgcaatgcttggggaatataaccactcagtgctctgttatgaccacgctttgcaggccagacctgggtttgagcaagctataaagaggaagcatgctgtcctatgtcagcaaaaactggagcagaaattggaggctcagcatagatctctccagcgaacactgaatgagttaaaagagtatcaaaagcagcatgaccactacctgagacagcaggaaatcctagaaaaacataaactgattcaggaggagcaaatcttaagaaatatcattcatgagactcagatggcaaaagaggcacaattaggaaatcatcagatatgccgactggtcaaccagcagcatagtttacattgccagtgggaccagcctgtacgctatcatcgtggagatatctttgaaaatgtggactatgttcagtttggtgaggattcatcaacctccagtatgatgtctgtgaactttgatgttcaatcaaatcagagtgatatcaatgattcggtcaagtcttctcccgtagcccattctattctctggatttggggcagggactctgatgcatatagggacaaacagcatattctatggcctaaaagagcagattgtacagaaagctaccctagagtccctgttggtggggaattgccaacgtattttctgcctccggaaaacaaaggactcaggatccacgaactcagcagtgatgattattctacagaagaagaggcccaaacccctgactgttccataactgacttcagaaaaagccacactctgtcctacttagtcaaagaattagaggttcgcatggatctgaaagccaaaatgccagatgaccatgcacgaaaaattttgctttcccgtattaataactatactatcccagaagaagaaattgggtctttcttatttcatgctattaataagccaaatgctcctatctggctcatactcaatgaagctggactatactggagagcagtaggaaatagcacttttgctattgcctgtcttcagagggctttgaatttagctccacttcaataccaagatgttcctcttgtcaacttggccaaccttttgattcattacggccttcatcttgatgccactaagctgctacttcaagctttggccatcaatagctctgagcctctgacctttttgagcctgggaaatgcttaccttgctctgaagaatatcagtggggcacttgaggcctttagacaggccttgaaattaaccaccaaatgtccagagtgtgaaaacagcctgaagttgatccgctgtatgcagttttatccttttctgtacaacatcacttcttctgtttgcagtggtacggtggttgaggagagcaatggttctgatgagatggagaattcagatgaaaccaaaatgtcagaagaaatactggctttggtggatgaatttcaacaggcatggcctttggaaggctttgggggtgcactagagatgaaagggcggcgtctagacttacaaggaatacgggtgctgaagaaaggtccccaggatggagtggccagaagctcttgctatggagactgcagaagtgaagatgatgaagcaacagaatggattacattccaggtcaaacgtgtaaagaaacccaaaggagatcataagaaaactcctgggaaaaaagtagaaacaggtcagatagaaaatggacatcgttaccaagcaaacctagagatcactggccccaaggtggcatctcctgggccacaaggaaaaaaacgtgactaccagcgtctgggatggcccagcccggacgaatgcctcaaactccgctgggtagagctgactgccatcgtgagtacctggcttgcagtttcttcaaaaaacattgacatcacagaacacatagattttgccacccctatacagcagccagcaatggagcctctttgcaatggcaatctccccacgagtatgcataccctggaccacttgcatggggtttccaaccgagccagcctgcactacacaggggagagtcagttaacagaggtattacaaaatctcggcaaagaccaatatccacaacagtcgcttgaacagattggcacccgaattgccaaagttttggaaaagaaccagacgtcctgggtcctctccagcatggcagccctctactggagggtgaaaggccaaggaaagaaggcaatcgactgcctccgccaggctctgcactatgcgccacaccagatgaaggatgtgcccctgattagcctggccaacatcttgcacaatgccaagctctggaatgacgccgtcatagtagccaccatggcagtagagatcgcaccacactttgctgtgaaccacttcactctgggcaatgtctacgtggcaatggaagaatttgaaaaagcactggtgtggtatgaatccacattgaagcttcagcccgagtttgtcccagccaagaaccgaatccagaccatccagtgtcacttaatgctgaagaagggacggcgctctccttagtgcacttcttccttctctctttctctttactcatgctctaaaaaaaaagaataagaaaagaaaccaatcattgtcagtatctactattaatgatgtgtgtgaaaataactaagacttataacaggacttttacatatgtgggaattggtttgtttttgtttttacgtttctcctttcccccaaccaacctcagaagaggcaccttcagaaacacacatttcttaaaaggaaagtgcagcttcaagatattgtgtaaatactgagccaagacatttctggagctgtgctctgtctccaaaaacctcaatgcctttagggcttttctcagtggtccagctagccttctctttggaggaggatgaagccgcattgcacattctctgcttcctgtcgtagcctctgttgtcaatggaaatgcggaagcccatctggtgcccgtcagtgagaagcaacgttctgcgctctctccgttagacctccatgctgtccccagtcttgtccattccatgctgctgtgttacaaactctcagaggtagtttgcaggggaggaaggggaatatgattttaaaaacaaaatatttacaacaacaaaaattcttaggatcacctgacctttgtaatgttatttatgttggggagggaggggggctgagaaggggaaatcagcagtgtgcaacatctttataatttgtactttaattacaaatcacaaggaaaccaataagttgaaatcctatataacaggtttatatatatagaatatgtatatttgaagccctctacagactgagtctatgttttactaattctttgttcactgtgttacccatcttggaataagttgtgaatgtcagctccctctctctgaggcctccagacttagctcctcaggagggtaatgagccaaggttgagtgtttccatacaatgcttttacctttgatcccaggagaatcagaaactccaacattttggaatcttcaagggcacatactgagaaaaaaaataaaattgtttatgagcaaaata

SEQ ID NO: 7594 - DNA, 3444 bp, Homo sapiens
agcggcccggccgggggggcaagatggcggcggcagtaggggttcgtggccggtacgagctgccgccttgctccggcccaggctggctcctcagcctttccgccttgctgagtgtggcggcacgaggggccttcgccaccacgcactgggtcgtcacggaggacgggaaaatccagcagcaggtggattcaccaatgaacttgaagcatcctcatgacctagtcatattaatgagacaagaagcaacagttaactacctcaaagaattagagaaacaattagttgctcaaaaaattcacatagaagagaatgaggacagagacacaggactggaacagagacataataaagaagacccagactgcatcaaagccaaggtgcccttaggggacctggatctatatgatggcacatacataactttggagagcaaagacatcagtcctgaagattatatagacacagaatctcctgtccctccagacccagagcaacctgattgtactaaaattctagaacttccatatagtatacatgcttttcagcacttgagaggtgtacaggagagagttaatctttctgcacctctgctacctaaagaagacccaatcttcacatatttatctaaacggttaggaaggagtatagatgacataggtcacctcattcatgaaggcctacagaagaacacttcctcgtgggtactgtataacatggcttcattttactggagaattaagaatgagccatatcaggtagtagaatgtgccatgcgagcacttcacttctcttccaggcacaataaagacattgccctggtcaacctggcaaacgttctacacagagcacacttctctgctgatgctgctgtcgtggtccatgcagctctggatgacagtgacttcttcaccagctattacactttggggaatatatatgcaatgcttggggaatataaccactcagtgctctgttatgaccacgctttgcaggccagacctgggtttgagcaagctataaagaggaagcatgctgtcctatgtcagcaaaaactggagcagaaattggaggctcagcatagatctctccagcgaacactgaatgagttaaaagagtatcaaaagcagcatgaccactacctgagacagcaggaaatcctagaaaaacataaactgattcaggaggagcaaatcttaagaaatatcattcatgagactcagatggcaaaagaggcacaattaggaaatcatcagatatgccgactggtcaaccagcagcatagtttacattgccagtgggaccagcctgtacgctatcatcgtggagatatctttgaaaatgtggactatgttcagtttggtgaggattcatcaacctccagtatgatgtctgtgaactttgatgttcaatcaaatcagagtgatatcaatgattcggtcaagtcttctcccgtagcccattctattctctggatttggggcagggactctgatgcatatagggacaaacagcatattctatggcctaaaagagcagattgtacagaaagctaccctagagtccctgttggtggggaattgccaacgtattttctgcctccggaaaacaaaggactcaggatccacgaactcagcagtgatgattattctacagaagaagaggcccaaacccctgactgttccataactgacttcagaaaaagccacactctgtcctacttagtcaaagaattagaggttcgcatggatctgaaagccaaaatgccagatgaccatgcacgaaaaattttgctttcccgtattaataactatactatcccagaagaagaaattgggtctttcttatttcatgctattaataagccaaatgctcctatctggctcatactcaatgaagctggactatactggagagcagtaggaaatagcacttttgctattgcctgtcttcagagggctttgaatttagctccacttcaataccaagatgttcctcttgtcaacttggccaaccttttgattcattacggccttcatcttgatgccactaagctgctacttcaagctttggccatcaatagctctgagcctctgacctttttgagcctgggaaatgcttaccttgctctgaagaatatcagtggggcacttgaggcctttagacaggccttgaaattaaccaccaaatgtccagagtgtgaaaacagcctgaagttgatccgctgtatgcagttttatccttttctgtacaacatcacttcttctgtttgcagtggtaattgtcatgagaaaaccctggacaacagccatgacaaacagaaatattttgacaactcacagtcactggatgctgctgaagaagagccctctgagagaggaacagaggaggaccctgtattctctgttgagaattcagggagggactcagatgcccttagacttgaaagtacggtggttgaggagagcaatggttctgatgagatggagaattcagatgaaaccaaaatgtcagaagaaatactggctttggtggatgaatttcaacaggcatggcctttggaaggctttgggggtgcactagagatgaaagggcggcgtctagacttacaaggaatacgggtgctgaagaaaggtccccaggatggagtggccagaagctcttgctatggagactgcagaagtgaagatgatgaagcaacagaatggattacattccaggtcaaacgtgtaaagaaacccaaaggagatcataagaaaactcctgggaaaaaagtagaaacaggtcagatagaaaatggacatcgttaccaagcaaacctagagatcactggccccaaggtggcatctcctgggccacaagggctactagactggaagaccaggaaagtgccatagacataatgtaactggatttcagcaaggcatttaacagagcctcttatgatatccttgtgaaccagatggagagatgtgggcttgaagccttcccattgcctacaggataaaattcaaacttcctagtgtggtgtacaagaccctttacagcccgcctctgtgtacccttcaacaccattctctgaaccaaccatgctcatgtttttacctcagtgcctttgcacatgctattccctctgcctggaatgccctgtgccccctctgccctctgccgtgctaaaatatcactcatccttaaacttcaaaatcaagtgccatctcttccttgttaccttcaggcagaattagttactctttcctctgtgcaattgttctatatcttcgctctagctcttttcctgttgtattgtaatgatttgtttatgtttaccttccttactagactgtgagctcaagagcaggccgtcttaattattcctttctgtacccctagtgtcttttatggttctcagccccttataacaggtgctcaataaatatttttcaaatg

SEQ ID NO: 7595 - DNA, 3703 bp, Homo sapiens
agctcagcgtctcgctccctgctcccggccccagagggttatcgcgagtcttggaataaacttgctcgtgcgatggccaaaaagaccaaagaaaacagagggacttttcccagttggtgatatggagcaagtgccatcagcaggcagactcgtgcagatcaccgtgacagagggatatgatttgaaaggttttaaaggagatactccagttacctttattcgagcagaattcaatcaagtggttctgggagactctgcaaaaattactgtttctccagaaggaagtgcaaaatacaacttcactagcagttttgagtttaatcctgaaggaggaatcacttcagatgacctcgctcacaaacctgtgttcttaactgtgactgaagttttaccaaaggaaaagaaacagaaagaagagaagaccttaattcttggtcaggctgtggtggaccttcttcccttactggaaggacagagttcatttcaaacaacagttccattgcaccctgtgcaaggctcacccttagaaactcctagatcaagtgctaagcagtgcagtcttgaagttaaagtattagtggcagagcctttactgaccacagcccagatctcagggggcaatctactgaaggtcacgttggaggctgcttactctgtgcctgaatccttcattccaacaggtcctgggcagaactacatggtcggtctgcaagttccatcacttggagagaaggactatcccattttatttaagaatggaactctgaagcttggaggggaaagggaacctgttccccggcccaaaaagtggccaattgccaacattctggctccaggagctaataacattcctgatgcattcattgttggtggtccctatgaagaagaagaaggagaactcaaccatcctgaggacagcgaatttaggaatcaagcagagtgcataaagaaaaggattatttgggacttggaaagtcgctgctaccttgatccttctgcagtggtcagttttcagaagcgaattgccgattgccggctttggcctgtagagatcacaagagttcctctggtcactatacccaaagggaaagctggcaaaactgaaaagactgatgaagaagctcagctttcgtttcatggtgtggcttatgttaatatggtcccattgttgtatccaggtgtgaagagaattcggggagcttttcatgtttacccttacctagacagtgtagtccatgaaaagaccaaatgtttattgagcttgttccgggatattggccatcacttgattcataataataaaataggaggaattaattctctgctgtccaaacaagctgtttctaagaatctgaaagaagataaaccagtgaaagaaaaggatatagatggaaggcctaggcctggggatgtgcaggcacctagtataaaatctcagagctcagatactcctttggaaggtgaaccccctctaagtcacaatcctgaaggacagcaatatgtagaagcagggacatacattgtgttggaaattcagctggacaaagccttggttccaaagcgaatgccagaggagctagccagaagggtcaaggaaatgattcctccaaggcctcctcttacccgtcggacaggaggagctcagaaggcaatgagtgactaccacatacagatcaagaatatttctagagccattctagatgaatactacagaatgtttggaaaacaggtggccaaactggagagtgatatggatagtgaaaccttggaggagcagaagtgccagctcagctatgaacttaattgctctggaaaatactttgctttcaaagaacaactcaagcatgctgtggtaaagattgtgagagataaatacttgaagacaacatcatttgaaagccaggaggaacttcagacatttatcagtgagctctatgtgttcttagtagatcagatgcatgtagccctaaaccagaccatgccagatgatgtccaaggcactgttgcaaccatttatacaagcagtgaacagcttcaactctttgcatttgaagcagaagtcaatgagaactttgagatggcagcagcatattataaagagagattggtccgtgagccccagaatctggatcactggttggactatggtgccttctgcctcctaactgaagacaacatcaaagcacaagagtgttttcagaaagccctttccctcaaccagagtcatatccacagcttgttgctgtgtggtgtcctggctgtcctgttggagaactatgagcaagcagaaattttctttgaggatgctacttgcttggaaccaactaatgttgtagcctggactttacttggtttgtactatgaaattcaaaacaatgatattcgaatggaaatggcatttcatgaggcctccaaacagcttcaggcacggatgcttcaggcacaagtaacaaagcaaaagagcactggtgtagaagacactgaggaaagagggaagagagaatctagtttaggcccttggggaatcacaaatggttctgcaacagcaatcaaggtggaagccccagcaggaccaggagctgcattatctattctagacaaatttcttgaagaatcctccaaactgcagtctgattcacaagaacccattttgactacacaaacttgggatccaagtataagccaaaaaccatctaacacatttatcaaggagataccaacaaagaaagaagcatcaaaatgtcaagattcatcagctcttctgcatcccggccttcattatggtgtttctcaaactaccaccatcttcatggagaccatacatttcttgatgaaagtcaaggctgtgcagtatgtgcacagagtgcttgcacatgagctgttatgccctcaaggaggccccagctgtgaatattacttggtgctggcccaaacacacattcttaagaagaactttgccaaggcagaggaataccttcaacaagcagcccagatggactacctgaaccccaatgtctggggcctgaagggccatctctattttctgagtggaaatcattctgaggccaaggcatgctatgaacgaaccattagctttgtagtggatgcttctgagatgcacttcatcttcctgagactggggctcatctatctggaagagaaagagtatgaaaaggcaaagaaaacctatatgcaagcctgtaagagatcaccttcatgccttacctggctaggactgggaatcgcctgctatcggctggaggagctcacagaggctgaggatgctctttctgaagccaatgcattgaacaactacaatgctgaagtatgggcatatctggctctggtctgcctgaaagttggacggcaattagaagctgagcaggcctacaagtacatgatcaagctgaaattgaaagatgaggctctgcttgcagagatccacacactacaggaaacagttggctttggaaatccatctttctgatacccctccagctgaacaattttctgcatgggactctgagttcctttccttcccagagagttttaccgtatgaagcctggagctggagaacgaaagaatcttcactataaacagagacccattcatttatttccattggctgtgttactggatgttttactggttgacgagaaactgggtcacaataaaaaaatggagatatgaaactcaaaattc

SEQ ID NO: 7596 - DNA, 1403 bp, Homo sapiens
agtaagttctcgcgagaggtagttggttgctatagttgtcaaaaacataactgaggctgctgcagagaccaaagaaaacagagggacttttcccagttggtgatatggagcaagtgccatcagcaggcagactcgtgcagatcaccgtgacagagggatatgatttgaaaggttttaaaggagatactccagttacctttattcgagcagaattcaatcaagtggttctgggagactctgcaaaaattactgtttctccagaaggaagtgcaaaatacaacttcactagcagttttgagtttaatcctgaaggaggaatcacttcagatgacctcgctcacaaacctgtgttcttaactgtgactgaagttttaccaaaggaaaagaaacagaaagaagagaagaccttaattcttggtcaggctgtggtggaccttcttcccttactggaaggacagagttcatttcaaacaacagttccattgcaccctgtgcaaggctcacccttagaaactcctagatcaagtgctaagcagtgcagtcttgaagttaaagtattagtggcagagcctttactgaccacagcccagatctcagggggcaatctactgaaggtcacgttggaggctgcttactctgtgcctgaatccttcattccaacaggtcctgggcagaactacatggtcggtctgcaagttccatcacttggagagaaggactatcccattttatttaagaatggaactctgaatggaaatcattctgaggccaaggcatgctatgaacgaaccattagctttgtagtggatgcttctgagatgcacttcatcttcctgagactggggctcatctatctggaagagaaagagtatgaaaaggcaaagaaaacctatatgcaagcctgtaagagatcaccttcatgccttacctggctaggactgggaatcgcctgctatcggctggaggagctcacagaggctgaggatgctctttctgaagccaatgcattgaacaactacaatgctgaagtatgggcatatctggctctggtctgcctgaaagttggacggcaattagaagctgagcaggcctacaagtacatgatcaagctgaaattgaaagatgaggctctgcttgcagagatccacacactacaggaaacagttggctttggaaatccatctttctgatacccctccagctgaacaattttctgcatgggactctgagttcctttccttcccagagagttttaccgtatgaagcctggagctggagaacgaaagaatcttcactataaacagagacccattcatttatttccattggctgtgttactggatgttttactggttgacgagaaactgggtcacaataaaaaaatggagatatgaaactcaaaa

SEQ ID NO: 7597 - DNA, 3891 bp, Homo sapiens
gactcctgcctgagtcatcctcctcagtagttgtcaaatgagaaatattgaaatcaaagagtcgagaaagcaaaatgtaaaggtggaaacctatgcacttaaacccaactcttggcaaggtaaagcatccgcggaaacagcaggctctcgaagtgaggaggctgcagccggcgctagggcgcaggcgcagaagctcagcgtctcgctccctgctcccggccccagagggttatcgcgagtcttggaataaacttgctcgtgcgatggccaaaaagaccaaagaaaacagagggacttttcccagttggtgatatggagcaagtgccatcagcaggcagactcgtgcagatcaccgtgacagagggatatgatttgaaaggttttaaaggagatactccagttacctttattcgagcagaattcaatcaagtggttctgggagactctgcaaaaattactgtttctccagaaggaagtgcaaaatacaacttcactagcagttttgagtttaatcctgaaggaggaatcacttcagatgacctcgctcacaaacctgtgttcttaactgtgactgaagttttaccaaaggaaaagaaacagaaagaagagaagaccttaattcttggtcaggctgtggtggaccttcttcccttactggaaggacagagttcatttcaaacaacagttccattgcaccctgtgcaaggctcacccttagaaactcctagatcaagtgctaagcagtgcagtcttgaagttaaagtattagtggcagagcctttactgaccacagcccagatctcagggggcaatctactgaaggtcacgttggaggctgcttactctgtgcctgaatccttcattccaacaggtcctgggcagaactacatggtcggtctgcaagttccatcacttggagagaaggactatcccattttatttaagaatggaactctgaagcttggaggggaaagggaacctgttccccggcccaaaaagtggccaattgccaacattctggctccaggagctaataacattcctgatgcattcattgttggtggtccctatgaagaagaagaaggagaactcaaccatcctgaggacagcgaatttaggaatcaagcagagtgcataaagaaaaggattatttgggacttggaaagtcgctgctaccttgatccttctgcagtggtcagttttcagaagcgaattgccgattgccggctttggcctgtagagatcacaagagttcctctggtcactatacccaaagggaaagctggcaaaactgaaaagactgatgaagaagctcagctttcgtttcatggtgtggcttatgttaatatggtcccattgttgtatccaggtgtgaagagaattcggggagcttttcatgtttacccttacctagacagtgtagtccatgaaaagaccaaatgtttattgagcttgttccgggatattggccatcacttgattcataataataaaataggaggaattaattctctgctgtccaaacaagctgtttctaagaatctgaaagaagataaaccagtgaaagaaaaggatatagatggaaggcctaggcctggggatgtgcaggcacctagtataaaatctcagagctcagatactcctttggaaggtgaaccccctctaagtcacaatcctgaaggacagcaatatgtagaagcagggacatacattgtgttggaaattcagctggacaaagccttggttccaaagcgaatgccagaggagctagccagaagggtcaaggaaatgattcctccaaggcctcctcttacccgtcggacaggaggagctcagaaggcaatgagtgactaccacatacagatcaagaatatttctagagccattctagatgaatactacagaatgtttggaaaacaggtggccaaactggagagtgatatggatagtgaaaccttggaggagcagaagtgccagctcagctatgaacttaattgctctggaaaatactttgctttcaaagaacaactcaagcatgctgtggtaaagattgtgagagataaatacttgaagacaacatcatttgaaagccaggaggaacttcagacatttatcagtgagctctatgtgttcttagtagatcagatgcatgtagccctaaaccagaccatgccagatgatgtccaaggcactgttgcaaccatttatacaagcagtgaacagcttcaactctttgcatttgaagcagaagtcaatgagaactttgagatggcagcagcatattataaagagagattggtccgtgagccccagaatctggatcactggttggactatggtgccttctgcctcctaactgaagacaacatcaaagcacaagagtgttttcagaaagccctttccctcaaccagagtcatatccacagcttgttgctgtgtggtgtcctggctgtcctgttggagaactatgagcaagcagaaattttctttgaggatgctacttgcttggaaccaactaatgttgtagcctggactttacttggtttgtactatgaaattcaaaacaatgatattcgaatggaaatggcatttcatgaggcctccaaacagcttcaggcacggatgcttcaggcacaagtaacaaagcaaaagagcactggtgtagaagacactgaggaaagagggaagagagaatctagtttaggcccttggggaatcacaaatggttctgcaacagcaatcaaggtggaagccccagcaggaccaggagctgcattatctattctagacaaatttcttgaagaatcctccaaactgcagtctgattcacaagaacccattttgactacacaaacttgggatccaagtataagccaaaaaccatctaacacatttatcaaggagataccaacaaagaaagaagcatcaaaatgtcaagattcatcagctcttctgcatcccggccttcattatggtgtttctcaaactaccaccatcttcatggagaccatacatttcttgatgaaagtcaaggctgtgcagtatgtgcacagagtgcttgcacatgagctgttatgccctcaaggaggccccagctgtgaatattacttggtgctggcccaaacacacattcttaagaagaactttgccaaggcagaggaataccttcaacaagcagcccagatggactacctgaaccccaatgtctggggcctgaagggccatctctattttctgagtggaaatcattctgaggccaaggcatgctatgaacgaaccattagctttgtagtggatgcttctgagatgcacttcatcttcctgagactggggctcatctatctggaagagaaagagtatgaaaaggcaaagaaaacctatatgcaagcctgtaagagatcaccttcatgccttacctggctaggactgggaatcgcctgctatcggctggaggagctcacagaggctgaggatgctctttctgaagccaatgcattgaacaactacaatgctgaagtatgggcatatctggctctggtctgcctgaaagttggacggcaattagaagctgagcaggcctacaagtacatgatcaagctgaaattgaaagatgaggctctgcttgcagagatccacacactacaggaaacagttggctttggaaatccatctttctgatacccctccagctgaacaattttctgcatgggactctgagttcctttccttcccagagagttttaccgtatgaagcctggagctggagaacgaaagaatcttcactataaacagagacccattcatttatttccattggctgtgttactggatgttttactggttgacgagaaactgggtcacaataaaaaaatggagatatgaaactcaaaa

SEQ ID NO: 7598 - DNA, 2048 bp, Homo sapiens
agtaagttctcgcgagaggtagttggttgctatagttgagaccaaagaaaacagagggacttttcccagttggtgatatggagcaagtgccatcagcaggcagactcgtgcagatcaccgtgacagagggatatgatttgaaaggttttaaaggagatactccagttacctttattcgagcagaattcaatcaagtggttctgggagactctgcaaaaattactgtttctccagaaggaagtgcaaaatacaacttcactagcagttttgagtttaatcctgaaggaggaatcacttcagatgacctcgctcacaaacctgtgttcttaactgtgactgaagttttaccaaaggaaaagaaacagaaagaagagaagaccttaattcttggtcaggctgtggtggaccttcttcccttactggaaggacagagttcatttcaaacaacagttccattgcaccctgtgcaaggctcacccttagaaactcctagatcaagtgctaagcagtgcagtcttgaagttaaagtattagtggcagagcctttactgaccacagcccagatctcagggggcaatctactgaaggtcacgttggaggctgcttactctgtgcctgaatccttcattccaacaggtcctgggcagaactacatggtcggtctgcaagttccatcacttggagagaaggactatcccattttatttaagaatggaactctgaagcttggaggggaaagggaacctgttccccggcccaaaaagtggccaattgccaacattctggctccaggagctaataacattcctgatgcattcattgttggtggtccctatgaagaagaagaaggagaactcaaccatcctgaggacagcgaatttaggaatcaagcagagtgcataaagaaaaggattatttgggacttggaaagtcgctgctaccttgatccttctgcagtggtcagttttcagaagcgaattgccgattgccggctttggcctgtagagatcacaagagttcctctggtcactatacccaaagggaaagctggcaaaactgaaaagactgatgaagaagctcagctttcgtttcatggtgtggcttatgttaatatggtcccattgttgtatccaggtgtgaagagaattcggggagcttttcatgtttacccttacctagacagtgtagtccatgaaaagaccaaatgtttattgagcttgttccgggatattggccatcacttgattcataataataaaataggaggaattaattctctgctgtccaaacaagctgtttctaagaatctgaaagaagataaaccagtgaaagaaaaggatatagatggaaggcctaggcctggggatgtgcaggcacctagtataaaatctcagagctcagatactcctttggaaggtgaaccccctctaagtcacaatcctgaaggacagcaatatgtagaagcagggacatacattgtgttggaaattcagctggacaaagccttggttccaaagcgaatgccagaggagctagccagaagggtcaaggaaatgattcctccaaggcctcctcttacccgtcggacaggaggagctcagaaggcaatgagtgactaccacatacagatcaagaatatttctagagccattctagatgaatactacagaatgtttggaaaacaggtggccaaactggagagtgatatggatagtgaaaccttggaggagcaggcctacaagtacatgatcaagctgaaattgaaagatgaggctctgcttgcagagatccacacactacaggaaacagttggctttggaaatccatctttctgatacccctccagctgaacaattttctgcatgggactctgagttcctttccttcccagagagttttaccgtatgaagcctggagctggagaacgaaagaatcttcactataaacagagacccattcatttatttccattggctgtgttactggatgttttactggttgacgagaaactgggtcacaataaaaaaatggagatatgaaactcaaaa

SEQ ID NO: 7599 - DNA, 428 bp, Homo sapiens
agttgtcaaaaacataactgaggctgctgcagagaccaaagaaaacagagggacttttcccagttggtgatatggagcaagtgccatcagcaggcagactcgtgcagatcaccgtgacagagggatatgatttgaaaggttttaaaggagatactccagttacctttattcgagcagaattcaatcaagtggttctgggagactctgcaaaaattactgtttctccagaaggaagtgcaaaatacaacttcactagcagttttgagtttaatcctgaaggaggaatcacttcagatgacctcgctcacaaacctgtgttcttaactgtgactgaagttttaccaaaggaaaagaaacagaaagaagagaagaccttaattcttggtcaggctgtggtggaccttcttcccttactggaaggtcagtca

SEQ ID NO: 7600 - DNA, 3601 bp, Homo sapiens
agcgtctcgctccctgctcccggccccagagggttatcgcgagtcttggaataaacttgctcgtgcgatggccaaaaagaccaaagaaaacagagggacttttcccagttggtgatatggagcaagtgccatcagcaggcagactcgtgcagatcaccgtgacagagggatatgatttgaaaggttttaaaggagatactccagttacctttattcgagcagaattcaatcaagtggttctgggagactctgcaaaaattactgtttctccagaaggaagtgcaaaatacaacttcactagcagttttgagtttaatcctgaaggaggaatcacttcagatgacctcgctcacaaacctgtgttcttaactgtgactgaagttttaccaaaggaaaagaaacagaaagaagagaagaccttaattcttggtcaggctgtggtggaccttcttcccttactggaaggacagagttcatttcaaacaacagttccattgcaccctgtgcaaggctcacccttagaaactcctagatcaagtgctaagcagtgcagtcttgaagttaaagtattagtggcagagcctttactgaccacagcccagatctcagggggcaatctactgaaggtcacgttggaggctgcttactctgtgcctgaatccttcattccaacaggtcctgggcagaactacatggtcggtctgcaagttccatcacttggagagaaggactatcccattttatttaagaatggaactctgaagcttggaggggaaagggaacctgttccccggcccaaaaagtggccaattgccaacattctggctccaggagctaataacattcctgatgcattcattgttggtggtccctatgaagaagaagaaggagaactcaaccatcctgaggacagcgaatttaggaatcaagcagagtgcataaagaaaaggattatttgggacttggaaagtcgctgctaccttgatccttctgcagtggtcagttttcagaagcgaattgccgattgccggctttggcctgtagagatcacaagagttcctctggtcactatacccaaagggaaagctggcaaaactgaaaagactgatgaagaagctcagctttcgtttcatggtgtggcttatgttaatatggtcccattgttgtatccaggtgtgaagagaattcggggagcttttcatgtttacccttacctagacagtgtagtccatgaaaagaccaaatgtttattgagcttgttccgggatattggccatcacttgattcataataataaaataggaggaattaattctctgctgtccaaacaagctgtttctaagaatctgaaagaagataaaccagtgaaagaaaaggatatagatggaaggcctaggcctggggatgtgcaggcacctagtataaaatctcagagctcagatactcctttggaaggtgaaccccctctaagtcacaatcctgaaggacagcaatatgtagaagcagggacatacattgtgttggaaattcagctggacaaagccttggttccaaagcgaatgccagaggagctagccagaagggtcaaggaaatgattcctccaaggcctcctcttacccgtcggacaggaggagctcagaaggcagtgagtgactaccacatacagatcaagaatatttctagagccattctagatgaatactacagaatgtttggaaaacaggtggccaaactggagagtgatatggatagtgaaaccttggaggagcagaagtgccagctcagctatgaacttaattgctctggaaaatactttgctttcaaagaacaactcaagcatgctgtggtaaagattgtgagagataaatacttgaagacaacatcatttgaaagccaggaggaacttcagacatttatcagtgagctctatgtgttcttagtagatcagatgcatgtagccctaaaccagaccatgccagatgatgtccaaggcactgttgcaaccatttatacaagcagtgaacagcttcaactctttgcatttgaagcagaagtcaatgagaactttgagatggcagcagcatattataaagagagattggtccgtgagccccagaatctggatcactggttggactatggtgccttctgcctcctaactgaagacaacatcaaagcacaagagtgttttcagaaagccctttccctcaaccagagtcatatccacagcttgttgctgtgtggtgtcctggctgtcctgttggagaactatgagcaagcagaaattttctttgaggatgctacttgcttggaaccaactaatgttgtagcctggactttacttggtttgtactatgaaattcaaaacaatgatattcgaatggaaatggcatttcatgaggcctccaaacagcttcaggcacggatgcttcaggcacaagtaacaaagcaaaagagcactggtgtagaagacactgaggaaagagggaagagagaatctagtttaggcccttggggaatcacaaatggttctgcaacagcaatcaaggtggaagccccagcaggaccaggagctgcattatctattctagacaaatttcttgaagaatcctccaaactgcagtctgattcacaagaacccattttgactacacaaacttgggatccaagtataagccaaaaaccatctaacacatttatcaaggagataccaacaaagaaagaagcatcaaaatgtcaagattcatcagctcttctgcatcccggccttcattatggtgtttctcaaactaccaccatcttcatggagaccatacatttcttgatgaaagtcaaggctgtgcagtatgtgcacagagtgcttgcacatgagctgttatgccctcaaggaggccccagctgtgaatattacttggtgctggcccaaacacacattcttaagaagaactttgccaaggcagaggaataccttcaacaagcagcccagatggactacctgaaccccaatgtctggggcctgaagggccatctctattttctgagtggaaatcattctgaggccaaggcatgctatgaacgaaccattagctttgtagtggatgcttctgagatgcacttcatcttcctgagactggggctcatctatctggaagagaaagagctggaggagctcacagaggctgaggatgctctttctgaagccaatgcattgaacaactacaatgctgaagtatgggcatatctggctctggtctgcctgaaagttggacggcaattagaagctgagcaggcctacaagtacatgatcaagctgaaattgaaagatgaggctctgcttgcagagatccacacactacaggaaacagttggctttggaaatccatctttctgatacccctccagctgaacaattttctgcatgggactctgagttcctttccttcccagagagttttaccgtatgaagcctggagctggagaacgaaagaatcttcactataaacagagacccattcatttatttccattggctgtgttactggatgttttactggttgacgagaaactgggtcacaataaaaaaatggagatatgaaactc

SEQ ID NO: 7601 - DNA, 3703 bp, Homo sapiens
agctcagcgtctcgctccctgctcccggccccagagggttatcgcgagtcttggaataaacttgctcgtgcgatggccaaaaagaccaaagaaaacagagggacttttcccagttggtgatatggagcaagtgccatcagcaggcagactcgtgcagatcaccgtgacagagggatatgatttgaaaggttttaaaggagatactccagttacctttattcgagcagaattcaatcaagtggttctgggagactctgcaaaaattactgtttctccagaaggaagtgcaaaatacaacttcactagcagttttgagtttaatcctgaaggaggaatcacttcagatgacctcgctcacaaacctgtgttcttaactgtgactgaagttttaccaaaggaaaagaaacagaaagaagagaagaccttaattcttggtcaggctgtggtggaccttcttcccttactggaaggacagagttcatttcaaacaacagttccattgcaccctgtgcaaggctcacccttagaaactcctagatcaagtgctaagcagtgcagtcttgaagttaaagtattagtggcagagcctttactgaccacagcccagatctcagggggcaatctactgaaggtcacgttggaggctgcttactctgtgcctgaatccttcattccaacaggtcctgggcagaactacatggtcggtctgcaagttccatcacttggagagaaggactatcccattttatttaagaatggaactctgaagcttggaggggaaagggaacctgttccccggcccaaaaagtggccaattgccaacattctggctccaggagctaataacattcctgatgcattcattgttggtggtccctatgaagaagaagaaggagaactcaaccatcctgaggacagcgaatttaggaatcaagcagagtgcataaagaaaaggattatttgggacttggaaagtcgctgctaccttgatccttctgcagtggtcagttttcagaagcgaattgccgattgccggctttggcctgtagagatcacaagagttcctctggtcactatacccaaagggaaagctggcaaaactgaaaagactgatgaagaagctcagctttcgtttcatggtgtggcttatgttaatatggtcccattgttgtatccaggtgtgaagagaattcggggagcttttcatgtttacccttacctagacagtgtagtccatgaaaagaccaaatgtttattgagcttgttccgggatattggccatcacttgattcataataataaaataggaggaattaattctctgctgtccaaacaagctgtttctaagaatctgaaagaagataaaccagtgaaagaaaaggatatagatggaaggcctaggcctggggatgtgcaggcacctagtataaaatctcagagctcagatactcctttggaaggtgaaccccctctaagtcacaatcctgaaggacagcaatatgtagaagcagggacatacattgtgttggaaattcagctggacaaagccttggttccaaagcgaatgccagaggagctagccagaagggtcaaggaaatgattcctccaaggcctcctcttacccgtcggacaggaggagctcagaaggcagtgagtgactaccacatacagatcaagaatatttctagagccattctagatgaatactacagaatgtttggaaaacaggtggccaaactggagagtgatatggatagtgaaaccttggaggagcagaagtgccagctcagctatgaacttaattgctctggaaaatactttgctttcaaagaacaactcaagcatgctgtggtaaagattgtgagagataaatacttgaagacaacatcatttgaaagccaggaggaacttcagacatttatcagtgagctctatgtgttcttagtagatcagatgcatgtagccctaaaccagaccatgccagatgatgtccaaggcactgttgcaaccatttatacaagcagtgaacagcttcaactctttgcatttgaagcagaagtcaatgagaactttgagatggcagcagcatattataaagagagattggtccgtgagccccagaatctggatcactggttggactatggtgccttctgcctcctaactgaagacaacatcaaagcacaagagtgttttcagaaagccctttccctcaaccagagtcatatccacagcttgttgctgtgtggtgtcctggctgtcctgttggagaactatgagcaagcagaaattttctttgaggatgctacttgcttggaaccaactaatgttgtagcctggactttacttggtttgtactatgaaattcaaaacaatgatattcgaatggaaatggcatttcatgaggcctccaaacagcttcaggcacggatgcttcaggcacaagtaacaaagcaaaagagcactggtgtagaagacactgaggaaagagggaagagagaatctagtttaggcccttggggaatcacaaatggttctgcaacagcaatcaaggtggaagccccagcaggaccaggagctgcattatctattctagacaaatttcttgaagaatcctccaaactgcagtctgattcacaagaacccattttgactacacaaacttgggatccaagtataagccaaaaaccatctaacacatttatcaaggagataccaacaaagaaagaagcatcaaaatgtcaagattcatcagctcttctgcatcccggccttcattatggtgtttctcaaactaccaccatcttcatggagaccatacatttcttgatgaaagtcaaggctgtgcagtatgtgcacagagtgcttgcacatgagctgttatgccctcaaggaggccccagctgtgaatattacttggtgctggcccaaacacacattcttaagaagaactttgccaaggcagaggaataccttcaacaagcagcccagatggactacctgaaccccaatgtctggggcctgaagggccatctctattttctgagtggaaatcattctgaggccaaggcatgctatgaacgaaccattagctttgtagtggatgcttctgagatgcacttcatcttcctgagactggggctcatctatctggaagagaaagagtatgaaaaggcaaagaaaacctatatgcaagcctgtaagagatcaccttcatgccttacctggctaggactgggaatcgcctgctatcggctggaggagctcacagaggctgaggatgctctttctgaagccaatgcattgaacaactacaatgctgaagtatgggcatatctggctctggtctgcctgaaagttggacggcaattagaagctgagcaggcctacaagtacatgatcaagctgaaattgaaagatgaggctctgcttgcagagatccacacactacaggaaacagttggctttggaaatccatctttctgatacccctccagctgaacaattttctgcatgggactctgagttcctttccttcccagagagttttaccgtatgaagcctggagctggagaacgaaagaatcttcactataaacagagacccattcatttatttccattggctgtgttactggatgttttactggttgacgagaaactgggtcacaataaaaaaatggagatatgaaactcaaaattc

SEQ ID NO: 7602 - DNA, 1710 bp, Homo sapiens
caggaggaacttcagacatttatcagtgagctctatgtgttcttagtagatcagatgcatgtagccctaaaccagaccatgccagatgatgtccaaggcactgttgcaaccatttatacaagcagtgaacagcttcaactctttgcatttgaagcagaagtcaatgagaactttgagatggcagcagcatattataaagagagattggtccgtgagccccagaatctggatcactggttggactatggtgccttctgcctcctaactgaagacaacatcaaagcacaagagtgttttcagaaagccctttccctcaaccagagtcatatccacagcttgttgctgtgtggtgtcctggctgtcctgttggagaactatgagcaagcagaaattttctttgaggatgctacttgcttggaaccaactaatgttgtagcctggactttacttggtttgtactatgaaattcaaaacaatgatattcgaatggaaatggcatttcatgaggcctccaaacagcttcaggcacggatgcttcaggcacaagtaacaaagcaaaagagcactggtgtagaagacactgaggaaagagggaagagagaatctagtttaggcccttggggaatcacaaatggttctgcaacagcaatcaaggtggaagccccagcaggaccaggagctgcattatctattctagacaaatttcttgaagaatcctccaaactgcagtctgattcacaagaacccattttgactacacaaacttgggatccaagtataagccaaaaaccatctaacacatttatcaaggagataccaacaaagaaagaagcatcaaaatgtcaagattcatcagctcttctgcatcccggccttcattatggtgtttctcaaactaccaccatcttcatggagaccatacatttcttgatgaaagtcaaggctgtgcagtatgtgcacagagtgcttgcacatgagctgttatgccctcaaggaggccccagctgtgaatattacttggtgctggcccaaacacacattcttaagaagaactttgccaaggcagaggaataccttcaacaagcagcccagatggactacctgaaccccaatgtctggggcctgaagggccatctctattttctgagtggaaatcattctgaggccaaggcatgctatgaacgaaccattagctttgtagtggatgcttctgagatgcacttcatcttcctgagactggggctcatctatctggaagagaaagagctggaggagctcacagaggctgaggatgctctttctgaagccaatgcattgaacaactacaatgctgaagtatgggcatatctggctctggtctgcctgaaagttggacggcaattagaagctgagcaggcctacaagtacatgatcaagctgaaattgaaagatgaggctctgcttgcagagatccacacactacaggaaacagttggctttggaaatccatctttctgatacccctccagctgaacaattttctgcatgggactctgagttcctttccttcccagagagttttaccgtatgaagcctggagctggagaacgaaagaatcttcactataaacagagacccattcatttatttccattggctgtgttactggatgttttactggttgacgagaaactgggtcacaataaaaaaatggagatatgaaactcaaaa

SEQ ID NO: 7603 - DNA, 4258 bp, Homo sapiens
gttttgttcctcccactccagacactggacgctcctagcaaccggctagcagctcggtttccaaggactgtaacgccttcaaccgcccgccgcgatagagtgcccacgaccctgcctcgggaatcccgctctgcaccgccccaccagacccggactcggagccgcgagcggcccgagatgagcagcaatgactcctcccttatggctgggatcatttactatagccaggaaaagtacttccaccatgtgcagcaggctgcagctgtgggcctggaaaaattcagcaatgaccctgtgttgaagttctttaaagcctatggagtcctcaaagaagagcacatccaggatgccatcagtgacctggaaagcatcaggcatcacccagacgtgtccctgtgctccaccatggccctcatttatgctcacaaaagatgtgaaatcattgaccgagaagcaattcaggagcttgagtacagcctgaaggaaatacgcaagacagtcagtgggactgcactgtactatgctggccttttcctctggctcataggccgccatgacaaggccaaagagtacattgaccgcatgctgaagatttctagaggcttcagagaggcctatgtgctcagaggctgggtggacctgacctcagacaagccccacactgcgaagaaagccattgagtacctggaacaaggaattcaggacaccaaagatgtgctggggctgatgggaaaggcaatgtacttcatgatgcagcagaactactcagaggccctggaggtggtgaaccagatcactgtgacttcagggagcttcctgccagccctcgtcctgaagatgcagctgttcttagctcggcaggactgggagcagacagtagaaatgggacacagaatcctagaaaaagatgagagcaatattgatgcctgccaaattctaaccgtgcatgagcttgcaagagaaggaaacatgaccacagtaagttctttgaagactcagaaggctaccaatcacgttagaaatctgattaaggcactagagacaagggaacccgaaaatccaagcctccatcttaaaaaaattattgtggttagccgactgtgtgggagtcaccaggtgattctagggctagtgtgtagtttcatcgagcgcaccttcatggccaccccctcgtatgtccatgtggccacagaactgggctatctcttcatcctgaagaaccaagtgaaagaggccttgctgtggtattcagaagccatgaaactggacaaggatggcatggctggtttgacagggatcatcttgtgtcatatcttagaaggccacctggaggaagctgagtaccggctggaattcctgaaggaggtgcagaagtcccttgggaagtctgaggtgctaattttcctccaagccctcctgatgtccaggaagcacaagggggaggaagagaccacagcgctcctgaaggaggcagtggagcttcacttctccagcatgcaaggcatccctcttggctctgagtactttgaaaagctggacccgtacttcctggtctgcattgctaaggagtacttgctcttctgccccaagcagcccaggttaccaggccagatcgtgtctccacttcttaaacaagtcgccgtgatcttgaatcctgtagtcaaagcagcaccagctctgatcgaccccctgtatttgatggctcaggtcaggtattactcaggagagctagagaatgcccagagcatcctgcagcgttgcctggagctggaccccgcctccgtggatgcccatctcctcatgtgtcagatctacttggctcagggcaactttggcatgtgcttccactgcttagagctgggtgtcagccacaacttccaggtccgagatcaccccctctaccacctcatcaaggccagggccctcaacaaggctggagactatccagaggccataaagacgctgaaaatggtcatcaaattgccagctctgaagaaggaagaaggcagaaagttcctcaggccctctgtgcagcctagccagcgggcatccatcttattggaactggtggaggccctccggctgaatggggagctacatgaggccaccaaggtcatgcaggacaccatcaatgagttcggtggcacaccagaagagaaccgcatcaccattgccaacgtggacttggtcctgagcaagggcaatgtggacgtggcgctgaacatgctaaggaacatcttgcccaagcagtcctgctatatggaagccagagagaagatggccaacatctacctgcagaccctcagagacaggcgcctctacatcagatgctaccgtgagctctgtgaacatctgcctggcccccacaccagcctgctactgggcgatgccttaatgagcattctggagcccgagaaggccctggaggtctatgatgaggcctatagacagaacccacatgacgcctccctggccagcagaattgggcacgcttatgtgaaggcccaccagtatactgaggcaattgagtattatgaggctgcccagaagattaatggacaggactttctgtgctgcgatctgggcaaactgctcctgaagttaaagaaggtcaataaagcagaaaaagttttgaagcaggcactggaacatgacattgtccaagacatcccatccatgatgaatgatgttaagtgcctgcttttgctggcaaaggtttacaagagccataaaaaagaagctgtgatagaaactttgaacaaggccttggacctccagtctcggatactgaagcgagttccactggagcaaccagaaatgattccctcccagaagcaactggcagcctctatctgcatccaatttgcagagcactacctggcagagaaagagtatgacaaggcggtacagtcttataaggatgtcttctcctacttgccaactgacaataaggtgatgctggagctggcgcagctctacctgctccaggggcacctggacctgtgtgagcagcactgtgccatcctcctgcagactgagcagaaccatgagaccgcttctgtgttgatggctgacctgatgtttagaaaacagaaacatgaagcggccatcaatctttaccaccaagtcttggagaaagcgccagacaattttttggtattgcataaattaatcgatctgctaagaagaagtggaaaacttgaagacattcctgccttctttgaattggccaagaaggtgtctagccgggtgcctttggaaccagggttcaattactgcagaggtatctactgctggcacatagggcagcccaacgaagccttaaagttcctgaacaaggcacgcaaggacagcacttggggccagagcgccatctaccacatggtgcagatctgtctgaatccagacaacgaggttgtgggcggagaggcttttgagaaccagggagctgagagcaactacatggagaagaaggagttggagcagcagggtgtgagcaccgccgagaaactgctgcgtgagttttacccacattcagactccagccagacccagctgcggctgctgcagggcctctgccggctggccaccagggagaaggctaacatggaggctgcgctgggcagcttcatccagatagcgcaggctgagaaggacagcgtccctgccctgctggccttggcacaagcctacgtgttcctgaagcagatccccaaggcgcgtatgcagttgaagcgcctggccaagaccccctgggtgctgagtgaggctgaggacctggagaagagctggctcctgctggctgacatttactgccagggcagcaagttcgacctcgccttagaactgctgcggcgctgtgtgcaatacaacaagtcctgctacaaggcctatgagtacatgggcttcatcatggagaaggagcagtcctacaaggatgcagtcaccaactacaaactggcctggaagtacagtcatcacgccaaccctgccattggcttcaaacttgctttcaactacctgaaggacaagaaatttgtggaggccattgaaatctgcaacgatgtcctcagggagcaccccgactaccccaagatcagggaggaaattttggaaaaggcccgaaggtccctgaggccctagctggggtcaaggggcctggaccagtagaagccatcaacctactgaagttgtgtggagggatggaaagtgggtcagtggagaagggattcagaaaatgacacattcttccccattt

SEQ ID NO: 7604 - DNA, 4204 bp, Homo sapiens
gttttgttcctcccactccagacactggacgctcctagcaaccggctagcagctcggtttccaaggactgtaacgccttcaaccgcccgccgcgatagagtgcccacgaccctgcctcgggaatcccgctctgcaccgccccaccagacccggactcggagccgcgagcggcccgagatgagcagcaatgactcctcccttatggctgggatcatttactatagccaggaaaagtacttccaccatgtgcagcaggctgcagctgtgggcctggaaaaattcagcaatgaccctgtgttgaagttctttaaagcctatggagtcctcaaagaagagcacatccaggatgccatcagtgacctggaaagcatcaggcatcacccagacgtgtccctgtgctccaccatggccctcatttatgctcacaaaagatgtgaaatcattgaccgagaagcaattcaggagcttgagtacagcctgaaggaaatacgcaagacagtcagtgggactgcactgtactatgctggccttttcctctggctcataggccgccatgacaaggccaaagagtacattgaccgcatgctgaagatttctagaggcttcagagaggcctatgtgctcagaggctgggtggacctgacctcagacaagccccacactgcgaagaaagccattgagtacctggaacaaggaattcaggacaccaaagatgtgctggggctgatgggaaaggcaatgtacttcatgatgcagcagaactactcagaggccctggaggtggtgaaccagatcactgtgacttcagggagcttcctgccagccctcgtcctgaagatgcagctgttcttagctcggcaggactgggagcagacagtagaaatgggacacagaatcctagaaaaagatgagagcaatattgatgcctgccaaattctaaccgtgcatgagcttgcaagagaaggaaacatgaccacagctaccaatcacgttagaaatctgattaaggcactagagacaagggaacccgaaaatccaagcctccatcttaaaaaaattattgtggttagccgactgtgtgggagtcaccaggtgattctagggctagtgtgtagtttcatcgagcgcaccttcatggccaccccctcgtatgtccatgtggccacagaactgggctatctcttcatcctgaagaaccaagtgaaagaggccttgctgtggtattcagaagccatgaaactggacaaggatggcatggctggtttgacagggatcatcttgtgtcatatcttagaaggccacctggaggaggtgcagaagtcccttgggaagtctgaggtgctaattttcctccaagccctcctgatgtccaggaagcacaagggggaggaagagaccacagcgctcctgaaggaggcagtggagcttcacttctccagcatgcaaggcatccctcttggctctgagtactttgaaaagctggacccgtacttcctggtctgcattgctaaggagtacttgctcttctgccccaagcagcccaggttaccaggccagatcgtgtctccacttcttaaacaagtcgccgtgatcttgaatcctgtagtcaaagcagcaccagctctgatcgaccccctgtatttgatggctcaggtcaggtattactcaggagagctagagaatgcccagagcatcctgcagcgttgcctggagctggaccccgcctccgtggatgcccatctcctcatgtgtcagatctacttggctcagggcaactttggcatgtgcttccactgcttagagctgggtgtcagccacaacttccaggtccgagatcaccccctctaccacctcatcaaggccagggccctcaacaaggctggagactatccagaggccataaagacgctgaaaatggtcatcaaattgccagctctgaagaaggaagaaggcagaaagttcctcaggccctctgtgcagcctagccagcgggcatccatcttattggaactggtggaggccctccggctgaatggggagctacatgaggccaccaaggtcatgcaggacaccatcaatgagttcggtggcacaccagaagagaaccgcatcaccattgccaacgtggacttggtcctgagcaagggcaatgtggacgtggcgctgaacatgctaaggaacatcttgcccaagcagtcctgctatatggaagccagagagaagatggccaacatctacctgcagaccctcagagacaggcgcctctacatcagatgctaccgtgagctctgtgaacatctgcctggcccccacaccagcctgctactgggcgatgccttaatgagcattctggagcccgagaaggccctggaggtctatgatgaggcctatagacagaacccacatgacgcctccctggccagcagaattgggcacgcttatgtgaaggcccaccagtatactgaggcaattgagtattatgaggctgcccagaagattaatggacaggactttctgtgctgcgatctgggcaaactgctcctgaagttaaagaaggtcaataaagcagaaaaagttttgaagcaggcactggaacatgacattgtccaagacatcccatccatgatgaatgatgttaagtgcctgcttttgctggcaaaggtttacaagagccataaaaaagaagctgtgatagaaactttgaacaaggccttggacctccagtctcggatactgaagcgagttccactggagcaaccagaaatgattccctcccagaagcaactggcagcctctatctgcatccaatttgcagagcactacctggcagagaaagagtatgacaaggcggtacagtcttataaggatgtcttctcctacttgccaactgacaataaggtgatgctggagctggcgcagctctacctgctccaggggcacctggacctgtgtgagcagcactgtgccatcctcctgcagactgagcagaaccatgagaccgcttctgtgttgatggctgacctgatgtttagaaaacagaaacatgaagcggccatcaatctttaccaccaagtcttggagaaagcgccagacaattttttggtattgcataaattaatcgatctgctaagaagaagtggaaaacttgaagacattcctgccttctttgaattggccaagaaggtgtctagccgggtgcctttggaaccagggttcaattactgcagaggtatctactgctggcacatagggcagcccaacgaagccttaaagttcctgaacaaggcacgcaaggacagcacttggggccagagcgccatctaccacatggtgcagatctgtctgaatccagacaacgaggttgtgggcggagaggcttttgagaaccagggagctgagagcaactacatggagaagaaggagttggagcagcagggtgtgagcaccgccgagaaactgctgcgtgagttttacccacattcagactccagccagacccagctgcggctgctgcagggcctctgccggctggccaccagggagaaggctaacatggaggctgcgctgggcagcttcatccagatagcgcaggctgagaaggacagcgtccctgccctgctggccttggcacaagcctacgtgttcctgaagcagatccccaaggcgcgtatgcagttgaagcgcctggccaagaccccctgggtgctgagtgaggctgaggacctggagaagagctggctcctgctggctgacatttactgccagggcagcaagttcgacctcgccttagaactgctgcggcgctgtgtgcaatacaacaagtcctgctacaaggcctatgagtacatgggcttcatcatggagaaggagcagtcctacaaggatgcagtcaccaactacaaactggcctggaagtacagtcatcacgccaaccctgccattggcttcaaacttgctttcaactacctgaaggacaagaaatttgtggaggccattgaaatctgcaacgatgtcctcagggagcaccccgactaccccaagatcagggaggaaattttggaaaaggcccgaaggtccctgaggccctagctggggtcaaggggcctggaccagtagaagccatcaacctactgaagttgtgtggagggatggaaagtgggtcagtggagaagggattcagaaaatgacacattcttccccattt

SEQ ID NO: 7605 - DNA, 4209 bp, Homo sapiens
ggctagcagctcggtttccaaggactgtaacgccttcaaccgcccgccgcgatagagtgcccacgaccctgcctcgggaatcccgctctgcaccgccccaccagacccggactcggagccgcgagcggcccgagatgagcagcaatgactcctcccttatggctgggatcatttactatagccaggaaaagtacttccaccatgtgcagcaggctgcagctgtgggcctggaaaaattcagcaatgaccctgtgttgaagttctttaaagcctatggagtcctcaaagaagagcacatccaggatgccatcagtgacctggaaagcatcaggcatcacccagacgtgtccctgtgctccaccatggccctcatttatgctcacaaaagatgtgaaatcattgaccgagaagcaattcaggagcttgagtacagcctgaaggaaatacgcaagacagtcagtgggactgcactgtactatgctggccttttcctctggctcataggccgccatgacaaggccaaagagtacattgaccgcatgctgaagatttctagaggcttcagagaggcctatgtgctcagaggctgggtggacctgacctcagacaagccccacactgcgaagaaagccattgagtacctggaacaaggaattcaggacaccaaagatgtgctggggctgatgggaaaggcaatgtacttcatgatgcagcagaactactcagaggccctggaggtggtgaaccagatcactgtgacttcagggagcttcctgccagccctcgtcctgaagatgcagctgttcttagctcggcaggactgggagcagacagtagaaatgggacacagaatcctagaaaaagatgagagcaatattgatgcctgccaaattctaaccgtgcatgagcttgcaagagaaggaaacatgaccacagtaagttctttgaagactcagaaggctaccaatcacgttagaaatctgattaaggcactagagacaagggaacccgaaaatccaagcctccatcttaaaaaaattattgtggttagccgactgtgtgggagtcaccaggtgattctagggctagtgtgtagtttcatcgagcgcaccttcatggccaccccctcgtatgtccatgtggccacagaactgggctatctcttcatcctgaagaaccaagtgaaagaggccttgctgtggtattcagaagccatgaaactggacaaggatggcatggctggtttgacagggatcatcttgtgtcatatcttagaaggccacctggaggaagctgagtaccggctggaattcctgaaggaggtgcagaagtcccttgggaagtctgaggtgctaattttcctccaagccctcctgatgtccaggaagcacaagggggaggaagagaccacagcgctcctgaaggaggcagtggagcttcacttctccagcatgcaaggcatccctcttggctctgagtactttgaaaagctggacccgtacttcctggtctgcattgctaaggagtacttgctcttctgccccaagcagcccaggttaccaggccagatcgtgtctccacttcttaaacaagtcgccgtgatcttgaatcctgtagtcaaagcagcaccagctctgatcgaccccctgtatttgatggctcaggtcaggtattactcagagctagagaatgcccagagcatcctgcagcgttgcctggagctggaccccgcctccgtggatgcccatctcctcatgtgtcagatctacttggctcagggcaactttggcatgtgcttccactgcttagagctgggtgtcagccacaacttccaggtccgagatcaccccctctaccacctcatcaaggccagggccctcaacaaggctggagactatccagaggccataaagacgctgaaaatggtcatcaaattgccagctctgaagaaggaagaaggcagaaagttcctcaggccctctgtgcagcctagccagcgggcatccatcttattggaactggtggaggccctccggctgaatggggagctacatgaggccaccaaggtcatgcaggacaccatcaatgagttcggtggcacaccagaagagaaccgcatcaccattgccaacgtggacttggtcctgagcaagggcaatgtggacgtggcgctgaacatgctaaggaacatcttgcccaagcagtcctgctatatggaagccagagagaagatggccaacatctacctgcagaccctcagagacaggcgcctctacatcagatgctaccgtgagctctgtgaacatctgcctggcccccacaccagcctgctactgggcgatgccttaatgagcattctggagcccgagaaggccctggaggtctatgatgaggcctatagacagaacccacatgacgcctccctggccagcagaattgggcacgcttatgtgaaggcccaccagtatactgaggcaattgagtattatgaggctgcccagaagattaatggacaggactttctgtgctgcgatctgggcaaactgctcctgaagttaaagaaggtcaataaagcagaaaaagttttgaagcaggcactggaacatgacattgtccaagacatcccatccatgatgaatgatgttaagtgcctgcttttgctggcaaaggtttacaagagccataaaaaagaagctgtgatagaaactttgaacaaggccttggacctccagtctcggatactgaagcgagttccactggagcaaccagaaatgattccctcccagaagcaactggcagcctctatctgcatccaatttgcagagcactacctggcagagaaagagtatgacaaggcggtacagtcttataaggatgtcttctcctacttgccaactgacaataaggtgatgctggagctggcgcagctctacctgctccaggggcacctggacctgtgtgagcagcactgtgccatcctcctgcagactgagcagaaccatgagaccgcttctgtgttgatggctgacctgatgtttagaaaacagaaacatgaagcggccatcaatctttaccaccaagtcttggagaaagcgccagacaattttttggtattgcataaattaatcgatctgctaagaagaagtggaaaacttgaagacattcctgccttctttgaattggccaagaaggtgtctagccgggtgcctttggaaccagggttcaattactgcagaggtatctactgctggcacatagggcagcccaacgaagccttaaagttcctgaacaaggcacgcaaggacagcacttggggccagagcgccatctaccacatggtgcagatctgtctgaatccagacaacgaggttgtgggcggagaggcttttgagaaccagggagctgagagcaactacatggagaagaaggagttggagcagcagggtgtgagcaccgccgagaaactgctgcgtgagttttacccacattcagactccagccagacccagctgcggctgctgcagggcctctgccggctggccaccagggagaaggctaacatggaggctgcgctgggcagcttcatccagatagcgcaggctgagaaggacagcgtccctgccctgctggccttggcacaagcctacgtgttcctgaagcagatccccaaggcgcgtatgcagttgaagcgcctggccaagaccccctgggtgctgagtgaggctgaggacctggagaagagctggctcctgctggctgacatttactgccagggcagcaagttcgacctcgccttagaactgctgcggcgctgtgtgcaatacaacaagtcctgctacaaggcctatgagtacatgggcttcatcatggagaaggagcagtcctacaaggatgcagtcaccaactacaaactggcctggaagtacagtcatcacgccaaccctgccattggcttcaaacttgctttcaactacctgaaggacaagaaatttgtggaggccattgaaatctgcaacgatgtcctcagggagcaccccgactaccccaagatcagggaggaaattttggaaaaggcccgaaggtccctgaggccctagctggggtcaaggggcctggaccagtagaagccatcaacctactgaagttgtgtggagggatggaaagtgggtcagtggagaagggattcagaaaatgacacattcttcccca

SEQ ID NO: 7606 - DNA, 3941 bp, Homo sapiens
gacccggactcggagccgcgagcggcccgagatgagcagcaatgactcctcccttatggctgggatcatttactatagccaggaaaagtacttccaccatgtgcagcaggctgcagctgtgggcctggaaaaattcagcaatgaccctgtgttgaagttctttaaagcctatggagtcctcaaagaagagcacatccaggatgccatcagtgacctggaaagcatcaggcatcacccagacgtgtccctgtgctccaccatggccctcatttatgctcacaaaagatgtgaaatcattgaccgagaagcaattcaggagcttgagtacagcctgaaggaaatacgcaagacagtcagtgggactgcactgtactatgctggccttttcctctggctcataggccgccatgacaaggccaaagagtacattgaccgcatgctgaagatttctagaggcttcagagaggcaatgtacttcatgatgcagcagaactactcagaggccctggaggtggtgaaccagatcactgtgacttcagggagcttcctgccagccctcgtcctgaagatgcagctgttcttagctcggcaggactgggagcagacagtagaaatgggacacagaatcctagaaaaagatgagagcaatattgatgcctgccaaattctaaccgtgcatgagcttgcaagagaaggaaacatgaccacagctaccaatcacgttagaaatctgattaaggcactagagacaagggaacccgaaaatccaagcctccatcttaaaaaaattattgtggttagccgactgtgtgggagtcaccaggtgattctagggctagtgtgtagtttcatcgagcgcaccttcatggccaccccctcgtatgtccatgtggccacagaactgggctatctcttcatcctgaagaaccaagtgaaagaggccttgctgtggtattcagaagccatgaaactggacaaggatggcatggctggtttgacagggatcatcttgtgtcatatcttagaaggccacctggaggaagctgagtaccggctggaattcctgaaggaggtgcagaagtcccttgggaagtctgaggtgctaattttcctccaagccctcctgatgtccaggaagcacaagggggaggaagagaccacagcgctcctgaaggaggcagtggagcttcacttctccagcatgcaaggcatccctcttggctctgagtactttgaaaagctggacccgtacttcctggtctgcattgctaaggagtacttgctcttctgccccaagcagcccaggttaccaggccagatcgtgtctccacttcttaaacaagtcgccgtgatcttgaatcctgtagtcaaagcagcaccagctctgatcgaccccctgtatttgatggctcaggtcaggtattactcaggagagctagagaatgcccagagcatcctgcagcgttgcctggagctggaccccgcctccgtggatgcccatctcctcatgtgtcagatctacttggctcagggcaactttggcatgtgcttccactgcttagagctgggtgtcagccacaacttccaggtccgagatcaccccctctaccacctcatcaaggccagggccctcaacaaggctggagactatccagaggccataaagacgctgaaaatggtcatcaaattgccagctctgaagaaggaagaaggcagaaagttcctcaggccctctgtgcagcctagccagcgggcatccatcttattggaactggtggaggccctccggctgaatggggagctacatgaggccaccaaggtcatgcaggacaccatcaatgagttcggtggcacaccagaagagaaccgcatcaccattgccaacgtggacttggtcctgagcaagggcaatgtggacgtggcgctgaacatgctaaggaacatcttgcccaagcagtcctgctatatggaagccagagagaagatggccaacatctacctgcagaccctcagagacaggcgcctctacatcagatgctaccgtgagctctgtgaacatctgcctggcccccacaccagcctgctactgggcgatgccttaatgagcattctggagcccgagaaggccctggaggtctatgatgaggcctatagacagaacccacatgacgcctccctggccagcagaattgggcacgcttatgtgaaggcccaccagtatactgaggcaattgagtattatgaggctgcccagaagattaatggacaggactttctgtgctgcgatctgggcaaactgctcctgaagttaaagaaggtcaataaagcagaaaaagttttgaagcaggcactggaacatgacattgtccaagacatcccatccatgatgaatgatgttaagtgcctgcttttgctggcaaaggtttacaagagccataaaaaagaagctgtgatagaaactttgaacaaggccttggacctccagtctcggatactgaagcgagttccactggagcaaccagaaatgattccctcccagaagcaactggcagcctctatctgcatccaatttgcagagcactacctggcagagaaagagtatgacaaggcggtacagtcttataaggatgtcttctcctacttgccaactgacaataaggtgatgctggagctggcgcagctctacctgctccaggggcacctggacctgtgtgagcagcactgtgccatcctcctgcagactgagcagaaccatgagaccgcttctgtgttgatggctgacctgatgtttagaaaacagaaacatgaagcggccatcaatctttaccaccaagtcttggagaaagcgccagacaattttttggtattgcataaattaatcgatctgctaagaagaagtggaaaacttgaagacattcctgccttctttgaattggccaagaaggtgtctagccgggtgcctttggaaccagggttcaattactgcagaggtatctactgctggcacatagggcagcccaacgaagccttaaagttcctgaacaaggcacgcaaggacagcacttggggccagagcgccatctaccacatggtgcagatctgtctgaatccagacaacgaggttgtgggcggagaggcttttgagaaccagggagctgagagcaactacatggagaagaaggagttggagcagcagggtgtgagcaccgccgagaaactgctgcgtgagttttacccacattcagactccagccagacccagctgcggctgctgcagggcctctgccggctggccaccagggagaaggctaacatggaggctgcgctgggcagcttcatccagatagcgcaggctgagaaggacagcgtccctgccctgctggccttggcacaagcctacgtgttcctgaagcagatccccaaggcgcgtatgcagttgaagcgcctggccaagaccccctgggtgctgagtgaggctgaggacctggagaagagctggctcctgctggctgacatttactgccagggcagcaagttcgacctcgccttagaactgctgcggcgctgtgtgcaatacaacaagtcctgctacaaggcctatgagtacatgggcttcatcatggagaaggagcagtcctacaaggatgcagtcaccaactacaaactggcctggaagtacagtcatcacgccaaccctgccattggcttcaaacttgctttcaactacctgaaggacaagaaatttgtggaggccattgaaatctgcaacgatgtcctcagggagcaccccgactaccccaagatcagggaggaaattttggaaaaggcccgaaggtccctgaggccctagctggggtcaaggggcctggaccagtagaagccatcaacctactgaagttgtgtggagggatggaaagtgggtcagtggagaagggattcag

SEQ ID NO: 7607 - DNA, 2149 bp, Homo sapiens
acaagggtgaggccaggggagcagagggagcagtcatggcggagctggaggctgtggccgacgatctagacgccctcatcgacgacctggactacctcccgggccactttcacctggagatgcagttgaacttcgagccgcgctcgccggccccacagcgcgcccgggacctgaagctgcagcgggagggtctgcggcaggagctccagctggcggccgccccgcagcgccccgctgtgcgtcacctcctgggcgctttcgcattctacctggaggagctggacgaggcccgcgagtgcttcctcgaggtggcccacgagcacccgggcaacctcaatgcctgggccaatctggcacacgtgtacgggcggctgggccaggaagaagaggaggaggcgtgcgccgcacggctggccgacctcatgggcctggcagaggagcccgaggccgccggggacccccagctccgcgccgctcgctgcctggccgagcagggctacgcgcatggcttcgacgtcggctgcgccagcccagaggagcgtgcgcgggggctggcggcaggcatcgcgctctacgacaaggcgctaggctacgggcagcagatcccgatggaggagaaaaggggctggtatttcaccatggcaacactctacatcaggctagatggcatcttcctggagctgggcagtgaggagcagaagagactgcctgccttcaaccgcacgctggccctactccggcaagtgctgaagtccgaggacccccgccaccgagccctggcctggtgctacctcgggatgctgctggagcggaaggacaccttctccaccacccccatgggcgtccatgactgcgggtactcagggaccgaccctctagactgcttcggcaaggccattgagattgccaagaaccaacctcccatcctgaatcgcctggcaaaaatcttctacttcctgggaaagcaggatatggccattggaacctgcaacatggccctggatgtcctacgagatccagaactcaactggcaggcgtactgcacaagggccaagagacgaggtctcactatgttgcccagactcgtctcaaactcctgggctcaagcagtcctcccacctcgacctcccaaagtgctggaattccaggtgtgagccactacacccagccctgtaaggtttttgagtgaaagaatgcaggagcctccactcactgcaggaatcccttctacaattcctggtcagtgagcccccagcctcttctggattggcacgggtggaatcagactgaccagagttgaaatctggcttctccgccttgtggaacttgcagcaagccacttacccccacaaacttcagttcccaaatctgtaagatataaataacaacactttccttaaaatgttgtcaacagacacagtgaggtagcatctaaagcacagtgccttggacatagggggtgcttttctgaaagccagtagaggtcatttaatatagtggatcagagctctggctctgaacacagacagccttggttcaaatcccacaacaccacgtgctacgggacctttggcaaaatactcttgcccagattctgagcctcaatttctttatctgtagactggagttgttatgagaattacattagattttgtatgtaaaactcagcatcaagcacacagtaagatttcataagagactgactgctactaatttaatattaggcatatttttgaattatctcactgtctcttgatgcagtccactgcatagtcattcagctctgcaagttacacacttaggtgagttctgcctcctgctagcttcccgcactggtcccagacctgcctcctagagcccacacagagcccatgtgcttgaggaagccgactcggagctcccagtttacttcactgcaagccgaagagtcctcccatcccctcatcttctccactactatccacatgacctagtggcaaatctactcccagtcttggtctcagtggcttaattactttgccagcaggtacgaggcaggagtgaaattccttcactgtcgtggatgtggttattattctagataataatgacattaaccataatagtaaataataaaatatctctataaaattctgcatttcatcaagca

SEQ ID NO: 7608 - DNA, 3345 bp, Homo sapiens
tgcccctcgcctcccgcacggagctcgctcggggaacgcccccatccactgccctccacagcctcagggacaagggtgaggccaggggagcagagggagcagtcatggcggagctggaggctgtggccgacgatctagacgccctcatcgacgacctggactacctcccgggccactttcacctggagatgcagttgaacttcgagccgcgctcgccggccccacagcgcgcccgggacctgaagctgcagcgggagggtctgcggcaggagctccagctggcggccgccccgcagcgccccgctgtgcgtcacctcctgggcgctttcgcattctacctggaggagctggacgaggcccgcgagtgcttcctcgaggtggcccacgagcacccgggcaacctcaatgcctgggccaatctggcacacgtgtacgggcggctgggccaggaagaagaggaggaggcgtgcgccgcacggctggccgacctcatgggcctggcagaggagcccgaggccgccggggacccccagctccgcgccgctcgctgcctggccgagcagggctacgcgcatggcttcgacgtcggctgcgccagcccagaggagcgtgcgcgggggctggcggcaggcatcgcgctctacgacaaggcgctaggctacgggcagcagatcccgatggaggagaaaaggggctggtatttcaccatggcaacactctacatcaggctagatggcatcttcctggagctgggcagtgaggagcagaagagactgcctgccttcaaccgcacgctggccctactccggcaagtgctgaagtccgaggacccccgccaccgagccctggcctggtgctacctcgggatgctgctggagcggaaggacaccttctccaccacccccatgggcgtccatgactgcgggtactcagggaccgaccctctagactgcttcggcaaggccattgagattgccaagaaccaacctcccatcctgaatcgcctggcaaaaatcttctacttcctgggaaagcaggatatggccattggaacctgcaacatggccctggatgtcctacgagatccagaactcaactggcaggcgtactgcacaagggccaagatccacatcagagcctacctgcatgacctcaagcgggccaagatgggtctcgggggcatgcctgacaggaaccacctggcctgtgccaaggctgaccttgaggaagtggtcagggtgtgcccaggcttcaaggcgtacctggacatcggccaggtctactactatatgggcgtggacgcggtgcaggagctgctggcggtggacgaggcggcgctgaaccaggcgctggtgttcctggccaaggcgggcgagtcggagctgggtgccacgctgcccgagctgcagctgctgcgcggcaagtgcctgcgcatcaagggcgaggacgccaacgcggccgcctgcttcaagcgcgcagtggagctggacgacgcgggctccagccacaccgacggcttcggctgcctgctcgaggcgctgctggcgcagtggagccaggcacagctgagcgacggggagctgggccgcgaggtggacgcctggctgcgccgcgcccaggacaagtaccccgcggcgcgcctgcgccaggagctgcagcgcgtgtggcgcgggcacacggacgaggtgttggggctggcccgggccctggtggcccagggacggccggcgctggtgcggctgctcttcgagaccatggagcgcgagggcgagggcgccagcgcgccgcgggaccgccgggctgtctcattctagggctcaggtgcccaggccggaggctccctgggaccccgcccaggccccgcccagctgatgggaccaggtccggatggactccctgccttaggctgacctgggagcggagccagttcgattcttggtcgggaattgtgaatggggatgttgcgacacccgcgcggtttgaaacgcccacccagactggaaggcctgattcccgagagcagaagaggctgggagcagaggtgagaaaacactgggaagctgccaattaagggacagaattttctagacatacaggtaaaataagatggttgtgaggcttctgagagaaacagaagacagctacctcagtgtggcagttttctagtccgggcgctcaatccctcaggcctgagtgcctgtctttggactccggtaggccacactctatccttatgagaaagccccgtttactttagttgactggagtgtggtctcagctcctgcagccagaaaagccctgactaaagcagagggcagggtggcacggcgagtgagttacgggacagggccctagcctaagcctcgtgctcagggctcattcctgcctctctgctacttttctagtaggcctccttcttggtccgcttggcccaaaaggcctcccaaatgctctgaaatagagctcatcaatagaaccttcacttgatttccctcttcttgggggaaactaagggcgccacccattaggaggtgccacctgcccccccccttttttttttttttttttgagagggagtttcgctcttgttgcccatgctggagtgcaatggcacgatcttggcccactgcaacctccatctcctgggttcaagcgatcttcccgcctcagccttccaagtagctgggattacagacgtgtgccatcaggcctggctaattttgtatttttagtagagacagggtttcgccatgttggtcaggatggtctcgaactcctgacctcaactgatccacccgcctcagcctcccaaagtgctaggattacaggtgtgagccactgcacccggccctgcccccagtcttgaccattctactaattttaaagaacatcttggaattttacactcttggaatcatagtcgtagaatcctttttttgagacagagtctcactctgtcgcccaggctggagtgcagtggccagatctcagctcactgaaacctcagcctcccaagttcaagtgattctcgtacctcagcctcctgagtagctggaattccaggctgtactcactgctttgctcatatcctcgctcattaccagggacaggccagcacccctgcattgcatctcacatatccactgatggatggagaacagactgaaattcagtgccttagagaccacacactccaaccccctcattgtgcagatgggaaaactgagagccatagaagggaagtggcttgcccaaagccacacttactgttttccccacactgtaccacaaactttcaccattcttcaggtttggaaaaatactaataaactgatcaacactaaa

SEQ ID NO: 7609 - DNA, 3686 bp, Homo sapiens
atcattcattcttttgcctggagttttgtgaggtacccgcttgctttatgggaaaaggctgctccggaactgccctactttagactttttcatggttatcaatctgtacaaagaatcaccaaactgataaagcaggaaccagagggcaaatcacgctgccaagacaactgtgtaattcgctcgaaaaagaaacggtgagcctctccagcagactgggtaaactggcaagggattttacgacatagttggagattggagagttacagaaacttttccggttttttacaagttttaaaggagtgattgagtgtcaaaggaaaagcagagaaaatacaggcacaatttaaagacagcaggaagaagagtgttcagagagcatttttctctttagggtgaagtttgaaagcatcatgcccagattatcagtggatttttgaaaggtctggcagaaggaacagtatcaactgactgagtaggtctcattggcagttgtgattcagagacctagaaagctgaacccacggctggcaagaagaggatggtttgtgggacctgggctgatgtctgatgaaattttaagccccagctatagctactacaaagaaaagtggctgatgataagcatgtaactcaaaaagacaatgtatataaaaatatgcaagaatcacaggaaacccacatatccaaccacctagatgaagttgttgctgctgttagcatcactcatagaaagaagttccaaaacaagctgcttcagacagcactattccagcctcctcgagagaaactccacctctgtgaagagaaagcaaagtcctattccaacagtcatgagtacaaacaggccgtccatgagcttgtgcgttgcgtagcactgacaagaatttgctatggagactcacattggaaactagcagaggcacatgttaatctggctcaaggctacctccagctgaaaggactgtcactgcaagcaaaacaacatgcagaaaaagccagacaaatcctcgccaactccattgtgcctccctatagtgagaatacagatgttttcaagttttccattgagcttttccataccatgggcagagctttactctcccttcaaaaatttaaggaagctgcagagaatttgacaaaagcagagagactttcaaaggagctgctacaatgtggaagaattataaaggaagaatggatagaaattgaagcacggatcagattatcatttgcacaggtgtatcaaggtcagaagaagtcaaaagaagctttgtcccactatcaagcagctttggaatatgttgagatcagtaaaggtgaaacaagtcgtgagtgtgtacccatattgagagaattagcaggtgtagagcaagccctgggactccacgatgtatccatcaaccacttcctccaggcacatcttatcatcctgagtagaagcccctctcaagtggaggcagcagactcggcacacatcgtcgcccatgctgctgtcgcttcagggagacacgagcaccatgatgtagctgagcagtattttcaagagagcatggctcatcttaaggattctgaagggatgggaagaaccaaatttctttcaattcaagatgaattttgccattttctacaaatgactggacaaaaagagagagcaacctcgatcctgagagagtccctggaagccaaagtggaagcatttggcgatttcagtcccgaggtggcagagacataccggctcctgggaggagcagacctggcgcaggggaaccacagtggggcccgcaagaaactgaagaagtgtctccagatccagaccctcttatatggaccgcaggacaaaaggactctggccacccagcaggccatgggcatgctgtccacggcccccaaggttgcttcgaagccaaggcaggcatcaaaagccaaagtggccttctgcaccagcatccctcaggacaccctgctggggaaggcccggcccggcacaacagcagactgaggcccccaccctgaaaaagcctaggacattcctgggcactgtcatttagggtgctgtacaaatcacctccgcctagaaaatggaattcaacagtcaggatacagatttccaaggccaactgttggccccaacatgcaacagtgagaccataagcctcccgtgggccacattttgacagtggatgcccttcagggtgatatatgctataaagcagttttctatcacctaagtggtttttcttgccaacaagaatttttacccatcagcactactgtggctgaaaaacttctcttcaacagttcagtgcgccctgtgcaggagtcagcccggcatctgcttgtacacacagctccttgcataggtgtggagttagatctggacagtgaacttcaggaagtcctttcttataggaggctaatagggattgagaataacatgagaagaaaacgctaataaagggaaacctgaacacgctgctgtcagcatgtgttttcaaagtgcagcctgcctcagagttcttcggagcctgaaaaggggtttgagaaagagcccagtaggaggggcaggaggccgacacacctgacttggcctggggcccaggaggcaggtgtaagggagtgaaaagaaaggctagccggaggctgcggggggaagaccgcagactccctgctgcttcgcatccctcctgtggcctccactgcaggcaggacaaacctggatgccacctggagctgcttcctgagttggcacactatcgtgtacacagcagtcttcagccccctggaaggaggccatagtcgtgtgaggatggcaaagtcgaacaggaagctttgagtgccttcctccacgatgtcaacgaggagatccagtgccagatcgaggtggatggaacacccaggggtaggggtgcaggtgtgggcagtgatgtcccttcccctccctcccctggtcccacagactgtggccatgaggctgcaggctggtgctatgacagcagattgcagcacagggccctcccctccagcccccagtgggacatcaaaaccaccctggggccatttgtgcagggcaccacctccagtattgatggggaaaataaactcagtagagccacgacagggtggagagaagcagggaccattgtcttcctcaggagcgtgacagctgaccccacagaccatgcttgctggtacacactggtcccagacccaggcctgtcggacatcagcagtgtgctaaaaacgtgtaagatgtcactactcaccgtgtgtcctatctagttgacatgggtggagtcagctaaggggtgaatgttcatatgctcccaattcacgttgaagccctaatccccaaagggatggtattgggggtggggtcttggagaggtgattaggttatgagggtggagccctgatgaatgggattagtgctttataaggagagacaccagagagatgatctctctctccaccatgtgaggacacagtgagaagacagccgtctgcaggcccggaagagagccctcaccaggaaatgaaactgttggcaccttgagacttcccagcttccagaactgtaagaaataaatgtttgttgtttaagcctttcaggctacggctttctgttacagcagcctgaactgagagtccatgccgagtttttgaaataaatgtgaattctgatgtta

SEQ ID NO: 7610 - DNA, 1959 bp, Homo sapiens
atcattcattcttttgcctggagttttgtgaggtacccgcttgctttatgggaaaaggctgctccggaactgccctactttagactttttcatggttatcaatctgtacaaagaatcaccaaactgataaagcaggaaccagagggcaaatcacgctgccaagacaactgtgtaattcgctcgaaaaagaaacggtgagcctctccagcagactgggtaaactggcaagggattttacgacatagttggagattggagagttacagaaacttttccggttttttacaagttttaaaggagtgattgagtgtcaaaggaaaagcagagaaaatacaggcacaatttaaagacagcaggaagaagagtgttcagagagcatttttctctttagggtgaagtttgaaagcatcatgcccagattatcagtggatttttgaaagatggagtctcgctctgtcacccaggctggagtatagtggtgtgatcttggctcactgcaacctctgcctcccaggttcaagcgattctcctgcctcagcctctcgagtagctggaattacaggtctggcagaaggaacagtatcaactgactgagtaggtctcattggcagttgtgattcagagacctagaaagctgaacccacggctggcaagaagaggatggtttgtgggacctgggctgatgtctgatgaaattttaagccccagctatagctactacaaagaaaagtggctgatgataagcatgtaactcaaaaagacaatgtatataaaaatatgcaagaatcacaggaaacccacatatccaaccacctagatgaagttgttgctgctgttagcatcactcatagaaagaagttccaaaacaagctgcttcagacagcactattccagcctcctcgagagaaactccacctctgtgaagagaaagcaaagtcctattccaacagtcatgagtacaaacaggccgtccatgagcttgtgcgttgcgtagcactgacaagaatttgctatggagactcacattggaaactagcagaggcacatgttaatctggctcaaggctacctccagctgaaaggactgtcactgcaagcaaaacaacatgcagaaaaagccagacaaatcctcgccaactccattgtgcctccctatagtgagaatacagatgttttcaagttttccattgagcttttccataccatgggcagagctttactctcccttcaaaaatttaaggaagctgcagagaatttgacaaaagcagagagactttcaaaggagctgctacaatgtggaagaattataaaggaagaatggatagaaattgaagcacggatcagattatcatttgcacaggtgtatcaaggtcagaagaagtcaaaagaagctttgtcccactatcaagcagctttggaatatgttgagatcagtaaaggtgaaacaagtcgtgagtgtgtacccatattgagagaattagcaggtgtagagcaagccctgggactccacgatgtatccatcaaccacttcctccaggcacatcttatcatcctgagtagaagcccctctcaagtggaggcagcagactcggcacacatcgtcgcccatgctgctgtcgcttcagggagacacgagcaccatgatgtagctgagcagtattttcaagagagcatggctcatcttaaggattctgaagggatgggaagaaccaaatttctttcaattcaagatgaattttgccattttctacaaatgactggacaaaaagagagagcaacctcgatcctgagagagtccctggaagccaaagtggaagcatttggcgatttcagtcccgaggtggcagagacataccggctcctgggaggagcagacctggcgcaggggaaccacagtggggcccgcaagaaactgaagaagggagaccttagtttcctgctctcagcgacacttccatag

SEQ ID NO: 7611 - DNA, 3849 bp, Homo sapiens
aaaaggctgctccggaactgccctactttagactttttcatggttatcaatctgtacaaagaatcaccaaactgataaagcaggaaccagagggcaaatcacgctgccaagacaactgtgtaattcgctcgaaaaagaaacggtgagcctctccagcagactgggtaaactggcaagggattttacgacatagttggagattggagagttacagaaacttttccggttttttacaagttttaaaggagtgattgagtgtcaaaggaaaagcagagaaaatacaggcacaatttaaagacagcaggaagaagagtgttcagagagcatttttctctttagggtgaagtttgaaagcatcatgcccagattatcagtggatttttgaaagatggagtctcgctctgtcacccaggctggagtatagtggtgtgatcttggctcactgcaacctctgcctcccaggttcaagcgattctcctgcctcagcctctcgagtagctggaattacaggtctggcagaaggaacagtatcaactgactgagtaggtctcattggcagttgtgattcagagacctagaaagctgaacccacggctggcaagaagaggatggtttgtgggacctgggctgatgtctgatgaaattttaagccccagctatagctactacaaagaaaagtggctgatgataagcatgtaactcaaaagacagagttttgccatgttgcccaggctggtcccaaactcctgagctgaggtgaccctcccgcctccacctcccagagtgctgggattacagaagacaatgtatataaaaatatgcaagaatcacaggaaacccacatatccaaccacctagatgaagttgttgctgctgttagcatcactcatagaaagaagttccaaaacaagctgcttcagacagcactattccagcctcctcgagagaaactccacctctgtgaagagaaagcaaagtcctattccaacagtcatgagtacaaacaggccgtccatgagcttgtgcgttgcgtagcactgacaagaatttgctatggagactcacattggaaactagcagaggcacatgttaatctggctcaaggctacctccagctgaaaggactgtcactgcaagcaaaacaacatgcagaaaaagccagacaaatcctcgccaactccattgtgcctccctatagtgagaatacagatgttttcaagttttccattgagcttttccataccatgggcagagctttactctcccttcaaaaatttaaggaagctgcagagaatttgacaaaagcagagagactttcaaaggagctgctacaatgtggaagaattataaaggaagaatggatagaaattgaagcacggatcagattatcatttgcacaggtgtatcaaggtcagaagaagtcaaaagaagctttgtcccactatcaagcagctttggaatatgttgagatcagtaaaggtgaaacaagtcgtgagtgtgtacccatattgagagaattagcaggtgtagagcaagccctgggactccacgatgtatccatcaaccacttcctccaggcacatcttatcatcctgagtagaagcccctctcaagtggaggcagcagactcggcacacatcgtcgcccatgctgctgtcgcttcagggagacacgagcaccatgatgtagctgagcagtattttcaagagagcatggctcatcttaaggattctgaagggatgggaagaaccaaatttctttcaattcaagatgaattttgccattttctacaaatgactggacaaaaagagagagcaacctcgatcctgagagagtccctggaagccaaagtggaagcatttggcgatttcagtcccgaggtggcagagacataccggctcctgggaggagcagacctggcgcaggggaaccacagtggggcccgcaagaaactgaagaagtgtctccagatccagaccctcttatatggaccgcaggacaaaaggactctggccacccagcaggccatgggcatgctgtccacggcccccaaggttgcttcgaagccaaggcaggcatcaaaagccaaagtggccttctgcaccagcatccctcaggacaccctgctggggaaggcccggcccggcacaacagcagactgaggcccccaccctgaaaaagcctaggacattcctgggcactgtcatttagggtgctgtacaaatcacctccgcctagaaaatggaattcaacagtcaggatacagatttccaaggccaactgttggccccaacatgcaacagtgagaccataagcctcccgtgggccacattttgacagtggatgcccttcagggtgatatatgctataaagcagttttctatcacctaagtggtttttcttgccaacaagaatttttacccatcagcactactgtggctgaaaaacttctcttcaacagttcagtgcgccctgtgcaggagtcagcccggcatctgcttgtacacacagctccttgcataggtgtggagttagatctggacagtgaacttcaggaagtcctttcttataggaggctaatagggattgagaataacatgagaagaaaacgctaataaagggaaacctgaacacgctgctgtcagcatgtgttttcaaagtgcagcctgcctcagagttcttcggagcctgaaaaggggtttgagaaagagcccagtaggaggggcaggaggccgacacacctgacttggcctggggcccaggaggcaggtgtaagggagtgaaaagaaaggctagccggaggctgcggggggaagaccgcagactccctgctgcttcgcatccctcctgtggcctccactgcaggcaggacaaacctggatgccacctggagctgcttcctgagttggcacactatcgtgtacacagcagtcttcagccccctggaaggaggccatagtcgtgtgaggatggcaaagtcgaacaggaagctttgagtgccttcctccacgatgtcaacgaggagatccagtgccagatcgaggtggatggaacacccaggggtaggggtgcaggtgtgggcagtgatgtcccttcccctccctcccctggtcccacagactgtggccatgaggctgcaggctggtgctatgacagcagattgcagcacagggccctcccctccagcccccagtgggacatcaaaaccaccctggggccatttgtgcagggcaccacctccagtattgatggggaaaataaactcagtagagccacgacagggtggagagaagcagggaccattgtcttcctcaggagcgtgacagctgaccccacagaccatgcttgctggtacacactggtcccagacccaggcctgtcggacatcagcagtgtgctaaaaacgtgtaagatgtcactactcaccgtgtgtcctatctagttgacatgggtggagtcagctaaggggtgaatgttcatatgctcccaattcacgttgaagccctaatccccaaagggatggtattgggggtggggtcttggagaggtgattaggttatgagggtggagccctgatgaatgggattagtgctttataaggagagacaccagagagatgatctctctctccaccatgtgaggacacagtgagaagacagccgtctgcaggcccggaagagagccctcaccaggaaatgaaactgttggcaccttgagacttcccagcttccagaactgtaagaaataaatgtttgttgtttaagcctttcaggctacggctttctgttacagcagcctgaactgagagtccatgccgagtttttgaaataaatgtgaattctgatgtta

SEQ ID NO: 7612 - DNA, 2496 bp, Homo sapiens
actcttgcttccggctccggcgtggggtttgatgtcgacggagtggcttttgcttagcgtcttgaaggggggaaaaaaatcctctaagctggtgatttcacgttctttgacaaacttcaatatcaacaggcaacgataccactttaagaaaattccaaggaaaagacctcattttaaaattcccacctctggctcccaaagattggtttgcaaacttcgacaaaatactcttctccactcgctattggtgagtgctctatcattcattcttttgcctggagttttgtgaggtacccgcttgctttatgggaaaaggctgctccggaactgccctactttagactttttcatggttatcaatctgtacaaagaatcaccaaactgataaagcaggaaccagagggcaaatcacgctgccaagacaactgtgtaattcgctcgaaaaagaaacggtgagcctctccagcagactgggtaaactggcaagggattttacgacatagttggagattggagagttacagaaacttttccggttttttacaagttttaaaggagtgattgagtgtcaaaggaaaagcagagaaaatacaggcacaatttaaagacagcaggaagaagagtgttcagagagcatttttctctttagggtgaagtttgaaagcatcatgcccagattatcagtggatttttgaaagaagacaatgtatataaaaatatgcaagaatcacaggaaacccacatatccaaccacctagatgaagttgttgctgctgttagcatcactcatagaaagaagttccaaaacaagctgcttcagacagcactattccagcctcctcgagagaaactccacctctgtgaagagaaagcaaagtcctattccaacagtcatgagtacaaacaggccgtccatgagcttgtgcgttgcgtagcactgacaagaatttgctatggagactcacattggaaactagcagaggcacatgttaatctggctcaaggctacctccagctgaaaggactgtcactgcaagcaaaacaacatgcagaaaaagccagacaaatcctcgccaactccattgtgcctccctatagtgagaatacagatgttttcaagttttccattgagcttttccataccatgggcagagctttactctcccttcaaaaatttaaggaagctgcagagaatttgacaaaagcagagagactttcaaaggagctgctacaatgtggaagaattataaaggaagaatggatagaaattgaagcacggatcagattatcatttgcacaggtgtatcaaggtcagaagaagtcaaaagaagctttgtcccactatcaagcagctttggaatatgttgagatcagtaaaggtgaaacaagtcgtgagtgtgtacccatattgagagaattagcaggtgtagagcaagccctgggactccacgatgtatccatcaaccacttcctccaggcacatcttatcatcctgagtagaagcccctctcaagtggaggcagcagactcggcacacatcgtcgcccatgctgctgtcgcttcagggagacacgagcaccatgatgtagctgagcagtattttcaagagagcatggctcatcttaaggattctgaagggatgggaagaaccaaatttctttcaattcaagatgaattttgccattttctacaaatgactggacaaaaagagagagcaacctcgatcctgagagagtccctggaagccaaagtggaagcatttggcgatttcagtcccgaggtggcagagacataccggctcctgggaggagcagacctggcgcaggggaaccacagtggggcccgcaagaaactgaagaagtgtctccagatccagaccctcttatatggaccgcaggacaaaaggactctggccacccagcaggccatgggcatgctgtccacggcccccaaggttgcttcgaagccaaggcaggcatcaaaagccaaagtggccttctgcaccagcatccctcaggacaccctgctggggaaggcccggcccggcacaacagcagactgaggcccccaccctgaaaaagcctaggacattcctgggcactgtcatttagggtgctgtacaaatcacctccgcctagaaaatggaattcaacagtcaggatacagatttccaaggccaactgttggccccaacatgcaacagtgagaccataagcctcccgtgggccacattttgacagtggatgcccttcagggtgatatatgctataaagcagttttctatcacctaagtggtttttcttgccaacaagaatttttacccatcagcactactgtggctgaaaaacttctcttcaacagttcagtgcgccctgtgcaggagtcagcccggcatctgcttgtacacacagctccttgcataggtgtggagttagatctggacagtgaacttcaggaagtcctttcttataggaggctaatagggattgagaataa

SEQ ID NO: 7613 - DNA, 3808 bp, Homo sapiens
atcattcattcttttgcctggagttttgtgaggtacccgcttgctttatgggaaaaggctgctccggaactgccctactttagactttttcatggttatcaatctgtacaaagaatcaccaaactgataaagcaggaaccagagggcaaatcacgctgccaagacaactgtgtaattcgctcgaaaaagaaacggtgagcctctccagcagactgggtaaactggcaagggattttacgacatagttggagattggagagttacagaaacttttccggttttttacaagttttaaaggagtgattgagtgtcaaaggaaaagcagagaaaatacaggcacaatttaaagacagcaggaagaagagtgttcagagagcatttttctctttagggtgaagtttgaaagcatcatgcccagattatcagtggatttttgaaagatggagtctcgctctgtcacccaggctggagtatagtggtgtgatcttggctcactgcaacctctgcctcccaggttcaagcgattctcctgcctcagcctctcgagtagctggaattacaggtctggcagaaggaacagtatcaactgactgagtaggtctcattggcagttgtgattcagagacctagaaagctgaacccacggctggcaagaagaggatggtttgtgggacctgggctgatgtctgatgaaattttaagccccagctatagctactacaaagaaaagtggctgatgataagcatgtaactcaaaaagacaatgtatataaaaatatgcaagaatcacaggaaacccacatatccaaccacctagatgaagttgttgctgctgttagcatcactcatagaaagaagttccaaaacaagctgcttcagacagcactattccagcctcctcgagagaaactccacctctgtgaagagaaagcaaagtcctattccaacagtcatgagtacaaacaggccgtccatgagcttgtgcgttgcgtagcactgacaagaatttgctatggagactcacattggaaactagcagaggcacatgttaatctggctcaaggctacctccagctgaaaggactgtcactgcaagcaaaacaacatgcagaaaaagccagacaaatcctcgccaactccattgtgcctccctatagtgagaatacagatgttttcaagttttccattgagcttttccataccatgggcagagctttactctcccttcaaaaatttaaggaagctgcagagaatttgacaaaagcagagagactttcaaaggagctgctacaatgtggaagaattataaaggaagaatggatagaaattgaagcacggatcagattatcatttgcacaggtgtatcaaggtcagaagaagtcaaaagaagctttgtcccactatcaagcagctttggaatatgttgagatcagtaaaggtgaaacaagtcgtgagtgtgtacccatattgagagaattagcaggtgtagagcaagccctgggactccacgatgtatccatcaaccacttcctccaggcacatcttatcatcctgagtagaagcccctctcaagtggaggcagcagactcggcacacatcgtcgcccatgctgctgtcgcttcagggagacacgagcaccatgatgtagctgagcagtattttcaagagagcatggctcatcttaaggattctgaagggatgggaagaaccaaatttctttcaattcaagatgaattttgccattttctacaaatgactggacaaaaagagagagcaacctcgatcctgagagagtccctggaagccaaagtggaagcatttggcgatttcagtcccgaggtggcagagacataccggctcctgggaggagcagacctggcgcaggggaaccacagtggggcccgcaagaaactgaagaagtgtctccagatccagaccctcttatatggaccgcaggacaaaaggactctggccacccagcaggccatgggcatgctgtccacggcccccaaggttgcttcgaagccaaggcaggcatcaaaagccaaagtggccttctgcaccagcatccctcaggacaccctgctggggaaggcccggcccggcacaacagcagactgaggcccccaccctgaaaaagcctaggacattcctgggcactgtcatttagggtgctgtacaaatcacctccgcctagaaaatggaattcaacagtcaggatacagatttccaaggccaactgttggccccaacatgcaacagtgagaccataagcctcccgtgggccacattttgacagtggatgcccttcagggtgatatatgctataaagcagttttctatcacctaagtggtttttcttgccaacaagaatttttacccatcagcactactgtggctgaaaaacttctcttcaacagttcagtgcgccctgtgcaggagtcagcccggcatctgcttgtacacacagctccttgcataggtgtggagttagatctggacagtgaacttcaggaagtcctttcttataggaggctaatagggattgagaataacatgagaagaaaacgctaataaagggaaacctgaacacgctgctgtcagcatgtgttttcaaagtgcagcctgcctcagagttcttcggagcctgaaaaggggtttgagaaagagcccagtaggaggggcaggaggccgacacacctgacttggcctggggcccaggaggcaggtgtaagggagtgaaaagaaaggctagccggaggctgcggggggaagaccgcagactccctgctgcttcgcatccctcctgtggcctccactgcaggcaggacaaacctggatgccacctggagctgcttcctgagttggcacactatcgtgtacacagcagtcttcagccccctggaaggaggccatagtcgtgtgaggatggcaaagtcgaacaggaagctttgagtgccttcctccacgatgtcaacgaggagatccagtgccagatcgaggtggatggaacacccaggggtaggggtgcaggtgtgggcagtgatgtcccttcccctccctcccctggtcccacagactgtggccatgaggctgcaggctggtgctatgacagcagattgcagcacagggccctcccctccagcccccagtgggacatcaaaaccaccctggggccatttgtgcagggcaccacctccagtattgatggggaaaataaactcagtagagccacgacagggtggagagaagcagggaccattgtcttcctcaggagcgtgacagctgaccccacagaccatgcttgctggtacacactggtcccagacccaggcctgtcggacatcagcagtgtgctaaaaacgtgtaagatgtcactactcaccgtgtgtcctatctagttgacatgggtggagtcagctaaggggtgaatgttcatatgctcccaattcacgttgaagccctaatccccaaagggatggtattgggggtggggtcttggagaggtgattaggttatgagggtggagccctgatgaatgggattagtgctttataaggagagacaccagagagatgatctctctctccaccatgtgaggacacagtgagaagacagccgtctgcaggcccggaagagagccctcaccaggaaatgaaactgttggcaccttgagacttcccagcttccagaactgtaagaaataaatgtttgttgtttaagcctttcaggctacggctttctgttacagcagcctgaactgagagtccatgccgagtttttgaaataaatgtgaattctgatgtta

SEQ ID NO: 7614 - DNA, 574 bp, Homo sapiens
attcattcttttgcctggagttttgtgaggtacccgcttgctttatgggaaaaggctgctccggaactgccctactttagactttttcatggttatcaatctgtacaaagaatcaccaaactgataaagcaggaaccagagggcaaatcacgctgccaagacaactgtgtaattcgctcgaaaaagaaacggtctggcagaaggaacagtatcaactgactgagtaggtctcattggcagttgtgattcagagacctagaaagctgaacccacggctggcaagaagaggatggtttgtgggacctgggctgatgtctgatgaaattttaagccccagctatagctactacaaagaaaagtggctgatgataagcatgtaactcaaaaagacaatgtatataaaaatatgcaagaatcacaggaaacccacatatccaaccacctagatgaagttgttgctgctgttagcatcactcatagaaagaagttccaaaacaagctgcttcagacagcactattccagcctcctcgagagaaactccacctctgtgaagagaaagcaaagtcctattcc

SEQ ID NO: 7615 - DNA, 3491 bp, Homo sapiens
atcattcattcttttgcctggagttttgtgaggtacccgcttgctttatgggaaaaggctgctccggaactgccctactttagactttttcatggttatcaatctgtacaaagaatcaccaaactgataaagcaggaaccagagggcaaatcacgctgccaagacaactgtgtaattcgctcgaaaaagaaacggtgagcctctccagcagactgggtaaactggcaagggattttacgacatagttggagattggagagttacagaaacttttccggttttttacaagttttaaaggagtgattgagtgtcaaaggaaaagcagagaaaatacaggcacaatttaaagacagcaggaagaagagtgttcagagagcatttttctctttagggtgaagtttgaaagcatcatgcccagattatcagtggatttttgaaagaagacaatgtatataaaaatatgcaagaatcacaggaaacccacatatccaaccacctagatgaagttgttgctgctgttagcatcactcatagaaagaagttccaaaacaagctgcttcagacagcactattccagcctcctcgagagaaactccacctctgtgaagagaaagcaaagtcctattccaacagtcatgagtacaaacaggccgtccatgagcttgtgcgttgcgtagcactgacaagaatttgctatggagactcacattggaaactagcagaggcacatgttaatctggctcaaggctacctccagctgaaaggactgtcactgcaagcaaaacaacatgcagaaaaagccagacaaatcctcgccaactccattgtgcctccctatagtgagaatacagatgttttcaagttttccattgagcttttccataccatgggcagagctttactctcccttcaaaaatttaaggaagctgcagagaatttgacaaaagcagagagactttcaaaggagctgctacaatgtggaagaattataaaggaagaatggatagaaattgaagcacggatcagattatcatttgcacaggtgtatcaaggtcagaagaagtcaaaagaagctttgtcccactatcaagcagctttggaatatgttgagatcagtaaaggtgaaacaagtcgtgagtgtgtacccatattgagagaattagcaggtgtagagcaagccctgggactccacgatgtatccatcaaccacttcctccaggcacatcttatcatcctgagtagaagcccctctcaagtggaggcagcagactcggcacacatcgtcgcccatgctgctgtcgcttcagggagacacgagcaccatgatgtagctgagcagtattttcaagagagcatggctcatcttaaggattctgaagggatgggaagaaccaaatttctttcaattcaagatgaattttgccattttctacaaatgactggacaaaaagagagagcaacctcgatcctgagagagtccctggaagccaaagtggaagcatttggcgatttcagtcccgaggtggcagagacataccggctcctgggaggagcagacctggcgcaggggaaccacagtggggcccgcaagaaactgaagaagtgtctccagatccagaccctcttatatggaccgcaggacaaaaggactctggccacccagcaggccatgggcatgctgtccacggcccccaaggttgcttcgaagccaaggcaggcatcaaaagccaaagtggccttctgcaccagcatccctcaggacaccctgctggggaaggcccggcccggcacaacagcagactgaggcccccaccctgaaaaagcctaggacattcctgggcactgtcatttagggtgctgtacaaatcacctccgcctagaaaatggaattcaacagtcaggatacagatttccaaggccaactgttggccccaacatgcaacagtgagaccataagcctcccgtgggccacattttgacagtggatgcccttcagggtgatatatgctataaagcagttttctatcacctaagtggtttttcttgccaacaagaatttttacccatcagcactactgtggctgaaaaacttctcttcaacagttcagtgcgccctgtgcaggagtcagcccggcatctgcttgtacacacagctccttgcataggtgtggagttagatctggacagtgaacttcaggaagtcctttcttataggaggctaatagggattgagaataacatgagaagaaaacgctaataaagggaaacctgaacacgctgctgtcagcatgtgttttcaaagtgcagcctgcctcagagttcttcggagcctgaaaaggggtttgagaaagagcccagtaggaggggcaggaggccgacacacctgacttggcctggggcccaggaggcaggtgtaagggagtgaaaagaaaggctagccggaggctgcggggggaagaccgcagactccctgctgcttcgcatccctcctgtggcctccactgcaggcaggacaaacctggatgccacctggagctgcttcctgagttggcacactatcgtgtacacagcagtcttcagccccctggaaggaggccatagtcgtgtgaggatggcaaagtcgaacaggaagctttgagtgccttcctccacgatgtcaacgaggagatccagtgccagatcgaggtggatggaacacccaggggtaggggtgcaggtgtgggcagtgatgtcccttcccctccctcccctggtcccacagactgtggccatgaggctgcaggctggtgctatgacagcagattgcagcacagggccctcccctccagcccccagtgggacatcaaaaccaccctggggccatttgtgcagggcaccacctccagtattgatggggaaaataaactcagtagagccacgacagggtggagagaagcagggaccattgtcttcctcaggagcgtgacagctgaccccacagaccatgcttgctggtacacactggtcccagacccaggcctgtcggacatcagcagtgtgctaaaaacgtgtaagatgtcactactcaccgtgtgtcctatctagttgacatgggtggagtcagctaaggggtgaatgttcatatgctcccaattcacgttgaagccctaatccccaaagggatggtattgggggtggggtcttggagaggtgattaggttatgagggtggagccctgatgaatgggattagtgctttataaggagagacaccagagagatgatctctctctccaccatgtgaggacacagtgagaagacagccgtctgcaggcccggaagagagccctcaccaggaaatgaaactgttggcaccttgagacttcccagcttccagaactgtaagaaataaatgtttgttgtttaagcctttcaggctacggctttctgttacagcagcctgaactgagagtccatgccgagtttttgaaataaatgtgaattctgatgtta

SEQ ID NO: 7616 - DNA, 2068 bp, Homo sapiens
actcttgcttccggctccggcgtggggtttgatgtcgacggagtggcttttgcttagcgtcttgaaggggggaaaaaaatcctctaagctggtgatttcacgttctttgacaaacttcaatatcaacaggcaacgataccactttaagaaaattccaaggaaaagacctcattttaaaattcccacctctggctcccaaagattggtttgcaaacttcgacaaaatactcttctccactcgctattgaagacaatgtatataaaaatatgcaagaatcacaggaaacccacatatccaaccacctagatgaagttgttgctgctgttagcatcactcatagaaagaagttccaaaacaagctgcttcagacagcactattccagcctcctcgagagaaactccacctctgtgaagagaaagcaaagtcctattccaacagtcatgagtacaaacaggccgtccatgagcttgtgcgttgcgtagcactgacaagaatttgctatggagactcacattggaaactagcagaggcacatgttaatctggctcaaggctacctccagctgaaaggactgtcactgcaagcaaaacaacatgcagaaaaagccagacaaatcctcgccaactccattgtgcctccctatagtgagaatacagatgttttcaagttttccattgagcttttccataccatgggcagagctttactctcccttcaaaaatttaaggaagctgcagagaatttgacaaaagcagagagactttcaaaggagctgctacaatgtggaagaattataaaggaagaatggatagaaattgaagcacggatcagattatcatttgcacaggtgtatcaaggtcagaagaagtcaaaagaagctttgtcccactatcaagcagctttggaatatgttgagatcagtaaaggtgaaacaagtcgtgagtgtgtacccatattgagagaattagcaggtgtagagcaagccctgggactccacgatgtatccatcaaccacttcctccaggcacatcttatcatcctgagtagaagcccctctcaagtggaggcagcagactcggcacacatcgtcgcccatgctgctgtcgcttcagggagacacgagcaccatgatgtagctgagcagtattttcaagagagcatggctcatcttaaggattctgaagggatgggaagaaccaaatttctttcaattcaagatgaattttgccattttctacaaatgactggacaaaaagagagagcaacctcgatcctgagagagtccctggaagccaaagtggaagcatttggcgatttcagtcccgaggtggcagagacataccggctcctgggaggagcagacctggcgcaggggaaccacagtggggcccgcaagaaactgaagaagtgtctccagatccagaccctcttatatggaccgcaggacaaaaggactctggccacccagcaggccatgggcatgctgtccacggcccccaaggttgcttcgaagccaaggcaggcatcaaaagccaaagtggccttctgcaccagcatccctcaggacaccctgctggggaaggcccggcccggcacaacagcagactgaggcccccaccctgaaaaagcctaggacattcctgggcactgtcatttagggtgctgtacaaatcacctccgcctagaaaatggaattcaacagtcaggatacagatttccaaggccaactgttggccccaacatgcaacagtgagaccataagcctcccgtgggccacattttgacagtggatgcccttcagggtgatatatgctataaagcagttttctatcacctaagtggtttttcttgccaacaagaatttttacccatcagcactactgtggctgaaaaacttctcttcaacagttcagtgcgccctgtgcaggagtcagcccggcatctgcttgtacacacagctccttgcataggtgtggagttagatctggacagtgaacttcaggaagtcctttcttataggaggctaatagggattgagaataacatgagaagaaaacgctaataaa

SEQ ID NO: 7617 - DNA, 581 bp, Homo sapiens
ttagactttttcatggttatcaatctgtacaaagaatcaccaaactgataaagcaggaaccagagggcaaatcacgctgccaagacaactgtgtaattcgctcgaaaaagaaacggtctggcagaaggaacagtatcaactgactgagtaggtctcattggcagttgtgattcagagacctagaaagctgaacccacggctggcaagaagaggatggtttgtgggacctgggctgatgtctgatgaaattttaagccccagctatagctactacaaagaaaagtggctgatgataagcatgtaactcaaaacagagttttgccatgttgcccaggctggtcccaaactcctgagctgaggtgaccctcccgcctccacctcccagagtgctgggattacagaagacaatgtatataaaaatatgcaagaatcacaggaaacccacatatccaaccacctagatgaagttgttgctgctgttagcatcactcatagaaagaagttccaaaacaagctgcttcagacagcactattccagcctcctcgagagaaactccacctctgtgaagagaaagcaaagt

SEQ ID NO: 7618 - DNA, 666 bp, Homo sapiens
actcttgcttccggctccggcgtggggtttgatgtcgacggagtggcttttgcttagcgtcttgaagggatggagtctcgctctgtcacccaggctggagtatagtggtgtgatcttggctcactgcaacctctgcctcccaggttcaagcgattctcctgcctcagcctctcgagtagctggaattacagaagacaatgtatataaaaatatgcaagaatcacaggaaacccacatatccaaccacctagatgaagttgttgctgctgttagcatcactcatagaaagaagttccaaaacaagctgcttcagacagcactattccagcctcctcgagagaaactccacctctgtgaagagaaagcaaagtcctattccaacagtcatgagtacaaacaggccgtccatgagcttgtgcgttgcgtagcactgacaagaatttgctatggagactcacattggaaactagcagaggcacatgttaatctggctcaaggctacctccagctgaaaggactgtcactgcaagcaaaacaacatgcagaaaaagccagacaaatcctcgccaactccattgtgcctccctatagtgagaatacagatgttttcaagttttccattgagcttttccataccatgggcagagctttactctcccttcaaaa

SEQ ID NO: 7619 - DNA, 585 bp, Homo sapiens
atcattcattcttttgcctggagttttgtgaggtacccgcttgctttatgggaaaaggctgctccggaactgccctactttagactttttcatggttatcaatctgtacaaagaatcaccaaactgataaagcaggaaccagagggcaaatcacgctgccaagacaactgtgtaattcgctcgaaaaagaaacgatggagtctcgctctgtcacccaggctggagtatagtggtgtgatcttggctcactgcaacctctgcctcccaggttcaagcgattctcctgcctcagcctctcgagtagctggaattacagaagacaatgtatataaaaatatgcaagaatcacaggaaacccacatatccaaccacctagatgaagttgttgctgctgttagcatcactcatagaaagaagttccaaaacaagctgcttcagacagcactattccagcctcctcgagagaaactccacctctgtgaagagaaagcaaagtcctattccaacagtcatgagtacaaacaggccgtccatgagcttgtgcgttgcgtagcactgacaagaatttgctatggagactcacat

SEQ ID NO: 7620 - DNA, 549 bp, Homo sapiens
cttttgcctggagttttgtgaggtacccgcttgctttatgggaaaaggctgctccggaactgccctactttagactttttcatggttatcaatctgtacaaagaatcaccaaactgataaagcaggaaccagagggcaaatcacgctgccaagacaactgtgtaattcgctcgaaaaagaaacgaagacaatgtatataaaaatatgcaagaatcacaggaaacccacatatccaaccacctagatgaagttgttgctgctgttagcatcactcatagaaagaagttccaaaacaagctgcttcagacagcactattccagcctcctcgagagaaactccacctctgtgaagagaaagcaaagtcctattccaacagtcatgagtacaaacaggccgtccatgagcttgtgcgttgcgtagcactgacaagaatttgctatggagactcacattggaaactagcagaggcacatgttaatctggctcaaggctacctccagctgaaaggactgtcactgcaagcaaaacaacatgcagaaaaagccaga

SEQ ID NO: 7621 - DNA, 560 bp, Homo sapiens
actcttgcttccggctccggcgtggggtttgatgtcgacggagtggcttttgcttagcgtcttgaagggaagacaatgtatataaaaatatgcaagaatcacaggaaacccacatatccaaccacctagatgaagttgttgctgctgttagcatcactcatagaaagaagttccaaaacaagctgcttcagacagcactattccagcctcctcgagagaaactccacctctgtgaagagaaagcaaagtcctattccaacagtcatgagtacaaacaggccgtccatgagcttgtgcgttgcgtagcactgacaagaatttgctatggagactcacattggaaactagcagaggcacatgttaatctggctcaaggctacctccagctgaaaggactgtcactgcaagcaaaacaacatgcagaaaaagccagacaaatcctcgccaactccattgtgcctccctatagtgagaatacagatgttttcaagttttccattgagcttttccataccatgggcagagctttactctcccttcaaaaatttaaggaagctgca

SEQ ID NO: 7622 - DNA, 3849 bp, Homo sapiens; identical to SEQ ID NO: 7611

SEQ ID NO: 7623 - DNA, 3808 bp, Homo sapiens; identical to SEQ ID NO: 7613

SEQ ID NO: 7624 - DNA, 3491 bp, Homo sapiens; identical to SEQ ID NO: 7615

SEQ ID NO: 7625 - DNA, 3686 bp, Homo sapiens; identical to SEQ ID NO: 7609

SEQ ID NO: 7626 - DNA, 1353 bp, Homo sapiens
attgtctccttggccggacctgggctgcggaaggtaactggggacgtcgcaggctgtgcagctttcgcgaggcaccgctttggcgcccggaccgaggaagaagatgcaagccagccccatccgtatcccaactgttagcaatgacatcgactgggatttctgcttccatatgtcacagcaaaccgagatcccagctcaccagcaaacagatgagttgtatcccactggtgggtgtggagagagtgaagaggaaactaaagctaaagagaaggagaaggccatagactgtatgtctcatcccaaagagaaattagcccaatcccagaagaaagtagctcagctgattaaggaaaaaatgaatactcaagcaaacaaggagctgattcgatgtgtcatcctttctcggattatttttggggaccatcactggaaatgtgcacgagctctggccaacctagcttatggctacttgacactgagaggcctcccagttcaggccaagaaacatgctacatcagccaagaatacactgttgacctggaaggcaaatacgacctcaaataaggagaaagaggaaatcctggaagctctggtcaagctgtactacactctgggcgtggcctggctcctgcagaaccgtggcagagaagcctatttcaacctgcagaaggcagagagaaacatgaaggagctgaaagaattatataaaggaggtgtttgtgaattacaagtctctgagaacgacctaacacttgctttgggcagagcctccttggccatccacagactgaacctagctctggcatactttgaaaaggcaattggcgatgttattgctgccaagggtgataggacgtcagatctgatcagcctgtacgaggaagctgctcagatagagcagctgaggaggaaccacaaccaggccatccagtacttgcagcaggctcattctgtctgtgtttctttgttcactgaagtcagccccaaaactgcagaaatgagtgcgttactggccaaagcttatgccatgtctggagaggcccagcacagggatgctgttgagatatatttcataagaagtatcaatgcatatcgagcaacattgggctcagaggattttgaaacactgagcaccactgaagaattttgcaaatggcttgtccaaaatggagaaaaacaggacaagtagcagttcatccagatggagaagagaagccattcctggaagaaggaactctacatacaaaggcacagaagcatgacagagggcagtgtatggaggaatggtcttctgttatcaaattgaaaacctctatacaggatagccaacaataaagacaaccttgttgatga

SEQ ID NO: 7627 - DNA, 1186 bp, Homo sapiens
attgtctccttggccggacctgggctgcggaaggtaactggggacgtcgcaggctgtgcagctttcgcgaggcaccgctttggcgcccggaccgaggaagaagatgcaagccagccccatccgtatcccaactgttagcaatgacatcgactgggatttctgcttccatatgtcacagcaaaccgagatcccagctcaccagcaaacagatgagttgtatcccactggtgggtgtggagagagtgaagaggaaactaaagctaaagagaaggagaaggccatagactgtatgtctcatcccaaagagaaattagcccaatcccagaagaaagtagctcagctgattaaggaaaaaatgaatactcaagcaaacaaggagctgattcgatgtgtcatcctttctcggattatttttggggaccatcactggaaatgtgcacgagctctggccaacctagcttatggctacttgacactgagaggcctcccagttcaggccaagaaacatgctacatcagccaagaatacactgttgacctggaaggcaaatacgacctcaaataaggagaaagaggaaatcctggaagctctggtcaagctgtactacactctgggcgtggcctggctcctgcagaaccgatgcagagaagcctatttcaacctgcagaaggcagagagaaacatgaaggagctgaaagaattatataaaggaggtgtttgtgaattacaagtctctgagaacgacctaacacttgctttgggcagagcctccttggccatccacagactgaacctagctctggcatactttgaaaaggcaattggcgatgttattgctgccaagggtgataggacgtcagatctgatcagcctgtacgaggaagctgctcagatagagcagctgaggaggaaccacaaccaggccatccagtacttgcagcaggctcattctgtctgtgtttctttgttcactgaagtcagccccaaaactgcagaaatgagtgcgttactggccaaagcttatgccatgtctggagaggcccagcacagggatgctgttgagatatatttcataagaagtatcaatgcatatcgagcaacattgggctcagaggattttgaaacactgagcaccactgaagaattttgcaaatggcttgtccaaaatggagaaaaacaggacagg

SEQ ID NO: 7628 - DNA, 1287 bp, Homo sapiens
ggagcactgagaggcgactgctggggcacctctataacgatctaggcctgggctactcccagctccagctgttcccgctggccgtggaggccttcctgcaggccctgcccctgtgctgggtgccaggagagcaggccacagtgctaagaaacctcgggatggcccacaatgccctcggcaactatcaggaagctcgggagtttcaccagaaggctgctgacctacacggctctgtggggcagcggtgggagcagggccggagctttggcagcctggcctttgcattgagccagctgggggaccacaaggctgccagagacaactacctgcatgccctgcaggctgcccgggactctggggacatgaagggacagtggcaggcctgtgagggtctgggggctgctgcagccaggctggggcagtatgaccaggccttgaagtactataaggaagcactggcccagtgtcagaaggagccagattctgtgcgagaacggctggtggccaagctggcagacaccgtgaggacgcgcttggcccaggtggggctggtccagactcacaccctgacttcggctccgggaagactccaggctccaggtggggccagccaggcggaggggaccccagcaaaggcaggaagcagcacagcaggtgtccagcacagatcttccagtgggtgggaagatgaagagtttgaggagggccaccagaagaaaaaagaggagaggtcggcaaacgttccggtgagggctgggccgggaagaccagagctgtgtttccttccaggcacagtgaatcattcgcaccatctagcttctagttgccccacgtttaccaagcacacgccctgcagagggacagtcctcggcaaagcctccatctatagtccaggacccagggcccatcttccatttgtaggtccaggccctcccagagcggagtaccctagcatcttggtacccaatggccctcaagccaataggtcatccaggtggcccagggaaagcctcagcaggagccgccagaggagacccatggagtcgggcatctgcactattgtgtgacctccccctgccagcctcagccctcatccctgaagcacctgtccaacacgcacacactagggggtcctggggaccaagcctcttcccagttgctcagccctgcagggatgtggaacacagtgcagccagtggactcctgaggaggctggccaagggctttgcaggctcggccctgagaggttctgtttgttcctccttgggatttttggactcagtaggt

SEQ ID NO: 7629 - DNA, 2005 bp, Homo sapiens
cagagagccagctgcggagaagacccaaggagccctatgtcttcccccaaccctgaggatgtgccccggaggccagaacctgagccctcaagctccaataagaaaaagaagaaaagaaagtggctgcggcaagaagccagcatccaagccctcaccagggctggccatggggcccttcaggctggccagaaccatgaagccttgaacaacttccagagggccttccttctggcctccaaggccccacaaaccagggatacccctgtgctccaggcctgcgccttcaacctgggggctgcctatgtggagactggggacccagccagaggccttgagctactcctgcgagcccaccctgaagagaaggcacagggcaggcgacacggcgaccaatgtttcaatgtggctttggcctaccatgccctcggcgagctgcctcaagctttggcctggtaccacagggccctgggccactaccagccacagggtgaccagggagaagcctgggcaaaaatgggagcctgctaccaggctctgggacagcctgagctagcagcccactgcctgcaggaagcaagccaggcctatgctcaagagagacagctgcgggccgcagccctggcactgggggctgcggcaggatgtatgctgaagagtgggcggcatcgggtgggggaagttgtgcaggtgctggagaaaagccggaggcttgccgagaggagcactgagaggcgactgctggggcacctctataacgatctaggcctgggctactcccagctccagctgttcccgctggccgtggaggccttcctgcaggccctgcccctgtgctgggtgccaggagagcaggccacagtgctaagaaacctcgggatggcccacaatgccctcggcaactatcaggaagctcgggagtttcaccagaaggctgctgacctacacggctctgtggggcagcggtgggagcagggccggagctttggcagcctggcctttgcattgagccagctgggggaccacaaggctgccagagacaactacctgcatgccctgcaggctgcccgggactctggggacatgaagggacagtggcaggcctgtgagggtctgggggctgctgcagccaggctggggcagtatgaccaggccttgaagtactataaggaagcactggcccagtgtcagaaggagccagattctgtgcgagaacggctggtggccaagctggcagacaccgtgaggacgcgcttggcccaggtggggctggtccagactcacaccctgacttcggctccgggaagactccaggctccaggtggggccagccaggcggaggggaccccagcaaaggcaggaagcagcacagcaggtgtccagcacagatcttccagtgggtgggaagatgaagagtttgaggagggccaccagaagaaaaaagaggagaggtcggcaaacgttccggtgagggctgggccgggaagaccagagctgtgtttccttccaggcacagtgaatcattcgcaccatctagcttctagttgccccacgtttaccaagcacacgccctgcagagggacagtcctcggcaaagcctccatctatagtccaggacccagggcccatcttccatttgtaggtccaggccctcccagagcggagtaccctagcatcttggtacccaatggccctcaagccaataggtcatccaggtggcccagggaaagcctcagcaggagccgccagaggagacccatggagtcgggcatctgcactattgtgtgacctccccctgccagcctcagccctcatccctgaagcacctgtccaacacgcacacactagggggtcctggggaccaagcctcttcccagttgctcagccctgcagggatgtggaacacagtgcagccagtggactcctgaggaggctggccaagggctttgcaggctcggccctgagaggttctgtttgttcctccttgggatttttggactcagtaggt

SEQ ID NO: 7630 - DNA, 1969 bp, Homo sapiens
atgtcttcccccaaccctgaggatgtgccccggaggccagaacctgagccctcaagctccaataagaaaaagaagaaaagaaagtggctgcggcaagaagccagcatccaagccctcaccagggctggccatggggcccttcaggctggccagaaccatgaagccttgaacaacttccagagggccttccttctggcctccaaggccccacaaaccagggatacccctgtgctccaggcctgcgccttcaacctgggggctgcctatgtggagactggggacccagccagaggccttgagctactcctgcgagcccaccctgaagagaaggcacagggcaggcgacacggcgaccaatgtttcaatgtggctttggcctaccatgccctcggcgagctgcctcaagctttggcctggtaccacagggccctgggccactaccagccacagggtgaccagggagaagcctgggcaaaaatgggagcctgctaccaggctctgggacagcctgagctagcagcccactgcctgcaggaagcaagccaggcctatgctcaagagagacagctgcgggccgcagccctggcactgggggctgcggcaggatgtatgctgaagagtgggcggcatcgggtgggggaagttgtgcaggtgctggagaaaagccggaggcttgccgagaggagcactgagaggcgactgctggggcacctctataacgatctaggcctgggctactcccagctccagctgttcccgctggccgtggaggccttcctgcaggccctgcccctgtgctgggtgccaggagagcaggccacagtgctaagaaacctcgggatggcccacaatgccctcggcaactatcaggaagctcgggagtttcaccagaaggctgctgacctacacggctctgtggggcagcggtgggagcagggccggagctttggcagcctggcctttgcattgagccagctgggggaccacaaggctgccagagacaactacctgcatgccctgcaggctgcccgggactctggggacatgaagggacagtggcaggcctgtgagggtctgggggctgctgcagccaggctggggcagtatgaccaggccttgaagtactataaggaagcactggcccagtgtcagaaggagccagattctgtgcgagaacggctggtggccaagctggcagacaccgtgaggacgcgcttggcccaggtggggctggtccagactcacaccctgacttcggctccgggaagactccaggctccaggtggggccagccaggcggaggggaccccagcaaaggcaggaagcagcacagcaggtgtccagcacagatcttccagtgggtgggaagatgaagagtttgaggagggccaccagaagaaaaaagaggagaggtcggcaaacgttccggtgagggctgggccgggaagaccagagctgtgtttccttccaggcacagtgaatcattcgcaccatctagcttctagttgccccacgtttaccaagcacacgccctgcagagggacagtcctcggcaaagcctccatctatagtccaggacccagggcccatcttccatttgtaggtccaggccctcccagagcggagtaccctagcatcttggtacccaatggccctcaagccaataggtcatccaggtggcccagggaaagcctcagcaggagccgccagaggagacccatggagtcgggcatctgcactattgtgtgacctccccctgccagcctcagccctcatccctgaagcacctgtccaacacgcacacactagggggtcctggggaccaagcctcttcccagttgctcagccctgcagggatgtggaacacagtgcagccagtggactcctgaggaggctggccaagggctttgcaggctcggccctgagaggttctgtttgttcctccttgggatttttggactcagtaggt

SEQ ID NO: 7631 - DNA, 647 bp, Homo sapiens
ggcacctctataacgatctaggcctgggctactcccagctccagctgttcccgctggccgtggaggccttcctgcaggccctgcccctgtgctgggtgccaggagagcaggccacagtgctaagaaacctcgggatggcccacaatgccctcggcaactatcaggaagctcgggagtttcaccagaaggctgctgacctacacggctctgtggggcagcggtgggagcagggccggagctttggcagcctggcctttgcattgagccagctgggggaccacaaggctgccagagacaactacctgcatgccctgcaggctgcccgggactctggagccagattctgtgcgagaacggctggtggccaagctggcagacaccgtgaggacgcgcttggcccaggtggggctggtccagactcacaccctgacttcggctccgggaagactccaggctccaggtggggccagccaggcggaggggaccccagcaaaggcaggaagcagcacagcaggtgtccagcacagatcttccagtgggtgggaagatgaagagtttgaggagggccaccagaagaaaaaagaggagaggtcggcaaacgttccggtgagggctgggccgggaagaccagagcgtgagttgatgta

SEQ ID NO: 7632 - DNA, 2255 bp, Homo sapiens
aaaccagatagaggttctccagcttttctttgattgtctctgctttagcgtctctaaatccggtcaccatgtcggaccccgaaggcgagaccttgcgaagcacctttccctcttatatggccgaaggcgagcggctctacctgtgcggggaattttctaaagccgcgcagagcttcagcaacgctctttaccttcaggatggagacaagaactgcctggttgctcgctcaaagtgcttcctgaagatgggagacttggagagatccctgaaggatgctgaggcttcgctccagagtgacccagctttctgtaaggggattttgcaaaaggctgagacactgtacaccatgggagactttgagtttgccttggtattctatcatcgaggctacaagctgaggcctgatcgggaattcagagttggcattcagaaagcccaggaagccatcaacaactcagtgggaagtccttcttccattaagctggagaacaaaggggacctctccttcttaagcaagcaggctgagaatataaaagcccagcagaagcctcagcccatgaaacacctcttacaccccaccaagggagagcccaagtggaaggcctcgctcaagagtgagaagactgtccgccagcttctgggggagctctacgtggacaaagagtatttggagaagctcctattggatgaagacctgatcaaaggcaccatgaagggcggcctgactgtggaggacctcatcatgacgggcatcaactacctggatactcacagcaacttctggaggcagcagaagccgatctacgccagggagcgggaccggaagctgatgcaagagaaatggctgcgggaccacaaacgccgtccctcacagacagcccattacatcctcaagagcctggaggacattgatatgttgctcacaagtggcagtgctgaagggagtcttcagaaagctgagaaagtgctgaagaaggtactggaatggaacaaggaagaggtacccaacaaggatgaactggttggaaacttgtatagctgcatagggaatgcccagattgagctggggcagatggaggcagccctgcagagccacagaaaggacctggagatcgccaaggaatatgaccttcctgatgcaaaatcgagagcccttgacaacattggcagagtttttgccagagttgggaaattccagcaagccattgacacgtgggaagaaaagatccctctggcaaaaaccaccctggagaagacctggctgttccacgagatcggccgctgctacttggagctggaccaggcctggcaggcccagaattatggcgagaagtcccagcagtgtgccgaggaggaaggggacattgagtggcaactgaatgccagtgttctggtggcccaggcacaagtgaagctgagagacttcgagtcagccgtgaacaattttgagaaggccctggagagagcaaagcttgtgcataacaacgaggcgcagcaggccatcatcagtgccttggacgatgccaacaagggtatcatcagagaactgaggaaaaccaactacgtggagaatctcaaagaaaaaagcgagggagaagcttcactgtatgaagatagaataataacaagagagaaggacatgaggagagtgagagatgagcccgagaaggtggtgaagcagtgggaccatagtgaggatgagaaagagacagatgaggacgatgaggcttttggggaagctctgcagagcccagcaagcggaaagcagagtgtggaagcaggaaaagccagaagcgatttgggagcagttgccaagggcctgtcaggagaattaggcacaagatcaggagaaacaggcaggaagctactagaagctggcagaagagagtcaagagaaatttataggaggccttcgggagaattagagcaaagactctcaggagaattcagcagacaggaaccagaagaactaaagaaactttcagaagtgggcagaagagagccagaagaactgggaaaaacacaatttggagaaataggagaaacgaaaaaaacaggaaatgagatggaaaaggaatatgaatgaagccatcggtagagatgaggatcaggaagctggtgttcagagggatcatgggattttattaaactggattttcaagcgatttgtctgttataggaaaaatgagggttttacttctgctgctttccatcactattttgccattaaataggtgtctttcactcttgcaaa

SEQ ID NO: 7633 - DNA, 2017 bp, Homo sapiens
cgtaccagcgtccaggcggggttaccgtggagacagaacgtgctgtgtggatgcggcgaaacgctgaggcgcggccttcgctgtgtggtggggactcacaagaccgacgtcaagatgatgctttcaagggccaaacctgctgtaggcagaggcgtacagcacactgacaaaagaaagaagaaaggtaggaagattccaaaactagaggagctactttcaaaaagagatttcactggagctattaccctgttggagttcaaacgtcatgttggggaagaagaagaggatactaatttgtggattggatattgtgcctttcacctgggtgactacaagagagctctggaggaatacgaaaatgctacaaaagaggaaaattgtaattctgaagtctgggtgaacctagcttgcacctacttctttcttgggatgtataaacaagctgaagcagctggatttaaagcttcaaaaagccgactccaaaaccgcctcctcttccacttggctcacaagtttaatgatgagaaaaaattgatgagctttcatcaaaatcttcaggatgtcacagaagatcaactcagtttggcctcaatccactatatgcgatctcactaccaagaagctatagatatatataagcgaatactgctagataacagggaataccttgcccttaatgtttatgtggccctctgctactacaagttggattactatgatgtgtctcaagaagttttggctgtttaccttcagcaaattcctgatagtaccatcgcactcaatcttaaagcctgtaaccattttcgcctttacaatggcagagcagctgaggcagaactcaaaagcttgatggacaatgcttcttcatcctttgaatttgctaaagaactcatcaggcacaatctggttgttttccgaggaggtgaaggggctttgcaggttttacctcccctagttgatgtcattcctgaagctaggctaaacttggtgatttactaccttcgtcaagatgatgtacaagaagcttataacttaattaaggatctggaacctactactcctcaggagtatattctcaaaggagtggtcaatgcagcccttggccaggaaatgggttcaagggatcatatgaaaattgcccagcagttcttccagttggtgggaggatcagctagtgaatgtgatacaataccagggaggcagtgcatggcttcctgtttcttcctgcttaagcaatttgatgatgttttgatttacctcaactcatttaagagttacttctataatgatgacatctttaactttaattatgcccaagccaaagctgcaacaggcaataccagtgagggcgaagaggcgttcctcttgatccaaagtgagaagatgaaaaatgattacatttacctcagctggttagctcggtgctatattatgaataagaaaccaagactagcctgggaactttatcttaagatggaaacctccggcgagtccttcagtctcttacagctcattgctaatgactgctacaagagagacccttcgagaagtgctccatttactgagaagcacaggtaacacccaagtagaatacatgatccggatcatgaagaaatgggccaaagaaaacagagtgtccatctaaaatagcgccagcgtcctaggaaccagcttctactttgacataaaactggaaatcattttcactccagtttaatctgtgatacagggctctgttttattgacattttccttccttgctctttaagcctcaaggtcagagactgacttgctgagacttagtctcctggctgaacagagtgccatagtctgtgaccctgtatgatcctagtagcaataagattttggacttatctggtgcctttcttccaaaaatgctcagagtacttttatgcaatttactgactttaaggaaaacagtataacttttttttgttagcattttatggcattgtctcctggctgcaataacaaacatctttgatgttcaagaatc

SEQ ID NO: 7634 - DNA, 4299 bp, Homo sapiens
agaacgtgctgtgtggatgcggcgaaacgctgaggcgcggccttcgctgtgtggtggggactcacaagaccgacgtcaagatgatgctttcaagggccaaacctgctgtaggcagaggcgtacagcacactgacaaaagaaagaagaaaggtaggaagattccaaaactagaggagctactttcaaaaagagatttcactggagctattaccctgttggagttcaaacgtcatgttggggaagaagaagaggatactaatttgtggattggatattgtgcctttcacctgggtgactacaagagagctctggaggaatacgaaaatgctacaaaagaggaaaattgtaattctgaagtctgggtgaacctagcttgcacctacttctttcttgggatgtataaacaagctgaagcagctggatttaaagcttcaaaaagccgactccaaaaccgcctcctcttccacttggctcacaagtttaatgatgagaaaaaattgatgagctttcatcaaaatcttcaggatgtcacagaagatcaactcagtttggcctcaatccactatatgcgatctcactaccaagaagctatagatatatataagcgaatactgctagataacagggaataccttgcccttaatgtttatgtggccctctgctactacaagttggattactatgatgtgtctcaagaagttttggctgtttaccttcagcaaattcctgatagtaccatcgcactcaatcttaaagcctgtaaccattttcgcctttacaatggcagagcagctgaggcagaactcaaaagcttgatggacaatgcttcttcatcctttgaatttgctaaagaactcatcaggcacaatctggttgttttccgaggaggtgaaggggctttgcaggttttacctcccctagttgatgtcattcctgaagctaggctaaacttggtgatttactaccttcgtcaagatgatgtacaagaagcttataacttaattaaggatctggaacctactactcctcaggagtatattctcaaaggagtggtcaatgcagcccttggccaggaaatgggttcaagggatcatatgaaaattgcccagcagttcttccagttggtgggaggatcagctagtgaatgtgatacaataccagggaggcagtgcatggcttcctgtttcttcctgcttaagcaatttgatgatgttttgatttacctcaactcatttaagagttacttctataatgatgacatctttaactttaattatgcccaagccaaagctgcaacaggcaataccagtgagggcgaagaggcgttcctcttgatccaaagtgagaagatgaaaaatgattacatttacctcagctggttagctcggtgctatattatgaataagaaaccaagactagcctgggaactttatcttaagatggaaacctccggcgagtccttcagtctcttacagctcattgctaatgactgctacaagatgggccagttttactattctgccaaagcttttgatgtccttgagaggctggatcctaaccctgaatattgggaaggcaaacggggtgcctgtgtgggcattttccagatgatcatagctgggagagaacccaaagagacccttcgagaagtgctccatttactgagaagcacaggtaacacccaagtagaatacatgatccggatcatgaagaaatgggccaaagaaaacagagtgtccatctaaaatagcgccagcgtcctaggaaccagcttctactttgacataaaactggaaatcattttcactccagtttaatctgtgatacagggctctgttttattgacattttccttccttgctctttaagcctcaaggtcagagactgacttgctgagacttagtctcctggctgaacagagtgccatagtctgtgaccctgtatgatcctagtagcaataagattttggacttatctggtgcctttcttccaaaaatgctcagagtacttttatgcaatttactgactttaaggaaaacagtataacttttttttgttagcattttatggcattgtctcctggctgcaataacaaacatctttgatgttcaagaatcagcatcattgtatcatttaactttaaggcgtctctgtacgttatcccattttattggggaattccataaagggttttataacgtcatctctgaatcttgggagaataactagctatgtgtttctaagaaaggcagtaagctactttatcaaactgtccagtcattaataggatagatttatgggattactctttcagtaattaaattgttgatgataataacatgttacagcgcagtaagatgagtattgcaatgttttaaaaggtgagtactatgaaaaaaattgtagtacctctaaaggtattcaagaaacaatgtttatgaatctcactagtccattatagtttggtaccataattattttaggtaacaaagcaggttaggtttttgttaatgtatcttgcttaacaaacatcagtttttgttgttgttgttgttgttgttgttgttgttgtttttgagacggagtctcgctctgtcgcccaggctggagtacagtggtgcgatctcggctcactgcaagctccacctcctgggttcacgccagtctcctgcctcagccttctgagtagctgggactacaggcacccgccaccgcgcccggctaattttttgtatttttagtagagacggggtttcaccgtgttagccacaatgctctccatctcctgacctcgtgatccgcccgtctcagcctcccaaagtgctgggattacaggcatgagccaccgcgcctggcccaaacatcagttttgaaagtagggctacagtgatttatatgtattgtgggcacttattaatgtaacgataataaaacatgaatcgtataaagtcctttgagggaatctcctaatggctaggctctctgtcgtaagtcatattccagccccaggcttctgagctcttataacatacaactgagcattcttaagctcacaacctatttccagaaaagagacccacatctttctatgttttatactacctttgtttttacaccatatagtttttttctattagtttaaggtacctagtgttacaggtctagaaagtgcagagccatccctacctagaagagaatagatgggaagagaactgaaagaaagaattcctcaagcactgaagtcaggaaaatccccgtaggcactgtattagttgttccatttatcccagcactccacttgtggatgaaggagttgtatagaaaggagatgagaaaatggcaggagtggaagcagccaagaagagatcgatgactgaagatctccttcaccttcaggactgtctcaaggggttatttcacctctactcatgaggatggccagtttttctgtcttttatctttagacccatatataatcagttcagagcacaaatcaaaataaactggcctaaataactgaattctaggaagcaaagctacatcttttttcatatgccaaagcttctgtttcctcatgttgttcctactttttaaataataaatggctctcagcatcttaggaactagatgggtcccatctgggtagaacctgctataatttttagaatcactcttgtaattcttacctcacttaaaatattaggaaacacagtaatagaaaagacagggagaactcgtctgcaggttttggcagtgaaatttgtcttccagtgaattgctattattttcaaattgcctatagtcaaaaagcttttccattgatggagacttactttcaaatgagcttgtgttgaattcagcactctagattctctctgacattttcctgtcttttgggaaaaaaaagcagatattccaaaaatggcagaaatctaatttttgtaaactttttcatctataggattgagccaaaaaacatacatactattttaaagaaaggtaccatctaattcttttattaaagatagctacttctgaaatgtcttaacagagtttcaagattgcaaagtagtattgcatagctggttttcttacatgtgatgatggaggagagaggaagacccagacttaggcatgtagtgaaatatgtacagtttctggcatcagtgtactatttatagtctatagcatacattacttgcaaatgggaaaagtattttataattatttttgtacctcaaaataattattatattctactgtattatattcaaattaaagtttattatttgattctta

SEQ ID NO: 7635 - DNA, 2015 bp, Homo sapiens
gtgctgtgtggatgcggcgaaacgctgaggcgcggccttcgctgtgtggtggggactcacaagaccgacgtcaagatgatgctttcaagggccaaacctgctgtaggcagaggcgtacagcacactgacaaaagaaagaagaaaggtaggaagattccaaaactagaggagctactttcaaaaagagatttcactggagctattaccctgttggaggaatacgaaaatgctacaaaagaggaaaattgtaattctgaagtctgggtgaacctagcttgcacctacttctttcttgggatgtataaacaagctgaagcagctggatttaaagcttcaaaaagccgactccaaaaccgcctcctcttccacttggctcacaagtttaatgatgagaaaaaattgatgagctttcatcaaaatcttcaggatgtcacagaagatcaactcagtttggcctcaatccactatatgcgatctcactaccaagaagctatagatatatataagcgaatactgctagataacagggaataccttgcccttaatgtttatgtggccctctgctactacaagttggattactatgatgtgtctcaagaagttttggctgtttaccttcagcaaattcctgatagtaccatcgcactcaatcttaaagcctgtaaccattttcgcctttacaatggcagagcagctgaggcagaactcaaaagcttgatggacaatgcttcttcatcctttgaatttgctaaagaactcatcaggcacaatctggttgttttccgaggaggtgaaggggctttgcaggttttacctcccctagttgatgtcattcctgaagctaggctaaacttggtgatttactaccttcgtcaagatgatgtacaagaagcttataacttaattaaggatctggaacctactactcctcaggagtatattctcaaaggagtggtcaatgcagcccttggccaggaaatgggttcaagggatcatatgaaaattgcccagcagttcttccagttggtgggaggatcagctagtgaatgtgatacaataccagggaggcagtgcatggcttcctgtttcttcctgcttaagcaatttgatgatgttttgatttacctcaactcatttaagagttacttctataatgatgacatctttaactttaattatgcccaagccaaagctgcaacaggcaataccagtgagggcgaagaggcgttcctcttgatccaaagtgagaagatgaaaaatgattacatttacctcagctggttagctcggtgctatattatgaataagaaaccaagactagcctgggaactttatcttaagatggaaacctccggcgagtccttcagtctcttacagctcattgctaatgactgctacaagatgggccagttttactattctgccaaagcttttgatgtccttgagaggctggatcctaaccctgaatattgggaaggcaaacggggtgcctgtgtgggcattttccagatgatcatagctgggagagaacccaaagagacccttcgagaagtgctccatttactgagaagcacaggtaacacccaagtagaatacatgatccggatcatgaagaaatgggccaaagaaaacagagtgtccatctaaaatagcgccagcgtcctaggaaccagcttctactttgacataaaactggaaatcattttcactccagtttaatctgtgatacagggctctgttttattgacattttccttccttgctctttaagcctcaaggtcagagactgacttgctgagacttagtctcctggctgaacagagtgccatagtctgtgaccctgtatgatcctagtagcaataagattttggacttatctggtgcctttcttccaaaaatgctcagagtacttttatgcaatttactgactttaaggaaaacagtataacttttttttgttagcattttatggcattgtctcctggctgcaataacaaacatctttgatgttcaag

SEQ ID NO: 7636 - DNA, 2876 bp, Homo sapiens
ggaagccagaccagagagcgtgcgtgtttttcccagggtgccccgcgctgctgttatggccgcctccttgaggtagtatccgcacatggaattctagggccgcaggtgtatttacggtaactgtcgccactagatttcagcgcctttggactctcctgttttcactttcttttgttgactcccgtgtggccctcgtgggagcctgttttggctgcagcggtgtctggggtgatgtggaccccggagctggcaattctgaggggattccccactgaggctgagcggcagcaatggaaacaggagggggtcgtcggttcagagagtggatctttcctacaattgctactggaagggaactatgaagccatattcttaaattcaatgactcaaaatatttttaattcaacaacaaccgctgaagaaaagattgatagctacctggagaagcaggtagtaacattcctggattactcaacagatttggacacaacggaaagacaacagttgatatttctacttggtgtgagcagtttgcaactttttgttcagagcaactggacggggccccctgttgacttacaccctcaggactttttgtcatctgttttgttccagcaattcagtgaggttaaaggactggatgcatttgttctgagcctgctcactctagatggtgaatcaatctacagcctgacctcgaagcctatactactgttattagcacgcattatcctagtgaatgtaagacataaactgacagctattcagagcttgccatggtggactttgagatgtgtgaatattcatcagcatttgcttgaggaacgctcacctctgctttttactcttgccgaaaactgtattgatcaagtgatgaaactacagaatctgtttgtagatgattcaggtcgatatttggctattcaattccatctggaatgtgcatatgtgtttttatattattatgagtacagaaaagcaaaagatcagttggatattgctaaggacatcagccaattacaaattgatttgacaggtgctttgggaaaaagaacacggttccaggaaaattatgtggcacaactgattctagatgtaagaagggaaggggatgtcctttcaaattgtgaattcactccagcacccactcctcaggaacatttaaccaagaatcttgagctcaatgatgacaccattctgaatgacataaagttagcagattgtgaacagttccagatgccggatctgtgtgctgaagagatcgctattattcttggaatctgcactaattttcaaaagaataacccagtgcacacattaactgaagtggagcttctggcatttacatcatgtttgctttcacaaccaaagttctgggccattcagacatcagccttgatcctccggacaaaacttgagaaaggaagtactcgccgagtggaacgggcaatgaggcagacacaggctcttgcagaccaatttgaagataaaactacatctgtattggaacgcctgaagattttctattgctgtcaagtaccacctcactgggccattcagcgccaacttgcaagtttgctctttgagttgggatgtaccagttcagcccttcagatatttgaaaagctagaaatgtgggaagatgttgtcatttgttatgaaagagccgggcagcacggaaaggcagaagaaatccttagacaagagctggagaaaaaagaaacgcctagtttatactgcttgcttggagatgtcctcggagaccattcttgctatgacaaggcctgggagttgtcccggtaccgcagtgctcgtgctcagcgctccaaagccctccttcatcttcggaacaaggagtttcaagagtgtgtagagtgcttcgaacgctcggttaagattaatcccatgcagctcggggtgtggttttctctcggttgtgcctatttggccttggaagactatcaaggttcagcaaaggcatttcagcgctgtgtgactctagaacccgataatgctgaagcttggaacaatttgtcaacttcctatatccgattaaaacaaaaagtaaaagcttttagaactttacaagaagctctcaagtgtaactatgaacactggcagatttgggaaaactacatcctcaccagcactgacgttggggaattttcagaagccattaaagcttatcaccggctcttggacttacgtgacaaatacaaagatgttcaggtccttaaaattctagtcagggcagtgattgatgggatgactgatcgaagtggagatgttgcaactggcctcaaaggaaagctgcaggagttatttggcagagtgacttcaagagtgacaaatgatggagaaatctggaggctgtatgcccacgtatatggaaatgggcagagtgaaaagcctgatgaaaatgaaaaggcattccagtgcctctcaaaggcatacaagtgtgacacccagtccaattgttgggagaaagatattacatcatttaaggaagttgttcaaagagccttaggacttgcacatgtggccataaaatgcagtaaaaacaaatccagttcccaagaagctgtacaaatgctttcttctgttcgactcaatttacggggcttgttatctaaagcaaagcaactttttacagatgtggcaactggagaaatgtccagggaattagctgatgacataacagctatggacaccttagtgacagagctccaagacctaagcaaccagtttcgaaatcagtattgattctgctggaagcagattctggaaaaggtgctttcacctgctggtaaaagatacatctgtatatctgaaatgcaagatattgatttttaaaataaatttgttttatgacttaa

SEQ ID NO: 7637 - DNA, 11793 bp, Homo sapiens
gggggcgcgcgcgcggtttgggggcagtgaggggcgccgcggcggcgcgcagcacggcgggaacatggcgcgcggaaccggcgcgcgcgcctagctggcgggaccgttagctcgaggcggacgcggcccgggccccgtggggatggagcagtcgccgccgccggcgcccgagccgacccaagggccgacccccgcaaggagccgaaggcggcgggagccagagtcgccgccggcgtcggcgccgattcctctctttggtgctgacactattggccagagaagtcctgatggaccggtactgagcaaagctgaatttgttgagaaagttcgtcagagtaatcaggcctgtcatgatggagatttccacacagctattgttctgtataatgaagccctggctgttgaccctcagaactgcatcttatacagcaatagatctgcagcctacatgaaaatccagcagtatgacaaggcactggatgatgcaatcaaagctcgacttctcaatcccaagtggccaaaggcatacttccgacagggtgttgccctccagtaccttggacgtcatgccgatgccctggcagcctttgcatctggactggctcaagaccccaagagtctccagcttctggtggggatggtggaagccgccatgaaatctcccatgagagactccctcgagcccacttatcagcagcttcagaaaatgaaactggacaagagtccctttgtggtcgtgtctgtggttgggcaggaactcctgacagctggccatcatggggcctctgtggttgtcttagaagccgcactgaagattggcacctgcagcctcaaactgagaggttctgttttctctgccctgagcagtgcttactggtctcttggaaatacagagaagagcaccggatatatgcagcaggacttggatgtagccaagaccttaggtgaccagacaggagaatgccgagctcatgggaatctgggctctgcattcttctccaaaggaaattaccgggaggctctcactaaccacaggcatcagttggtactcgccatgaaactcaaagatcgagaggcagcttcatcagccttgagcagtctgggccacgtgtacacagccattggagactaccccaatgcactggccagtcacaaacagtgtgttcttcttgccaagcaatccaaagatgaactttctgaagcccgagaacttggcaacatgggagctgtgtatattgccatgggtgactttgagaatgctgtgcagtgccatgagcagcatctgaagatagccaaggacctggggaacaagcgagaagaggcccgggcttatagcaacctgggcagtgcctatcactaccggaggaactttgacaaggccatgtcttaccataactatgtcctggagctggcacaggagttgatggagaaggctattgagatgcgggcctatgctggactaggccatgctgccaggtgcatgcaggatttggagagagctaaacaataccatgagcagcagctgggcattgctgaggatctcaaggaccgggctgcagaggggcgagcatcctccaatctaggaatcatacaccagatgaaaggtgattatgacactgcactgaaactccacaagacccacctgtgcattgcccaggagctgagtgattatgctgcccagggccgtgcctatgggaatatgggcaatgcctacaatgccctgggcatgtacgaccaggcggtcaaataccatcggcaggagctgcagatctccatggaagtgaatgaccgcgcctcacaggcctccacacatgggaaccttgccgtggcctaccaggccctgggtgcccatgaccgggccctgcaacactatcagaaccacttgaacatcgcccgggagctacgagacatccagagcgaggcccgggccctcagcaacctgggcaatttccactgctctcggggagagtatgtccaggctgccccctattatgaacagtacctccggcttgctcccgaccttcaagacatggaaggagaagggaaggtctgccacaatcttggctatgcccattactgccttggaaactatcaggaggcagtgaagtactacgaacaggatctggcactggctaaagaccttcacgacaagttgagccaagcaaaagcctactgcaacttgggcctagcattcaaggctctgctgaatttcagtaaagctgaagagtgtcagaagtacctactgtccctagcccagtctctgaataattcccaggctaaatttcgagccctaggaaacctgggcgatatattcatctgtaaaaaagatataaatggtgcaataaaattctatgagcagcaactgggcttagctcaccaggtaaaggacagaagattagaagccagtgcatatgcagccctgggcactgcataccgaatgatccagaagtatgacaaggccctgggttatcacacacaggaactggaggtatatcaggagctgagtgacttgccaggggagtgcagagctcatgggcacctggctgctgtctacatggcccttgggaaatacacaatggcattcaagtgttatgaagagcaactggatctagggcaaaagctgaaggatccgagtctggaagcccaggtctatggcaacatgggcatcacaaagatgaacatgaatgtgatggaagaagccattggctactttgagcagcaattggccatgctgcagcagctaagtggaaatgagtctgtgctcgacaggggccgggcctatggcaacctgggggattgctacgaagccctgggtgactatgaggaagctatcaaatactatgaacaatatttatctgtcgcgcagagtctgaatcgcatgcaagaccaagccaaggcttaccggggcctgggaaatggacacagggcaatggggagcttgcagcaagcccttgtgtgctttgaaaagaggctcgtggttgctcatgaacttggagaggccttcaataaagcccaggcctatggagagctgggaagtctgcacagccaattagggaattacgaacaagccatttcctgccttgaacgccagctgaacattgctagagatatgaaagaccgagccctggagagtgacgcagcctgtggcctggggggcgtttaccagcagatgggggagtatgacacagccctgcagtaccaccagcttgatctacagatagcagaggaaaccaacaaccccacgtgccagggccgagcctatgggaacctgggcctgacttatgaatccctgggcaccttcgagagggctgtggtctatcaagaacagcacttgagcattgctgcacagatgaatgacttggcggccaagacggtgtcatatagtagccttggaaggacccatcatgccttgcagaactattcccaagcagtcatgtacttacaggaaggtttaaggttagctgagcaactgggccgaagagaagatgaggcaaaaattcgccatggccttggcctctccctttgggctagtggaaacttggaggaggcccaacaccagctttatagggcatcagccttgtttgaaacaatccgacatgaggcacagctgagcacggactacaaactctccctctttgacctgcagacatcatcctaccaggccttgcagcgggtgctcgtcagcctaggccatcatgatgaagccctggctgtggcagaaaggggacggacaagggcatttgctgatcttctggtggaacgacaaacaggacaacaagactccgacccctactccccagtcactattgatcagatcttagagatggtaaatggccagaggggactagtgctttactattccctggctgcaggctatctgtatagctggctgctggctcctggggcaggaattgtgaagtttcatgaacactacctgggtgagaacacagtggaaaactcaagtgacttccaggccagcagcagtgtaacccttccaacagcaaccggctcagccctggagcagcacattgccagtgtccgggaggccctgggggtggagtctcactactcaagggcctgtgccagcagtgagacagagagtgaagcgggagacatcatggaccagcaatttgaagagatgaacaacaaactcaactcggtcactgaccccactggctttctgcggatggttcgccgcaataacctgtttaacaggagctgccagagcatgacgagcctgttcagtaacactgtgtcaccgacccaggacgggacctcctctcttcccaggaggcagagctcgtttgccaagcccccgctccgtgccctgtatgacctgctcatcgcgcccatggaagggggcctgatgcactccagcggccccgtgggccggcaccggcagctcatcctggttctggagggggagctctacctcattcctttcgccctcctgaagggaagctcctccaatgagtacctctacgagcgcttcggcctccttgctgtcccttccatccgctccctcagcgtgcagtccaagtctcacttacggaagaacccgcccacatactccagctccacatccatggcggctgtcatcggcaaccccaagctaccatcggccgtgatggacaggtggctgtgggggcccatgccatcggccgaggaagaggcctacatggtgtccgagctgctgggctgccagcccctagtgggcagtgtggccaccaaggagagggtcatgagtgccctgacccaggctgaatgcgtccactttgccacccacatctcctggaagctgtcggccttggtcctcacgcccagcatggacggcaaccctgccagcagcaagagctccttcggccacccctacacgatccctgagtccttgcgggtgcaggacgatgccagtgatggggagagcatctcggactgcccgcccctgcaggagctgctgcttactgccgccgacgtcctggacctgcagctgcctgtgaagctggtggtgcttggctcctcccaggagtccaacagcaaagtcacagccgacggggtcatcgcgctgacaagggccttcctggctgccggcgctcagtgtgtcctcgtgtctctgtggcctgtgccagtggctgcttctaagatgttcatccatgccttctactcatccctgctgaacggcctgaaagccagcgccgccctgggggaggccatgaaggtggtgcagagcagcaaggccttctcgcacccctccaactgggcagggttcatgctcatcgggagtgacgttaagctgaacagcccctcatcactcatcggccaggccctcacagagatcctgcagcacccggagcgtgcgcgggacgccctgcgagtgctgctgcacctggtggagaaatccctgcagcgcatccagaatgggcagcgcaatgccatgtacacatcccagcagagtgtggagaacaaagtgggcggcatccctggctggcaggccctcctcaccgctgtgggcttccggctggaccccccaaccagtggcctgccagcggctgtcttcttcccaacctccgacccgggcgaccggctccagcagtgcagcagcacactccagtccctgctgggtctgcccaatcctgccctccaagccctttgcaaactcatcactgcctccgagacgggcgagcagctcatcagccgggctgttaaaaatatggttggaatgctccaccaggtgctggttcagctccaggctggcgagaaggagcaggacttggcatcagctcccattcaggtctccatcagcgtccagctgtggcggctcccgggatgccacgagttcctggcagctctaggttttgatctctgtgaagttggtcaggaggaagtaatcctgaaaaccgggaagcaagctaatcgacggactgtgcacttcgcgctccagtccctgctgtctctgtttgattctactgagctacccaagcgcctcagccttgacagctcctcctccctcgagtctcttgcttctgctcagtctgtttccaacgccctgcccttgggttaccagcaaccccccttctctcccaccggtgcggacagcatcgcctcagatgccatctctgtgtacagtctgagctccattgcctcctcaatgagctttgtctccaaacccgagggtggatcagagggtggaggccccggaggacggcaggaccatgaccggtccaagaacgcttacctgcagagatccaccctgcctaggagccagctgcctccccagacccgccctgcaggcaacaaagatgaagaagaatatgaagggttttctatcatcagtaacgagcccttggcgacctaccaagaaaaccgaaacacatgcttctcaccagaccacaaacaaccccaacctgggacagccggaggcatgagagtctcggtgagctccaaagggagcatcagcactccaaattctccagtgaaaatgactctgattcccagccccaactcacccttccaaaaggtgggaaaactagcaagctcagatacaggagaatcagaccagtctagcacagaaacggacagtaccgtgaaatcccaagaagaaagcaacccaaaactggatccacaagagttagcccagaaaattctggaggagacacagagtcatctcattgcggtggagcgtcttcagaggagcggcggccaggtgagcaagagtaataaccctgaagacggcgttcaggcgcccagcagcactgctgtcttcagagcgtcagaaaccagtgcgttcagcaggcctgttctctcccatcagaagagtcagccatcaccagtcactgttaaaccaaagcccccagccaggagctcctccctgcccaaggtgagttccggatatagcagccccaccacctcagagatgtccatcaaagacagcccgagccagcacagtggccggccatcgcccggctgcgactcacagacttcccagctggaccagcctctctttaaactgaagtaccccagctctccttacagcgctcacatttccaaatcaccaaggaacatgtccccaagctccggccaccagtctcctgctggcagtgcaccctccccagctctctcctactcctcagctggatctgctcgctcaagtccagcagacgctcccgacatagacaaactgaaaatggcagccattgatgaaaaggtgcaggctgtccataacctgaagatgttctggcagagcacaccccagcattccacagggccaatgaagatcttccggggggctcctggcacgatgacttccaaaagggatgtcctcagtctgttgaatttgtcaccacggcacaataagaaggaggagggagtggataagcttgaactgaaggagctgtccctgcagcagcatgacggagctccaccgaaagcccctcccaacggacactggcgcaccgagaccacctcgctgggctcactgccgctgcccgccggccctcccgccacagcccccgcgcgccctttgaggcttccttctggaaatggctacaagttcctgtctccaggaagatttttcccttcttccaaatgctaaagcatcttttatacccactgactctgagcagcctgcagatgggggcctggcgtttgcttcagcccttccctgagtgcagtccccccacagccaccagcaccctcatgatgctgtgctctgcaggcgaggggcaccaccacgtccaaaggctgccacacacactggtggcttttctgggccacattcaccaaaagccaggacttctgtggggctggtacaggaggctcatggaatttcctacacacttcaccaaatgtttgtttacctttgaactccctgcttctcatctttgatatgattcttcaccaggattttgtacaaaaatgatcatggttctggggtggggagaggaaagggagcacatattttgctaagaggtatatatgcagtaccttttatacacagaaatacaaatagagctttttctaaggctttcggttgctggttgggggtgggatatatgaaatttcagttgaattctacaggaaagtgttatattagccaaaaacagaaaaatggtttttaaaatgccaatgatttgtaattaaattgtagcaattttggtctcatgatagtgtaatatctcagcaacaatgcaataattcacattgaaacagcgcttccattctgaactctgctctgcaaatgtcttttgggtcccgctgtcaaccaaacttgaattttcttaaaaaaaaaattatgtaactcttatccaggcattttagaactatgcaattgtgatttaaaatgcaactttgtgcttttaaaacattattgaccttttttgtatatggataaacaacttggttttattatcaatagtactttgcatttatagctattatttttaaaagctcaaaaagttttttaaaatgtcaaattttgaatagtcatcaataagtaattatcaagtttggaaggaaaggttgaaatgactccgtttccttataagcaaaaaaaaaaaaaaaaaaaaaaaaaaaaaaaaaaaaatttccatggctaactagatttaaccagaatcccgccttccaggctcctgttcccttttattagctgctgaattttattcccttttcccaactccaggtccctcagttgtcttatatctaaatcctttgccaggtccccacaatcccagcacctgcctctgtgagctgcccccaggccctcaccttggccctggccagcctcctgtgctcctgctgtctgaaggactggcccctcccccactgctgaagccacacgtacagatcctaagcaacagggccttttgctgggacgtatgcctggattatggccaaccgggaagagagagatgtatcttaaaaagtggaggtggacttctcctacagctctgacggtaacttaaattgttgccagcttgaggcaagacaagggaatcatctagttaggggtaaccattaatttattttataaagaaaggaaatgctgaaagtcgtattagtactgagtttagttggagaatttagataagtaagtatcttttaggtaattctaaaattaaaatcctacccacctcactacagggttcctcatgaaggtgggcggccacctggcctgggccaccagcagcacatggagcagacctgaggggcctggcagggggcactgacctcaggatccccaggtgggggttttaaccatgggtgggatctcagcttctgcgcatacactgacaatctcacctgttcctcagtgtactcctctgaaaagaagaaaggataatatttatccaatctgtgttctcctgagctccatcctaggggtttttaatttaaccaacagccatgttgacaaaagccaacaataagcatgtcttattctagccctgatcccaacactgaaagcgaagtactttataaagaagccagcaattatgagggtttctttatgttagtaggggaaaaaatggtaataaaagtaccagtgtagcaagtgaagaccaaatttatagcactgtgcattagatagcaaaatcaggttcttaacaatgaaaagtaaacctcaagtttctaaatccatatgcagatggttaggctgtccctctcttagcaaatctctcagcctccttctttcccaagtgccaaggatccctggagtaaagctctggggtctgtgctctctttctgtgaggggaaggctgcggccctatttgcccctctctagcaaacacccccaccaccctgccgcttcctgtggttattgagccagctaggagttactcatggactctaacctggttttagtcccatgtacatcgttgttttaggtttcatactgaagagccaatggtttatgtggttttattctgtcttaaatataagtttcaaggaagggaaaacaaaagtgataaaatgatagaacagtctagaggccactgtaaagtcaccgccactttacgtgtatgtcagtcttggtgttcttgtatgagtaaaatggatgtaaaatcataaaatcacagtgaatgtttcaggctacactggaaaaagtatgcacttagaattaaaggaaattgtataattcaccaagatttctttgtgtagatcaggggttggcaactatgacccacaggctaagactggtcagcggtctggtttttcacagccatgagctaagttacctttttaaagggttatataagtaattacatcatatttttgattttgcctttggcccacaccacataaaatattcaatacctggcctttttttttttttttgagacagagtctcgctctgtcacccaggatagagtgcactggtgcgattttggctcactgcaacctcttcctcctgggttcaagcaattctccctgcctcagcctctaagtagctgggactacaggcacccactaccatgccttgctaatttttgtatttttaatagagatggggtttcaccatgttggccaggctggtctcgaactcctgacctcaggggatccgcccgccttggcctcccaaactgctgggattacaggtgagccactgcgcccagccaatacctggccttttaagaagtttgctgactcctggtatggatgacagaaaatggaataacgttttgtttctccagtctaggaaaagcaagtcaggtagtggatagactgactggcgtccggggagcccagggtatgtgagggccacgtggatggaagcaaatgcctcctgcatagcccttggctctttgtcccacttgggaggagtccatggatgtaatatttacaaaacaattttttccttaccatttgcagaaagcattgcatatatttccttttagctcaggaaactggcatgccccaccctctgctactccatcagatgtaaatacaatgactataagccgtacaactcccctctcttagaaacctcagcaggaccacagagcaagggagtcaaagctttcttaattctctccagtaaatgactcaactaatttgatttttttaattaagtcaaaatatcaagagaaaaattgctactaaaacttacattttgatccacactgatgtgcaacacaaaatgaaagttttcacctccattccattttttaaaaattcacggtccacactgaaacttgctgggttttagcaggagacaaaggtgtcacccacgctgtcctcatcctgctctctctgtcccagtgacgctccagcatatgatcactgcagccggtccctggcccgtgccgattctgccacctcccagccacacacatttgcagacccacaagaagaactgtagccttgataatttcagttcaggctggaaaaatgccatgcaataatctggtttgctttcagtaagtaggcaacaagtgaaaactgtataattttcatcacctattctgctgttctatctaaaatgagtgtacctgtggtttgtgaactgggcccttgtttgtgccagatccttcaaagatgttccctgtcaggacacctgtggccctgcccctcctcagacaccttcccactggcattcacgttccttatatgcagtgttagccatctttggcctacgtggactttttttgtaaattacaccatttccagacattaaactttttatattatgaaatttaccatgtaaaaagaacttcatatttttattgagattgctaaggcacttggccttcctcctttgtgattttcagtgtctattaaagcatgagttccctcagtttt

SEQ ID NO: 7638 - DNA, 1785 bp, Homo sapiens
ctctgtttccgtggagacgctctcggcgtcccctgtctccgctccggcggagccaggcttcggaatcactgagagaggagggggcagcgccaacgcccagcacctgccgccggtgggggactgacttcggcggaacggaaaactggagttgtttccctgggccagtgcaccgaggctgaagtctataagcctggagagaccatcagcagtaatctgcaaattccgaaatgaccaccctgcccccactgcccatgacacgcccgaagcttacagccttagccagacagaagctgccttgctcctccagaaaaattccaaggtctcaattgatcaaagaaaaagatgacatagatcattatctagaggtaaatttcaaaggattatcaaaagaggaagttgctgcttataggaactcctacaagaagaatatctgtgtggacatgctgcgagatggttatcataagtccttcaccgagctcttcgctctgatggagcggtgggatgccctgagggaggctgcgagagtcaggtccctcttctggctgcagaagcccctggaggagcagcctgataaactggattacctgtaccattacctgaccagggctgaggacgctgagaggaaagaatccttcgaagatgtacataataacttgtatgctctggcctgttacttcaataattctgaagacaagtgggtaaggaaccacttctatgaacgatgttttaagattgctcagctgatcaaaattgactgtgggaagaaagaagccgaggcacacatgcatatgggtcttctctacgaggaagatggtcagcttctggaagctgctgagcattatgaagcattccatcaattgacacaggggcggatatggaaggatgagacaggccgctctctcaacttgttggcctgtgagagtctcctgaggacttacagattactctcagacaaaatgctagaaaataaagaatacaaacaggccatcaaaattctaataaaagcttctgaaatagccaaagaaggaagtgacaaaaagatggaagcggaagcctcttactacttgggcttagcacacttagctgctgaggaatatgaaacagcattaacagtccttgacacttactgtaaaatctccacagacctggatgatgatctcagtctggggagaggctatgaagccatagccaaggtcctgcagagccaaggagagatgacagaagcaattaaatacttgaaaaaatttgtgaaaattgcaagaaacaattttcaaagcctagatttggtgagagcaagtacaatgcttggggacatctacaatgaaaaaggatactacaacaaagcttctgaatgctttcagcaagcttttgacacaacagtagagctaatgagcatgcctctgatggatgagacaaaagttcactatggaatagcaaaagctcatcagatgatgcttacagtgaacaactatatagagtctgcagatctcaccagcctcaactacctgctgtcatggaaggagagcagaggtaacattgaacctgatccagttactgaagagtttagaggatccacagtggaagctgtatctcaaaactcagaacgtttggaagaactcagtaggtttccaggtgatcaaaaaaatgaaacttaaagcagcttttcacttaacatcaaagcaagaagaaatccatcatgtcaccttagacttcaatacttgtaataggagcatgttacagataatatagagttataataaaacggactatgactcttttcattgg

SEQ ID NO: 7639 - DNA, 1729 bp, Homo sapiens
aggcttcggaatcactgagagaggagggggcagcgccaacgcccagcacctgccgccggtgggggactgacttcggcggaacggaaaactggagttgtttccctgggccagtgcaccgaggctgaagtctataagcctggagagaccatcagcagtaatctgcaaattccgaaatgaccaccctgcccccactgcccatgacacgcccgaagcttacagccttagccagacagaagctgccttgctcctccagaaaaattccaaggtctcaattgatcaaagaaaaagatgacatagatcattatctagaggtaaatttcaaaggattatcaaaagaggaagttgctgcttataggaactcctacaagaagaatatctgtgtggacatgctgcgagatggttatcataagtccttcaccgagctcttcgctctgatggagcggtgggatgccctgagggaggctgcgagagtcaggtccctcttctggctgcagaagcccctggaggagcagcctgataaactggattacctgtaccattacctgaccagggctgaggacgctgagaggaaagaatccttcgaagatgtacataataacttgtatgctctggcctgttacttcaataattctgaagacaagtgggtaaggaaccacttctatgaacgatgttttaagattgctcagctgatcaaaattgactgtgggaagaaagaagccgaggcacacatgcatatgggtcttctctacgaggaagatggtcagcttctggaagctgctgagcattatgaagcattccatcaattgacacaggggcggatatggaaggatgagacaggccgctctctcaacttgttggcctgtgagagtctcctgaggacttacagattactctcagacaaaatgctagaaaataaagaatacaaacaggccatcaaaattctaataaaagcttctgaaatagccaaagaaggaagtgacaaaaagatggaagcggaagcctcttactacttgggcttagcacacttagctgctgaggaatatgaaacagcattaacagtccttgacacttactgtaaatctccacagacctggatgatgatctcagtctggggagaggctatgaagccatagccaaggtcctgcagagccaaggagagatgacagaagcaattaaatacttgaaaaaatttgtgaaaattgcaagaaacaattttcaaagcctagatttggtgagagcaagtacaatgcttggggacatctacaatgaaaaaggatactacaacaaagcttctgaatgctttcagcaagcttttgacacaacagtagagctaatgagcatgcctctgatggatgagacaaaagttcactatggaatagcaaaagctcatcagatgatgcttacagtgaacaactatatagagtctgcagatctcaccagcctcaactacctgctgtcatggaaggagagcagaggtaacattgaacctgatccagttactgaagagtttagaggatccacagtggaagctgtatctcaaaactcagaacgtttggaagaactcagtaggtttccaggtgatcaaaaaaatgaaacttaaagcagcttttcacttaacatcaaagcaagaagaaatccatcatgtcaccttagacttcaatacttgtaataggagcatgttacagataatatagagttataataaaacggactatgactcttttcattg

SEQ ID NO: 7640 - DNA, 1636 bp, Homo sapiens
atgattccgatgttcactgtaacattggaagactctggaactctgtggaaaagtcttcacagctcctctgaatccgaaatgaccaccctgcccccactgcccatgacacgcccgaagcttacagccttagccagacagaagctgccttgctcctccagaaaaattccaaggtctcaattgatcaaagaaaaagatgacatagatcattatctagaggtaaatttcaaaggattatcaaaagaggaagttgctgcttataggaactcctacaagaagaatatctgtgtggacatgctgcgagatggttatcataagtccttcaccgagctcttcgctctgatggagcggtgggatgccctgagggaggctgcgagagtcaggtccctcttctggctgcagaagcccctggaggagcagcctgataaactggattacctgtaccattacctgaccagggctgaggacgctgagaggaaagaatccttcgaagatgtacataataacttgtatgctctggcctgttacttcaataattctgaagacaagtgggtaaggaaccacttctatgaacgatgttttaagattgctcagctgatcaaaattgactgtgggaagaaagaagccgaggcacacatgcatatgggtcttctctacgaggaagatggtcagcttctggaagctgctgagcattatgaagcattccatcaattgacacaggggcggatatggaaggatgagacaggccgctctctcaacttgttggcctgtgagagtctcctgaggacttacagattactctcagacaaaatgctagaaaataaagaatacaaacaggccatcaaaattctaataaaagcttctgaaatagccaaagaaggaagtgacaaaaagatggaagcggaagcctcttactacttgggcttagcacacttagctgctgaggaatatgaaacagcattaacagtccttgacacttactgtaaaatctccacagacctggatgatgatctcagtctggggagaggctatgaagccatagccaaggtcctgcagagccaaggagagatgacagaagcaattaaatacttgaaaaaatttgtgaaaattgcaagaaacaattttcaaagcctagatttggtgagagcaagtacaatgcttggggacatctacaatgaaaaaggatactacaacaaagcttctgaatgctttcagcaagcttttgacacaacagtagagctaatgagcatgcctctgatggatgagacaaaagttcactatggaatagcaaaagctcatcagatgatgcttacagtgaacaactatatagagtctgcagatctcaccagcctcaactacctgctgtcatggaaggagagcagaggtaacattgaacctgatccagttactgaagagtttagaggatccacagtggaagctgtatctcaaaactcagaacgtttggaagaactcagtaggtttccaggtgatcaaaaaaatgaaacttaaagcagcttttcacttaacatcaaagcaagaagaaatccatcatgtcaccttagacttcaatacttgtaataggagcatgttacagataatatagagttataataaaacggactatgactcttttcattgg

SEQ ID NO: 7641 - DNA, 557 bp, Homo sapiens
tgtttccgtggagacgctctcggcgtcccctgtctccgctccggcggagccaggcttcggaatcactgagagaggagggggcagcgccaacgcccagcacctgccgccggtgggggactgacttcggcggaacggaaaactggagttgtttccctgggccagtgcaccgaggctgaagtctataagcctggagagaccatcagcagtaatctgcaaatgtgggggccaaacttagagattgtagctgtgatacaagagccaaccagcagatcaaagagtacaccaaatttcttctgaataccaacagtggaatggcttcaggcggccttttgatctttgtctcagcacccgatgatgccacactgtagcactgcccacttgctagcactggcggaggttcctgtgggtcctcctaacaggctgattcagcctgagctcctggggctaagctcatttggtagcagccaaagagtccgaaatgaccaccctgcccccactgcccatgacacgcccgaagcttacagccttagccagacagaagctgccttgctcctcca

SEQ ID NO: 7642 - DNA, 1777 bp, Homo sapiens
ctctgtttccgtggagacgctctcggcgtcccctgtctccgctccggcggagccaggcttcggaatcactgagagaggagggggcagcgccaacgcccagcacctgccgccggtgggggactgacttcggcggaacggaaaactggagttgtttccctgggccagtgcaccgaggctgaagtctataagcctggagagaccatcagcagtaatctgcaaattccgaaatgaccaccctgcccccactgcccatgacacgcccgaagcttacagccttagccagacagaagctgccttgctcctccagaaaaattccaaggtctcaattgatcaaagaaaaagatgacatagatcattatctagaggtaaatttcaaaggattatcaaaagaggaagttgctgcttataggaactcctacaagaagaatatctgtgtggacatgctgcgagatggttatcataagtccttcaccgagctcttcgctctgatggagcggtgggatgccctgagggaggctgcgagagtcaggtccctcttctggctgcagaagcccctggaggagcagcctgataaactggattacctgtaccattacctgaccagggctgaggacgctgagaggaaagaatccttcgaagatgtacataataacttgtatgctctggcctgttacttcaataattctgaagacaagtgggtaaggaaccacttctatgaacgatgttttaagattgctcagctgatcaaaattgactgtgggaagaaagaagccgaggcacacatgcatatgggtcttctctacgaggaagatggtcagcttctggaagctgctgagcattatgaagcattccatcaattgacacaggggcggatatggaaggatgagacaggccgctctctcaacttgttggcctgtgagagtctcctgaggacttacagattactctcagacaaaatgctagaaaataaagaatacaaacaggccatcaaaattctaataaaagcttctgaaatagccaaagaaggaagtgacaaaaagatggaagcggaagcctcttactacttgggcttagcacacttagctgctgaggaatatgaaacagcattaacagtccttgacacttactgtaaaatctccacagacctggatgatgatctcagtctggggagaggctatgaagccatagccaaggtcctgcagagccaaggagagatgacagaagcaattaaatacttgaaaaaatttgtgaaaattgcaagaaacaattttcaaagcctagatttggtgagagcaagtacaatgcttggggacatctacaatgaaaaaggatactacaacaaagcttctgaatgctttcagcaagcttttgacacaacagtagagctaatgagcatgcctctgatggatgagacaaaagttcactatggaatagcaaaagctcatcagatgatgcttacagtgaacaactatatagagtctgcagatctcaccagcctcaactacctgctgtcatggaaggagagcagaggtaacattgaacctgatccagttactgagtttagaggatccacagtggaagctgtatctcaaaactcagaacgtttggaagaactcagtaggtttccaggtgatcaaaaaaatgaaacttaaagcagcttttcacttaacatcaaagcaagaagaaatccatcatgtcaccttagacttcaatacttgtaataggagcatgttacagataatatagagttataataaaacggactatgactcttttc

SEQ ID NO: 7643 - DNA, 2226 bp, Homo sapiens
agccaggcttcggaatcactgagagaggagggggcagcgccaacgcccagcacctgccgccggtgggggactgacttcggcggaacggaaaactggagttgtttccctgggccagtgcaccgaggctgaagtctataagcctggagagaccatcagcagtaatctgcaaatggctacactggtgtgggttaagaacttagatgattccgatgttcactgtaacattggaagactctggaactctgtggaaaagtcttcacagctcctctgaatccgaaatgaccaccctgcccccactgcccatgacacgcccgaagcttacagccttagccagacagaagctgccttgctcctccagaaaaattccaaggtctcaattgatcaaagaaaaagatgacatagatcattatctagaggtaaatttcaaaggattatcaaaagaggaagttgctgcttataggaactcctacaagaagaatatctgtgtggacatgctgcgagatggttatcataagtccttcaccgagctcttcgctctgatggagcggtgggatgccctgagggaggctgcgagagtcaggtccctcttctggctgcagaagcccctggaggagcagcctgataaactggattacctgtaccattacctgaccagggctgaggacgctgagaggaaagaatccttcgaagatgtacataataacttgtatgctctggcctgttacttcaataattctgaagacaagtgggtaaggaaccacttctatgaacgatgttttaagattgctcagctgatcaaaattgactgtgggaagaaagaagccgaggcacacatgcatatgggtcttctctacgaggaagatggtcagcttctggaagctgctgagcattatgaagcattccatcaattgacacaggggcggatatggaaggatgagacaggccgctctctcaacttgttggcctgtgagagtctcctgaggacttacagattactctcagacaaaatgctagaaaataaagaatacaaacaggccatcaaaattctaataaaagcttctgaaatagccaaagaaggaagtgacaaaaagatggaagcggaagcctcttactacttgggcttagcacacttagctgctgaggaatatgaaacagcattaacagtccttgacacttactgtaaaatctccacagacctggatgatgatctcagtctggggagaggctatgaagccatagccaaggtcctgcagagccaaggagagatgacagaagcaattaaatacttgaaaaaatttgtgaaaattgcaagaaacaattttcaaagcctagatttggtgagagcaagtacaatgcttggggacatctacaatgaaaaaggatactacaacaaagcttctgaatgctttcagcaagcttttgacacaacagtagagctaatgagcatgcctctgatggatgagacaaaagttcactatggaatagcaaaagctcatcagatgatgcttacagtgaacaactatatagagtctgcagatctcaccagcctcaactacctgctgtcatggaaggagagcagaggtaacattgaacctgatccagttactgaagagtttagaggatccacagtggaagctgtatctcaaaactcagaacgtttggaagaactcagtaggtttccaggtgatcaaaaaaatgaaacttaaagcagcttttcacttaacatcaaagcaagaagaaatccatcatgtcaccttagacttcaatacttgtaataggagcatgttacagataatatagagttataataaaacggactatgactcttttcattggattttgcatttcagtgtgttactataaatttaatccaaaacatctaaatccatgaaaataaaatatattccaattcttagaaatatcagcaatcatccatgaaataaatgatttcctcttatccactattccacaagaaatagtgataccatgaaaccaaaataagaaaatattttctaatgagaaaataattacaagcttaagaaaatctttcatgctgaattcatgtaggaaaatatttgctaaaactctagggaaacttctcaacatagataaaaggagtataagcaattaagcctaccatactgataagtcttgtttgaaacagttttctttacctgtgtaacagtatattttatgatacttttagctgatagcacataataaaac

SEQ ID NO: 7644 - DNA, 565 bp, Homo sapiens
cagcagtaatctgcaaatagattgtagctgtgatacaagagccaaccagcagatcaaagagtacaccaaatttcttctgaataccaacagtggaatggcttcaggcggccttttgatctttgtctcagcacccgatgatgccacactgtagcactgcccacttgctagcactggcggaggttcctgtgggtcctcctaacaggctgattcagcctgagctcctggggctaagctcatttggtagcagccaaagagggctacactggtgtgggttaagaacttagatgattccgatgttcactgtaacattggaagactctggaactctgtggaaaagtcttcacagctcctctgaatccgaaatgaccaccctgcccccactgcccatgacacgcccgaagcttacagccttagccagacagaagctgccttgctcctccagaaaaattccaaggtctcaattgatcaaagaaaaagatgacatagatcattatctagaggtaaatttcaaaggattatcaaaagaggaagttgctgcttataggaactcctacaagaagaatat

SEQ ID NO: 7645 - DNA, 4669 bp, Homo sapiens
gcggcgccacaggaacgatgcatgccgggaccgggaagattcagtctctgaacggcccggagtagtcgtctttccccttctgactgccgccacgctgcagtccagaatatttgaagatcaaaccgaacttgagagactaacgagaacggtccctttttattcctaacagattccttccgtggcaaagtaacccgtcgtcttccgtttccggttgcccggttgccctgttgccgtggtaaccgcacgcataacagccgtggtggttatggctggtctgagcggcgcgcagatccccgacggggagtttaccgcgctagtgtaccggctcatccgcgatgcccgctacgccgaggcggtgcagctgctgggccgagaactgcagcggagccccaggagccgtgccggcctgtcgctgctaggctactgctactaccgcctgcaggagttcgcgctggcggccgagtgctatgagcagctgggccagctgcacccggaactggagcagtaccgcctgtaccaggcccaggccctgtacaaggcctgcctttatccggaggccactcgggtcgccttccttctcctggataaccccgcctaccacagccgggtcctccgcctgcaagctgccatcaagtatagcgagggcgatctgccagggtccaggagcctggtggagcagctgctgagtggggaagggggagaagaaagtggaggcgacaatgagaccgatggccaggtcaacctgggttgtttgctctacaaggagggacagtatgaagctgcatgctccaagttttctgccacactgcaggcctcgggctaccagcctgacctttcctacaacctggctttggcctattacagcagccgacagtatgcctcagcactgaagcatatcgctgagattattgagcgtggcatccgccagcatcctgagctaggtgtgggcatgaccaccgagggctttgatgttcgcagtgttggcaacaccttagttctccatcagactgctctggtggaagccttcaaccttaaggcagccatagaataccaactgagaaactatgaggtagctcaagaaaccctcaccgacatgccacccagggcagaggaagagttggaccctgtgaccctgcacaaccaggcactaatgaacatggatgccaggcctacagaagggtttgaaaagctacagtttttgctccaacagaatccctttcctccagagacttttggcaacctgttgctgctctactgtaaatatgagtattttgacctggcagcagatgtcctggcagaaaatgcccatttgacgtataagttcctcacaccctatctctatgacttcttagatgccctgatcacttgccagacagctcctgaagaggctttcattaagcttgatgggctagcagggatgctgactgagcagcttcggagactcaccaagcaagtacaggaagcaagacacaacagagatgatgaagctatcaaaaaggcagtgaatgaatatgatgaaaccatggagaaatacattcctgtgttgatggctcaggcaaaaatctactggaatcttgaaaattatccaatggtggaaaaggtcttccgcaaatctgtggaattctgtaacgaccatgatgtgtggaagttgaatgtggctcatgttctgttcatgcaggaaaacaaatacaaagaagccattggtttctatgaacccatagtcaagaagcattatgataacatcctgaatgtcagtgctattgtactggctaatctctgtgtttcctatattatgacaagtcaaaatgaagaagcagaggagttgatgaggaagattgaaaaggaggaagagcagctctcttatgatgacccaaatcggaaaatgtaccatctctgcattgtgaatttggtgataggaactctttattgtgccaaaggaaactatgagtttggtatttctcgagttatcaaaagcttggagccttataataaaaagctgggaacagatacctggtattatgccaaaagatgcttcctgtccttgttagaaaacatgtcaaaacacatgatagtcattcatgacagtgttattcaagaatgtgtccagtttttaggacactgtgaactttatggcacaaacatacctgctgttattgaacaacccctcgaagaagaaagaatgcatgttgggaagaatacagtcacagatgagtccagacaattgaaagctttgatttatgagattataggatggaataagtagttatgactgatagtggcttttttcaaaatggctttcttacgtaccacacttttttttatctgtatttagccttggcatctttatatttgtcttattttgaatcttatccactttgtaagaacaagtttatgtttgagcaactttttcatttaatccagaagggtagggactatgcagtgtaagctgcatcacttctgctttcttcctactagtgacaatcatctggtcttgccctcaagcaacaattgctagagtaacatctttgtataagcaagtaaccccagatagagttgacgtttcagctttgggctgtcaaaagggtatgtcatggaccaaagcactgttagtacgggtatgtttgcatttggtcactgatatgtaaatgactgctagcccacggctggaccacttctcaatcagcaaataaagccatgtctattttgctatctcagcatagactatgctgtctgataaatctaattcttaactctatttctccagttttttagtcctttaactttctggattgcaacgaagtctagtttagacctctaagcccttttagaagtacaagtataatgggaatttcttttcttggttcttttcaggttatgaggtttggtcagtgacaaaattttttttcataatttggttgattggttgcttcttaagttttataataaacgtttttcttcatgttctatttttgattttacagaaatgattttgcctccttgtggatactgacatatattaagtgtggaagcttattaatatttttggttttttaaaaactgaaatttttaatttttactttttaattttttaggaaaaaataagcactgaactgagaatgagaagaataaaagtatgagttccataccttctaattttaggctgtcagaaattcctttattctttgggatttcacaatcatttgaactatcagaagcctttacaattacttttagctgtaacatccgattctgtataagccacatagaaaaaagttgcctttctttttttatgacctggatatataagcaaatcagctaggaaatatataattgtattttatattaatgttttctaggattttggcttacagtaaatgttaacccctatggtaagtgattgttattgttggatgttatactgattattaataagaaatttggatttttgcctttttacctggaatttttgcttacagccgtagctatgaatatatatagggtggtccccagtctctgttatggttgcgcataaattaataattttataagtatttagaaatggtataattctcttaacttcctctttcagtttttgtactaatgtttgtttttgttcgggaagaggagatttgcttttaatccttccaaaaaatgatgaaccaccgttccattcagtagtttgacaagctgttataatgtgtattttttcctcaattattcttgaaatatttagagcctctcctgcttctaacatgaaggcctttagatgccagtctgccagaaatctggaaacagaggaaccggtgaagtgaagatgtaatggagatttagctaatgatgtacttcacaatccaccttggatctcctgcatgtccaaatctcagtagttaatcaagtgtctgctgccattaacagaacagaagtaatggataacagaatggaaataagagatgccagaactacttccataactaactcaccaaatcaaatcatcagtcctcatattcttgttttatttaatacaaggagaagaggccatgcactttccaaaaggtcaaagccacatagaataggaaggcaatctctagtttaaagctttctcttggagtgttttctccccctgtcttcaaagggtctacttgagagatagtggtgtttactgctgcagcatgtatcacaagataagaaatgaaaaatcaatctttcttaccaccctgttctctttcccttttttatcttttcccttttgtcaattatagaattatagggacatttttctctgatagctggaagttgaacctcaaccaggtataaaagatgcataacaaccttttagcagtaagtgtcaagtgagtgagcactatgattatcaaggtgactttggaaaccttttaaaaatgcatttttgcaaaacaagataacatatattgataaaaagtgactctcagattggtaatgccagaaaaaattttaagaggactcaccaaaagtactagatctatgtaagttgtagaatagagtgaagtttttttatatatttgtggtagcctccatcttttaaactttttgaactcagtagaaaaacagactgaaattttaaagacatgcagtatttgtatcattttaaattctgtaacactgggaattaaatatactcaactttagagga

SEQ ID NO: 7646 - DNA, 3212 bp, Homo sapiens
ataacagccgtggtggttatggctggtctgagcggcgcgcagatccccgacggggagtttaccgcgctagtgtaccggctcatccgcgatgcccgctacgccgaggcggtgcagctgctgggccgagaactgcagcggagccccaggagttcgcgctggcggccgagtgctatgagcagctgggccagctgcacccggaactggagcagtaccgcctgtaccaggcccaggccctgtacaaggcctgcctttatccggaggccactcgggtcgccttccttctcctggataaccccgcctaccacagccgggtcctccgcctgcaagctgccatcaagtatagcgagggcgatctgccagggtccaggagcctggtggagcagctgctgagtggggaagggggagaagaaagtggaggcgacaatgagaccgatggccaggtcaacctgggttgtttgctctacaaggagggacagtatgaagctgcatgctccaagttttctgccacactgcaggcctcgggctaccagcctgacctttcctacaacctggctttggcctattacagcagccgacagtatgcctcagcactgaagcatatcgctgagattattgagcgtggcatccgccagcatcctgagctaggtgtgggcatgaccaccgagggctttgatgttcgcagtgttggcaacaccttagttctccatcagactgctctggtggaagccttcaaccttaaggcagccatagaataccaactgagaaactatgaggtagctcaagaaaccctcaccgacatgccacccagggcagaggaagagttggaccctgtgaccctgcacaaccaggcactaatgaacatggatgccaggcctacagaagggtttgaaaagctacagtttttgctccaacagaatccctttcctccagagacttttggcaacctgttgctgctctactgtaaatatgagtattttgacctggcagcagatgtcctggcagaaaatgcccatttgacgtataagttcctcacaccctatctctatgacttcttagatgccctgatcacttgccagacagctcctgaagaggctttcattaagcttgatgggctagcagggatgctgactgagcagcttcggagactcaccaagcaagtacaggaagcaagacacaacagagatgatgaagctatcaaaaaggcagtgaatgaatatgatgaaaccatggagaaatacattcctgtgttgatggctcaggcaaaaatctactggaatcttgaaaattatccaatggtggaaaaggtcttccgcaaatctgtggaattctgtaacgaccatgatgtgtggaagttgaatgtggctcatgttctgttcatgcaggaaaacaaatacaaagaagccattggtttctatgaacccatagtcaagaagcattatgataacatcctgaatgtcagtgctattgtactggctaatctctgtgtttcctatattatgacaagtcaaaatgaagaagcagaggagttgatgaggaagattgaaaaggaggaagagcagctctcttatgatgacccaaatcggaaaatgtaccatctctgcattgtgaatttggtgataggaactctttattgtgccaaaggaaactatgagtttggtatttctcgagttatcaaaagcttggagccttataataaaaagctgggaacagatacctggtattatgccaaaagatgcttcctgtccttgttagaaaacatgtcaaaacacatgatagtcattcatgacagtgttattcaagaatgtgtccagtttttaggacactgtgaactttatggcacaaacatacctgctgttattgaacaacccctcgaagaagaaagaatgcatgttgggaagaatacagtcacagatgagtccagacaattgaaagctttgatttatgagattataggatggaataagtagttatgactgatagtggcttttttcaaaatggctttcttacgtaccacacttttttttatctgtatttagccttggcatctttatatttgtcttattttgaatcttatccactttgtaagaacaagtttatgtttgagcaactttttcatttaatccagaagggtagggactatgcagtgtaagctgcatcacttctgctttcttcctactagtgacaatcatctggtcttgccctcaagcaacaattgctagagtaacatctttgtataagcaagtaaccccagatagagttgacgtttcagctttgggctgtcaaaagggtatgtcatggaccaaagcactgttagtacgggtatgtttgcatttggtcactgatatgtaaatgactgctagcccacggctggaccacttctcaatcagcaaataaagccatgtctattttgctatctcagcatagactatgctgtctgataaatctaattcttaactctatttctccagttttttagtcctttaactttctggattgcaacgaagtctagtttagacctctaagcccttttagaagtacaagtataatgggaatttcttttcttggttcttttcaggttatgaggtttggtcagtgacaaaattttttttcataatttggttgattggttgcttcttaagttttataataaacgtttttcttcatgttctatttttgattttacagaaatgattttgcctccttgtggatactgacatatattaagtgtggaagcttattaatatttttggttttttaaaaactgaaatttttaatttttactttttaattttttaggaaaaaataagcactgaactgagaatgagaagaataaaagtatgagttccataccttctaattttaggctgtcagaaattcctttattctttgggatttcacaatcatttgaactatcagaagcctttacaattacttttagctgtaacatccgattctgtataagccacatagaaaaaagttgcctttctttttttatgacctggatatataagcaaatcagctaggaaatatataattgtattttatattaatgttttctaggattttggcttacagtaaatgttaacccctatggtaagtgattgttattgttggatgttatactgattattaataagaaatttggatttttgcctttttacctggaatttttgcttacagccgtagctatgaatatatatagggtggtcccc

SEQ ID NO: 7647 - DNA, 2770 bp, Homo sapiens
gcggaaccactggaacggtgcatgccgggacgagtagattcagtctctgaacggcccggagtagtctttcccctcctgaatgccgccactccgcagtccagagtatttgaagatcaagctgaaattgagagactgacgagagtggtccctttttgttcctaacagatttcttgcgacaaggaaaccggcagtcttccgcttccggttgctctgttgccatagtaaccgcacccataacagccgtggtggttatggctggcctgagcggcgcgcagatccccgacggggagttcaccgcggtcgtgtaccgcctcatccgcaatgcacgctacgccgaggcggtgcagctgctgggcggagaactgcagcggagccctaggagccgcgccggcctgtcgctgctaggctactgctactaccgcctgcaggagttcgcgctggcggccgagtgctatgagcagctgggccagctgcacccggaactggagcagtaccgcctgtaccaggcccaggccctgtacaaggcctgcctttatgcggaggccacccgggtcgccttccttctcctggataaccccgcctaccacagccgggtcctccgcctgcaagctgctatcaagtacagcgagggcgatctgccagggtccaggagcctggtagagcagctgccgagtagggaagggggagaggaaagtgggggcgagaatgagaccgatggccagatcaacctgggttgtttgctctacaaggagggacagtatgaagctgcatgctccaagttttttgccgccctgcaggcctcgggctaccagcctgacctttcctacaacctggctttggcctattacagcagccgacagtatgcttcagcactgaagcatatcgctgagattattgagcgtggcatccgccagcaccctgagctaggtgtgggcatgaccactgagggcattgatgttcgcagtgttggcaacaccttagtcctccatcagactgctctggtggaagccttcaaccttaaggcagctatagaataccaactgagaaactatgaggcagctcaagaagccctcactgacatgccacccagggcagaggaagagttggaccctgtgaccctacacaaccaggcactaatgaacatggatgccaggcctacagaagggtttgaaaagctacagtttttgctccaacagaatccctttcctccagagacttttggcaacctgttgctgctctactgtaaatatgagtattttgacctggcagcagatgtcctggcagaaaatgcccatttgatttataagttcctcacaccctatctctatgacttcttggacgctgtgatcacttgccagacagctcctgaagaggctttcattaagcttgatgggctagcagggatgctgactgaggtcctccggaaacttaccatacaagtacaggaagcaagacacaatagagatgatgaagctatcaaaaaggcagtgaatgaatatgatgaaaccatggagaaatacattcctgtgttgatggctcaggcaaaaatctactggaatcttgaaaattatccaatggtggaaaagatcttccgcaaatctgtggaattctgtaacgaccatgatgtgtggaagttgaatgtggctcatgttctgttcatgcaggaaaacaaatacaaagaagccattggtttctatgaacccatagtcaagaagcattatgataacatcctgaatgtcagtgctattgtactggctaatctctgtgtttcctatattatgacaagtcaaaatgaagaagcagaggagttgatgaggaagattgaaaaggaggaagagcagctctcttatgatgacccagataagaaaatgtaccatctctgcattgtgaatttggtgataggaactctttattgtgccaaaggaaattatgactttggtatttctcgagttatcaaaagcttggaaccttacaacaaaaagctgggaacagacacctggtattatgccaaaagatgcttcctgtccttgttagaaaacatgtcaaaacacacaatcatgcttcgtgatagtgttattcaagaatgtgtccagtttctagaacactgtgaacttcatggcagaaacatacctgctgttattgaacaacccctggaagaagaaagaatgcatgttggaaagaatacagtcacatatgagtctaggcagttaaaagctttgatttatgagattataggatggaatatatagtaatagctgatagtggcatttatcaaatggctttgttatgtaaatttgcatcgctttatttaccctttggcatctttatatttgttacatgttgaactttgtacacttatgcattataaaaaaaaaagtagctaaaacttttgctgttaaatttcccagaaagtgacatattctaagaacttttaccccaggagttatgaaaaattccaaacttatgaggaatgtttatatcagaagttgtaatacgtttgtttcctttcctctgttatcttttgtgctttgacgtatcttgaggggtctttgcacaaggattacatcattcagggaccaagcactatctcagtaatagttaagagtagtctttaaataatcatttcagggattgtgtgagagtagtctcacaatttacactcattaatttgtaatgcatactttttatatagactttaggatattttggcagtgtttattcatatggatataattctttacctaaccaaaattccttaggttataagtgg

SEQ ID NO: 7648 - DNA, 2470 bp, Homo sapiens
gtggtggttatggctggcctgagcggcgcgcagatccccgacggggagttcgcgctggcggccgagtgctatgagcagctgggccagctgcacccggaactggagcagtaccgcctgtaccaggcccaggccctgtacaaggcctgcctttatgcggaggccacccgggtcgccttccttctcctggataaccccgcctaccacagccgggtcctccgcctgcaagctgctatcaagtacagcgagggcgatctgccagggtccaggagcctggtagagcagctgccgagtagggaagggggagaggaaagtgggggcgagaatgagaccgatggccagatcaacctgggttgtttgctctacaaggagggacagtatgaagctgcatgctccaagttttttgccgccctgcaggcctcgggctaccagcctgacctttcctacaacctggctttggcctattacagcagccgacagtatgcttcagcactgaagcatatcgctgagattattgagcgtggcatccgccagcaccctgagctaggtgtgggcatgaccactgagggcattgatgttcgcagtgttggcaacaccttagtcctccatcagactgctctggtggaagccttcaaccttaaggcagctatagaataccaactgagaaactatgaggcagctcaagaagccctcactgacatgccacccagggcagaggaagagttggaccctgtgaccctacacaaccaggcactaatgaacatggatgccaggcctacagaagggtttgaaaagctacagtttttgctccaacagaatccctttcctccagagacttttggcaacctgttgctgctctactgtaaatatgagtattttgacctggcagcagatgtcctggcagaaaatgcccatttgatttataagttcctcacaccctatctctatgacttcttggacgctgtgatcacttgccagacagctcctgaagaggctttcattaagcttgatgggctagcagggatgctgactgaggtcctccggaaacttaccatacaagtacaggaagcaagacacaatagagatgatgaagctatcaaaaaggcagtgaatgaatatgatgaaaccatggagaaatacattcctgtgttgatggctcaggcaaaaatctactggaatcttgaaaattatccaatggtggaaaagatcttccgcaaatctgtggaattctgtaacgaccatgatgtgtggaagttgaatgtggctcatgttctgttcatgcaggaaaacaaatacaaagaagccattggtttctatgaacccatagtcaagaagcattatgataacatcctgaatgtcagtgctattgtactggctaatctctgtgtttcctatattatgacaagtcaaaatgaagaagcagaggagttgatgaggaagattgaaaaggaggaagagcagctctcttatgatgacccagataagaaaatgtaccatctctgcattgtgaatttggtgataggaactctttattgtgccaaaggaaattatgactttggtatttctcgagttatcaaaagcttggaaccttacaacaaaaagctgggaacagacacctggtattatgccaaaagatgcttcctgtccttgttagaaaacatgtcaaaacacacaatcatgcttcgtgatagtgttattcaagaatgtgtccagtttctagaacactgtgaacttcatggcagaaacatacctgctgttattgaacaacccctggaagaagaaagaatgcatgttggaaagaatacagtcacatatgagtctaggcagttaaaagctttgatttatgagattataggatggaatatatagtaatagctgatagtggcatttatcaaatggctttgttatgtaaatttgcatcgctttatttaccctttggcatctttatatttgttacatgttgaactttgtacacttatgcattataaaaaaaaaagtagctaaaacttttgctgttaaatttcccagaaagtgacatattctaagaacttttaccccaggagttatgaaaaattccaaacttatgaggaatgtttatatcagaagttgtaatacgtttgtttcctttcctctgttatcttttgtgctttgacgtatcttgaggggtctttgcacaaggattacatcattcagggaccaagcactatctcagtaatagttaagagtagtctttaaataatcatttcagggattgtgtgagagtagtctcacaatttacactcattaatttgtaatgcatactttttatatagactttaggatattttggcagtgtttattcatatggatataattctttacctaaccaaaattccttaggttataagtggttttaacgtgcaaaagtcagtaaaaaattttgttgccttaacaaaattatggtgctataatgtagagacaatgaacgattatc

SEQ ID NO: 7649 - DNA, 897 bp, Homo sapiens
gtagatgcgatggcgccgattccaaagactgtggggcggatcaagctagactgctctctacggcccagctgcccactggaggtcgctgctgcacccaaactttgcaaggaattcggtccagaggattacggcgaagaggacatagtggattttcttcgacggcttgtggagagtgatccccagggcctgcaccggatccatgtggatgggagcagcgggcggctgcagctgtggcaccatgattacctcctgggccacttggatgatgaagggaaatcaactggacagagtgacaggggcaagggggctgagggactgggcacctactgtggtctccgcaagtccttcctgtatcctcccttccctcaggtgccctcgaagcactgctttgaggtcccctggcctgtctccactcttgcattatccttcatgtcaccgaagccaccccaaccagcccctctcccagactcagagtagaaggccccatcctctcaagccccaggacccttcaaagggctgggacatcctgggacttgggctccagcatctgtctcaggccagatgagggggcaccggtccctcatagggcagggccatgtatatatcccttggtgggggacatagtgtggtgacagttcactgcatattttgagaccttattctctagatccatagttaatgatgccctggcagtcattcctcttgccatggggaagcttctgatgagagaaaggagccccacatccactgaaacatcctttggttctcaagcttcttctggaggcagtaaggaaaaataaaacccaccaaggctcaagaagggaactatagaaaagttcaggtttttaggctatagcagagacagtgagaaagcatctgggcctttctcttcctctt

SEQ ID NO: 7650 - DNA, 867 bp, Homo sapiens
gtagatgcgatggcgccgattccaaagactgtggggcggatcaagctagactgctctctacggcccagctgcccactggaggtcgctgctgcacccaaactttgcaaggaattcggtccagaggattacggcgaagaggacatagtggattttcttcgacggcttgtggagagtgatccccagggcctgcaccggatccatgtggatgggagcagcgggcggctgcagctgtggcaccatgattacctcctgggccacttggatgatgaagggaaatcaactggacagagtgacaggggcaagggggctgagggactgggcacctactgtggtctccgcaagtccttcctgtatcctccccaagagtctgagccctgccctcaaagcccctctgcctctgccaccttccccagtgtctcagacagcctgcttcaggtggccatgccccagaagctcctggtgacagaagaggaagccaatcgcctggctgaggagctggtggctgaggaggagcgcatgaaacagaaagcagagaaaaagcgactcaagaagaagcgtcaaaaggaacggaagcgacaggagcgtttggagcagtactgtggggagcccaaggccagcactacctcagatggagatgagagccccccatccagccctggaaacccagttcagggacagtgtggtgaagaagaggactcactggatctatctagcacttttgtgtctctggctttgcgcaaggttggggattggcccctcagtgcccgcagagagaagggactgaaccaggagccccaaggcaggggtctggccctccagaagatgggtcaagaggaagagagccctccaaccacttccccatgctga

SEQ ID NO: 7651 - DNA, 1018 bp, Homo sapiens
gtagatgcgatggcgccgattccaaagactgtggggcggatcaagctagactgctctctacggcccagctgcccactggaggtcgctgctgcacccaaactttgcaaggaattcggtccagaggattacggcgaagagattacctcctgggccacttggatgatgaagggaaatcaactggacagagtgacaggggcaagggggctgagggactgggcacctactgtggtctccgcaagtccttcctgtatcctccccaagagtctgagccctgccctcaaagcccctctgcctctgccaccttccccagtgtctcagacagcctgcttcaggtggccatgccccagaagctcctggtgacagaagaggaagccaatcgcctggctgaggagctggtggctgaggaggagcgcatgaaacagaaagcagagaaaaagcgactcaagaagaagcgtcaaaaggaacggaagcgacaggagcgtttggagcagtactgtggggagcccaaggccagcactacctcagatggagatgagagccccccatccagccctggaaacccagttcagggacagtgtggtgaagaagaggactcactggatctatctagcacttttgtgtctctggctttgcgcaaggttggggattggcccctcagtgcccgcagagagaagggactgaaccaggagccccaaggcaggggtcccctggcctgtctccactcttgcattatccttcatgtcaccgaagccaccccaaccagcccctctcccagactcagagtagaaggccccatcctctcaagccccaggacccttcaaagggctgggacatcctgggacttgggctccagcatctgtctcaggccagatgagggggcaccggtccctcatagggcagggccatgtatatatcccttggtgggggacatagtgtggtgacagttcactgcatattttgagaccttattctctagatccatagttaatgatgccctggcagtcattcctcttgccat

SEQ ID NO: 7652 - DNA, 2098 bp, Homo sapiens
actgtagatgcgatggcgccgattccaaagactgtggggcggatcaagctagactgctctctacggcccagctgcccactggaggtcgctgctgcacccaaactttgcaaggaattcggtccagaggattacggcgaagaggtaaaagcgaccctcagtttcccccagtcctgctcattttggtcacgcctctttgaagtcagctgtgcagaaacccgcgacggatgggcgccagacggggctctggaggctttggggagttgtagtctccggccatgcccttgaggatcttagattacctcctgggccacttggatgatgaagggaaatcaactggacagagtgacaggggcaagggggctgagggactgggcacctactgtggtctccgcaagtccttcctgtatcctccccaagagtctgagccctgccctcaaagcccctctgcctctgccaccttccccagtgtctcagacagcctgcttcaggtggccatgccccagaagctcctggtgacagaagaggaagccaatcgcctggctgaggagctggtggctgaggaggagcgcatgaaacagaaagcagagaaaaagcgactcaagaagaagcgtcaaaaggaacggaagcgacaggagcgtttggagcagtactgtggggagcccaaggccagcactacctcagatggagatgagagccccccatccagccctggaaacccagttcagggacagtgtggtgaagaagaggactcactggatctatctagcacttttgtgtctctggctttgcgcaaggttggggattggcccctcagtgcccgcagagagaagggactgaaccaggagccccaaggcaggggtctggccctccagaagatgggtcaagaggaagagagccctccaagagaggagaggccccagcagagtccaaaggtacaggtgaggtggctgaagaaccttattcagctggaaccgtggaaggggcacaaggagctgctggggaggcacagggtctaaggattgacacagggtccagtgggagttctctggctctagggtcaagagacctacagtcaggccccatcactgtcaccatgaccccgggtggtttcctgtctaggaagatagggctgataccatcttgtagggctgtcatgaggattacatgagttgggtaatgctaattgcagtgttacctgtttaaacaaaggagaaggatttggggaggctgagacctcaagacctgcttgactttgcaccctatccccaggcatctccgggactgctggcagctgccttacaacagagccagtggtctggtgctcacctcctctcactgctagaatattcaccaagggtttgcatttgggaagtcccttaccagctcctgcttagagctggtagggccatacatgtccacactcccaactggtggctctcccgctgaatggggcctcagcaggtgcccaagctgctacaaccttggccactctgtttctccaccccagcactgggcatggtaattagcctttccccatgttaatttattcagttttttcaagggtcaactgaattccccacttcctgggtaagaagcatgatctccttttaatttcacgtctaagatcctggcagcttcccctagctggttcctctgtagtcctgctgggactgtcagctcatttaaatgtgggtctgcagaaggctttaggtctcccccaacccccttacctttcacagaggaacctttcatcaggataaatgattattgctgccctgtgggtcttgctcaatactgttcatacctggagagagaaggtattgaaacatctcctttatgtgtgactttcccaaatttttaaaaattgtttatggtttaggccccttaaatactgtgtagcaggatgaagtctaccattaccagctgggtcaccttggatgggtctgtcaacatctaagcctcagttccctcacctgtaaaaatgagggtagtccctacctcataagggatattgtgaggatggaaagcgaaagtgtgagaaaatacctcccaagtgcctggtacatagtgggtgctaaataaaccactttttgtctgc

SEQ ID NO: 7653 - DNA, 3235 bp, Homo sapiens
agatgcgatggcgccgattccaaagactgtggggcggatcaagctagactgctctctacggcccagctgcccactggaggtcgctgctgcacccaaactttgcaaggaattcggtccagaggattacggcgaagaggacatagtggattttcttcgacggcttgtggagagtgatccccagggcctgcaccggatccatgtggatgggagcagcgggcggctgcagctgtggcaccatgattacctcctgggccacttggatgatgaagggaaatcaactggacagagtgacaggggcaagggggctgagggactgggcacctactgtggtctccgcaagtccttcctgtatcctccccaagagtctgagccctgccctcaaagcccctctgcctctgccaccttccccagtgtctcagacagcctgcttcaggtggccatgccccagaagctcctggtgacagaagaggaagccaatcgcctggctgaggagctggtggctgaggaggagcgcatgaaacagaaagcagagaaaaagcgactcaagaagaagcgtcaaaaggaacggaagcgacaggagcgtttggagcagtactgtggggagcccaaggccagcactacctcagatggagatgagagccccccatccagccctggaaacccagttcagggacagtgtggtgaagaagaggactcactggatctatctagcacttttgtgtctctggctttgcgcaaggttggggattggcccctcagtgcccgcagagagaagggactgaaccaggagccccaaggcaggggtctggccctccagaagatgggtcaagaggaagagagccctccaagagaggagaggccccagcagagtccaaaggtacaggcatctccgggactgctggcagctgccttacaacagagccaggaactggcaaagttgggtaccagctttgctcaaaatggtttctaccatgaggccgtggtcctcttcacccaggccttgaagctcaacccccaggaccaccggttatttggaaatcgttccttctgccatgagcggttgggtcagccagcgtgggccctggctgatgcccaggtggcccttaccctacggcctggctggccccggggcctcttccgcctgggcaaggccttgatgggactacagcgcttcagagaggcagctgctgtgtttcaggaaactctgagaggtgggtcccagcctgacgcagcccgagagctccgctcttgccttctccacctcacactgcagggtcagcgaggaggaatctgtgcaccacctctgtcacctggggccctccagccacttccccatgctgagctggcaccctcaggcctaccttccctcaggtgccctcgaagcactgctttgaggtcccctggcctgtctccactcttgcattatccttcatgtcaccgaagccaccccaaccagcccctctcccagactcagagtagaaggccccatcctctcaagccccaggacccttcaaagggctgggacatcctgggacttgggctccagcatctgtctcaggccagatgagggggcaccggtccctcatagggcagggccatgtatatatcccttggtgggggacatagtgtggtgacagttcactgcatattttgagaccttattctctagatccatagttaatgatgccctggcagtcattcctcttgccatggggaagcttctgatgagagaaaggagccccacatccactgaaacatcctttggttctcaagcttcttctggaggcagtaaggaaaaataaaacccaccaaggctcaagaagggaactatagaaaagttcaggtttttaggctatagcagagacagtgagaaagcatctgggcctttctcttcctcttggtccaggggacctcattcaccaactagagcttggtgtacaggaacggggtcacagtgctgagggggcttgagtcccacctttcagcttgatggatgctcacctcttctcagccccagctcgtgccctgtttttctagccatagcccccagattactcacagctcctcatgccatttcctgtccagattgctatgtatgactctgacctctcttgtccagtggtctggtgctcacctcctctcactgctagaatattcaccaagggtttgcatttgggaagtcccttaccagctcctgcttagagctggtagggccatacatgtccacactcccaactggtggctctcccgctgaatggggcctcagcaggtgcccaagctgctacaaccttggccactctgtttctccaccccagcactgggcatggtaattagcctttccccatgttaatttattcagttttttcaagggtcaactgaattccccacttcctgggtaagaagcatgatctccttttaatttcacgtctaagatcctggcagcttcccctagctggttcctctgtagtcctgctgggactgtcagctcatttaaatgtgggtctgcagaaggctttaggtctcccccaacccccttacctttcacagaggaacctttcatcaggataaatgattattgctgccctgtgggtcttgctcaatactgttcatacctggagagagaaggtattgaaacatctcctttatgtgtgactttcccaaatttttaaaaattgtttatggtttaggccccttaaatactgtgtagcaggatgaagtctaccattaccagctgggtcaccttggatgggtctgtcaacatctaagcctcagttccctcacctgtaaaaatgagggtagtccctacctcataagggatattgtgaggatggaaagcgaaagtgtgagaaaatacctcccaagtgcctggtacatagtgggtgctaaataaaccactttttgtctgcaactgtcctacatagtcatgcttcccacaataggaagagaggagtgtgggtgaattggtgctgaaattcacaaaatccagagttctgggactggattctcaaagtgtgctttctaggctagcagcatcagcatcatccaggaacttactagaaatgcaatttctcaggctgggcacggtggctcacgcctgtaatctcagcactttgggaggccaagatgggtggatcacctgaggtcaggagtttgagaccagcctgaccaacatggagaaacgcctcctctgctaaaaatacaaaattagccaggtgtggtgtcacatgcctgtaat

SEQ ID NO: 7654 - DNA, 822 bp, Homo sapiens
ataaggcacaaacctagcgccaaggttggctgtcaaggtagattccagggtgtggaagtggctttgtggtgccacctctaaccgctcggaggtcaacccccattctacaccgaaaactaggccttggctgctatggaaggacagcggcaagaaagccacgcaaccctaacactcgcccaggctcatttcaacaatggagagtacgcggaggccgaggcactgtactccgcttacattcgccggtgcgcttgcgcggcctccagcgacgagagtcccgggagcaaatgcagccctgaggatttggctactgcatataacaacagggggcaaatcaagtacttcagggttgatttttatgaagccatggatgactacacatctgccatagaagtccaacccaattttgaagttccatattacaacagagggttgatactgtataggctgggatattttgatgatgctttggaagatttcaagaaggtcttagacttaaatcctggatttcaagatgctactttgagcttaaaacagactattctagacaaagaagaaaaacaaagaagaaatgttgcaaaaaattattgatatttttaacttaatggaagtattgattcatgatccttacatctgcatctagttatcagtaatttagatattgagctattttgatttatatttaagaaattaatacattagcactgaaagttaaatagtgtgtttaaggtagttaatttcaggttgaatgggttttttttaatgaagtgtaaataataccaatgtataagtgtatattattatattaaatattatagtaaaaag

SEQ ID NO: 7655 - DNA, 2612 bp, Homo sapiens
gcggtgacttctgggatttgtggtcccggagaagagattggcggaggggaaagactgagtcgtctttcctttgcccgcttctgtggactgttcgaacgcccaggggtgggccaaacccgtttcttaggaaaccaggaatccagggaaggcagaatggcttcctttgggtggaagaggaaaattggtgagaaggtctcaaaggtcacttcccagcagtttgaagctgaagctgctgatgagaaggatgtagttgacaacgatgaagggaactggcttcatgccattaaacgtaggaaagaaattcttcttgaaggctgtgctgagaaaagtaaacagctgaaggatgaaggagccagtttggctgaaaataaaagatatcgggaggcaattcagaagtgggatgaagcactacagttaactccaaatgatgctaccctatacgagatgaaatcacaggtgctaatgtctcttcatgaaatgttcccagcagtacatgcagcagaaatggccgtccagcaaaatccacattcatgggagtcttggcagactttgggacgtgctcaacttggtttaggagagataatcctggcaattcgaagttttcaagtagcccttcacatctatccaatgaaccctgaaatatggaaagaagacctctcttgggcaagaacgctccaggagcagcagaaggtagcacagaggattaaaaaaagtgaagcaccagctgaagtaacacacttttcaccaaagtcaattccagactatgactttgaaagtgatgagattgttgctgtttgtgcagctattgctgagaaagagaagacagtttcagcaaataaaacaatggttattgtgtctgcttctggggccatagagactgtaactgaaaaggaggatggtgctacaccaccagatggctctgtttttatcaaagcccgatgaagcagtatgcataggattatttgaatctgtctttttgattgcctcttgaagttttgacatagagacatttactctggagatagataggagaacgcctggttgtaaaatatgtttttcagatgaggcatataaaaactaaaatggcaggattattgtatagtgtttggaatatgctttgataagttatgatttatatttctcaaggttaaaattctgagtaaaatggtctttgattaataaacttagtttaatctgaatatgtaaatgaatacattttaaagacaaaacttgaaaaatgtattcttgaatagtgaataatttgatcaatgttactgaaatgctgtctcaacttttgttttatgataaaggaagtgtgtgatttccctccctctgagaaatatactgcgcttaatatttgctgtctttttcttgcttcattagagtaagtctgtcagaaagcttgaatatttttgacattcattttgattcaaagttgtcatttggttatatgtggaatctttgaaagtttggctgaaaatgcacacaaatgtgtacattctgaacattttctgaagtttctcttaattctgatttgtgtttctgttttgactttgaagttgtaacaatgatagttgtctccttcagtatttggtaaaagtgtaaagtattgataaatatgagaatgatggttttattttttaattgttacagtaagtaatccttaccacaaatgagtcatttttaaaatatgcatttttaaatgaatggcttttacagataggttaatgacaattgtactgctatattatcccagtcaaaaccaatactttcttttctttattttacaaagctttaaaaaccctggaaacaacttacttcttgcttgtgtctttccatttgatgactgggaattacttttctagataactttttttgaaactactcagtgaaatgaaaaataattacaattttaaatagctaattatatctttctaaaaataaaaaagtagggctgttattagagtgccaatgaataaataacttaagcacaaaatacatagaaattggaatgtgatttatagtacaatctcatgagtatgaaaaggctatattaaaaaaaattttattgaaagtccacagtcatattcacaaaccaatactgtcattgctaatctgaactattatttttatactatatattgtagtacaataatatagaactgttgggttctgttacttctgacactcaggaagatactattggtgtattaattttatctttgttagagatgaaagtagcccactttatgttaaagatcttactactgttggagcttataagtaatgatctacattttttatgaagatggtttttaaaacttttgttttattggaatgcatatctcttttcagggttggagaaattagcacttgccttgaaaagaatattctttccttaagttatatcatcagaaaattagctctggttagagaggttagtttcagagtgctccaaaaaatatgttaattattttattttgtttaataaagaacattctcaaaacgtaaataggtatctagagaagtgagtactcaacatttggtatattgttttgagtaatggatgtttgttttttgtgtaatttgtgaataaatagtttttttctgca

SEQ ID NO: 7656 - DNA, 1781 bp, Homo sapiens
cgctgctggccgccaaggcctacgtgccctggaaccagcgggggctgctgctggtggtgctgcgggaggaggcccgtgggatgctgcagcgatctccacgcgccgggccgtccagagcgcagggccggagggaggccgcagagacgggcggccccaccacgcaggagggggtcgcctgcggcgtgcaccagctggccacactgctgatggagctggattcagaggacgaggcctctcgcctcctggcggctgatgccctgtaccgcctgggccgcctggaggagacccacaaggccctgctggtggccctatcccggaggccccaggcagcccctgtgctggcacgactggccctgctgcagctgaggaggggcttcttctatgacgccaaccagttggtgaagaagctggtccagtctggtgacaccgcctgcctccagcccaccctggacgtcttctgccacgaggaccggcagctgcttcaaggccactgccacgccagggccctggccatcctgcgggcacggccaggcggggccgacggcagggttcacaccaaggaggccatcgcctacctgtctctggccatctttgccgcaggaagccaggcaagtgagtccctccttgcccgagcccgctgctatgggttcctgggccagaagaagacggccatgttcgacttcaacacagtgctgcgggctgagccggggaacgtgcaggcactgtgtggacgggcgttggtgcacctggccctagaccagctgcaggaagccgtggacgacatcgtctctgctctgaagctcggccccgggactgtggtccctgagctccgctctctgaagccggaagcccaggccctcatcacacagggcctctactcccactgccgggcccttctgagccagctgccagacactggggcccctctcgaggacaaggacacccagggcctccttgctgtgggggaggcgctgatcaaaatcgactcagggcaaccgcactggcacctcctcctggcagacattctcatggcacagggcagctacgaggaagctggcacccacctggaaaaagccctgcaccgtgccccaacgtcagaggcagcccgggcccggctgggcctgctccagctcaagaagggagacgtgccaggggctgcaagggacctgcagagcctggccgaggtggatgccccggatctcagctgcctgctgcatctcctggaggcctcggagcggcagagccttgcccaggcggcggcccaggaagccggcaccctcctggacgcagggcaacccaggcaggcgctgggctactgttcgctgtctgtcctggccagtggcagcagtgcctgtcacctgcgtctgcgggccacctgcctggccgagttgcaggagtttggccgggcccttagggacctggaccatgtgctccaggaggcgctgggggatggtgacctcccaaggcgggcagaggacttctgccgtcagggtcgcctgctgctgagcctgggggatgaggcggcggccgcaggggcctttgcccaggccctgaagctggcgccctccttggcccagaacagcctgtgcaggcagccaggccgggcccccactgcacgcatgttccttctccgcgggcagtgctgcctggaggagcagcgtcacgcagaggcctggacggcggtagagagcggcctcctggtggaccccgaccaccgtggcctgaagagactgaaggccagaatccggagggaggcatcctcaggctgctggctacagtga

SEQ ID NO: 7657 - DNA, 874 bp, Homo sapiens
ttgggattttggagttgagcaccatggggactccaaatgatcaggcagtgctgcaggccatcttcaaccctgacaccccatttggagacattgttggattggacctcggagaggaagcagaaaaggaagaacgagaagaagatgaagttttccctcaagcacagctggaacagtccaaggccctggagctgcagggggtgatggcagcagaggctggggacctcagcacagccctggagaggtttggccaagccatctgcctgctgcctgagagggcttcagcctacaacaaccgtgcccaggcccggcgactccagggagacgtggcaggcgccctggaggatctggaacgcgcggtggagctgagcggcggccggggccgcgccgcccgccagagctttgtgcagcgcggactcctggcgcggctgcagggccgagacgacgacgcccgcagggacttcgagagggcggcacggctgggcagccccttcgcgcggcgccagctggtgctgctcaacccctacgccgcgctgtgcaaccgcatgctggccgacatgatggggcagctgcgccgcccccgtgacagccgctgagcgccgcggacccgggcgtccgcgggcgaggggacgggactgggccctgaaccaataaagccgtcgggcctcaccgactccgcctgctcctgcgtcctgcccgcgcccggagagaagggcactcgggggtactcggcgcgggctggggaccagccggggggtggtgagccgcggccgcccacctgccgggtaagggcccctcgggcccgtggtcgggcatcgattggccccgcctggcgcagcccccgcccctgcagcggactgcggtgctcatcagacct

SEQ ID NO: 7658 - DNA, 1009 bp, Homo sapiens
ttgggattttggagttgagcaccatggggactccaaatgatcaggcagtgctgcaggccatcttcaaccctgacaccccatttggagacattgttggattggacctcggagaggaagcagaaaaggaagaacgagaagaagagaataccaccaccagaacagaagactgaaataaggcagggcatggttgctcagttgagtggttccaatatagcaagcacaaccagtaaccgttaaacactgtcacaagccaagctccaaactaactcttccgcaatgaagttttccctcaagcacagctggaacagtccaaggccctggagctgcagggggtgatggcagcagaggctggggacctcagcacagccctggagaggtttggccaagccatctgcctgctgcctgagagggcttcagcctacaacaaccgtgcccaggcccggcgactccagggagacgtggcaggcgccctggaggatctggaacgcgcggtggagctgagcggcggccggggccgcgccgcccgccagagctttgtgcagcgcggactcctggcgcggctgcagggccgagacgacgacgcccgcagggacttcgagagggcggcacggctgggcagccccttcgcgcggcgccagctggtgctgctcaacccctacgccgcgctgtgcaaccgcatgctggccgacatgatggggcagctgcgccgcccccgtgacagccgctgagcgccgcggacccgggcgtccgcgggcgaggggacgggactgggccctgaaccaataaagccgtcgggcctcaccgactccgcctgctcctgcgtcctgcccgcgcccggagagaagggcactcgggggtactcggcgcgggctggggaccagccggggggtggtgagccgcggccgcccacctgccgggtaagggcccctcgggcccgtggtcgggcatcgattggccccgcctggcgcagcccccgcccctgcagcggactgcggtgctcatcagacct

SEQ ID NO: 7659 - DNA, 5706 bp, Homo sapiens
atgagtcctgggaaaggcgcatgcgctctcattgcagcctcggcgtttgtagaagaggagcatctgctccagatggaaaatgggtaaggaacaatcaaattcaattcgggaagaatatagaggtggtaataattggtaaaagtctgcagggttttttttaaccaaaggaaactggtttgagaaaattgtgaaatcagcattgaaatttgttacctactccaatcaagatttgcaaactacaaaaaaatcattctgaagctttcacctataaatatataccaagataatttcagataagaatgtccagcaaggaagtgaagactgctctaaaaagtgctagagatgcaatcagaaacaaagaatacaaagaagctttgaaacactgtaagacagtgttaaagcaagagaaaaataactataatgcctgggtttttattggcgttgctgcagctgaactagaacaacctgatcaggcccagagtgcctataaaaaagctgctgaattagagccagaccaattactagcttggcaggggttagcaaacttgtatgagaaatataatcacataaatgctaaggatgacttgcctggtgtttaccaaaagctcctggatctttatgagagtgttgacaagcagaagtggtgtgatgtctgcaagaaacttgtggatctatattaccaagaaaagaaacacctagaggtggctcgaacatggcacaagttgataaaaacacggcaggaacaaggtgcagaaaatgaagagcttcatcaactatggagaaaattgactcagttcctggctgaaagtacagaggaccagaataatgaaactcagcaattgctttttactgcttttgagaatgcactgggattatcagataagattcctagtgaagatcaccaagtactttataggcatttcattcagagtttatccaaatttcctcatgagtctgctagattgaagaaggcctgtgaaggaatgataaacatctatcctactgtacagtatccattagaagtgctttgtttgcatttaattgaatcaggaaatcttactgatgaggggcagcagtattgttgtagattagtggaaatggattcaaaaagtggtccaggcctcattggcttaggcattaaagcattacaagacaaaaagtatgaagatgctgttaggaacctaacagaagggttaaaggaaagccctgtctgcacaagtggatggtatcatctggcagaagcccaagtcaaaatgcatagacctaaagaagctgttctttcatgcagtcaagctctgaagatcgtagataatcttggtgcgtctggtaacagtctttatcagaggaatctttgtcttcatttgaaagcagaggctttgattaaactctcagattatgactcttcagaggaagcaattcgtacgcttgatcagatttctgatgcagataatatcccaggacttttggttctcaaaagcttggcctatcggaacaaaggttcatttgatgaagctgcaaagattatggaagaccttctctcttcttaccctgacctagctgaagttcatgcccttgaggctttgattcatttcaccaaaaaggactatctacaagcagaaaaatgttttcagagagctcttgagaaagataccgaagttgcagaatatcattaccaacttggattaacatactggttcatgggtgaagagacaagaaaagataaaacaaaggctcttacccactttctgaaggctgcaagactggatacatatatgggcaaagttttctgctatttaggtcattattatagagacgtagtgggagataaaaacagagctcgtggatgttataggaaagcctttgaattagatgacactgatgctgaatctggagctgcagcagttgacctaagtgtggagcttgaagatatggaaatggctttagctatcctaacaacagtaactcaaaaggcaagtgctggaacggcaaaatgggcctggcttaggcgaggactatactatttgaaagctggtcagcattctcaagcagtggctgatttacaggcagcattaagagcagacccaaaggacttcaattgttgggaatcgttaggagaagcatacttaagcagaggaggctacacaacagccttgaagtccttcacaaaagccagtgagctgaacccagaatccatatacagtgtgtttaaggttgcagcaatacagcaaatcctaggcaaatataaggaggctgtagctcaataccagatgatcattaaaaagaaagaagattatgtgcctgctttaaaaggtttgggtgaatgccatcttatgatggcaaaagcagctctagttgattatcttgatggaaaagccgtagactacatagaaaaagcactggaatattttacttgtgctctacagcatcgagctgatgtgtcctgcctctggaagctagctggggatgcttgtacctgtctgtatgctgtcgcaccatctaaagtgaatgttcatgttttaggagtccttctaggtcagaaagaaggaaaacaagtattaaagaaaaatgagctcctccaccttggaggaaggtgttatggtcgtgcattaaaactgatgtctacatctaatacatggtgtgaccttggaattaattattatcgccaagcacaacatctagcagaaacaggcagcaacatgaatgatcttaaggagttgctggagaaatctttacattgtctgaaaaaagcagtgagactcgacagtaataatcacttatactggaatgctcttggtgtggttgcatgttacagtggtattggaaattatgcccttgctcagcactgtttcatcaaatcaatccagtcagaacaaattaatgctgttgcatggaccaacttgggagtgttatacctcacaaatgaaaacattgagcaagctcatgaggctttcaaaatggctcaatcccttgatccatcttatttaatgtgctggattggacaagctcttattgctgaggcagttggaagttatgacaccatggatctcttcaggcacactacagaactaaatatgcatactgaaggagcattaggttatgcgtattgggtctgcacaacattgcaagataaaagcaacagagaaacagagctgtaccagtacaacatcctccagatgaatgctattccagcagcacaagttattttgaataaatatgtagaaagaattcagaattatgccccagctttcacaatgttgggttacttaaacgaacatctacaactgaaaaaggaagcagcaaatgcataccaaagggcaattttgttgttacagactgcagaagaccaagatacttacaatgttgcaataagaaattacggcagattgttatgttccactggtgaatatgataaagctatccaggcttttaagtcaacaccccttgaagtgttagaagacatcataggttttgcattggctttattcatgaaggggctttataaagagagcagcaaagcctatgagagagccttgtctattgttgaatcggagcaagacaaagcccatatcttgacagctctggcaataactgaatataaacaaggaaaaacggatgtagccaagacattgctatttaaatgctctatcttaaaggaaccaaccacagaaagccttcaagccctgtgtgctctagggttggcaatgcaggatgctacactgtcaaaagcagcacttaatgagttactgaagcacatcaaacacaaagacagtaattatcagaggtgccttcttacatcagcgatttatgcactccaaggccgcagtgtggctgtgcaaaaacaaatatctaaagctgttcacagcaaccctggtgaccctgctctttggtctctgttgtctcgagttgttgcacagtatgctcaacgaaatgcaaagggaggtgttgtagcaggaaatgtggctcatattctggactcaaatcatggaaagaaggcattactgtacactgcggtaaatcagttggctatgggaagcagttcagcagaagatgaaaaaaatactgcactaaagaccattcagaaggcagctctcctttctccaggtgatcctgctatctgggctgggctaatggcagcctgtcacgctgatgataaactggccttagtgaacaacactcagccaaagaggatagatttatacttggcactgttatctgctgtttctgcttcaattaaagacgaaaaattctttgaaaattacaaccagtcccttgaaaagtggtctctctcacaagctgtcactggtctaatagacacaggaagaatatctgaagctgaaactctctgcacaaagaatttaaaaagtaaccctgatcagccagccgttatcttacttttgagacaagttcagtgtaaaccactcctggagtcacaaaagccactcccagatgctgtacttgaagaactacaaaaaacagtcatgtccaactcaacctctgttccagcttggcagtggctggcacatgtgtatcaatcccaaggaatgatgagagctgcagagatgtgttacagaaagagtctacaattggcatcccaacggggcagttggagtgggaagctctcaagtctgttgagactagcactacttgcattaaaagtctgtatggctaacatttccaatgatcactggccatctttggttcaagaggctacaactgaggccttgaagctttgcttttgtccactggctgttcttttacaagctttgttacaattcaaacgcaaaatgggggcaagagagacacggcgtcttttggaaagagtggtatatcagcctgggtatcccaaatctattgcatcaactgcacgttggtacctactgagacacttatatgccaaagatgactatgagcttattgacgtgctggtaaacaatgccaaaactcatggagatacaagagcattggaactgaatcagagattgtcctcacaataacattggattattttatagtaaggaagcaaagaaaaagctgtaagaatgaagcaatgaatcaagacttctacccaaagcaacatttttttaaactatatttattccttttctaaaggaatctagagaagttgaagtttttaagttaggaatgcaattttctgttaactccaaacctgattttaatctgaaaaaaaaaaaatttaatttgggaaaaccagaatgaaaggaaaaccattattgccttggttgcttaacattatttgtaaaccattattttctgcatcttgcatggtgcacaatagaatatcttttactgtaatcccttacaataaagccttaatagccattttctatgtaatatgcaaaagtagattagcacaatgcacaattttcttttgttaaaaatcaaattcaaagatttaattcttgctatgaattctaaagttcggcaaaccaattcatcataaaatccaaataatcttgtaacctatttatctagtgattcatctccaattctgttgaaaaagcataatataaatgttgatgagactagactctaatggatatgtttatataattccaaacactcaggtgtgtgaatgcatttaaaaacattaatggaaaataatgctgataatatttaattgatcatgcaattccttcaattatgatggaaagacttgaactttctgaaataaaacaaaaatacagc

SEQ ID NO: 7660 - DNA, 577 bp, Homo sapiens
ctgctccaggtgggtttggatttctgtcggttttgcacaagggatcctaaaggcgattgaaatgatggaaaatgggtaaggaacaatcaaattcaattcgggaagaatatagaggtggtaataattggtaaaagtctgcagggttttttttaaccaaaggaaactggtttgagaaaattgtgaaatcagcattgaaatttgttacctactccaatcaagatttgcaaactacaaaaaaatcattctgaagctttcacctataaatatataccaagataatttcagataagaatgtccagcaaggaagtgaagactgctctaaaaagtgctagagatgcaatcagaaacaaagaatacaaagaagctttgaaacactgtaagacagtgttaaagcaagagaaaaataactataatgcctgggtttttattggcgttgctgcagctgaactagaacaacctgatcaggcccagagtgcctataaaaaagctgctgaattagagccagaccaattactagcttggcaggggttagcaaacttgtatgagaaatataatcacataaatgctaaggatgact

SEQ ID NO: 7661 - DNA, 1388 bp, Homo sapiens
actcccaggaaggcccgggtgcccagagctcgcggtggactccgacccggcgcaacatggccgcagcctcgcctctgcgcgactgccaggcctggaaggatgcgaggctcccgctctccaccacaagcaacgaagcctgcaagctgttcgatgccacgctgacccagtatgtaaaatggaccaatgacaagagtctcggtggcatcgagggctgcctgtcaaagctcaaagcagcagatccaacctttgtgatgggccacgccatggctactggccttgtgctgattggcactggaagctccgtgaagctggacaaagagctggacctggctgtgaagacaatggtggagatttcaagaacccagccgctgacaaggcgggagcagctgcacgtgtctgcagtagagacatttgccaatggctatgtgaaaggcatctactcttttggcttgatggaaaccaacttctacgaccaggcagaaaaactcgccaaagaggctttatctattaacccgacagacgcatggtcggtgcacaccgtcgctcacatccacgagatgaaagcagagatcaaggatgggttggaattcatgcagcactcagagaccttctggaaggactctgatatgttggcttgtcataactattggcactgggctttatatctgattgagaagggcgaatatgaggccgcgctgaccatctacgatacccacatccttcccagcctgcaggccaacgatgcaatgctggacgtggtggacagctgctccatgctctaccgcctgcagatggaaggagtgtctgtgggccagcggtggcaggatgtcctgcctgtggcccggaagcacagccgagaccacatcctgctgttcaatgacgcacacttcctgatggcatccctgggtgcacacgacccccagaccacacaggagctgctgaccaccctgcgggacgccagcgaatccccaggggagaactgccagcacctcctggcccgagacgtggggctgcccctgtgccaggccctggtggaggctgaggacgggaaccctgaccgcgtcctggagctgctcctgcccatccgctaccggatcgtccagctcggtgggagcaatgcccagagagacgtcttcaaccagctgctgattcacgcggccttaaactgcacctccagcgtccataagaacgtagcccggagccttctgatggagcgtgatgccttgaagcccaactcgcccctgaccgagcggctcatccgcaaggcagctaccgtccacctcatgcagtgagccagcctggccgcctccaccctgcagaacctcagtggtggcgtcactgcgtccagtcagctgctccaccgggttagggtcaggagacggccagag

SEQ ID NO: 7662 - DNA, 2610 bp, Homo sapiens
tttccgcgaccgccccgcccactcccaggaaggcccgggtgcccagagctcgcggtggactccgacccggcgcaacatggccgcagcctcgcctctgcgcgactgccaggcctggaaggatgcgaggctcccgctctccaccacaagcaacgaagcctgcaagctgttcgatgccacgctgacccagtatgtaaaatggaccaatgacaagagtctcggtggcatcgagggctgcctgtcaaagctcaaagcagcagatccaacctttgtgatgggccacgccatggctactggccttgtgctgattggcactggaagctccgtgaagctggacaaagagctggacctggctgtgaagacaatggtggagatttcaagaacccagccgctgacaaggcgggagcagctgcacgtgtctgcagtagagacatttgccaatgggaactttccgaaagcctgtgaactatgggaacagattctccaggaccacccgacagacatgttggccctgaaattttcccatgatgcttatttttacctgggctatcaggaacagatgagagattctgttgctcgaatttaccccttctggacacctgacatccccctaagcagctatgtgaaaggcatctactcttttggcttgatggaaaccaacttctacgaccaggcagaaaaactcgccaaagaggctttatctattaacccgacagacgcatggtcggtgcacaccgtcgctcacatccacgagatgaaagcagagatcaaggatgggttggaattcatgcagcactcagagaccttctggaaggactctgatatgttggcttgtcataactattggcactgggctttatatctgattgagaagggcgaatatgaggccgcgctgaccatctacgatacccacatccttcccagcctgcaggccaacgatgcaatgctggacgtggtggacagctgctccatgctctaccgcctgcagatggaaggagtgtctgtgggccagcggtggcaggatgtcctgcctgtggcccggaagcacagccgagaccacatcctgctgttcaatgacgcacacttcctgatggcatccctgggtgcacacgacccccagaccacacaggagctgctgaccaccctgcgggacgccagcgaatccccaggggagaactgccagcacctcctggcccgagacgtggggctgcccctgtgccaggccctggtggaggctgaggacgggaaccctgaccgcgtcctggagctgctcctgcccatccgctaccggatcgtccagctcggtgggagcaatgcccagagagacgtcttcaaccagctgctgattcacgcggccttaaactgcacctccagcgtccataagaacgtagcccggagccttctgatggagcgtgatgccttgaagcccaactcgcccctgaccgagcggctcatccgcaaggcagctaccgtccacctcatgcagtgagccagcctggccgcctccaccctgcagaacctcagtggtggcgtcactgcgtccagtcagctgctccaccgggttagggtcaggagacggccagagcctgtttgttagggctgttagagggtgatcttcagttttacaggaagtgggtcacgggttaattttaaatgtgattccgaatctcctttcagtcctcgagaagggccaatgagcatttttcagcagtcacagccagtgtgagtgctgctctttccacctgccttgcaaattctgtttcccaggggaatgtgtctactgcctggtggttcaaaggttggaaggcagggcagaggtgggggctgattctgctgggacaggtcttccagaggcagcctccccccactgcctgtccccgtccccaccaggctgcccttgggatggaccttttcattcttttctttatattctagacagtctctgttgtctcattgtgttgctgtcccatttttcaggtgagggtaccggggtaggggagtggcctgcccagggtcacactatgagaggcccccacctgctgcctttggacgcagccccctgctgctgcatccaccacccttcttacagatcagcgcgcacatggggtccttctgctgtctctggggcgagtcttggagccccctggggggctctgttggtgctgatttggacccgtttctctttttaaactgcacatcataacagggcttcatgtcgagcatgattttaatcataaatgcacttctgaggtgcaaggattgagctcagagctgctctgttgtggcaaaacccaaagtgctgtgatgtgtggctgtgacaagcctggagcgggtcctgtgagcgccgcctctgtctcctgcttccccactgaacgcctgctgaatgtgccgctgactcagctgtgctgctttcagccctcctgtgaggggcggtcccagtgcacagatgtttttcaagttcctcagtttgtactgaaattagggattcatcagggcaggaagcaggcaggcctctcagaagggagaggaggcctccaaatctattgagtccccacagtttgctcaagcccaggcaaatttctgtgattaaaatgaattcatcagttcctccaa

SEQ ID NO: 7663 - DNA, 6287 bp, Homo sapiens
gtgccagaagatcaggtcaggtggagacaccgcctcagggctcggtgcacagtggacatttggggagcgttgtgggtgacccccacacaggcactgggaatgcaggggagagggggccaagggggaaaggggccagagtgttggctttggattcaggagggatggattccagtcctagcttgccacttattaggactcctgagagcagcctccatgaggccctggaccagtgcatgaccgccctggacctcttcctcaccaaccagttctcagaagcactcagctacctcaagcccagaaccaaggaaagcatgtaccactcactgacatatgccaccatcctggagatgcaggccatgatgacctttgaccctcaggacatcctgcttgccggcaacatgatgaaggaggcacagatgctgtgtcagaggcaccggaggaagtcttctgtaacagattccttcagcagcctggtgaaccgccccacgctgggccaattcactgaagaggaaatccacgctgaggtctgctatgcagagtgcctgctgcagcgagcagccctgaccttcctgcagggttcctcacacggaggggcagtcaggcccagagccttgcatgatccctctcacgcctgcagctgcccacctgggccaggccgtcagcatcttttcctcctgcaggacgagaacatggtgagcttcatcaaaggcggcatcaaagttcgaaacagctaccagacctacaaggagctggacagccttgttcagtcctcacaatactgcaagggtgagaaccacccgcactttgaaggaggagtgaagcttggtgtaggggccttcaacctgacactgtccatgcttcctactaggatcctgaggctgttggagtttgtggggttttcaggaaacaaggactatgggctgctgcagctggaggagggagcgtcagggcacagcttccgctctgtgctctgtgtcatgctcctgctgtgctaccacaccttcctcaccttcgtgctcggtactgggaacgtcaacatcgaggaggccgagaagctcttgaagccctacctgaaccggtaccctaagggtgccatcttcctgttctttgcagggaggattgaagtcattaaaggcaacattgatgcagtgagtgatgggggtccgggccggggctggggatccctcggggtctcccagaccagcaggaagtcaggcacatgtgacatactcagggacaggatagactgggggcggggggggggccaagagagaaccaaccagagagcaggggcaggagaggcccttctggcagagcagcctgggaagacaagggaggaggaggcatttgtggtgcctgggattttgactgggagatataggactgcagcattgcagtggagggaggtggagggaggtgcttgagggaggcagaggttaggaaagcccatctgtttagggcatgacgattaggctggagtctggtacctcccctccattatagctctctcctgctctttcattttgttactaaaaaccagagtcctaggcgggggctgtatttgagcccaacgtcatgtaagacttaggaggtaaaaccaggactggaggccagatctcctggctcctggggccccacctgagcctagcacagggctggaccactatgccctggaggagtcccggtctgctgtggtgttgggaggttcggaggatgcagaggggttggggctgggtgggcacccgtcaggctgaccagaaggtgcctgcaggccatccggcgtttcgaggagtgctgtgaggcccagcagcactggaagcagttccaccacatgtgctactgggagctgatgtggtgcttcacctacaagggccagtggaagatgtcctacttctacgccgacctgctcagcaaggagaactgctggtccaaggtgggctgatgccacgtgttaggggcattgggtgaccagggctgactgtgtgcctccagaccacgggccaaatccctaactgaacacagatgtctcagctggaatctaaacataaccttaaattctaataggactcaggcttggaaggaactaaagaccacaagagaaacttctgaaccacaatgtgtcacaaagagatttctagtcacaaaggacagaaacatggctccctctgtccagtagaactgtttctgtggtagaaatgttctacttatgcactgcccaaatatggtagtcaccagccacatgtgcacaatgagcacatgaaatgtgcctagtgcaactgggaaactgattgttttcagttttatttaattttaattaactaaatgttaaatttaaatagccatgtagggcttgtggccactatattggactatgcaggtccaaaacacaaaaggctcatataactgaacattcttggcacatccgacttcaggtagggctggatccaggaattcaaatgatgtcgtctggcttggtctttccatttgtggctgtgctctctcctatgacatctttgtttctgctgcatctttgcaggaaggttctctccatgtgacaggcaaggtggccacgggctgcttctactcatatcctccccttggtttcaaccagagtcccacagtttgagcctcactggtctgacttgtcacctgccaatgcctggaacagaggggtgggaagattcctcatgggctgagagtaggagaggggtggttccacagaagaaaatgatgcacccagaaatagtggagggattaacaagatgccatacaggcaaaacaaagccaaacagatgcccgcctaccaaagatgaaatttatcatggtaagtattgaaataagtgttagcttgtaccatcatagtaatgatagtgcagaaattggaaccaagagtcttacaaccacctagctcagcaaacgtctaatctgttatttgtaaatacacaggacatgtgtcttcatggcttcatcccctgcccatagcagacattgctaatcaatcctctgccatgagcctagctgtgaccttagataccttccctgcaaagctccaggcagccgttagaactgacccacattggcacctgttaggagacctgtcatctgcatctggtccctccccctcctctgcatggaggtctcttccgtagccctgcctggggaccaagctgaaggggaattctctgggtctggggcaggtggggctggggaagggagcaggcttctactgagctctcaacatgtctggcacctgtcatgtcctccacaccacacccagtgaggagaagttattatctccattgggcacatgagggccactgatgctaagcgaggactgtgactttcccacccacatggctgttggtgacagacaccggatttgaggacagtcctgtgtgactcagaggcctctgcttctctcttgctcctagagtcctcctgaggagtcggggcttgccctgagcccaccctgctgttgaaggtgcttcctcaggcccagctcccatggcccccacaccccctcctcatcacctcctactcccaaaaaggacaaagcctcagggaaccttttttctttttttagagacagggtcttgctatgttggtcaggctagtcttgaactcctgggcccaagcaatcttcccacctctgcctcctaaagtgctgggattctgggccttagggaacctttttgaactgaaagtgactctcgaagccttcctgtagagtgaggtgggtggctggggctaaccatatggggaaggagagacctggtgggggcacacagctgctatatagaggaacagaaggtgggccaggcctcccagctgtcaggaaatctggctcagtccccagaccgctgtgtggctttggggtggccagtccctctctctctgcaacactctcctcatgaggacttctgtgaaaaatgggggttgtaaccctctgagttctggggccccacccatttctaatctccagaacttggccaccacagactccaccaacttctagtcctggggcctgggcctctggccattgccataggcaccacctgctctgtgcaggcagcgcccccctctgccaggatcctccgaggtcagctgctgggtctgacccgcagaccctggctgagcgacggatgaacggagtatgcagacacaggcttgcctgtcagcagatgggggacccctgccagagtcagcagcggcccccataagcctgccacgcttgcatttatttagtacagatgtaatgacaaaggcctaaagcaaactccatttgtgggtaattaacattgtcgcccccccagaaagagcagtcctccgcatgatgattaaaggccaggttccgaggcctaagtaaaccaacttatctagatcaattcccttacttcttgttatctactctgagagaattcagctgccttcagccaaatcctttcccgaagcttttgcaaaacctccgagccttccaaggtttgcttctttctgtaatttttctcaccaccctgacctatctcctgcagtcagccctgtggaggcctttgtgtttcccccagtgctggcagcctagaggctgagatggccagaaacaaggtggtgacagtggcgtgctcagggcttgggaaacccaaggagctaaaggcatgcccaggcaaccaaagaggacaggaaggcttctgaggagagacctctgaggtgggtcttggagaggaaggacttagggaggcagagtggaggaagtgagaggacaccccaagccaagagggcggcaggaccaaaggctcagaagccagggcgctgcagaggggctgtgtgccacagggtgaagagtttgtgtggcagaagggcagggggcttgcatcaggggtgacagctgctcttttgtcccagcatagcccctgtacatccctggagagctggggcgtccacaactctaagtcacagcccccatcctaaccctggtggtgcagtgagggtgagctgtctgtgggcaggagggaagactcttggagatgagcctggtgaagggataatggcatcccgggccgaggagcagcacaggcagaggcctggggagagtttaaggagtgtaggggaggaaatggcagaagatgagccagaaaaagaaaggttagggcaggtcctggaggacatgagtggctgtttgggctttatccagcagtgggggagccttggcaggcttgtggcttagataggtgctttagaaagcccaccagcagttgctgggccaccccgctggctgggtcctgttctaaggcaggaaatacaagcatgagcaggaaaagaccccctcaaggctcacgtcctagtggggagacaagaaacacagatgggcaatataacacgatgtctggttccagtaagtgcagtgaagaacaagcgaggctggatgcagggagtgatgggaggggctttgtaaggggaggtcgggggaagcctgtctcagaggacaccagaatggagcgcaggagcagcacgtggcagtcacatggcaggccgttagggcagagggagctgggcagggcacagcagggcaggagtgtgtttgatgtgtcctgggaaccgccctgaggccgtcgtgtggctggagtgctgcaggtgtcaaggaaattgtaggagatgtctcctgagtgtgatggaatataaccagatttccagaaggaactgacatgatctgacttaaaaaggtcagtgtgcgaaatggcttgcaggggacaggagtgggagcagggagataggagacaatgtgtaccaggacagcagaaagacatcccgggtagcctggaacagggagacggtgtggagatggtggcagtccgataatgagagccgtagggcaaggccagcaggatcctagagtgagacgggaggtaaagtcaccgggacttggtgtctccacgtcaggggcaggggaaagggagaggacaagggtgacccgggaggttaaagatgggaccggggccagacgcagtggctcatgcctgtaatcctagcactttgggaggctgaggcgggcggatagcttgaggtcaggagtttgaaaccagcctggccaacatggtgaaaccccgtctctactaaaatatacaaaaattagcctggcgtggtggtgcatgcctgcagtcccagctattcaggaggctgaggcaacaagaatcgcttgaacctgggaggcggaggttgcagtgagccgagatcgcgccatagcactccagccttagcctgggcgacagagcgagaccacatcaaaaaaaaaaaaa

SEQ ID NO: 7664 - DNA, 2021 bp, Homo sapiens
cctgggggagggaggaggccttggagaaggaggagggaaaaaggggctgtgggatttagtggctgggctgcaccccctgggggggcagcagagcccaatgggccagaagggccacaaagactccctttacccttgtggagggactcctgagagcagcctccatgaggccctggaccagtgcatgaccgccctggacctcttcctcaccaaccagttctcagaagcactcagctacctcaagcccagaaccaaggaaagcatgtaccactcactgacatatgccaccatcctggagatgcaggccatgatgacctttgaccctcaggacatcctgcttgccggcaacatgatgaaggaggcacagatgctgtgtcagaggcaccggaggaagtcttctgtaacagattccttcagcagcctggtgaaccgccccacgctgggccaattcactgaagaggaaatccacgctgaggtctgctatgcagagtgcctgctgcagcgagcagccctgaccttcctgcaggacgagaacatggtgagcttcatcaaaggcggcatcaaagttcgaaacagctaccagacctacaaggagctggacagccttgttcagtcctcacaatactgcaagggtgagaaccacccgcactttgaaggaggagtgaagcttggtgtaggggccttcaacctgacactgtccatgcttcctactaggatcctgaggctgttggagtttgtggggttttcaggaaacaaggactatgggctgctgcagctggaggagggagcgtcagggcacagcttccgctctgtgctctgtgtcatgctcctgctgtgctaccacaccttcctcaccttcgtgctcggtactgggaacgtcaacatcgaggaggccgagaagctcttgaagccctacctgaaccggtaccctaagggtgccatcttcctgttctttgcagggaggattgaagtcattaaaggcaacattgatgcagccatccggcgtttcgaggagtgctgtgaggcccagcagcactggaagcagttccaccacatgtgctactgggagctgatgtggtgcttcacctacaagggccagtggaagatgtcctacttctacgccgacctgctcagcaaggagaactgctggtccaaggccacctacatttacatgaaggccgcctacctcagcatgtttgggaaggaggaccacaagccgttcggggacgacgaagtggaattatttcgagctgtgccaggcctgaagctcaagattgctgggaaatctctacccacagagaagtttgccatccggaagtcccggcgctacttctcctccaaccctatctcgctgccagtgcctgctctggaaatgatgtacatctggaacggctacgccgtgattgggaagcagccgaaactcacggatgggatacttgagattatcactaaggctgaagagatgctggagaaaggcccagagaacgagtactcagtggatgacgagtgcttggtgaaattgttgaaaggcctgtgtctgaaatacctgggccgtgtccaggaggccgaggagaattttaggagcatctctgccaatgaaaagaagattaaatatgaccactacttgatcccaaacgccctgctggagctggccctgctgcttatggagcaagacagaaacgaagaggccatcaaacttttggaatctgccaagcaaaactacaagaattactccatggagtcaaggacacactttcgaatccaggcagccacactccaagccaagtcttccctagagaacagcagcagatccatggtctcatcagtgtccttgtagctttgtgcagcagttccgggctggaagacagagacagctggacagagctcctgaaaacatttcaaaataccccctccccctgccctgccctgcctttggggtccaccggcactccagttggatggcacaacatagtgtatccgtgcagaagccgagctggcattttcaccagtgtagccaagggcct

SEQ ID NO: 7665 - DNA, 2718 bp, Homo sapiens
actgtagcctccacggccgccgccgccgccgcgaggggccgcccgcggccccgtccgagcccggcccgcgcccatggcctttctgaccacctggaaggaggcggcctccgggaaaagcgaccgcaggactcctgagagcagcctccatgaggccctggaccagtgcatgaccgccctggacctcttcctcaccaaccagttctcagaagcactcagctacctcaagcccagaaccaaggaaagcatgtaccactcactgacatatgccaccatcctggagatgcaggccatgatgacctttgaccctcaggacatcctgcttgccggcaacatgatgaaggaggcacagatgctgtgtcagaggcaccggaggaagtcttctgtaacagattccttcagcagcctggtgaaccgccccacgctgggccaattcactgaagaggaaatccacgctgaggtctgctatgcagagtgcctgctgcagcgagcagccctgaccttcctgcaggacgagaacatggtgagcttcatcaaaggcggcatcaaagttcgaaacagctaccagacctacaaggagctggacagccttgttcagtcctcacaatactgcaagggtgagaaccacccgcactttgaaggaggagtgaagcttggtgtaggggccttcaacctgacactgtccatgcttcctactaggatcctgaggctgttggagtttgtggggttttcaggaaacaaggactatgggctgctgcagctggaggagggagcgtcagggcacagcttccgctctgtgctctgtgtcatgctcctgctgtgctaccacaccttcctcaccttcgtgctcggtactgggaacgtcaacatcgaggaggccgagaagctcttgaagccctacctgaaccggtaccctaagggtgccatcttcctgttctttgcagggaggattgaagtcattaaaggcaacattgatgcagccatccggcgtttcgaggagtgctgtgaggcccagcagcactggaagcagttccaccacatgtgctactgggagctgatgtggtgcttcacctacaagggccagtggaagatgtcctacttctacgccgacctgctcagcaaggagaactgctggtccaaggccacctacatttacatgaaggccgcctacctcagcatgtttgggaaggaggaccacaagccgttcggggacgacgaagtggaattatttcgagctgtgccaggcctgaagctcaagattgctgggaaatctctacccacagagaagtttgccatccggaagtcccggcgctacttctcctccaaccctatctcgctgccagtgcctgctctggaaatgatgtacatctggaacggctacgccgtgattgggaagcagccgaaactcacggatgggatacttgagattatcactaaggctgaagagatgctggagaaaggcccagagaacgagtactcagtggatgacgagtgcttggtgaaattgttgaaaggcctgtgtctgaaatacctgggccgtgtccaggaggccgaggagaattttaggagcatctctgccaatgaaaagaagattaaatatgaccactacttgatcccaaacgccctgctggagctggccctgctgcttatggagcaagacagaaacgaagaggccatcaaacttttggaatctgccaagcaaaactacaagaattactccatggagtcaaggacacactttcgaatccaggcagccacactccaagccaagtcttccctagagaacagcagcagatccatggtctcatcagtgtccttgtagctttgtgcagcagttccgggctggaagacagagacagctggacagagctcctgaaaacatttcaaaataccccctccccctgccctgccctgcctttggggtccaccggcactccagttggatggcacaacatagtgtatccgtgcagaagccgagctggcattttcaccagtgtagccaagggcctttgccaagggcagagcaggtggagccctctgcctgccctatcacacatacgggtacttgcttttcactgtgatgtttaagagaatgtatgaacagtttacattttccttagaaatacattgatgggatcacagttggctttaaaaaccaacaacaatcaaccacctgtaagtctttgtcttcacctattatcatctggaggtaaatctctttatatgatgatgccaaagggcaaattgcttttcaaattcagcaagttctcagcttgtgtgacggaaggtccttcagaggacctgaggaatgcctgggagaggctaagcctcaggcttcaatgcttctggggttgggcatgaggatgtacacagacacccactaccttactactcacacttcatttcactccttttgtaaatttccaatttaaaaatcaagcacgtctttttagtgagataaaatctgagctcttctgtagaaaaatcaatctctaccagtagaaaatgccagggcttgatggaagagctgtgtagccctttctatgccaaagccaggaaatttggggggcaggaggaggttctcagaatccagtctgtatctttgctgtatgccaaactgaaaccactgggaataatttatgaaacataaaaatcttctgtacttcactccaaggtacatttgcttactgacagcatttttgttaaaactgttattcttga

SEQ ID NO: 7666 - DNA, 2790 bp, Homo sapiens
gtgggatttagtggctgggctgcaccccctgggggggcagcagagcccaatgggccagaagggccacaaagactccctttacccttgtggagggactcctgagagcagcctccatgaggccctggaccagtgcatgaccgccctggacctcttcctcaccaaccagttctcagaagcactcagctacctcaagcccagaaccaaggaaagcatgtaccactcactgacatatgccaccatcctggagatgcaggccatgatgacctttgaccctcaggacatcctgcttgccggcaacatgatgaaggaggcacagatgctgtgtcagaggcaccggaggaagtcttctgtaacagattccttcagcagcctggtgaaccgccccacgctgggccaattcactgaagaggaaatccacgctgaggtctgctatgcagagtgcctgctgcagcgagcagccctgaccttcctgcagggttcctcacacggaggggcagtcaggcccagagccttgcatgatccctctcacgcctgcagctgcccacctgggccaggccgtcagcatcttttcctcctgcaggacgagaacatggtgagcttcatcaaaggcggcatcaaagttcgaaacagctaccagacctacaaggagctggacagccttgttcagtcctcacaatactgcaagggtgagaaccacccgcactttgaaggaggagtgaagcttggtgtaggggccttcaacctgacactgtccatgcttcctactaggatcctgaggctgttggagtttgtggggttttcaggaaacaaggactatgggctgctgcagctggaggagggagcgtcagggcacagcttccgctctgtgctctgtgtcatgctcctgctgtgctaccacaccttcctcaccttcgtgctcggtactgggaacgtcaacatcgaggaggccgagaagctcttgaagccctacctgaaccggtaccctaagggtgccatcttcctgttctttgcagggaggattgaagtcattaaaggcaacattgatgcagccatccggcgtttcgaggagtgctgtgaggcccagcagcactggaagcagttccaccacatgtgctactgggagctgatgtggtgcttcacctacaagggccagtggaagatgtcctacttctacgccgacctgctcagcaaggagaactgctggtccaaggccacctacatttacatgaaggccgcctacctcagcatgtttgggaaggaggaccacaagccgttcggggacgacgaagtggaattatttcgagctgtgccaggcctgaagctcaagattgctgggaaatctctacccacagagaagtttgccatccggaagtcccggcgctacttctcctccaaccctatctcgctgccagtgcctgctctggaaatgatgtacatctggaacggctacgccgtgattgggaagcagccgaaactcacggatgggatacttgagattatcactaaggctgaagagatgctggagaaaggcccagagaacgagtactcagtggatgacgagtgcttggtgaaattgttgaaaggcctgtgtctgaaatacctgggccgtgtccaggaggccgaggagaattttaggagcatctctgccaatgaaaagaagattaaatatgaccactacttgatcccaaacgccctgctggagctggccctgctgcttatggagcaagacagaaacgaagaggccatcaaacttttggaatctgccaagcaaaactacaagaattactccatggagtcaaggacacactttcgaatccaggcagccacactccaagccaagtcttccctagagaacagcagcagatccatggtctcatcagtgtccttgtagctttgtgcagcagttccgggctggaagacagagacagctggacagagctcctgaaaacatttcaaaataccccctccccctgccctgccctgcctttggggtccaccggcactccagttggatggcacaacatagtgtatccgtgcagaagccgagctggcattttcaccagtgtagccaagggcctttgccaagggcagagcaggtggagccctctgcctgccctatcacacatacgggtacttgcttttcactgtgatgtttaagagaatgtatgaacagtttacattttccttagaaatacattgatgggatcacagttggctttaaaaaccaacaacaatcaaccacctgtaagtctttgtcttcacctattatcatctggaggtaaatctctttatatgatgatgccaaagggcaaattgcttttcaaattcagcaagttctcagcttgtgtgacggaaggtccttcagaggacctgaggaatgcctgggagaggctaagcctcaggcttcaatgcttctggggttgggcatgaggatgtacacagacacccactaccttactactcacacttcatttcactccttttgtaaatttccaatttaaaaatcaagcacgtctttttagtgagataaaatctgagctcttctgtagaaaaatcaatctctaccagtagaaaatgccagggcttgatggaagagctgtgtagccctttctatgccaaagccaggaaatttggggggcaggaggaggttctcagaatccagtctgtatctttgctgtatgccaaactgaaaccactgggaataatttatgaaacataaaaatcttctgtacttcactccaaggtacatttgcttactgacagcatttttgttaaaactgttattcttga

SEQ ID NO: 7667 - DNA, 2162 bp, Homo sapiens
agcgcccggctcggggttgcggcggcagcacctgggccgcgattggcgtccggctggggcagcgccgcccgcgcccctcggcgatgacctcggctggcggcgccccaggagccctgcccgcggggactcctgagagcagcctccatgaggccctggaccagtgcatgaccgccctggacctcttcctcaccaaccagttctcagaagcactcagctacctcaagcccagaaccaaggaaagcatgtaccactcactgacatatgccaccatcctggagatgcaggccatgatgacctttgaccctcaggacatcctgcttgccggcaacatgatgaaggaggcacagatgctgtgtcagaggcaccggaggaagtcttctgtaacagattccttcagcagcctggtgaaccgccccacgctgggccaattcactgaagaggaaatccacgctgaggtctgctatgcagagtgcctgctgcagcgagcagccctgaccttcctgcaggacgagaacatggtgagcttcatcaaaggcggcatcaaagttcgaaacagctaccagacctacaaggagctggacagccttgttcagtcctcacaatactgcaagggtgagaaccacccgcactttgaaggaggagtgaagcttggtgtaggggccttcaacctgacactgtccatgcttcctactaggatcctgaggctgttggagtttgtggggttttcaggaaacaaggactatgggctgctgcagctggaggagggagcgtcagggcacagcttccgctctgtgctctgtgtcatgctcctgctgtgctaccacaccttcctcaccttcgtgctcggtactgggaacgtcaacatcgaggaggccgagaagctcttgaagccctacctgaaccggtaccctaagggtgccatcttcctgttctttgcagggaggattgaagtcattaaaggcaacattgatgcagccatccggcgtttcgaggagtgctgtgaggcccagcagcactggaagcagttccaccacatgtgctactgggagctgatgtggtgcttcacctacaagggccagtggaagatgtcctacttctacgccgacctgctcagcaaggagaactgctggtccaaggccacctacatttacatgaaggccgcctacctcagcatgtttgggaaggaggaccacaagccgttcggggacgacgaagtggaattatttcgagctgtgccaggcctgaagctcaagattgctgggaaatctctacccacagagaagtttgccatccggaagtcccggcgctacttctcctccaaccctatctcgctgccagtgcctgctctggaaatgatgtacatctggaacggctacgccgtgattgggaagcagccgaaactcacggatgggatacttgagattatcactaaggctgaagagatgctggagaaaggcccagagaacgagtactcagtggatgacgagtgcttggtgaaattgttgaaaggcctgtgtctgaaatacctgggccgtgtccaggaggccgaggagaattttaggagcatctctgccaatgaaaagaagattaaatatgaccactacttgatcccaaacgccctgctggagctggccctgctgcttatggagcaagacagaaacgaagaggccatcaaacttttggaatctgccaagcaaaactacaagaattactccatggagtcaaggacacactttcgaatccaggcagccacactccaagccaagtcttccctagagaacagcagcagatccatggtctcatcagtgtccttgtagctttgtgcagcagttccgggctggaagacagagacagctggacagagctcctgaaaacatttcaaaataccccctccccctgccctgccctgcctttggggtccaccggcactccagttggatggcacaacatagtgtatccgtgcagaagccgagctggcattttcaccagtgtagccaagggcctttgccaagggcagagcaggtggagccctctgcctgccctatcacacatacgggtacttgcttttcactgtgatgtttaagagaatgtatgaacagtttacattttccttagaaatacattgatgggatcacagttggctttaaaaaccaacaacaatc

SEQ ID NO: 7668 - DNA, 429 bp, Homo sapiens
atttagtgggcaaggtgctggggttgactcccggctctgccccagtagctctggggtcccaggaagcagaggtggggccacctacatttacatgaaggccgcctacctcagcatgtttgggaaggaggaccacaagccgttcggggacgacgaagtggaattatttcgagctgtgccaggcctgaagctcaagattgctgggaaatctctacccacagagaagtttgccatccggaagtcccggcgctacttctcctccaaccctatctcgctgccagtgcctgctctggaaatgatgtacatctggaacggctacgccgtgattgggaagcagccgaaactcacggatgggatacttgagattatcactaaggctgaagagatgctggagaaaggcccagagaacgagtactcagtggatgacgagtg

SEQ ID NO: 7669 - DNA, 1780 bp, Homo sapiens
catggcaggccgttagggcagagggagctgggcagggcacagcagggcaggagtgtgtttgatgtgtcctgggaaccgccctgaggccgtcgtgtggctggagtgctgcaggtgtcaaggaaattgtaggagatgtctcctgagtgtgatggaatataaccagatttccagaaggaactgacatgatctgacttaaaaaggccacctacatttacatgaaggccgcctacctcagcatgtttgggaaggaggaccacaagccgttcggggacgacgaagtggaattatttcgagctgtgccaggcctgaagctcaagattgctgggaaatctctacccacagagaagtttgccatccggaagtcccggcgctacttctcctccaaccctatctcgctgccagtgcctgctctggaaatgatgtacatctggaacggctacgccgtgattgggaagcagccgaaactcacggatgggatacttgagattatcactaaggctgaagagatgctggagaaaggcccagagaacgagtactcagtggatgacgagtgcttggtgaaattgttgaaaggcctgtgtctgaaatacctgggccgtgtccaggaggccgaggagaattttaggagcatctctgccaatgaaaagaagattaaatatgaccactacttgatcccaaacgccctgctggagctggccctgctgcttatggagcaagacagaaacgaagaggccatcaaacttttggaatctgccaagcaaaactacaagaattactccatggagtcaaggacacactttcgaatccaggcagccacactccaagccaagtcttccctagagaacagcagcagatccatggtctcatcagtgtccttgtagctttgtgcagcagttccgggctggaagacagagacagctggacagagctcctgaaaacatttcaaaataccccctccccctgccctgccctgcctttggggtccaccggcactccagttggatggcacaacatagtgtatccgtgcagaagccgagctggcattttcaccagtgtagccaagggcctttgccaagggcagagcaggtggagccctctgcctgccctatcacacatacgggtacttgcttttcactgtgatgtttaagagaatgtatgaacagtttacattttccttagaaatacattgatgggatcacagttggctttaaaaaccaacaacaatcaaccacctgtaagtctttgtcttcacctattatcatctggaggtaaatctctttatatgatgatgccaaagggcaaattgcttttcaaattcagcaagttctcagcttgtgtgacggaaggtccttcagaggacctgaggaatgcctgggagaggctaagcctcaggcttcaatgcttctggggttgggcatgaggatgtacacagacacccactaccttactactcacacttcatttcactccttttgtaaatttccaatttaaaaatcaagcacgtctttttagtgagataaaatctgagctcttctgtagaaaaatcaatctctaccagtagaaaatgccagggcttgatggaagagctgtgtagccctttctatgccaaagccaggaaatttggggggcaggaggaggttctcagaatccagtctgtatctttgctgtatgccaaactgaaaccactgggaataatttatgaaacataaaaatcttctgtacttcactccaaggtacatttgcttactgacagcatttttgttaaaactgttattcttga

SEQ ID NO: 7670 - DNA, 4886 bp, Homo sapiens
aatcatgcttacgcatataggttaaccacagttatgtaagcaggttctgagaaaaggtgagaaagagaatggagagttttgctacaacagaggcaggattctgaatttatttccagctgcccatcttgtccctcctggagacctaacccctccagcacctacacacacagcctctttagaagcaactatcctgccactggctcagaaaggctgagtcctaagaattctaaaatcttgctcctaagaaatctcaagcttcttttgtgaaatcatagcccactaatgagttttggagccagctttgtcagttttttgaatgccatgatgacatttgaggaagaaaaaatgcagttggcatgtgatgacttaaaaaccacagaaaaactgtgtgaaagtgaagaggctggagtaattgaaacaatcaagaataaaattaagaagaacgttgatgtccgaaaatccgccccctctatggttgatcggcttcagaggcagataatcatagctgactgccaggtttacctggctgtgctttcatttgtaaaacaagaattgtcagcttatatcaaaggtgggtggatccttaggaaagcctggaagatttacaataaatgctatctggacatcaatgcccttcaggagctgtatcagaagaagctaactgaagagtccttgacttctgatgctgcaaatgataatcacattgtggctgaaggggtgtctgaggagtctctgaacagactgaaaggtgctgttagctttggatatggcctttttcacctttgcatatccatggtgcccccaaacctgctcaaaatcatcaacctgctgggttttcctggagaccgcctacaggggctttcttcactgatgtatgcaagcgaaagtaaggacatgaaggcccctttagctacattagctctgctctggtatcatactgtagtccgcccgttttttgccttggatggcagtgataacaaggcaggcctggatgaagctaaggaaattctccttaaaaaagaagctgcttatccaaattcttccctctttatgtttttcaagggacggatacaacgactagagtgtcaaatcaacagtgccttgacatctttccacactgctttggaacttgcagtagaccagagagaaattcaacatgtctgtctgtatgaaattggttggtgcagcatgatagagctcaatttcaaggatgcatttgattcctttgagaggctaaaaaatgagtccaggtggtcccagtgctattatgcctacttgactgcagtttgtcagggagccactggtgatgtggatggggcacagattgtctttaaagaagttcagaaactcttcaaaaggaaaaacaatcagattgaacagttctcggtgaaaaaggcagagcgatttcggaagcaaaccccaaccaaagcgctctgtgtgttggcgtctattgaagtgttgtacttgtggaaagctcttccaaactgttccttccccaacctgcagaggatgagtcaagcttgccatgaagtggatgactcatctgttgttggattaaagtatttgcttcttggtgccatacacaaatgtctaggaaactcagaagatgctgttcagtacttccagcgagctgttaaagatgaattgtgtcgtcagaataacttatatgttcagccgtatgcctgttatgaacttggctgtcttctattagacaaaccagagactgtaggaagaggcagagctctacttcttcaagcaaaggaggatttctctggctacgactttgaaaacagattgcatgtccgcatccatgctgctctggcctctctgagggaattggttcctcagtgacagacccggaacacccgctccgtccctccccacccagggtccgcactttaaaataaaagcagaggacaaagctcttgtgaagatgggcttttcttctgaaaaccacctgtgccagggacacattttcccagttaagctgacatattaaagatctcctcttttaaacatgtagctgaaaagtaataatgatgttgaggaggatgatgatggtaataataactaaccacctggggagagggttaagtgaccttgctcaaacgttttagttttgtgatttattatttttaaaataaaatcaaacggaacatccaacccaagatcctgtaggaacacctaccttaagcacatatctgaatgggtaacatgatgaggtacctgtaaaattattaacaatatcatgacatagcatttatatttgtgttttgaaaaaataaaagtgctttctagtgttttactttatcctcaaaatactccagtgaataacatagcacagatattcttaaccccactttgcagacagtgaaactcaggcacaaaaaggcaaattgacttatcccaattaattattcctgttatcagcagagcaatgaatagaaagcagatctcctgaccaccaactgacttttattgtaaaaataattcatgttaataggccagaattccatgttttacttattaaaagaacaaaatcttcagctgaagttatgtcaccagaaatagtcatctccagattgtctacagaatgtttcaaagcgatggacactctttttcctttgaaagccaaccaagtaagagcaaatattaatagaagataattttacaactaaaagtgtgactcttttgctaatctattagcctagtctatagattagacaaacagtatctacattttaggagtttacctttctttgtgaaaattgtcaaattaccaacttttggaaatcttttgacacattacttgaaaaggttattcgtgaatgaacatagattttggcctcaaaatatttgctggtggaacatttgctgggctacacagtgccaggatttaatcattttccccttagctcaggttatttagatattatacaaggaattcaaagttatttttttattcttcattgctaatttttgtcatttaatttacctccatgcccggtactgcaaacctgtggttttgaagaatctaaatacctcagtcacttttaagaatctctgccataatttggctcaatgtttaaggttagatttttaaagaaatttttattgagctaaaggatatcattttagggtatcgtttatttacaaattcttttggctgaaacatgatctcatattaatattttaatatttcttttcaaaataaaacagaaaagcaagtagaatgttggcaaattttatctgatttgaccttgttttgagggaatagtcataatttctttgaaagaagttatttctcactgattttggctaaacagtattcatatttcttcatctctgttactgaccacttttcagtagactgtttccaaaatgtgtattcacattgactttctccctgatgtgaattccgtgtgggttttagataatagtaagagagaagagattgctctcctatattcagtgaatgagaagggaacttttttctgaagagcaaaattggtgcccaaaaatattggacatctgttttttgtttttttttttttttttttttttttttgagacggagtctcgctctgtcacccaggctggagtgcagtggcgtgatcttggctcactgcaacctctgcctcctgggttcacaccattctcctgcctcagcctcccaagtagctgggactacaggcacccgcaaccacacccggctaattttttttgtatttttagtagagatggggtttcaccatgttagccaggattgtctccatctcctgacctcgtgatccacccgccttggcctcccaaagagctgggattactggtgtgagccaccgtgcccggcctggacatctggttttaactagatggaagggaagaacattatgaatctttaaaatacggctgttgccatttttctctcttcttaacatgcagcataggtgacaagcttttctgtcatcatcatggagcattctgaatcatgacatttttgtttgagagttcattcttgaattttcagttcaaaatattgtttgaactattattccacattcaaagattatataaggtcctgtgcttttgaatctttttcaaaacatttatttctgcctgcttaaaaaaaatacttttatttccccacagagagttcaggacttcagattagtttgtgttcagctcacttaactggatagacaattttgcgttttgcaacaccatcctgtaggttttctttactagtcaaagtgtaggtctttttaaaatttttaatctttatttttatttttattttgaaacagagtctcactctgttgcccaggctggagtgcagtggtgtgatctgtgctcactgcaacctctgtcacccgggtttaagcgattcttctgcctgagcctcccaagtagctgggattacaagttcctgccaccgtgcctggctaatttttgcagttttagtagaggcagggttccaccaccttggccaggctggtcttgaactcctgacctcatgatccacccaccttgtcctctcaaaatgcttacaggcatgaaccactgtgaccggccaggtctttttttttttaaagagtctatcctaggcttggtacagatggcgcctgtggtaaatctgtgttaacatggtggtagaccatggagaatgggtagatggagcttctagactccaaaacaacaaaaccacagtgtgagtacactgtcccattaggttgactgaagtctgagtacattttctggcctgcgtgccgtgacttatccaacctgtgaactgattgtgatctgcttggtaacttggtttggtgtaaactgctcttaaccctttgctgatgaagaaaataatcatataagtggaactatttgcatct

SEQ ID NO: 7671 - DNA, 5239 bp, Homo sapiens
gtctcgcgtgcgtgtgtccgagcagtcctgggcggtgggcgaaggcgcggcttggggacccgggaggggccggggcgcgggggctgcaggaagtggaggcggccgccgctcggggaccggcttggcggggtgagagacacccggaaacggattccgcttcggggcccgcgcgagttgggtgcttcggagggcgcgagaggagcgggcgggtgctgctgagtaatccccgcggcggcggccggacgcccacctcccacgccgcgccgcagccgggccgcggctcctccctccgcggtccttccctcctcttccctcccgtcttctcccctcccctcccctcccctcccggctccgcttggctccgggcaggtagagccgggctccgggcgcgcgcggggccgcagcagctgctcccgatctcgcctcggcccagcgcagggcctcgcacgcccatggccggctcggagcagcagcggccgcggcggcgggacgacggagactcggacgcggcagcggcggcggcggcgcccctgcaggacgcggagctggccctggccggcatcaacatgctgctcaacaacggcttcagggagtcggaccagcttttcaaacaatacagaaatcatagcccactaatgagttttggagccagctttgtcagttttttgaatgccatgatgacatttgaggaagaaaaaatgcagttggcatgtgatgacttaaaaaccacagaaaaactgtgtgaaagtgaagaggctggagtaattgaaacaatcaagaataaaattaagaagaacgttgatgtccgaaaatccgccccctctatggttgatcggcttcagaggcagataatcatagctgactgccaggtttacctggctgtgctttcatttgtaaaacaagaattgtcagcttatatcaaaggtgggtggatccttaggaaagcctggaagatttacaataaatgctatctggacatcaatgcccttcaggagctgtatcagaagaagctaactgaagagtccttgacttctgatgctgcaaatgataatcacattgtggctgaaggggtgtctgaggagtctctgaacagactgaaaggtgctgttagctttggatatggcctttttcacctttgcatatccatggtgcccccaaacctgctcaaaatcatcaacctgctgggttttcctggagaccgcctacaggggctttcttcactgatgtatgcaagcgaaagtaaggacatgaaggcccctttagctacattagctctgctctggtatcatactgtagtccgcccgttttttgccttggatggcagtgataacaaggcaggcctggatgaagctaaggaaattctccttaaaaaagaagctgcttatccaaattcttccctctttatgtttttcaagggacggatacaacgactagagtgtcaaatcaacagtgccttgacatctttccacactgctttggaacttgcagtagaccagagagaaattcaacatgtctgtctgtatgaaattggttggtgcagcatgatagagctcaatttcaaggatgcatttgattcctttgagaggctaaaaaatgagtccaggtggtcccagtgctattatgcctacttgactgcagtttgtcagggagccactggtgatgtggatggggcacagattgtctttaaagaagttcagaaactcttcaaaaggaaaaacaatcagattgaacagttctcggtgaaaaaggcagagcgatttcggaagcaaaccccaaccaaagcgctctgtgtgttggcgtctattgaagtgttgtacttgtggaaagctcttccaaactgttccttccccaacctgcagaggatgagtcaagcttgccatgaagtggatgactcatctgttgttggattaaagtatttgcttcttggtgccatacacaaatgtctaggaaactcagaagatgctgttcagtacttccagcgagctgttaaagatgaattgtgtcgtcagaataacttatatgttcagccgtatgcctgttatgaacttggctgtcttctattagacaaaccagagactgtaggaagaggcagagctctacttcttcaagcaaaggaggatttctctggctacgactttgaaaacagattgcatgtccgcatccatgctgctctggcctctctgagggaattggttcctcagtgacagacccggaacacccgctccgtccctccccacccagggtccgcactttaaaataaaagcagaggacaaagctcttgtgaagatgggcttttcttctgaaaaccacctgtgccagggacacattttcccagttaagctgacatattaaagatctcctcttttaaacatgtagctgaaaagtaataatgatgttgaggaggatgatgatggtaataataactaaccacctggggagagggttaagtgaccttgctcaaacgttttagttttgtgatttattatttttaaaataaaatcaaacggaacatccaacccaagatcctgtaggaacacctaccttaagcacatatctgaatgggtaacatgatgaggtacctgtaaaattattaacaatatcatgacatagcatttatatttgtgttttgaaaaaataaaagtgctttctagtgttttactttatcctcaaaatactccagtgaataacatagcacagatattcttaaccccactttgcagacagtgaaactcaggcacaaaaaggcaaattgacttatcccaattaattattcctgttatcagcagagcaatgaatagaaagcagatctcctgaccaccaactgacttttattgtaaaaataattcatgttaataggccagaattccatgttttacttattaaaagaacaaaatcttcagctgaagttatgtcaccagaaatagtcatctccagattgtctacagaatgtttcaaagcgatggacactctttttcctttgaaagccaaccaagtaagagcaaatattaatagaagataattttacaactaaaagtgtgactcttttgctaatctattagcctagtctatagattagacaaacagtatctacattttaggagtttacctttctttgtgaaaattgtcaaattaccaacttttggaaatcttttgacacattacttgaaaaggttattcgtgaatgaacatagattttggcctcaaaatatttgctggtggaacatttgctgggctacacagtgccaggatttaatcattttccccttagctcaggttatttagatattatacaaggaattcaaagttatttttttattcttcattgctaatttttgtcatttaatttacctccatgcccggtactgcaaacctgtggttttgaagaatctaaatacctcagtcacttttaagaatctctgccataatttggctcaatgtttaaggttagatttttaaagaaatttttattgagctaaaggatatcattttagggtatcgtttatttacaaattcttttggctgaaacatgatctcatattaatattttaatatttcttttcaaaataaaacagaaaagcaagtagaatgttggcaaattttatctgatttgaccttgttttgagggaatagtcataatttctttgaaagaagttatttctcactgattttggctaaacagtattcatatttcttcatctctgttactgaccacttttcagtagactgtttccaaaatgtgtattcacattgactttctccctgatgtgaattccgtgtgggttttagataatagtaagagagaagagattgctctcctatattcagtgaatgagaagggaacttttttctgaagagcaaaattggtgcccaaaaatattggacatctgttttttgtttttttttttttttttttttttttttgagacggagtctcgctctgtcacccaggctggagtgcagtggcgtgatcttggctcactgcaacctctgcctcctgggttcacaccattctcctgcctcagcctcccaagtagctgggactacaggcacccgcaaccacacccggctaattttttttgtatttttagtagagatggggtttcaccatgttagccaggattgtctccatctcctgacctcgtgatccacccgccttggcctcccaaagagctgggattactggtgtgagccaccgtgcccggcctggacatctggttttaactagatggaagggaagaacattatgaatctttaaaatacggctgttgccatttttctctcttcttaacatgcagcataggtgacaagcttttctgtcatcatcatggagcattctgaatcatgacatttttgtttgagagttcattcttgaattttcagttcaaaatattgtttgaactattattccacattcaaagattatataaggtcctgtgcttttgaatctttttcaaaacatttatttctgcctgcttaaaaaaaatacttttatttccccacagagagttcaggacttcagattagtttgtgttcagctcacttaactggatagacaattttgcgttttgcaacaccatcctgtaggttttctttactagtcaaagtgtaggtctttttaaaatttttaatctttatttttatttttattttgaaacagagtctcactctgttgcccaggctggagtgcagtggtgtgatctgtgctcactgcaacctctgtcacccgggtttaagcgattcttctgcctgagcctcccaagtagctgggattacaagttcctgccaccgtgcctggctaatttttgcagttttagtagaggcagggttccaccaccttggccaggctggtcttgaactcctgacctcatgatccacccaccttgtcctctcaaaatgcttacaggcatgaaccactgtgaccggccaggtctttttttttttaaagagtctatcctaggcttggtacagatggcgcctgtggtaaatctgtgttaacatggtggtagaccatggagaatgggtagatggagcttctagactccaaaacaacaaaaccacagtgtgagtacactgtcccattaggttgactgaagtctgagtacattttctggcctgcgtgccgtgacttatccaacctgtgaactgattgtgatctgcttggtaacttggtttggtgtaaactgctcttaaccctttgctgatgaagaaaataatcatataagtggaactatttgcatct

SEQ ID NO: 7672 - DNA, 1666 bp, Homo sapiens
gtgctgaggagaggagcccaggtctgcgggtgggggacccgtcctctgagaagcctgcagcttctcctccaggacccttccagcccacctggctggctgtggggataatgggcacttgggagcattggagggggaggaagcatagagaaagcagcaggagacgcacctggaagcccaggggagggaagtccacctccctgcaagtgtagggcagtgagaggagccctggcaccagcagagcaagaaagaaatgcatgcaccgttcagaataagctgtcaggtcgtctggctgtttaagatttatttattaatgtgtcaaatcaacagtgccttgacatctttccacactgctttggaacttgcagtagaccagagagaaattcaacatgtctgtctgtatgaaattggttggtgcagcatgatagagctcaatttcaaggatgcatttgattcctttgagaggctaaaaaatgagtccaggtggtcccagtgctattatgcctacttgactgcagtttgtcagggagccactggtgatgtggatggggcacagattgtctttaaagaagttcagaaactcttcaaaaggaaaaacaatcagattgaacagttctcggtgaaaaaggcagagcgatttcggaagcaaaccccaaccaaagcgctctgtgtgttggcgtctattgaagtgttgtacttgtggaaagctcttccaaactgttccttccccaacctgcagaggatgagtcaagcttgccatgaagtggatgactcatctgttgttggattaaagtatttgcttcttggtgccatacacaaatgtctaggaaactcagaagatgctgttcagtacttccagcgagctgttaaagatgaattgtgtcgtcagaataacttatatgttcagccgtatgcctgttatgaacttggctgtcttctattagacaaaccagagactgtaggaagaggcagagctctacttcttcaagcaaaggaggatttctctggctacgactttgaaaacagattgcatgtccgcatccatgctgctctggcctctctgagggaattggttcctcagtgacagacccggaacacccgctccgtccctccccacccagggtccgcactttaaaataaaagcagaggacaaagctcttgtgaagatgggcttttcttctgaaaaccacctgtgccagggacacattttcccagttaagctgacatattaaagatctcctcttttaaacatgtagctgaaaagtaataatgatgttgaggaggatgatgatggtaataataactaaccacctggggagagggttaagtgaccttgctcaaacgttttagttttgtgatttattatttttaaaataaaatcaaacggaacatccaacccaagatcctgtaggaacacctaccttaagcacatatctgaatgggtaacatgatgaggtacctgtaaaattattaacaatatcatgacatagcatttatatttgtgttttgaaaaaataaaagtgctttctagtgttttactttatcctcaaaatactccagtgaataacatagcacagatattcttaaccccactttgcagacagtgaaactcaggcacaaaaaggcaaattgacttatcccaattaattattcctgttatcagcagagc

SEQ ID NO: 7673 - DNA, 1048 bp, Homo sapiens
gtctcgcgtgcgtgtgtccgagcagtcctgggcggtgggcgaaggcgcggcttggggacccgggaggggccggggcgcgggggctgcaggaagtggaggcggccgccgctcggggaccggcttggcggggtgagagacacccggaaacggattccgcttcggggcccgcgcgagttgggtgcttcggagggcgcgagaggagcgggcgggtgctgctgagtaatccccgcggcggcggccggacgcccacctcccacgccgcgccgcagccgggccgcggctcctccctccgcggtccttccctcctcttccctcccgtcttctcccctcccctcccctcccctcccggctccgcttggctccgggcaggtagagccgggctccgggcgcgcgcggggccgcagcagctgctcccgatctcgcctcggcccagcgcagggcctcgcacgcccatggccggctcggagcagcagcggccgcggcggcgggacgacggagactcggacgcggcagcggcggcggcggcgcccctgcaggacgcggagctggccctggccggcatcaacatgctgctcaacaacggcttcagggagtcggaccagcttttcaaacaatacagaaaaagttttttgacttctgagaaaacctcagcgcttcctggagaaactcaaaggcgcttgtaagagatgttgagtcagcaggcctctgagcctcttctctgcctaaaaccatgtcagattcttgggaggactggaaggacttgcaggctgtccatgatttctagacaagtcatctgctcacagacaagaatgtgtctctgccttgctcctggagacgataggagagtccacagatgcagagatgtaagaaaaggagaagaaatgaaaagcagaaatggtttaagggaactggcgggaaagacaggaaactcatctgttgactttttccatcctcttcaactcagtggtgtgttggaaaaaggcatcttttttcccccaactattacactgtctgaaaaggtcctaattaaatattcattaaagattca

SEQ ID NO: 7674 - DNA, 2745 bp, Homo sapiens
cgtatggcctggcccagggtgccgtagctgaggaagaagggaggcttcacagcatccagggcttatatggcctggcccagggcgccatggctgaggaagaagggaggcttcacagcgtccagggcctattgtcacttcaagacttgcagaacgtcaacacgcccctgatgaggaagctggcgcgcctcaagctcggcctcgtggaaatggctctggacatgctccagttcatctgggaggaggcccacgggcagcagagtgagcaggggtccctggagaagctgctggcggactatctgcagaacaccagtgactacacttccgtcggcctgcaatggttcacgctgaagcggactctagcacacggggcactggcacagctggggagcctgcagccgctgagcgtgggctgtgtggagatccgcgcccggctcctgggcctggccgggagggccctgcacctgctggccatgcaagctgaccctgtgcaccctacctgctactgggaggcgggcccctcggtgggcgccaagctgagcggcctcaagtctctggagctggaggtagaggaagagggtgccacaaagtccagcagggacccgccggcctccagggcagccccggaggagcactgcaggagaggcgaggacctgaagaggaggatggttctggcccagcagtacctggctcaggcgtcagaggtgctgctgcagtgcctacaggtggcccttggcagtggcctcctggatgtcgcagcagccgccagcctggagatggtggagtgtgtcggcaccctggaccctgcaactacctgccagttcctggctctgtctcagagctgctcggcctcagagacgatgagggatgtcctgcttgcagccacagccaacaccagcagctcacagctggcggccctgctgcagctacagcaccagctccggtgccaagacaggaccaccaccagcctgggcgcccgtgtggagcagaggctggccgccgtgtccaaggcttggcaaaatctctgcgtcactgagcagcattttaacctcttgaatgagatgcctccgaccttttggatcctctttctgcacctctcaggggacaggtcccgtctgtacggcgctgcctacgagaaacccaagttcattactgcagccaaaggaaaggtgcaggcggtgggaggctcctgcaaggtgatgcgtctggccataagtcccactgccttctcccacctgctggcctgtgcccagcagttccggaagcagacccaggcccaggtgtacagtgaggacatggccctgaacataggctcggaaccagaaggcctgcaggtggaagagaaggagcgccctgtgcagaggctcagtagcgtcctggggcccctggaggagcttctgcagccgctattccccctgctcagcctctccaaggccagagtgcagacacctgcggttgttgccgattcagggaagtcgaagggcaaagacaaggagaggaaaacgtccacaggacaacacagcacagtccagcctgaggttgccgataagatagtcctggtcgcagacagacatctcctggagctgccactggaaggtctctctgtgttcgatgaagggacaatttcctctgtgtcacgagaattttctcttcaaatgctgtggaatcgcctccataaagaagagacagaaggtggcgtgaaaaaggagggaagaagcagagaccccaaaaagagaagcctagcgaagaagggcaggaagggcagcatcccccggaccatcccccctgactgcatcatagtcgactcagacaacttcaagttcgtcgtggacccatacgaggaggcccagggcccagaaatgctaactcctgtctccatcacccaagacattttggaaagattccaagacacattcacgtcgcgatgggcgggacatctgggaagcaagcactttcccagccaggcccagtgggagcaggccctgggcagctgcagcggtttcttcttctatggaatggagagcttcctgtcccatatattagtggagagattggtcgccatgaacttgcaagagtgccaggtggcagtcctgctggacctggcgcggtcctaccagagcttgaagaggcacatggagagcgtggagcacaggagatctgttggccgttgggaagccaattggagaaacagtgcgtctccttcagaagatgagtggcgacgaggcggtgaaccaagacgaggcttctcagaccttgaaggacaagctgctgctgctccaaagctccgagctccttcccaccacgctcaacttggtcctgtatgggctgccgcaccaagccatcgggtagtgcaggcctggacctgcctcccatcagctgctggggccccagcacttgcctctgcccttggctctgcccctctgccaacccatccccacctcccggctcccatccccagctcccagctcgctctccccttcctgggcctctccccagcccttggtgcagcctcagccagggaccctcccccagcgacttcccgcaaggcagccgcctggacctcgagctctgcctgcctgtgtgcgccatggggtctgcgtcggggctggagctgcgtctcttcccggggccaggacaagggcggcctccccttggcggcgctggtgctgagttgcttagaccagaagactattcagaccgtgagcctgtttttgatttgagtgttccactaaacaaacaacaaaagcc

SEQ ID NO: 7675 - DNA, 4694 bp, Homo sapiens
caaccgtggccgggtcctcgcggctggagaacccaaccgacagtgggcggcaggacgcaccgcggaccccggagagagcggacgagcagggcgccggcgccatggacctggtcatcacgcaggagctggcccgcgccgagagccagcaagatgctgcgtccttgaagaaggcctacgagttgatcaaatcggccaacctagggaaatcggagtttgacccctcagagagcttcagcccagacctgtttgttctgtgtgcagagcaggccctgaagatgaggcagccagaggtgagcgaggactgcatccaaatgtacttcaaggtgaaggcgcccatcacccagtttctgggccgagcgcacctgtgcagggcccagatgtgtgccccgaagtcggcagaaaacctggaggaatttgaaaattgcgtgactgagtacatgaaggccataaactttgccaaaggagaaccgaggtactactttttggtgtacaatgcatcagtcctctactggcagatggtgaggccgttcctcaagcctggatatcgtcaccatctgatccccagcctttcccaaatcataaacgtgctgagtcagactgaggaggaagacaaggagtggcgtgctgagctgatgctggaacttctggagtgttatctgcaagccggaagaaaggaggaggctgccaggttctgctccacggcagctccgttcattaagtctcacgtgccacagaaataccggcagatattctctgttatggttcgtcatgaattaatggacgaacttcagttaaaggaagaaaagaaaaattccattagcctgtcagtcactttctatattaatatgctaaaggcaaaagcggagcaaaatgatttaccaggtgacatcagtgtcattctgaggaaggcctacagacacttaggtcattacaaccaccagcgctttccctctatcagtgaagaaaaaatgcttttgctttttgaattggcgcgtttttccttgaccttgaaatgcatggagatctcctctgcctgcctctcagacctgaagaagatggaaagcaaagatcctgggaagcttattgaaatggaatgtctggagtgtgaatcggaagctttaagacttgaaagtaagatgaaagtgtacaaccgagcggctgttgaggcccagctggatatcatacagaggctagacgtcgcgctgcagcgagccgtgcgcctgggcgacccccgggtcatccacgtggtgtgcgccacgcagtggaacacctgcctgcccctgctgcagcacaacctgcggcaccacctgcggaagcccctggctggcgttgcggacgtgctggagaagctggacagcctcatgacgcttctccgctgtcaagtgcacatggagatggcgcagatcgaggaggacgaggaccggctggagcccgccacggagcacctccggaaagccgcgcgcctggacagcctgggcctctaccgggacaggatccagatggcctccacccggctgcgtctgtgcaccacgctataccaggcccctgagcgcgcagaggacaaggccatcatggccgttgagcaggcaaaaaaagctacaccaaaggacagcgtcaggaagaagcgggccctcctggtgaatgcaggcctggccttagcccctgacgcgtttcagattgtgctggacagtgagaatgaggccaaagtctccaccgggaagaacaggggccggttcacctacctctgtgcgaaggcgtggcaccacaccgtcagcgtggacaaagctgccgggcacctgcggcgcctgggcaacgaaaacgacaaggagaggatacagatttgggcagagctggccaaagtggcccggaaacaaggcgtgtgggacgtctgtcggacggcgagccgcttctgcctcctgtatgacaacgtcaaggtgaagaagttgaggctgcggcgagggaagaagaagcgaggtagggacggctcggtgcaggacacctggagccagcctgaggtcgtcctgcagaggcaggtgtgccccgacctgctgcggaagttcgcggaggtggggttcatccatgctgaggccacggttcatttgctgcggtcagaaggtgtagagctgaatgaccgggccatcccccccgaagacctgagccagcacccagctggctacgtgcctgagcccccggaggtgaatgctgagtggatcacatacagaacctggatcgagagtctgtcccggtgtgccatgaataactggctgcgctccgcagagatcggacaggagatccaggaggcgtggattgtgcagaacgccgtggtctacgtcctgaaccacaaccaccacctgatcctggccgggcggcagaaggagctggtggacgccctgtaccacctcctgagcatcgttaaggccacaggccacagtggggaccccgtgatgctggtgacgctctgcaacaccttggcgcgaggcctgatcatcagctggattccagtccaggctgccgagaagtccaggaaattcatgcgaccaaacgcgtttcacagcccactggacgcaggagccacttccgagatcaaaacagcggtggaggtctgcgagtttgccctgaacctgaccaatgggagtgcgcccgaggagacggtgcccaccggcacccggcagcagcttatcgccacctgggtcaaggccaagcagctgctgcagcagcagattgggccacggctgggcaccgaggagcagggcaccaatgaggatgtcagctcggtgaccagagtcctcgttgccttggaaatgtactcatgcaacgggctgggcctcatggacttcactgtcccctccctggcccagttggtgaaaatggcttccgagtgcaactggtcggaccccctggtggagctgcagaccctgacgcggctgacccacttcgcccatgcagcgcgtgaccatgagaccaccatggcctgtgctcacagggctctggagatgggcatcaagtacctgaagaaatttgggcccgaggagtcccggctggtggcagagatgctgtgcacagccacggccatccagggcaggagcatcatggaaaacctgaagggccggaagcagctgcgactggtggcagccaaggccttcacggagagcgccaggttcggaggcatcgcgggcagcagcgccctggtgatgctggccgcgcggcattactggaacgcctggctcccactgctgtcctcagccgtctacaggaagaaggccaagggtgccctgaagaggctcatcggcatcatcaacaagacagaggccagaaagcaggagaaaggaaagacgctgcttctgcaccagtggcccacggccgacttccagggtggcgggacgaccgaaggatattttcttccaggggctgaggacgacctggcgctccgtgctgcgctctacggcctgctcttccacagccatgccgaccaggacgactgggagggcggcctcaaggtgctggacgaggctgtgcaggtgctgccaaggacggcccaccgcctcttgatcttcaagcacatggtcatcgtgaaggccaagctcgggcagaatttttcgatggaaatacagaaattcaaggccgagagtgaggactacttggcgcgcatgtggcaccgcctggccctgaactcgccgagcgtgtctggagagctggcctgctacaacaacgccatccaggccttgcagaagcctgagatggagtggcagaaggtggagtacctcatggagttcggccagtggctccatcacagacactttcctctcgaggacgtggtcttccacctccgctgggctgtcgagatcctgctggccatgaagccgcccggcgatgtccctgagccacagcccacgccggatggggagtacgtggctgtggagatgcccccacggagccccgtgtccgaggccgaggaggcggtgtccttggagcagctgcgtagcgtgcggcagctggaggcgctggcccgcgtgcacatcctgctggccctggtgctgtcgccgggcgccgagggctacgaggactgctgccttgcagcctacgccttcttcaggcacatctggcaggtttctttgatgacagcaggaaaatcagttctggaaaacagacccctggcagcaaccagctcacatctgttattgcctaaaaaagagaaggagaatgagaggagtaaagagaaggagaaggagaggagtaaagagaaggagaatgagaggagtaaagagaaggacaaggagaagggaaaggaggagaaagtcaaggagcccaagcagtctcaaagcccagctcctatcaaacaactggaagacttacccatgagcatagaagagtgggcttcctactcctgccccgaggaagtgctgtctgtactgaaacaggacagaagtgactctactgtgaacccctcaagtatccagaagccgacatacagtttgtatttcctggaccacctggtcaaggccctgcagaagatgtgcctgcacgaactcacggttcccgtcctgcagttgggggtgctgatttcggactccgtggtgggaagcaagggcctgtcggatctctaccaccttcggtgggtacagctcctttttcggagtgtgatttccccaaagcaaaacaaaaataaacaacatgttaaggtattaattctgtag

SEQ ID NO: 7676 - DNA, 1825 bp, Homo sapiens
gggcacacaggagccctgagcggggagaggaggcccgcgcggagcccccggcgtccccccacgccgccttccctcccctttcttcttcccgcccctcgccgggggtcgctgccctggtgtctcactcccgcggagctggcggggggcagggcgggggcgcggcgttgttcgccttccccgaagtgtggccccgccgccgacccgtagccccgcgtccgcgtccctttcggtctccaggcaaccgtggccgggtcctcgcggctggagaacccaaccgacagtgggcggcaggacgcaccgcggaccccggagagagcggacgagcagggcgccggcgccatggacctggtcatcacgcaggagctggcccgcgccgagagccagcaagatgctgcgtccttgaagaaggcctacgagttgatcaaatcggccaacctagggaaatcggagtttgacccctcagagagcttcagcccagacctgtttgttctgtgtgcagagcaggccctgaagatgaggcagccagaggtgagcgaggactgcatccaaatgtacttcaaggtgaaggcgcccatcacccagtttctgggccgagcgcacctgtgcagggcccagatgtgtgccccgaagtcggcagaaaacctggaggaatttgaaaattgcgtgactgagtacatgaaggccataaactttgccaaaggagaaccgaggtactactttttggtgtacaatgcatcagtcctctactggcagatggtgaggccgttcctcaagcctggatatcgtcaccatctgatccccagcctttcccaaatcataaacgtgctgagtcagactgaggaggaagacaaggagtggcgtgctgagctgatgctggaacttctggagtgttatctgcaagccggaagaaaggaggaggctgccaggttctgctccacggcagctccgttcattaagtctcacgtgccacagaaataccggcagatattctctgttatggttcgtcatgaattaatggacgaacttcagttaaaggaagaaaagaaaaattccattagcctgtcagtcactttctatattaatatgctaaaggcaaaagcggagcaaaatgatttaccaggtgacatcagtgtcattctgaggaaggcctacagacacttaggtcattacaaccaccagcgctttccctctatcagtgaagaaaaaatgcttttgctttttgaattggcgcgtttttccttgaccttgaaatgcatggagatctcctctgcctgcctctcagacctgaagaagatggaaagcaaagtaagtggcttcatgacactgctgcctggggatgaggcgctgctcaccgtgcagttggacaaaaggcaaagaaaggaagagcagttcaccaggccacggcccccagggcttcggtccgtggttggcacattgccgtctttcctacctgtgttttgcacagttgcagttagatggtgtttgcaattttacacctgcccgtttctctttacctttcttgtggccacgggtccacagcaccacagttgtttctagagtccaatttacggacggcgtaaaatttcatgatgctgatgatccagaacatcctccaccagtcccattattggacgtgtaaatcacaccggcagtgcctcgttacccgcagttcactttctgcagtttgttacctgcagacagctacagtatgaaaatattaagctattctgagggagaggccacagccacatcacttctgttacagtatagtgttatgattgtatcttattattagttattgttataaatatcttattgtgcctaa

SEQ ID NO: 7677 - DNA, 8516 bp, Homo sapiens
gggcacacaggagccctgagcggggagaggaggcccgcgcggagcccccggcgtccccccacgccgccttccctcccctttcttcttcccgcccctcgccgggggtcgctgccctggtgtctcactcccgcggagctggcggggggcagggcgggggcgcggcgttgttcgccttccccgaagtgtggccccgccgccgacccgtagccccgcgtccgcgtccctttcggtctccaggcaaccgtggccgggtcctcgcggctggagaacccaaccgacagtgggcggcaggacgcaccgcggaccccggagagagcggacgagcagggcgccggcgccatggacctggtcatcacgcaggagctggcccgcgccgagagccagcaagatgctgcgtccttgaagaaggcctacgagttgatcaaatcggccaacctagggaaatcggagtttgacccctcagagagcttcagcccagacctgtttgttctgtgtgcagagcaggccctgaagatgaggcagccagaggtgagcgaggactgcatccaaatgtacttcaaggtgaaggcgcccatcacccagtttctgggccgagcgcacctgtgcagggcccagatgtgtgccccgaagtcggcagaaaacctggaggaatttgaaaattgcgtgactgagtacatgaaggccataaactttgccaaaggagaaccgaggtactactttttggtgtacaatgcatcagtcctctactggcagatggtgaggccgttcctcaagcctggatatcgtcaccatctgatccccagcctttcccaaatcataaacgtgctgagtcagactgaggaggaagacaaggagtggcgtgctgagctgatgctggaacttctggagtgttatctgcaagccggaagaaaggaggaggctgccaggttctgctccacggcagctccgttcattaagtctcacgtgccacagaaataccggcagatattctctgttatggttcgtcatgaattaatggacgaacttcagttaaaggaagaaaagaaaaattccattagcctgtcagtcactttctatattaatatgctaaaggcaaaagcggagcaaaatgatttaccaggtgacatcagtgtcattctgaggaaggcctacagacacttaggtcattacaaccaccagcgctttccctctatcagtgaagaaaaaatgcttttgctttttgaattggcgcgtttttccttgaccttgaaatgcatggagatctcctctgcctgcctctcagacctgaagaagatggaaagcaaagatcctgggaagcttattgaaatggaatgtctggagtgtgaatcggaagctttaagacttgaaagtaagatgaaagtgtacaaccgagcggctgttgaggcccagctggatatcatacagaggctagacgtcgcgctgcagcgagccgtgcgcctgggcgacccccgggtcatccacgtggtgtgcgccacgcagtggaacacctgcctgcccctgctgcagcacaacctgcggcaccacctgcggaagcccctggctggcgttgcggacgtgctggagaagctggacagcctcatgacgcttctccgctgtcaagtgcacatggagatggcgcagatcgaggaggacgaggaccggctggagcccgccacggagcacctccggaaagccgcgcgcctggacagcctgggcctctaccgggacaggatccagatggcctccacccggctgcgtctgtgcaccacgctataccaggcccctgagcgcgcagaggacaaggccatcatggccgttgagcaggcaaaaaaagctacaccaaaggacagcgtcaggaagaagcgggccctcctggtgaatgcaggcctggccttagcccctgacgcgtttcagattgtgctggacagtgagaatgaggccaaagtctccaccgggaagaacaggggccggttcacctacctctgtgcgaaggcgtggcaccacaccgtcagcgtggacaaagctgccgggcacctgcggcgcctgggcaacgaaaacgacaaggagaggatacagatttgggcagagctggccaaagtggcccggaaacaaggcgtgtgggacgtctgtcggacggcgagccgcttctgcctcctgtatgacaacgtcaaggtgaagaagttgaggctgcggcgagggaagaagaagcgaggtagggacggctcggtgcaggacacctggagccagcctgaggtcgtcctgcagaggcaggtgtgccccgacctgctgcggaagttcgcggaggtggggttcatccatgctgaggccacggttcatttgctgcggtcagaaggtgtagagctgaatgaccgggccatcccccccgaagacctgagccagcacccagctggctacgtgcctgagcccccggaggtgaatgctgagtggatcacatacagaacctggatcgagagtctgtcccggtgtgccatgaataactggctgcgctccgcagagatcggacaggagatccaggaggcgtggattgtgcagaacgccgtggtctacgtcctgaaccacaaccaccacctgatcctggccgggcggcagaaggagctggtggacgccctgtaccacctcctgagcatcgttaaggccacaggccacagtggggaccccgtgatgctggtgacgctctgcaacaccttggcgcgaggcctgatcatcagctggattccagtccaggctgccgagaagtccaggaaattcatgcgaccaaacgcgtttcacagcccactggacgcaggagccacttccgagatcaaaacagcggtggaggtctgcgagtttgccctgaacctgaccaatgggagtgcgcccgaggagacggtgcccaccggcacccggcagcagcttatcgccacctgggtcaaggccaagcagctgctgcagcagcagattgggccacggctgggcaccgaggagcagggcaccaatgaggatgtcagctcggtgaccagagtcctcgttgccttggaaatgtactcatgcaacgggctgggcctcatggacttcactgtcccctccctggcccagttggtgaaaatggcttccgagtgcaactggtcggaccccctggtggagctgcagaccctgacgcggctgacccacttcgcccatgcagcgcgtgaccatgagaccaccatggcctgtgctcacagggctctggagatgggcatcaagtacctgaagaaatttgggcccgaggagtcccggctggtggcagagatgctgtgcacagccacggccatccagggcaggagcatcatggaaaacctgaagggccggaagcagctgcgactggtggcagccaaggccttcacggagagcgccaggttcggaggcatcgcgggcagcagcgccctggtgatgctggccgcgcggcattactggaacgcctggctcccactgctgtcctcagccgtctacaggaagaaggccaagggtgccctgaagaggctcatcggcatcatcaacaagacagaggccagaaagcaggagaaaggaaagacgctgcttctgcaccagtggcccacggccgacttccagggtggcgggacgaccgaaggatattttcttccaggggctgaggacgacctggcgctccgtgctgcgctctacggcctgctcttccacagccatgccgaccaggacgactgggagggcggcctcaaggtgctggacgaggctgtgcaggtgctgccaaggacggcccaccgcctcttgatcttcaagcacatggtcatcgtgaaggccaagctcgggcagaatttttcgatggaaatacagaaattcaaggccgagagtgaggactacttggcgcgcatgtggcaccgcctggccctgaactcgccgagcgtgtctggagagctggcctgctacaacaacgccatccaggccttgcagaagcctgagatggagtggcagaaggtggagtacctcatggagttcggccagtggctccatcacagacactttcctctcgaggacgtggtcttccacctccgctgggctgtcgagatcctgctggccatgaagccgcccggcgatgtccctgagccacagcccacgccggatggggagtacgtggctgtggagatgcccccacggagccccgtgtccgaggccgaggaggcggtgtccttggagcagctgcgtagcgtgcggcagctggaggcgctggcccgcgtgcacatcctgctggccctggtgctgtcgccgggcgccgagggctacgaggactgctgccttgcagcctacgccttcttcaggcacatctggcaggtttctttgatgacagcaggaaaatcagttctggaaaacagacccctggcagcaaccagctcacatctgttattgcctaaaaaagagaaggagaatgagaggagtaaagagaaggagaaggagaggagtaaagagaaggagaatgagaggagtaaagagaaggacaaggagaagggaaaggaggagaaagtcaaggagcccaagcagtctcaaagcccagctcctatcaaacaactggaagacttacccatgagcatagaagagtgggcttcctactcctgccccgaggaagtgctgtctgtactgaaacaggacagaagtgactctactgtgaacccctcaagtatccagaagccgacatacagtttgtatttcctggaccacctggtcaaggccctgcagaagatgtgcctgcacgaactcacggttcccgtcctgcagttgggggtgctgatttcggactccgtggtgggaagcaagggcctgtcggatctctaccaccttcgcctcgcccacgcgtgctccgagctgaagctgagagaagcagccgcgcgccatgaagaggcggtcgggcaggtgtgcgtcagcgagctggagcaggccagctgcagaaaagagatcgcgttgaaaaaagagaaaaataaggagcctttattagaagaaagcctgccagcactgaatgagcagacacttcctgtccagcctggggagatcaaaccactggacgccaaggacaagattttgaagatgaatggggagaccgggagggacctggatgggacgtcctttccccacctgtggatgctgaaggcagaagttctgctggagatgaacctgtaccagcctgcacggctgctcctgtcggaggcttacctggctttccaggagctggatgagccttgtgcagaggcccagtgcctgctcctcctcgcacagttggccaacaaggagaaaaactatggacaagccaagaaaatgatcgcacaggcccagcacctgggcggaagtgaggagttctggtacaattccactctgaccctggcagaggcgctcttgtccatggaacactcaggaagggaagctacggtgtgtcacatatttcagaagctcatcaatgccttcaagatcctcaagaaagaaagaccaaaccgattgcctttactggaattcatgatcacagatctagaagccaggtgcctgagcctgcgggtcagagttgcgcagcactcagcggtcactgaacccacagagtgctcgttgctactgaaagagatggatgatggcctgttggaaattgagagaaagtttatcgactgtggctgcaaagagaattgtgttgacgtaaaactagagcgtgcgaagatcaagaggttacgtgcccagaacgagaaagatgaagaacaaaaaactgcgtattacttggaagcgtatggcctggcccagggtgccgtagctgaggaagaagggaggcttcacagcatccagggcttatatggcctggcccagggcgccatggctgaggaagaagggaggcttcacagcgtccagggcctattgtcacttcaagacttgcagaacgtcaacacgcccctgatgaggaagctggcgcgcctcaagctcggcctcgtggaaatggctctggacatgctccagttcatctgggaggaggcccacgggcagcagagtgagcaggggtccctggagaagctgctggcggactatctgcagaacaccagtgactacacttccgtcggcctgcaatggttcacgctgaagcggactctagcacacggggcactggcacagctggggagcctgcagccgctgagcgtgggctgtgtggagatccgcgcccggctcctgggcctggccgggagggccctgcacctgctggccatgcaagctgaccctgtgcaccctacctgctactgggaggcgggcccctcggtgggcgccaagctgagcggcctcaagtctctggagctggaggtagaggaagagggtgccacaaagtccagcagggacccgccggcctccagggcagccccggaggagcactgcaggagaggcgaggacctgaagaggaggatggttctggcccagcagtacctggctcaggcgtcagaggtgctgctgcagtgcctacaggtggcccttggcagtggcctcctggatgtcgcagcagccgccagcctggagatggtggagtgtgtcggcaccctggaccctgcaactacctgccagttcctggctctgtctcagagctgctcggcctcagagacgatgagggatgtcctgcttgcagccacagccaacaccagcagctcacagctggcggccctgctgcagctacagcaccagctccggtgccaagacaggaccaccaccagcctgggcgcccgtgtggagcagaggctggccgccgtgtccaaggcttggcaaaatctctgcgtcactgagcagcattttaacctcttgaatgagatgcctccgaccttttggatcctctttctgcacctctcaggggacaggtcccgtctgtacggcgctgcctacgagaaacccaagttcattactgcagccaaaggaaaggtgcaggcggtgggaggctcctgcaaggtgatgcgtctggccataagtcccactgccttctcccacctgctggcctgtgcccagcagttccggaagcagacccaggcccaggtgtacagtgaggacatggccctgaacataggctcggaaccagaaggcctgcaggtggaagagaaggagcgccctgtgcagaggctcagtagcgtcctggggcccctggaggagcttctgcagccgctattccccctgctcagcctctccaaggccagagtgcagacacctgcggttgttgccgattcagggaagtcgaagggcaaagacaaggagaggaaaacgtccacaggacaacacagcacagtccagcctgaggttgccgataagatagtcctggtcgcagacagacatctcctggagctgccactggaaggtctctctgtgttcgatgaagggacaatttcctctgtgtcacgagaattttctcttcaaatgctgtggaatcgcctccataaagaagagacagaaggtggcgtgaaaaaggagggaagaagcagagaccccaaaaagagaagcctagcgaagaagggcaggaagggcagcatcccccggaccatcccccctgactgcatcatagtcgactcagacaacttcaagttcgtcgtggacccatacgaggaggcccagggcccagaaatgctaactcctgtctccatcacccaagacattttggaaagattccaagacacattcacgtcgcgatgggcgggacatctgggaagcaagcactttcccagccaggcccagtgggagcaggccctgggcagctgcagcggtttcttcttctatggaatggagagcttcctgtcccatatattagtggagagattggtcgccatgaacttgcaagagtgccaggtggcagtcctgctggacctggcgcggtcctaccagagcttgaagaggcacatggagagcgtggagcacaggagatctgttggccgttgggaagccaattggagaaacagtgcgtctccttcagaagatgagtggcgacgaggcggtgaaccaagacgaggcttctcagaccttgaaggacaagctgctgctgctccaaagctccgagctccttcccaccacgctcaacttggtcctgtatgggctgccgcaccaagccatcgggtagtgcaggcctggacctgcctcccatcagctgctggggccccagcacttgcctctgcccttggctctgcccctctgccaacccatccccacctcccggctcccatccccagctcccagctcgctctccccttcctgggcctctccccagcccttggtgcagcctcagccagggaccctcccccagcgacttcccgcaaggcagccgcctggacctcgagctctgcctgcctgtgtgcgccatggggtctgcgtcggggctggagctgcgtctcttcccggggccaggacaagggcggcctccccttggcggcgctggtgctgagttgcttagaccagaagactattcagaccgtgagcctgtttttgatttgagtgttccactaaacaaacaacaaaagcca

SEQ ID NO: 7678 - DNA, 2113 bp, Homo sapiens
tcagaaaggaagcaatcgatgttattaggagctaaatttctgtttctcactcaacagttgcataaattgaaaaaggcagtaaatgaattgtctcgtgctatccaccttcagccagatggaatccaattatacataagaagaggacaatatcttcttatgatgaaatattatgatcttgcaaagtttactatttatcaaatagcagaaatggacaaaggtctcagtgagttgagtcctatgcagcaagcccttatttattcattttgtgaaaaccatgacaaggccattgaggtcttggacggaatcagctggaatagagctgagatgaccatgtgtgctctattagcaaaagttcaaatgaaggccaagagaaccaaggaagctgtggaagtgcttaagaaggctttggatgccatttctcattctgataaaggaccagatgccacagcaatttcagcagactgtctgtataacttgggtctttgttacatggaggaaggcaatttacaaatgacttataagctagcaattacagatttaactacagctatcagcatggacaaaaatagttatacagcattttataacagagcattatgttacaccaagataagggaacttcaaatggcattaacagattatggaattgtgctgcttcttgatgctacagaaactgtaaaactaaataccttccttaatcgtggactcatctacgtagaactaggccagtatggctttgcactagaggattttaaacaagctgcactgataagccggactaacgggagcctttgtcacgccactgccatgtgccatcacagaattaatgagtttgaagaagctgtcaatttctttacttgggctcttaaaattaacccatgttttctggatgcttatgttggacggggaaattcttacatggaatacggtcatgatgaagccaccaagcaagcacagaaagactttctgaaagcactgcatattaatccagcatacataaaagccagaattagttttggctataatttgcaggcccaaggaaaattccagaaagcttggaaccactttaccattgccatagatactgatccaaagaactacctagcctatgaaggaagagctgtggtctgtcttcagatgggtaataattttgctgcaatgcaggatattaatgctgccatgaagatcagtactacagcagaattcttaacaaatcgtggggtgattcatgagtttatgggccacaaacagaatgcaatgaaagactaccaagatgcaattactctaaaccccaagtactcgctggcttactttaatgcaggaaatatctactttcaccacaggcagttttcccaggccagtgactacttctcaaaagctttaaaatttgatccagaaaatgaatatgttctcatgaatcgagctattacaaatacaatattaaagaaatatgaagaagcaaaagaagattttgcaaatgtaattgaaagctgtcccttttgggctgcagtatattttaatagagcacatttctactactgcttaaagcaatatgaactagctgaggaagaccttaataaagccctgtctttgaagcctaatgatgctctagtatataattttagagcaaaagttcgtggtaaaataggtctgattgaggaagctatggctgactataaccaagcacttgatcttgaagactatgcctcagttatatgattacatagactgtggttgctatagtagtttacacagctgttctctctgaaacggaaacatatttgttgtctaaaaggttctaccattttcattattgtattcgttatgcttagtcttccatataaccttctatgcattttaataaaatgtttgttatacattaattataaaacatatatcatttgctgcatatttggaataccttgagaactgaatttttccaaggttgcagaatctcaaggaaaatgtttcttaaggaattaaataggaatgtctcttaacatttaaaatattttctttaattctttttgaaataatactatacattgtagaaaaagtgtcactgaccttttcatcaatccttgctgacaatgtattaaacagtatacagatt

SEQ ID NO: 7679 - DNA, 2193 bp, Homo sapiens
tgctatccaccttcagccagatggaatccaattatacataagaagaggacaatatcttcttatgatgaaatattatgatcttgcaaagtttactatttatcaaatagcagaaatggacaaaggtctcagtgagttgagtcctatgcagcaagcccttatttattcattttgtgaaaaccatgacaaggccattgaggtcttggacggaatcagctggaatagagctgagatgaccatgtgtgctctattagcaaaagttcaaatgaaggccaagagaaccaaggaagctgtggaagtgcttaagaaggctttggatgccatttctcattctgataaaggaccagatgccacagcaatttcagcagactgtctgtataacttgggtctttgttacatggaggaaggcaatttacaaatggcttttgattcttttacaaaagctgtgaaagcaaatccagattttgcagaaagcttttatcagcgagggctttgtaaagtgaaactccacaaggatagctcgattctggattttaatcgtgcaattaccctcaatccaaaacattaccaggcatatttaagccgagtagcattctatggtttaaaaggcaggtattccaaagcaatcttgaattgtaacaaggctattaaaatttaccctgaaagcgtacgtgcctatctctacagaggagttctgaaatactacaacaagacttataagctagcaattacagatttaactacagctatcagcatggacaaaaatagttatacagcattttataacagagcattatgttacaccaagataagggaacttcaaatggcattaacagattatggaattgtgctgcttcttgatgctacagaaactgtaaaactaaataccttccttaatcgtggactcatctacgtagaactaggccagtatggctttgcactagaggattttaaacaagctgcactgataagccggactaacgggagcctttgtcacgccactgccatgtgccatcacagaattaatgagtttgaagaagctgtcaatttctttacttgggctcttaaaattaacccatgttttctggatgcttatgttggacggggaaattcttacatggaatacggtcatgatgaagccaccaagcaagcacagaaagactttctgaaagcactgcatattaatccagcatacataaaagccagaattagttttggctataatttgcaggcccaaggaaaattccagaaagcttggaaccactttaccattgccatagatactgatccaaagaactacctagcctatgaaggaagagctgtggtctgtcttcagatgggtaataattttgctgcaatgcaggatattaatgctgccatgaagatcagtactacagcagaattcttaacaaatcgtggggtgattcatgagtttatgggccacaaacagaatgcaatgaaagactaccaagatgcaattactctaaaccccaagtactcgctggcttactttaatgcaggaaatatctactttcaccacaggcagttttcccaggaagaaagtcttggcctggcttggagtctttcccttgactcatttctgagaactgggggtgcaaccttctcttcaggagtgaatcctcttcaaactcttcacagaaggatgtcaattctgtcccccctccccccaacctgtcccagggatgagatggattttacatcttgaactaattacctaattaagaggaagcaaagttcatggagtattgcctaaaggccagtgactacttctcaaaagctttaaaatttgatccagaaaatgaatatgttctcatgaatcgagctattacaaatacaatattaaagaaatatgaagaagcaaaagaagattttgcaaatgtaattgaaagctgtcccttttgggctgcagtatattttaatagagcacatttctactactgcttaaagcaatatgaactagctgaggaagaccttaataaagccctgtctttgaagcctaatgatgctctagtatataattttagagcaaaagttcgtggtaaaataggtctgattgaggaagctatggctgactataaccaagcacttgatcttgaagactatgcctcagttatatgattacatagactgtggttgctatagtagtttacacagctgttctctctgaaacggaaa

SEQ ID NO: 7680 - DNA, 2253 bp, Homo sapiens
gtgggcgccccttccccagcctcgctgccgccttgcagtttgatctcagactgccgtgctagcaatcagggagactccgtgggcgtaggaccctccgagccacgtgtgggatataacctcgtagtgtgccgttttttaagcccgtcggaaaagtgcagtatgcaggtgggagcgaacggattttccagttgcataaattgaaaaaggcagtaaatgaattgtctcgtgctatccaccttcagccagatggaatccaattatacataagaagaggacaatatcttcttatgatgaaatattatgatcttgcaaagtttactatttatcaaatagcagaaatggacaaaggtctcagtgagttgagtcctatgcagcaagcccttatttattcattttgtgaaaaccatgacaaggccattgaggtcttggacggaatcagctggaatagagctgagatgaccatgtgtgctctattagcaaaagttcaaatgaaggccaagagaaccaaggaagctgtggaagtgcttaagaaggctttggatgccatttctcattctgataaaggaccagatgccacagcaatttcagcagactgtctgtataacttgggtctttgttacatggaggaaggcaatttacaaatgacttataagctagcaattacagatttaactacagctatcagcatggacaaaaatagttatacagcattttataacagagcattatgttacaccaagataagggaacttcaaatggcattaacagattatggaattgtgctgcttcttgatgctacagaaactgtaaaactaaataccttccttaatcgtggactcatctacgtagaactaggccagtatggctttgcactagaggattttaaacaagctgcactgataagccggactaacgggagcctttgtcacgccactgccatgtgccatcacagaattaatgagtttgaagaagctgtcaatttctttacttgggctcttaaaattaacccatgttttctggatgcttatgttggacggggaaattcttacatggaatacggtcatgatgaagccaccaagcaagcacagaaagactttctgaaagcactgcatattaatccagcatacataaaagccagaattagttttggctataatttgcaggcccaaggaaaattccagaaagcttggaaccactttaccattgccatagatactgatccaaagaactacctagcctatgaaggaagagctgtggtctgtcttcagatgggtaataattttgctgcaatgcaggatattaatgctgccatgaagatcagtactacagcagaattcttaacaaatcgtggggtgattcatgagtttatgggccacaaacagaatgcaatgaaagactaccaagatgcaattactctaaaccccaagtactcgctggcttactttaatgcaggaaatatctactttcaccacaggcagttttcccaggccagtgactacttctcaaaagctttaaaatttgatccagaaaatgaatatgttctcatgaatcgagctattacaaatacaatattaaagaaatatgaagaagcaaaagaagattttgcaaatgtaattgaaagctgtcccttttgggctgcagtatattttaatagagcacatttctactactgcttaaagcaatatgaactagctgaggaagaccttaataaagccctgtctttgaagcctaatgatgctctagtatataattttagagcaaaagttcgtggtaaaataggtctgattgaggaagctatggctgactataaccaagcacttgatcttgaagactatgcctcagttatatgattacatagactgtggttgctatagtagtttacacagctgttctctctgaaacggaaacatatttgttgtctaaaaggttctaccattttcattattgtattcgttatgcttagtcttccatataaccttctatgcattttaataaaatgtttgttatacattaattataaaacatatatcatttgctgcatatttggaataccttgagaactgaatttttccaaggttgcagaatctcaaggaaaatgtttcttaaggaattaaataggaatgtctcttaacatttaaaatattttctttaattctttttgaaataatactatacattgtagaaaaagtgtcactgaccttttcatcaatccttgctgacaatgtattaaacagtatacagattaaaaaataa

SEQ ID NO: 7681 - DNA, 3433 bp, Homo sapiens
gttacgccgcggagccgggagccggagcccgagcccgcggcggcggcgggaggcggcgagggggcgccgcggcggcggcggtggggcctgcggggcgggcggccgggcccggccaggccgcgatggcgaccaagaaggcaggctcgcggctggagacggagatcgagcgctgccgctccgagtgccagtgggagcggatccctgagctcgtcaagcagctgtcggccaagctcatcgccaacgatgacatggcagagcttctcctcggggagtcgaagctggagcagtacctgaaggaacaccccctgaggcagggggccagtccccgaggccccaagccccagctgactgaggtccgcaagcatctgaccgccgccctggaccgagggaaccttaagtcagaattcctacaagaatccaatctgatcatggccaagttgaattatgtggaaggtgattataaagaagctctgaacatttacgcccgggtgggcctggacgatctgccactgacagctgtcccgccctacaggctgcgggtgatcgcagaagcctacgctaccaaaggactttgtttggagaagctgcctatttcttcttctaccagtaatctccatgtggaccgggaacaggatgtcatcacctgttatgagaaagcaggggacatcgcactcctgtatctccaagagatagaaagggtaatactttctaatattcaaaacagaagccctaagcctggccctgctccccacgatcaagaactaggttttttcctagaaacaggacttcagagagcccatgtcctctatttcaaaaatgggaacttgacaagaggagtcggaagatttagagagcttctcagagcagttgaaacaagaacgactcaaaacctgcgaatgacaatagccaggcagctggcagagatcttgttgcggggtatgtgtgagcagagctactggaaccctctggaggatccaccgtgccagtcacctctggacgatcctctccgcaaaggagcaaacacaaaaacctacactctcactcggagagcccgtgtctactcaggagagaacattttttgtcctcaagaaaatacggaagaagccctgttgttattgctgattagtgaatcaatggccaaccgggacgctgtgctgagcaggatacctgaacacaagagtgaccgcctcatcagtctgcagagtgcatctgtggtctatgacttactcaccattgctcttggaagaagaggccagtatgagatgctgtcagagtgcctagaaagagccatgaagtttgcctttgaggaattccacctgtggtaccagtttgctctgtccctgatggctgctggaaaatctgcccgtgccgtgaaggtgctgaaagagtgtatccgcctgaagccagacgatgccaccatccctctcctcgctgccaagctctgcatgggctccctgcactggttggaagaggctgaaaagtttgccaaaactgtcgttgatgtgggagagaaaacgtcagagttcaaggccaaaggctacttagctctggggctcacgtacagtctgcaggccactgacgcttctttgcgagggatgcaggaggtcctacagagaaaggcgcttcttgcatttcagagggcccacagcctgtcacccacagatcaccaagcagctttctacctggctctgcagcttgccatctccagacagatcccagaggctctggggtatgtccgccaagctcttcagcttcaaggtgacgatgccaactccctgcacctccttgccctcctgctgtcagcacagaagcattaccatgacgctctgaacatcatcgacatggccctgagtgaatacccagaaaatttcatactactgttttccaaagtgaagttgcagtcactctgccgaggcccggacgaggcactgctgacttgtaagcacatgctgcagatatggaaatcctgctacaacctcaccaaccccagtgattctggacgtgggagcagcctcttagatagaaccattgctgacagacgacagcttaatacaattactttgccagacttcagcgatcccgagacaggctccgtccatgccacatcggtagcagcctcaagagtggagcaggcactgtcggaagtggcttcgtctctgcagagcagtgcccctaagcagggcccgctgcacccctggatgacgctggcacagatctggctccatgcagctgaagtctatatcggcatcgggaagcctgcagaagccacagcctgtacccaagaagctgccaacctcttcccaatgtcccacaatgtcctctacatgcgcggccagattgctgagctccggggaagcatggacgaggcgcggcggtggtatgaagaggccttagccatcagccccacccacgtgaagagcatgcagcgactggccctgatccttcaccagctaggccgctacagtctggcggagaagatcctccgggacgcggtgcaggtgaactcgacagcccacgaggtctggaacgggctgggcgaggtcctccaagctcagggcaacgatgcggcggctacggagtgcttcctgacagccttggagctggaggccagcagccccgccgtgcccttcaccatcatcccccgcgtgctctgagcaggcgcctgccagcctcacctgccgctcaggcctcagaggccctgccgggcaccagggcttgtgccatcgccccaaggggatgaatctgccacactgaggccagggacgagtgttcagtgggccacagtgaaccaaccaaaccaaccccgaatcatcgctctcgccatgtgcgtttctcttgttttttttgccagcccaatggtagtttctgaacctattgacattgttcaaaatggatcatgtgccatattttgttagttgacatctgagttttcagtaaaatgattatggaattaatcagcaaatgtagaagaatatattcaaagttaaaattcagtggcagcacagattatttttatcagagctgtaaagaaaacaactgtccttttctccccaccacccctcctgccccactttggcccagaaaccaaatgtgaacttcctgtctcccacctcagcactagtccatgccaggacaccagctgacaatttcttggttttactgtcaataattgtaccatgtgatcaattactgtcctcacttagaacaaagcctgagtccgagaatatttatattttaccaatatatgcctgttacaagagaaggaaatatgagttatttaagtttaacttttttatgtgaattcagagtttatttatcgagggaaatatgtacaaagaagcttcaaatggaatatttaccgacattccttatacatgacagacacttggctacatgggaagatgatgttaataataaaatgatttttaaatgg

SEQ ID NO: 7682 - DNA, 3484 bp, Homo sapiens
gttacgccgcggagccgggagccggagcccgagcccgcggcggcggcgggaggcggcgagggggcgccgcggcggcggcggtggggcctgcggggcgggcggccgggcccggccaggccgcgatggcgaccaagaaggcaggctcgcggctggagacggagatcgagcgctgccgctccgagtgccagtgggagcggatccctgagctcgtcaagcagctgtcggccaagctcatcgccaacgatgacatggcagagcttctcctcggggagtcgaagctggagcagtacctgaaggaacaccccctgaggcagggggccagtccccgaggccccaagccccagctgactgaggtccgcaagcatctgaccgccgccctggaccgagggaaccttaagtcagaattcctacaagaatccaatctgatcatggccaagttgaattatgtggaaggtgattataaagaagctctgaacatttacgcccgggtgggcctggacgatctgccactgacagctgtcccgccctacaggctgcgggtgatcgcagaagcctacgctaccaaaggactttgtttggagaagctgcctatttcttcttctaccagtaatctccatgtggaccgggaacaggatgtcatcacctgttatgagaaagcaggggacatcgcactcctgtatctccaagagatagaaagggtaatactttctaatattcaaaacagaagccctaagcctggccctgctccccacgatcaagaactaggttttttcctagaaacaggacttcagagagcccatgtcctctatttcaaaaatgggaacttgacaagaggagtcggaagatttagagagcttctcagagcagttgaaacaagaacgactcaaaacctgcgaatgacaatagccaggcagctggcagagatcttgttgcggggtatgtgtgagcagagctactggaaccctctggaggatccaccgtgccagtcacctctggacgatcctctccgcaaaggagcaaacacaaaaacctacactctcactcggagagcccgtgtctactcaggagagaacattttttgtcctcaagaaaatacggaagaagccctgttgttattgctgattagtgaatcaatggccaaccgggacgctgtgctgagcaggatacctgaacacaagagtgaccgcctcatcagtctgcagagtgcatctgtggtctatgacttactcaccattgctcttggaagaagaggccagtatgagatgctgtcagagtgcctagaaagagccatgaagtttgcctttgaggaattccacctgtggtaccagtttgctctgtccctgatggctgctggaaaatctgcccgtgccgtgaaggtgctgaaagagtgtatccgcctgaagccagacgatgccaccatccctctcctcgctgccaagctctgcatgggctccctgcactggttggaagaggctgaaaagtttgccaaaactgtcgttgatgtgggagagaaaacgtcagagttcaaggccaaaggctacttagctctggggctcacgtacagtctgcaggccactgacgcttctttgcgagggatgcaggaggtcctacagagaaaggcgcttcttgcatttcagagggcccacagcctgtcacccacagatcaccaagcagctttctacctggctctgcagcttgccatctccagacagatcccagaggctctggggtatgtccgccaagctcttcagcttcaaggtgacgatgccaactccctgcacctccttgccctcctgctgtcagcacagaagcattaccatgacgctctgaacatcatcgacatggccctgagtgaatacccagaaaatttcatactactgttttccaaagtgaagttgcagtcactctgccgaggcccggacgaggcactgctgacttgtaagcacatgctgcagatatggaaatcctgctacaacctcaccaaccccagtgattctggacgtgggagcagcctcttagatagaaccattgctgacagacgacagcttaatacaattactttgccagacttcagcgatcccgagacaggcaactctccagaagcatactttcatggttttccttcccttttttcagttagctccgtccatgccacatcggtagcagcctcaagagtggagcaggcactgtcggaagtggcttcgtctctgcagagcagtgcccctaagcagggcccgctgcacccctggatgacgctggcacagatctggctccatgcagctgaagtctatatcggcatcgggaagcctgcagaagccacagcctgtacccaagaagctgccaacctcttcccaatgtcccacaatgtcctctacatgcgcggccagattgctgagctccggggaagcatggacgaggcgcggcggtggtatgaagaggccttagccatcagccccacccacgtgaagagcatgcagcgactggccctgatccttcaccagctaggccgctacagtctggcggagaagatcctccgggacgcggtgcaggtgaactcgacagcccacgaggtctggaacgggctgggcgaggtcctccaagctcagggcaacgatgcggcggctacggagtgcttcctgacagccttggagctggaggccagcagccccgccgtgcccttcaccatcatcccccgcgtgctctgagcaggcgcctgccagcctcacctgccgctcaggcctcagaggccctgccgggcaccagggcttgtgccatcgccccaaggggatgaatctgccacactgaggccagggacgagtgttcagtgggccacagtgaaccaaccaaaccaaccccgaatcatcgctctcgccatgtgcgtttctcttgttttttttgccagcccaatggtagtttctgaacctattgacattgttcaaaatggatcatgtgccatattttgttagttgacatctgagttttcagtaaaatgattatggaattaatcagcaaatgtagaagaatatattcaaagttaaaattcagtggcagcacagattatttttatcagagctgtaaagaaaacaactgtccttttctccccaccacccctcctgccccactttggcccagaaaccaaatgtgaacttcctgtctcccacctcagcactagtccatgccaggacaccagctgacaatttcttggttttactgtcaataattgtaccatgtgatcaattactgtcctcacttagaacaaagcctgagtccgagaatatttatattttaccaatatatgcctgttacaagagaaggaaatatgagttatttaagtttaacttttttatgtgaattcagagtttatttatcgagggaaatatgtacaaagaagcttcaaatggaatatttaccgacattccttatacatgacagacacttggctacatgggaagatgatgttaataataaaatgatttttaaatgg

SEQ ID NO: 7683 - DNA, 2153 bp, Homo sapiens
gttacgccgcggagccgggagccggagcccgagcccgcggcggcggcgggaggcggcgagggggcgccgcggcggcggcggtggggcctgcggggcgggcggccgggcccggccaggccgcgatggcgaccaagaaggcaggctcgcggctggagacggagatcgagcgctgccgctccgagtgccagtgggagcggatccctgagctcgtcaagcagctgtcggccaagctcatcgccaacgatgacatggcagagcttctcctcggggagtcgaagctggagcagtacctgaaggaacaccccctgaggcagggggccagtccccgaggccccaagccccagctgactgaggtccgcaagcatctgaccgccgccctggaccgagggaaccttaagtcagaattcctacaagaatccaatctgatcatggccaagttgaattatgtggaaggtgattataaagaagctctgaacatttacgcccgggtgggcctggacgatctgccactgacagctgtcccgccctacaggctgcgggtgatcgcagaagcctacgctaccaaaggactttgtttggagaagctgcctatttcttcttctaccagtaatctccatgtggaccgggaacaggatgtcatcacctgttatgagaaagcaggggacatcgcactcctgtatctccaagagatagaaagggtaatactttctaatattcaaaacagaagccctaagcctggccctgctccccacgatcaagaactaggttttttcctagaaacaggacttcagagagcccatgtcctctatttcaaaaatgggaacttgacaagaggagtcggaagatttagagagcttctcagagcagttgaaacaagaacgactcaaaacctgcgaatgacaatagccaggcagctggcagagatcttgttgcggggtatgtgtgagcagagctactggaaccctctggaggatccaccgtgccagtcacctctggacgatcctctccgcaaaggagcaaacacaaaaacctacactctcactcggagagcccgtgtctactcaggagagaacattttttgtcctcaagaaaatacggaagaagccctgttgttattgctgattagtgaatcaatggccaaccgggacgctgtgctgagcaggatacctgaacacaagagtgaccgcctcatcagtctgcagagtgcatctgtggtctatgacttactcaccattgctcttggaagaagaggccagtatgagatgctgtcagagtgcctagaaagagccatgaagtttgcctttgaggaattccacctgtggtaccagtttgctctgtccctgatggctgctggaaaatctgcccgtgccgtgaaggtgctgaaagagtgtatccgcctgaagccagacgatgccaccatccctctcctcgctgccaagctctgcatgggctccctgcactggttggaagaggctgaaaagtttgccaaaactgtcgttgatgtgggagagaaaacgtcagagttcaaggccaaaggctacttagctctggggctcacgtacagtctgcaggccactgacgcttctttgcgagggatgcaggaggtcctacagagaaaggcgcttcttgcatttcagagggcccacagcctgtcacccacagatcaccaagcagctttctacctggctctgcagcttgccatctccagacagatcccagaggctctggggtatgtccgccaagctcttcagcttcaaggtgacgatgccaactccctgcacctccttgccctcctgctgtcagcacagaagcattaccatgacgctctgaacatcatcgacatggccctgagtgaatacccagaaaatttcatactactgttttccaaagtgaagttgcagtcactctgccgaggcccggacgaggcactgctgacttgtaagcacatgctgcagatatggaaatcctgctacaacctcaccaaccccagtgattctggacgtgggagcagcctcttagatagaaccattgctgacagacgacagcttaatacaattactttgccagacttcagcgatcccgagacaggaaatcagtgttcatggattgcatttggggaaatgctggtggatatggggatccagtgcatttga

SEQ ID NO: 7684 - DNA, 1719 bp, Homo sapiens
atcccagaggctctggggtatgtccgccaagctcttcagcttcaaggtgacgatgccaactccctgcacctccttgccctcctgctgtcagcacagaagcattaccatgacgctctgaacatcatcgacatggccctgagtgaatacccagaaaatttcatactactgttttccaaagtgaagttgcagtcactctgccgaggcccggacgaggcactgctgacttgtaagcacatgctgcagatatggaaatcctgctacaacctcaccaaccccagtgattctggacgtgggagcagcctcttagatagaaccattgctgacagacgacagcttaatacaattactttgccagacttcagcgatcccgagacaggcaactctccagaagcatactttcatggttttccttcccttttttcagttagctccgtccatgccacatcggtagcagcctcaagagtggagcaggcactgtcggaagtggcttcgtctctgcagagcagtgcccctaagcagggcccgctgcacccctggatgacgctggcacagatctggctccatgcagctgaagtctatatcggcatcgggaagcctgcagaagccacagcctgtacccaagaagctgccaacctcttcccaatgtcccacaatgtcctctacatgcgcggccagattgctgagctccggggaagcatggacgaggcgcggcggtggtatgaagaggccttagccatcagccccacccacgtgaagagcatgcagcgactggccctgatccttcaccagctaggccgctacagtctggcggagaagatcctccgggacgcggtgcaggtgaactcgacagcccacgaggtctggaacgggctgggcgaggtcctccaagctcagggcaacgatgcggcggctacggagtgcttcctgacagccttggagctggaggccagcagccccgccgtgcccttcaccatcatcccccgcgtgctctgagcaggcgcctgccagcctcacctgccgctcaggcctcagaggccctgccgggcaccagggcttgtgccatcgccccaaggggatgaatctgccacactgaggccagggacgagtgttcagtgggccacagtgaaccaaccaaaccaaccccgaatcatcgctctcgccatgtgcgtttctcttgttttttttgccagcccaatggtagtttctgaacctattgacattgttcaaaatggatcatgtgccatattttgttagttgacatctgagttttcagtaaaatgattatggaattaatcagcaaatgtagaagaatatattcaaagttaaaattcagtggcagcacagattatttttatcagagctgtaaagaaaacaactgtccttttctccccaccacccctcctgccccactttggcccagaaaccaaatgtgaacttcctgtctcccacctcagcactagtccatgccaggacaccagctgacaatttcttggttttactgtcaataattgtaccatgtgatcaattactgtcctcacttagaacaaagcctgagtccgagaatatttatattttaccaatatatgcctgttacaagagaaggaaatatgagttatttaagtttaacttttttatgtgaattcagagtttatttatcgagggaaatatgtacaaagaagcttcaaatggaatatttaccgacattccttatacatgaca

SEQ ID NO: 7685 - DNA, 843 bp, Homo sapiens
cggcaggagtttcccacaatgcagcgcggcgcgctgtccccggtgctgatgctcagcgctgccccggagcctccgccgcgcccgcctcccgccctctccccaccgggctcgggcccaggctcgggctcccgccatggctcggctcgtcccggtcctaccccagagccgtcggggagcctgggcgcggcgctcgacagcagcctgcgtgccgccgtggcgttcaaggcagagggccagcgctgctatcgagagaagaagttccgggaggccatcggcaagtaccaccgagcgctgctgcagctgaaggcggcgcagggggcccgccctagcggcctgcccgcccccgcccccgggcccaccagcagccccgggccggcgcgcctcagcgaggagcagcggcgcctggtggagagcacggaggtggagtgttacgactccctcacggcttgcctgctgcagtcggagctggtaaactacgagcgcgtgcgcgagtactgtctcaaggtactggagaagcagcagggcaacttcaaggccacctaccgtgccggcattgccttctaccacctgggcgactacgcacgcgcgctgcgctacctgcaggaggcccgcagccgggaacccacagacaccaatgtgctccgctacatccagctgactcagctgaagatgaatcgttgcagcctccagcgggaagacagtggggctgggtcccagactcgggatgtaattggctgaggccaatccagggggacctctctatccctcgccctcccacctcaccatgtaacttcccccgactcatgtgtttgttggtaaaacacttgtcactggtgatcataa

SEQ ID NO: 7686 - DNA, 1080 bp, Homo sapiens
agttcttcggaaagtctcatccacccccacatcgcctctttaggaagtcacttaatgttgggcttcattattcccacatccctttccttactacttgcctgcacttcttgagaaaaagactgcagaaaggagaggtggggctttcagtagaaacaagcaaaccgcaggtccctgtggggggactctccaggaagaagggtaatttcctgcctccttaaattggctgctactgtcagttattttgctcccaaccccagagcttcacttgctccttcacttcccagttccgcaagaaccgtgggcgacagttatggagaagcgtctgcaggaggctcagctgtacaaggaggaagggaaccagcgctaccgggaagggaagtaccgagatgctgtgagtaggtaccatcgagctctgcttcagctgcggggtctggatccgagtctgccctctccgttacctaatctcggacctcagggcccggccctcacgcctgaacaagaaaacatattgcataccacccagacagactgctataacaatctagctgcttgtctccttcagatggagcccgtgaactacgaacgagtgagagaatatagtcagaaagtcctggaacgacagcctgataatgccaaggccttgtatcgggccggagtggcctttttccatctgcaggactatgaccaggcccgccactacctcctggctgccgtgaataggcagcctaaagatgccaacgtccggcggtacctccagctgacacagtcagaactcagcagctaccatagaaaagagaagcagctctacctgggcatgtttggttaacaaagaagaaagatgctcctccagttgaacttaggtggaccattaaacatgcatgaaggagaaatctgagcctcagcaagagaaattaaccctatacctctgacccaggtggatttttgtttctagttctgcacaaacttcactacttagacagtctgagtctttttctgtctatccatctgtttatttctatacctttcaatacatgttattgttgcagatatttggcttgagaaatataatcagaaaacata

SEQ ID NO: 7687 - DNA, 1809 bp, Homo sapiens
tctgattgggtggtgtggcgcaatgcgcgcgaccctcaagataccaaactgtacgcatctctgaccctttcctctccttgctcctgctggtaaaccgaagcccaggagacttccaggtttgggcatctgcagagggcgaggaactggtcacggcgccgggtgggcttgcagctgtgacgcttatgtggacacctcagtgtcgctggtggttcacctcggcttcccagtttatttattgacgtcaacaaataaatgttgaataaggaagaagagttagaattgcttgaagccctctggagttttagcactagtcccgcccactcccttctacttccaggtcgggggggggcgggtccaatagaaaggcggaagccagtgtcccaggcgttctcacgcccgcaacaattcctgagtagggccttgcttgagttcttcggaaagtctcatccacccccacatcgcctctttaggaagtcacttaatgttgggcttcattattcccacatccctttccttactacttgcctgcacttcttgagaaaaagactgcagaaaggagaggtggggctttcagtagaaacaagcaaaccgcaggtccctgtggggggactctccaggaagaaggttccgcaagaaccgtgggcgacagttatggagaagcgtctgcaggaggctcagctgtacaaggaggaagggaaccagcgctaccgggaagggaagtaccgagatgctgtgagtaggtaccatcgagctctgcttcagctgcggggtctggatccgagtctgccctctccgttacctaatctcggacctcagggcccggccctcacgcctgaacaagaaaacatattgcataccacccagacagactgctataacaatctagctgttgtgaaatagggagtgtttcccttcttaatcataaaaaggcagaacattgacctgaattgcctgaattgactcctctgcagcttgtctccttcagatggagcccgtgaactacgaacgagtgagagaatatagtcagaaagtcctggaacgacagcctgataatgccaaggccttgtatcgggccggagtggcctttttccatctgcaggactatgaccaggcccgccactacctcctggctgccgtgaataggcagcctaaaggtaagcaagaagggctttgaaatggtaaagacaaaattgtcttgctggggtggatctgtggaaagggggttttattttactttgccaatgtattattttcaataagtaatacattcacatggttgagaattcgaactgaaaaagtatacgatgaacagacctttttccactcttgtgttcttgtctccacagaaaagcagtattattagtttcatgtgtagggggttgatgcttaatcagacatacacaatatatatgttggtatgtctgtttcatatatgtatgtatgcctattctaatatataaatatatgtatatcaacgtgcttttatttataaatatacagtgtatatatttatacatatacatgaatatatatataaaataggcaggccaggtggggtggctcacatctgttatctcagcactttgggagaccaaagtgggtggatcacctgaggtcaggagtttgagaccagcctgaccaacatggagaaaccccatctctactaaaaatacaaaattagccaggcatggtggcgcatgcctgtaaacccagctactcgggaggctgaggcaggagaattgcttgaacccaggaggcggaggttgcggtgagccgagatcctgggcaacaagaacgagattctgtctc

SEQ ID NO: 7688 - DNA, 606 bp, Homo sapiens
ggaggcggggtcgtttctgcgggattatttttccggagcctcttctgattgggtggtgtggcgcaatgcgcgcgaccctcaagataccaaactgtacgcatctctgaccctttcctctccttgctcctgctggtaaaccgaagcccaggagacttccagttccgcaagaaccgtgggcgacagttatggagaagcgtctgcaggaggctcagctgtacaaggaggaagggaaccagcgctaccgggaagggaagtaccgagatgctgtgagtaggtaccatcgagctctgcttcagctgcggggtctggatccgagtctgccctctccgttacctaatctcggacctcagggcccggccctcacgcctgaacaagaaaacatattgcataccacccagacagactgctataacaatctagctgcttgtctccttcagatggagcccgtgaactacgaacgagtgagagaatatagtcagaaagtcctggaacgacagcctgataatgccaaggccttgtatcgggccggagtggcctttttccatctgcaggactatgaccaggcccgccactacctcctggctgccgtgaataggcagcctaaag

SEQ ID NO: 7689 - DNA, 858 bp, Homo sapiens
cttcttgagaaaaagactgcagaaaggagaggtggggctttcagtagaaacaagcaaaccgcaggtccctgtggggggactctccaggaagaaggttccgcaagaaccgtgggcgacagttatggagaagcgtctgcaggaggctcagctgtacaaggaggaagggaaccagcgctaccgggaagggaagtaccgagatgctgtgagtaggtaccatcgagctctgcttcagctgcggggtctggatccgagtctgccctctccgttacctaatctcggacctcagggcccggccctcacgcctgaacaagaaaacatattgcataccacccagacagactgctataacaatctagctgcttgtctccttcagatggagcccgtgaactacgaacgagtgagagaatatagtcagaaagtcctggaacgacagcctgataatgccaaggccttgtatcgggccggagtggcctttttccatctgcaggactatgaccaggcccgccactacctcctggctgccgtgaataggcagcctaaagatgccaacgtccggcggtacctccagctgacacagtcagaactcagcagctaccatagaaaagagaagcagctctacctgggcatgtttggttaacaaagaagaaagatgctcctccagttgaacttaggtggaccattaaacatgcatgaaggagaaatctgagcctcagcaagagaaattaaccctatacctctgacccaggtggatttttgtttctagttctgcacaaacttcactacttagacagtctgagtctttttctgtctatccatctgtttatttctatacctttcaatacatgttattgttgcaga

SEQ ID NO: 7690 - DNA, 11777 bp, Homo sapiens
ttttgcagtagaagagtataaccatgtttcggaatagtctcaagatgctgcttactggtgggaaatcaagtcgtaaaaacaggtcaagtgatggagggagcgaggaaccaccggatcgaagacagtcaagtgtagactctcgccaaagccgctctgggcaaggtggcatctccacagaaagcgactgtgcttttgagccagactacgctgtcccgccacttccagtgagtgaaggtgatgctgaacaggagcttggcccccctccatctgtagatgaggcagcaaacacactcatgactcgtctgggtttcctccttggagagaaagtcacagaagttcagccaggtgaccaatacagcatggaagtacaggatgaaaatcagacctcagcaatcacccagcggataagtccttgttccactctgactagcagcactgcctctccaccagccagtagcccctgctctacactcccacccatcagtacaaatgcaactgccaaggactgcagctatggggctgttactagtccaacctctacccttgaaagcagagatagtggcatcattgctacattaacaagctattctgaaaatgtggaacgcacaaaatatgctggggaaagcagtaaagaattaggatctggaggaaacataaaaccttggcagtctcaaaaatccagcatggactcctgtttgtatcgagtagatgaaaacatgactgcttccacctatagtctgaataagatcccagagagaaatttggaaacagtgttatctcaatcagtacagtctattcctttgtatctcatgccacggccaaattcagtagcagccaccagctctgcccacttggaagaccttgcttacctggatgagcagagacatacacctttgagaacttctctacgaatgccaagacagagcatgggtggtgctcgcacacagcaggatttaagagttcgctttgcaccttataggcctccagatatctccttgaagcctctgctctttgaagtgcccagcatcactacagagtcagtgtttgttggccgagattgggttttccacgaaatagatgctcaacttcaaagttcaaatgccagcgtgaaccaaggagtagtgattgtgggaaacattggattcggcaaaactgccatcatctccagactggtggccctcagctgccatggtacaaggatgagacagatcgcctcagacagcccacatgcctcccccaaacatgtggatgccaacagagagctgccactcacacagccaccttcagcccactcatctatcaccagtggaagctgcccaggaactccggaaatgcgcaggcggcaggaggaggctatgcgaagactagcctcgcaggtggttgcctatcactattgtcaagcagataatgcctacacttgcttggtgccagaatttgtccacaatgttgctgccttgctctgccgctcacctcagctgacagcctatcgggagcagcttcttcgggaacctcacctgcagagcatgctgagccttcgttcctgtgttcaagaccccatggcctccttccggaggggagttctggagccactagaaaatctccataaagagagaaaaatcccagatgaagatttcatcattttaattgatggattaaatgaagcagaatttcacaaaccggattatggggatacaattgtatcgtttctgagtaaaatgatcggaaagtttccttcttggctcaaactaattgtaacagttaggaccagtttacaggaaattaccaagctgctgcctttccataggatttttttggatcgactagaagagaatgaagccatagaccaggacctgcaggcttacatcctgcaccggatacacagcagctcagagatccagaataacatttcacttaatggcaaaatggacaatactacatttggcaaactcagttctcatctcaagaccctcagtcaagggtcctatctatatctgaaacttacatttgacctcatagagaaaggctatctagtgttaaagagctctagctacaaagtagttcctgtttcgctctcagaggtttatttactccagtgcaatatgaagttcccaacccagtcttcctttgaccgggtgatgcctctcctgaatgtggcagtggcctctctccacccactgactgatgagcatatcttccaggccatcaatgctgggagcattgaaggcacactagaatgggaggattttcagcagagaatggagaacctctccatgttcctaatcaagcgcagagacatgactcgtatgtttgtacatccttcttttcgagaatggcttatctggagagaagaaggagagaaaaccaaatttctctgtgatccgaggagtggtcacacgttacttgccttctggttttcccgccaagagggaaaactaaaccgacagcagactattgaactgggacatcacatcctcaaagcacacatttttaagggtttgagtaaaaaagttggtgtatcatcctccatcctccaaggtctctggatctcttatagcacagaaggtctttccatggcactggcgtctttacgaaatctctacactccaaatataaaggtcagccgactgctgattttgggaggtgccaatattaattaccggacagaggttttaaataatgctccaattctatgtgttcagtcccatcttggttacacagaaatggtagccctgctgctggagttcggggccaacgtggatgcctcttctgaaagtggcctgactcccctgggatatgctgcagcagcagggtacctgagcattgtggtgctgctgtgcaagaaacgggccaaggtggatcatttggataagaacgggcagtgtgctttggttcatgctgcactccgaggtcatctggaggttgtcaagtttttgattcagtgtgactggacgatggccggccagcagcaaggagtatttaagaagagccatgccatccaacaggccctcattgctgcagccagcatgggttatactgagattgtctcctacctacttgatcttccagaaaaagatgaagaggaagtagagcgagcacagatcaacagctttgacagtctctggggagagacagccctaacagctgcagccggaaggggcaaactggaggtgtgccgtttgctcttggaacaaggggcggcagtggcccagccaaaccgccgaggagcagtgccactattcagcacagtgcgccagggccactggcagattgttgatcttttactcacccatggagctgatgtcaacatggcagacaagcagggccgcactcccctgatgatggctgcttccgaaggccatctaggaaccgtggactttctgcttgcacaaggtgcctccattgctcttatggacaaagaaggattgacagccctcagctgggcttgtttgaagggccatctctcagtagtacgttctctggtggataacggagctgccacagaccatgctgacaagaatggccgtaccccactggatctggcagctttctatggcgatgctgaggtggtccagttcctggtagatcatggggccatgatcgagcacgttgactacagtggaatgcgccctttggatagggcagtggggtgccggaacacttctgttgttgtcactcttctgaagaaaggagccaagataggttgtcagacgttaccgagtcgcccacgaggtccagccacatgggcgatggccacctccaagccagacatcatgatcatcctgttgagcaagctgatggaagagggggacatgttttataagaaaggtaaagtaaaggaagctgcccagcgctaccagtacgccctgaagaagttccctagagaagggtttggtgaggacttgaaaactttccgggaactaaaggtgtctctcctcctcaacctctctcggtgtcgcaggaaaatgaacgattttggaatggcggaggaatttgctactaaggccctggagctgaaaccgaaatcttatgaagcttactatgcgagagcaagggcaaaacgcagcagcagacagttcgcagcagccttagaggacctgaacgaggccatcaagctgtgtcccaacaaccgtgagatccagagacttctgctgagagtggaagaagagtgtagacagatgcagcagccacagcagccaccgccgccaccgcagcctcagcagcagttgccggaagaagcagaacctgagccacagcatgaagacatatactctgtacaggatatattcgaggaggagtacctggaacaggatgttgaaaatgtttccattggcctccagacagaggcccggcccagccaggggctcccggtcatccagagcccaccctcctctcccccgcatcgggactcagcctacatctccagctcacctcttggctctcatcaggtttttgacttccggtccagtagttctgtaggctctcccactagacagacctatcagtccacctcacctgccctttctccaactcatcagaactcacattacaggcctagcccaccacacacttccccggctcatcagggaggatcttaccgtttcagcccccctcctgtgggaggacagggcaaagaatacccaagccctcccccttcccctctccggagaggccctcagtatcgggccagccctccagctgaaagtatgagtgtctatagatcccagtctggttcacccgtgcgctatcagcaggaaacaagcgtcagtcagcttcctggcagacccaaatctccattatccaaaatggcccagcggccctaccagatgcctcagctccctgtggcagttccccagcaagggctcaggctacagcctgccaaggcccagattgtgagaagtaaccagcccagcccagccgtccattcaagcaccgtcatccccacaggagcctatggccaagtagcccattcaatggccagtaaataccagtcttcacaaggagacataggagtcagccagagccggttggtttatcaagggtcaattgggggaatcgtaggggatggaaggccggtgcagcatgtccaagccagcctgagtgcaggcgccatctgtcagcatggaggattgaccaaagaggatcttccacagcgaccttcctcagcataccgaggtggcgtgagatacagccagacaccacagatcggacgcagccagtcagcatcctattacccagtctgtcactcaaaactagatctggagcgctcctccagccaactaggttcccctgatgtgtcgcatttaatcagaagacctatcagtgtcaaccctaacgaaatcaaaccgcacccgccaactcccaggccgttgctgcattcccaaagtgtaggccttcgcttctctccatctagcaatagtatctcctccacctccaacctaactccgaccttccggccatcttcttccatccagcaaatggagatcccactgaaacctgcatatgagaggtcatgtgacgagctgtcgccagtgtctccaactcaaggaggttaccccagtgagcccacccgatccaggaccacaccattcatggggatcatagataaaacagcacggactcagcagtacccccacctccaccagcagaatcggacctgggcagtgtcatctgtggacaccgtcctcagtcccacgtctccaggcaacctgcctcagcctgagtccttcagtccaccatcatccatcagcaacattgccttttataacaaaaccaacaatgcacagaatggccatttgctggaggacgattattacagcccccatgggatgctggctaacgggtctcgtggagacctcttggagcgagtcagccaggcctcctcctatcccgacgtgaaggtagctcggactctacctgtggctcaggcataccaggacaacctgtacaggcagctgtcccgagactctcggcaagggcagacatcccctatcaaaccaaagagaccgttcgtggagtctaatgtttaaaagacgttttgttggagtgagacccatatgttttcactgcacattttcaggcttggtttccacattcgaggtagttctctggcttaatttctcatgtagtttctgtgtggtgttcagaggtggcagcccacatgctgaaatcctttgcatgcagccgactgggaagcggcctcccgggagccaggacttcagtttctcttgtctgtgcccagccacatgctctctccctctcttcagatgccaacgaggagattttcgtgctgtgtgctttaacccagggagatcagacacactggtcagctttttccaggagacaatcgctttcactgatgttcttgttgtgtaattgtctttttccttttttaaaaaataaggtgttcttgttcgttttcttctagaaactttagaaagagtgcgatgcccctttgcctttgcatccttagccagtgtcacccacacagccagccgcagcgcattctcatgctgtggcccctccccagaccgccagcgccctgcagccaccaggtctgcagtgtgcattaggattattgctggtcttcctagggggtaaaaggatcagagagagaagaattaagtgctaaattggaagaaaaccccaatataattatgtaaaatgtcactacattgattttccaagaggcattgtaggaacatgtcaaaaacagccagccctttaaatattgcagtcagccaaggaaattagatgagaattgtggctattaagagaattcactgagagttattctctagatttttagccgacaattaaccactaaaagctgctgcttttccagggtgggggagggaatgaatacatagaaaaacaaaaaagattgttctggattctcagtgaaaggctataggaagtctgttctggagacatctactttttagatcctgatacatcactgagtgtcatactccactaaaaggaaactctaaccgaaggctggctggtgtgacaatcccgttagttggatcttcacctacagccagattttgttctagtggccctcttcctgtaaacccagatggtgtcatacagaaattgtttctttcagaagcagattggaatctcttgggaccatgagactgagtcccaatatttccacccagggtcatgcccgttgttgtctacttccattttgagatctatagtttgattatctattattacaggaactgtttcttttctttttctaggagtgtttatgagagtgtgatattttaaagtcagacgcagcaaaaactgtttcagggtgaagaaagacccctttcagccctgttttgcagccctgggtgggggcatgagatagacagcaagcttctgatcttgaagcttgtctagaagacacatcttctaggtctcgtggtcatttggtaggctgacctttgagtgagcgaggccactattgagtggatagcaagaacattggaaccaaagcctcggcacaggcctggcactggctgtacatcagctcttacaactaaacaactcaactaagcaactgaaacgaaacaaaggagcattcgttctctgttgttaggaatcattctgctctgttagggaagggctgcaggaagggcagtttcctgaataaaaatctggctgcgaccagtcccatgtgtctggtaagtaagtaagtaagtaagtgccctttgaagggatcattaagacacagggagcatgaacctgagatcagaagcatttctttactaatttagattctgcgaaatagacggacctctccacccccaaacctaaaacaggccaggacttgtctctgtgctgaaagcaaatagcaagactaactcaagccccagcctctttccacactccctgatacctaaggactgctttctcagctagaccagggtgggcatcagcgacgccttctcagctagaccagggtaggcatcagcgtcctctctccatctctatacccctctctctcacatcaggaagatgaaatgtgtagctctagcggcaacctctagccaggagcccagtggcctctcagattgctttttggccaggtctcagcactgctggcatctttacatcttactccttaaaaccgcctctcgctgaggagccactgcattttgaagaatttctcagtgtctgtcaggaaagtgctcctgctcatttggaacgccacacaccacccgcactcacctgtccaggcgaatgagcaggtcctgtagctttacaaatatgccgctgatgccgcttctccccagggtctctcagttttccaggacaaaaagatttagggcctataccctatgggcaaaacacctaaaatgtcaacagtcaaaatgccattctttttggccatcataagagggagtaggtatcactgctgcatgccagttgtttttgactagaatatgccaaccagagcttgttggggcaggagacgtttttccttacaagcagactgcctgtgccctgtgccctgtttgctacttcactgccatggaatgatccgagtactgtatttcagagctgccccttccccagcagcaaacactcgctgagtccatgtctggcttcaggtgggaggaaatgtttcagatgaaacttactcaattcataccaccctgaaatggaggacagaggtgacaaacttcagtttaataggtttctcaccaagttgtatgttccattggcccaggattcttgcactaatgggtttctatcacatcatgtctataaatgggtgcactttactgtttgaatttgtaactgaagtactggatatttaagtgtgagtaatgtcttcattagaaaatagcagaaccgctcttgtcttttagtgtatttttcaagaaaaaaggaaaggaaagacatcaagcagtggatcacaacatttatagcacaagaaataacttgtatataagcatcaaaaagattaagaattttttaatatgaaaaatatttgcagtgattttaaagtgcttttccagcaatgttcttagggactcctgagacacggttactttatctactggatcagtaaggcacacaattaacaattaacaattaatgtttatttacaaagtaaagggaaaacctgtgtaacatgagaatttggcatgacaaaatggagaccattttgtatctgctgttgtatcttgtccgggttgcagacgtgcactattaaagtcccaagttaatagagcacaaacccttctcgctcctcccccatgtgcccctctttttagatgtgtataacttaaactcgatggctcaggaaaattccactaattagaatcatgtacagtaccccaggtcgttgtccagatatacaagtttgctaatgtagttaagcctggattattaaacacttttcctaaattattgtaaacagaacagcttagagaaaggtattctcagtccttaatattgtatagtagtttatgagcccctctctaaatattggtatttttatattccagagatgtacccaatagaaaaaattaaaaattaatcagtatctaatttaatatccataagtatttttccttagattttagtcacgtacagtgggctatgtggatgtcacttgtgcttcaccatagtttaccactaggtgtcactgtggctctgcactgcgcttgttttgtagcaaagaacagcggcatcccctcgggagagaggagctgcttccagggcaacaggcaagcgggctcagaggttcaggagaaggcaacagaggcctggaaggggtcttcgtgcatctgtgccagttgtgcaagacgaactctttgaacactacatgctttggacttcagccaggcagaggctggaagaaggttgaccagagctcccttgctctggtagagggatgggtacatggagaagccccttcttccccatgagcctccctcctgtcagttcctctcagcctccagcttttataactccagaagcgtcacagttgggtggtttgattcagagagagttatttttctactgcagaaatgccttggacaaaaccagtgctcactgaatctttgccacaaaatggaataggctatcccagggggcaagaggtgcccgcccctgtgcccagcctcctcttgatgctcccagtgcccagcagcctcgcacaccctgcctgtctgttcctgggctgcccatttctcaagaaaccgacctgcaaaggcagccggctgctgcctccacaccgagggctgtgcggtcctgctgctcgctcactgggaggtgcagctctttctcctcttcctctaggaattccagaccgaccatctaccatgactaacaacaatgaacaaagggcttaggggcaagagctacctgcaaagacgtgtcatggaacccttcaccatgcaatgccttgaactcagctctggctgctcccaagaaaaggtggctggctgggggcctggacacaagcacaatggggctggtggagccactgtgcagagctacttgaataatcactgggttttcatcaactccttttgtcatacagaccactcaagggctgaagtgttggtaaccttcatttcggtgtccaaagcctcacagcaggtgagccaccctgagatgcttgtggccacatggtggccacagtcagagctttgaaagtcagtaccaaatgaacgcataattggacaccaaaaatcaagtgttactttcatgtttcctcaccccatcatctcattgcctcctgctgactctgataccgacgctgagctgacttgccaggctgccgctggacgcgtagagatcaggccagcgccgcgctcatttttccaggtagacctactctgtggaacggaagtgccctagctgctttgtttttgtagcacttgctggctgaatttttcttttgctaatcgctaaccagaaagtctggttagagggggctcaactcaatccctttggtccccagcgccagacaagagttaattctggaaaattcagtacttgaatgtacctgccttattgcataccaatttactggggggaaaaaaaaagttaagagatgccggctccagatctccacttcattcacaggtgattttggaaatcctgtaagttacacttcctgttctggttttgttttgttttttgtttcctttggctgattcctgctgagtgaggccagttcctcatcaggctcagggcaggtgccttttcaggcgtggcctcctttccatctagcacagcatctttgtctctgttctgtctcctccaaatccaagatgattttaattagtacagacatgtacagtctacaattaaagagtgatttgtactaatatgattttgattcttcctcctctttgctgtcctttcaagacacttgctggaaaaagctttaatgcacttagttttcctttaggttttctatgactcagatgtaaaggactttctctgtacagtatattatccaatgcatgtttgttctctctcctgatatattgaacaccacacagttgtgaagccgtgcagtggggatgccccacaccccacagaggcatctacccctgtgtataaggaaagacattttcctttgctgtacttgcttgagcagttttattgtctgtacatgtgagctgtgtgagatagatgtgaaaagttcaaatgaatgcattttcctgccccatgtatacagattgtcatctgtacaaggaactgtatgtatgaaagcaaatgtacttatttataaatggctaacacttggaaaacca

SEQ ID NO: 7691 - DNA, 11747 bp, Homo sapiens
ttttgcagtagaagagtataaccatgtttcggaatagtctcaagatgctgcttactggtgggaaatcaagtcgtaaaaacaggtcaagtgatggagggagcgaggaaccaccggatcgaagacagtcaagtgtagactctcgccaaagccgctctgggcaaggtggcatctccacagaaagcgactgtgcttttgagccagactacgctgtcccgccacttccagtgagtgaaggtgatgctgaacaggagcttggcccccctccatctgtagatgaggcagcaaacacactcatgactcgtctgggtttcctccttggagagaaagtcacagaagttcagccaggtgaccaatacagcatggaagtacaggatgaaaatcagacctcagcaatcacccagcggataagtccttgttccactctgactagcagcactgcctctccaccagccagtagcccctgctctacactcccacccatcagtacaaatgcaactgccaaggactgcagctatggggctgttactagtccaacctctacccttgaaagcagagatagtggcatcattgctacattaacaagctattctgaaaatgtggaacgcacaaaatatgctggggaaagcagtaaagaattaggatctggaggaaacataaaaccttggcagtctcaaaaatccagcatggactcctgtttgtatcgagtagatgaaaacatgactgcttccacctatagtctgaataagatcccagagagaaatttggaaacagtgttatctcaatcagtacagtctattcctttgtatctcatgccacggccaaattcagtagcagccaccagctctgcccacttggaagaccttgcttacctggatgagcagagacatacacctttgagaacttctctacgaatgccaagacagagcatgggtggtgctcgcacacagcaggatttaagagttcgctttgcaccttataggcctccagatatctccttgaagcctctgctctttgaagtgcccagcatcactacagagtcagtgtttgttggccgagattgggttttccacgaaatagatgctcaacttcaaagttcaaatgccagcgtgaaccaaggagtagtgattgtgggaaacattggattcggcaaaactgccatcatctccagactggtggccctcagctgccatggtacaaggatgagacagatcgcctcagacagcccacatgcctcccccaaacatgtggatgccaacagagagctgccactcacacagccaccttcagcccactcatctatcaccagtggaagctgcccaggaactccggaaatgcgcaggcggcaggaggaggctatgcgaagactagcctcgcaggtggttgcctatcactattgtcaagcagataatgcctacacttgcttggtgccagaatttgtccacaatgttgctgccttgctctgccgctcacctcagctgacagcctatcgggagcagcttcttcgggaacctcacctgcagagcatgctgagccttcgttcctgtgttcaagaccccatggcctccttccggaggggagttctggagccactagaaaatctccataaagagagaaaaatcccagatgaagatttcatcattttaattgatggattaaatgaagcagaatttcacaaaccggattatggggatacaattgtatcgtttctgagtaaaatgatcggaaagtttccttcttggctcaaactaattgtaacagttaggaccagtttacaggaaattaccaagctgctgcctttccataggatttttttggatcgactagaagagaatgaagccatagaccaggacctgcaggcttacatcctgcaccggatacacagcagctcagagatccagaataacatttcacttaatggcaaaatggacaatactacatttggcaaactcagttctcatctcaagaccctcagtcaagggtcctatctatatctgaaacttacatttgacctcatagagaaaggctatctagtgttaaagagctctagctacaaagtagttcctgtttcgctctcagaggtttatttactccagtgcaatatgaagttcccaacccagtcttcctttgaccgggtgatgcctctcctgaatgtggcagtggcctctctccacccactgactgatgagcatatcttccaggccatcaatgctgggagcattgaaggcacactagaatgggaggattttcagcagagaatggagaacctctccatgttcctaatcaagcgcagagacatgactcgtatgtttgtacatccttcttttcgagaatggcttatctggagagaagaaggagagaaaaccaaatttctctgtgatccgaggagtggtcacacgttacttgccttctggttttcccgccaagagggaaaactaaaccgacagcagactattgaactgggacatcacatcctcaaagcacacatttttaagggtttgagtaaaaaagttggtgtatcatcctccatcctccaaggtctctggatctcttatagcacagaaggtctttccatggcactggcgtctttacgaaatctctacactccaaatataaaggtcagccgactgctgattttgggaggtgccaatattaattaccggacagaggttttaaataatgctccaattctatgtgttcagtcccatcttggttacacagaaatggtagccctgctgctggagttcggggccaacgtggatgcctcttctgaaagtggcctgactcccctgggatatgctgcagcagcagggtacctgagcattgtggtgctgctgtgcaagaaacgggccaaggtggatcatttggataagaacgggcagtgtgctttggttcatgctgcactccgaggtcatctggaggttgtcaagtttttgattcagtgtgactggacgatggccggccagcagcaaggagtatttaagaagagccatgccatccaacaggccctcattgctgcagccagcatgggttatactgagattgtctcctacctacttgatcttccagaaaaagatgaagaggaagtagagcgagcacagatcaacagctttgacagtctctggggagagacagccctaacagctgcagccggaaggggcaaactggaggtgtgccgtttgctcttggaacaaggggcggcagtggcccagccaaaccgccgaggagcagtgccactattcagcacagtgcgccagggccactggcagattgttgatcttttactcacccatggagctgatgtcaacatggcagacaagcagggccgcactcccctgatgatggctgcttccgaaggccatctaggaaccgtggactttctgcttgcacaaggtgcctccattgctcttatggacaaagaaggattgacagccctcagctgggcttgtttgaagggccatctctcagtagtacgttctctggtggataacggagctgccacagaccatgctgacaagaatggccgtaccccactggatctggcagctttctatggcgatgctgaggtggtccagttcctggtagatcatggggccatgatcgagcacgttgactacagtggaatgcgccctttggatagggcagtggggtgccggaacacttctgttgttgtcactcttctgaagaaaggagccaagataggtccagccacatgggcgatggccacctccaagccagacatcatgatcatcctgttgagcaagctgatggaagagggggacatgttttataagaaaggtaaagtaaaggaagctgcccagcgctaccagtacgccctgaagaagttccctagagaagggtttggtgaggacttgaaaactttccgggaactaaaggtgtctctcctcctcaacctctctcggtgtcgcaggaaaatgaacgattttggaatggcggaggaatttgctactaaggccctggagctgaaaccgaaatcttatgaagcttactatgcgagagcaagggcaaaacgcagcagcagacagttcgcagcagccttagaggacctgaacgaggccatcaagctgtgtcccaacaaccgtgagatccagagacttctgctgagagtggaagaagagtgtagacagatgcagcagccacagcagccaccgccgccaccgcagcctcagcagcagttgccggaagaagcagaacctgagccacagcatgaagacatatactctgtacaggatatattcgaggaggagtacctggaacaggatgttgaaaatgtttccattggcctccagacagaggcccggcccagccaggggctcccggtcatccagagcccaccctcctctcccccgcatcgggactcagcctacatctccagctcacctcttggctctcatcaggtttttgacttccggtccagtagttctgtaggctctcccactagacagacctatcagtccacctcacctgccctttctccaactcatcagaactcacattacaggcctagcccaccacacacttccccggctcatcagggaggatcttaccgtttcagcccccctcctgtgggaggacagggcaaagaatacccaagccctcccccttcccctctccggagaggccctcagtatcgggccagccctccagctgaaagtatgagtgtctatagatcccagtctggttcacccgtgcgctatcagcaggaaacaagcgtcagtcagcttcctggcagacccaaatctccattatccaaaatggcccagcggccctaccagatgcctcagctccctgtggcagttccccagcaagggctcaggctacagcctgccaaggcccagattgtgagaagtaaccagcccagcccagccgtccattcaagcaccgtcatccccacaggagcctatggccaagtagcccattcaatggccagtaaataccagtcttcacaaggagacataggagtcagccagagccggttggtttatcaagggtcaattgggggaatcgtaggggatggaaggccggtgcagcatgtccaagccagcctgagtgcaggcgccatctgtcagcatggaggattgaccaaagaggatcttccacagcgaccttcctcagcataccgaggtggcgtgagatacagccagacaccacagatcggacgcagccagtcagcatcctattacccagtctgtcactcaaaactagatctggagcgctcctccagccaactaggttcccctgatgtgtcgcatttaatcagaagacctatcagtgtcaaccctaacgaaatcaaaccgcacccgccaactcccaggccgttgctgcattcccaaagtgtaggccttcgcttctctccatctagcaatagtatctcctccacctccaacctaactccgaccttccggccatcttcttccatccagcaaatggagatcccactgaaacctgcatatgagaggtcatgtgacgagctgtcgccagtgtctccaactcaaggaggttaccccagtgagcccacccgatccaggaccacaccattcatggggatcatagataaaacagcacggactcagcagtacccccacctccaccagcagaatcggacctgggcagtgtcatctgtggacaccgtcctcagtcccacgtctccaggcaacctgcctcagcctgagtccttcagtccaccatcatccatcagcaacattgccttttataacaaaaccaacaatgcacagaatggccatttgctggaggacgattattacagcccccatgggatgctggctaacgggtctcgtggagacctcttggagcgagtcagccaggcctcctcctatcccgacgtgaaggtagctcggactctacctgtggctcaggcataccaggacaacctgtacaggcagctgtcccgagactctcggcaagggcagacatcccctatcaaaccaaagagaccgttcgtggagtctaatgtttaaaagacgttttgttggagtgagacccatatgttttcactgcacattttcaggcttggtttccacattcgaggtagttctctggcttaatttctcatgtagtttctgtgtggtgttcagaggtggcagcccacatgctgaaatcctttgcatgcagccgactgggaagcggcctcccgggagccaggacttcagtttctcttgtctgtgcccagccacatgctctctccctctcttcagatgccaacgaggagattttcgtgctgtgtgctttaacccagggagatcagacacactggtcagctttttccaggagacaatcgctttcactgatgttcttgttgtgtaattgtctttttccttttttaaaaaataaggtgttcttgttcgttttcttctagaaactttagaaagagtgcgatgcccctttgcctttgcatccttagccagtgtcacccacacagccagccgcagcgcattctcatgctgtggcccctccccagaccgccagcgccctgcagccaccaggtctgcagtgtgcattaggattattgctggtcttcctagggggtaaaaggatcagagagagaagaattaagtgctaaattggaagaaaaccccaatataattatgtaaaatgtcactacattgattttccaagaggcattgtaggaacatgtcaaaaacagccagccctttaaatattgcagtcagccaaggaaattagatgagaattgtggctattaagagaattcactgagagttattctctagatttttagccgacaattaaccactaaaagctgctgcttttccagggtgggggagggaatgaatacatagaaaaacaaaaaagattgttctggattctcagtgaaaggctataggaagtctgttctggagacatctactttttagatcctgatacatcactgagtgtcatactccactaaaaggaaactctaaccgaaggctggctggtgtgacaatcccgttagttggatcttcacctacagccagattttgttctagtggccctcttcctgtaaacccagatggtgtcatacagaaattgtttctttcagaagcagattggaatctcttgggaccatgagactgagtcccaatatttccacccagggtcatgcccgttgttgtctacttccattttgagatctatagtttgattatctattattacaggaactgtttcttttctttttctaggagtgtttatgagagtgtgatattttaaagtcagacgcagcaaaaactgtttcagggtgaagaaagacccctttcagccctgttttgcagccctgggtgggggcatgagatagacagcaagcttctgatcttgaagcttgtctagaagacacatcttctaggtctcgtggtcatttggtaggctgacctttgagtgagcgaggccactattgagtggatagcaagaacattggaaccaaagcctcggcacaggcctggcactggctgtacatcagctcttacaactaaacaactcaactaagcaactgaaacgaaacaaaggagcattcgttctctgttgttaggaatcattctgctctgttagggaagggctgcaggaagggcagtttcctgaataaaaatctggctgcgaccagtcccatgtgtctggtaagtaagtaagtaagtaagtgccctttgaagggatcattaagacacagggagcatgaacctgagatcagaagcatttctttactaatttagattctgcgaaatagacggacctctccacccccaaacctaaaacaggccaggacttgtctctgtgctgaaagcaaatagcaagactaactcaagccccagcctctttccacactccctgatacctaaggactgctttctcagctagaccagggtgggcatcagcgacgccttctcagctagaccagggtaggcatcagcgtcctctctccatctctatacccctctctctcacatcaggaagatgaaatgtgtagctctagcggcaacctctagccaggagcccagtggcctctcagattgctttttggccaggtctcagcactgctggcatctttacatcttactccttaaaaccgcctctcgctgaggagccactgcattttgaagaatttctcagtgtctgtcaggaaagtgctcctgctcatttggaacgccacacaccacccgcactcacctgtccaggcgaatgagcaggtcctgtagctttacaaatatgccgctgatgccgcttctccccagggtctctcagttttccaggacaaaaagatttagggcctataccctatgggcaaaacacctaaaatgtcaacagtcaaaatgccattctttttggccatcataagagggagtaggtatcactgctgcatgccagttgtttttgactagaatatgccaaccagagcttgttggggcaggagacgtttttccttacaagcagactgcctgtgccctgtgccctgtttgctacttcactgccatggaatgatccgagtactgtatttcagagctgccccttccccagcagcaaacactcgctgagtccatgtctggcttcaggtgggaggaaatgtttcagatgaaacttactcaattcataccaccctgaaatggaggacagaggtgacaaacttcagtttaataggtttctcaccaagttgtatgttccattggcccaggattcttgcactaatgggtttctatcacatcatgtctataaatgggtgcactttactgtttgaatttgtaactgaagtactggatatttaagtgtgagtaatgtcttcattagaaaatagcagaaccgctcttgtcttttagtgtatttttcaagaaaaaaggaaaggaaagacatcaagcagtggatcacaacatttatagcacaagaaataacttgtatataagcatcaaaaagattaagaattttttaatatgaaaaatatttgcagtgattttaaagtgcttttccagcaatgttcttagggactcctgagacacggttactttatctactggatcagtaaggcacacaattaacaattaacaattaatgtttatttacaaagtaaagggaaaacctgtgtaacatgagaatttggcatgacaaaatggagaccattttgtatctgctgttgtatcttgtccgggttgcagacgtgcactattaaagtcccaagttaatagagcacaaacccttctcgctcctcccccatgtgcccctctttttagatgtgtataacttaaactcgatggctcaggaaaattccactaattagaatcatgtacagtaccccaggtcgttgtccagatatacaagtttgctaatgtagttaagcctggattattaaacacttttcctaaattattgtaaacagaacagcttagagaaaggtattctcagtccttaatattgtatagtagtttatgagcccctctctaaatattggtatttttatattccagagatgtacccaatagaaaaaattaaaaattaatcagtatctaatttaatatccataagtatttttccttagattttagtcacgtacagtgggctatgtggatgtcacttgtgcttcaccatagtttaccactaggtgtcactgtggctctgcactgcgcttgttttgtagcaaagaacagcggcatcccctcgggagagaggagctgcttccagggcaacaggcaagcgggctcagaggttcaggagaaggcaacagaggcctggaaggggtcttcgtgcatctgtgccagttgtgcaagacgaactctttgaacactacatgctttggacttcagccaggcagaggctggaagaaggttgaccagagctcccttgctctggtagagggatgggtacatggagaagccccttcttccccatgagcctccctcctgtcagttcctctcagcctccagcttttataactccagaagcgtcacagttgggtggtttgattcagagagagttatttttctactgcagaaatgccttggacaaaaccagtgctcactgaatctttgccacaaaatggaataggctatcccagggggcaagaggtgcccgcccctgtgcccagcctcctcttgatgctcccagtgcccagcagcctcgcacaccctgcctgtctgttcctgggctgcccatttctcaagaaaccgacctgcaaaggcagccggctgctgcctccacaccgagggctgtgcggtcctgctgctcgctcactgggaggtgcagctctttctcctcttcctctaggaattccagaccgaccatctaccatgactaacaacaatgaacaaagggcttaggggcaagagctacctgcaaagacgtgtcatggaacccttcaccatgcaatgccttgaactcagctctggctgctcccaagaaaaggtggctggctgggggcctggacacaagcacaatggggctggtggagccactgtgcagagctacttgaataatcactgggttttcatcaactccttttgtcatacagaccactcaagggctgaagtgttggtaaccttcatttcggtgtccaaagcctcacagcaggtgagccaccctgagatgcttgtggccacatggtggccacagtcagagctttgaaagtcagtaccaaatgaacgcataattggacaccaaaaatcaagtgttactttcatgtttcctcaccccatcatctcattgcctcctgctgactctgataccgacgctgagctgacttgccaggctgccgctggacgcgtagagatcaggccagcgccgcgctcatttttccaggtagacctactctgtggaacggaagtgccctagctgctttgtttttgtagcacttgctggctgaatttttcttttgctaatcgctaaccagaaagtctggttagagggggctcaactcaatccctttggtccccagcgccagacaagagttaattctggaaaattcagtacttgaatgtacctgccttattgcataccaatttactggggggaaaaaaaaagttaagagatgccggctccagatctccacttcattcacaggtgattttggaaatcctgtaagttacacttcctgttctggttttgttttgttttttgtttcctttggctgattcctgctgagtgaggccagttcctcatcaggctcagggcaggtgccttttcaggcgtggcctcctttccatctagcacagcatctttgtctctgttctgtctcctccaaatccaagatgattttaattagtacagacatgtacagtctacaattaaagagtgatttgtactaatatgattttgattcttcctcctctttgctgtcctttcaagacacttgctggaaaaagctttaatgcacttagttttcctttaggttttctatgactcagatgtaaaggactttctctgtacagtatattatccaatgcatgtttgttctctctcctgatatattgaacaccacacagttgtgaagccgtgcagtggggatgccccacaccccacagaggcatctacccctgtgtataaggaaagacattttcctttgctgtacttgcttgagcagttttattgtctgtacatgtgagctgtgtgagatagatgtgaaaagttcaaatgaatgcattttcctgccccatgtatacagattgtcatctgtacaaggaactgtatgtatgaaagcaaatgtacttatttataaatggctaacacttggaaaacca

SEQ ID NO: 7692 - DNA, 918 bp, Homo sapiens
ccccgcgccccgaagagtcggccagccccgaactgccggagtaggggtgggaaccaaactttttcctgccccgggacagacacgtttacccaaggtccagcctagcccctaggcaccatgtcggacagtgatctaggtgaggacgaaggcctcctctccctggcgggcaaaaggaagcgcagggggaacctgcccaaggagtcggtgaagatcctccgggactggctgtacttgcaccgctacaacgcctacccctcagagcaggagaagctgagcctttctggacagaccaacctgtcagtgctgcaagatgaatttttagatgtgatctactggttccgacagatcattgctgtggtcctgggtgtcatttggggagttttgccattacgagggttcttgggaatagcaggattctgcctgatcaatgcaggagtcctgtacctctacttcagcaattacctacagattgatgaggaagaatatggtggcacgtgggagctcacgaaggaagggtttatgacctcttttgccttgttcatggtcatttggatcatcttttacactgccatccattatgactgatggtgtacagctcccaagtgctccctatccagtccaaaggaccctcttgattacagcacaggaacttgatcgttggggaaccccagccccttggaacttggaagacccgtgtttcctggaccgcgaatcagtgtgttgggcatcagtgttttctgcaagggttgtgacctgaaactttttaaaaaccacccacctttggggaagcatttctgaatttatccatcaccaaccatttcttcttggataccatcaagtaacagctattatttgccaagtggagctgtcatttaatttgatgcacctctggattcagatgaaacattaaattgtctt

SEQ ID NO: 7693 - DNA, 1650 bp, Homo sapiens
gagcaaactgcgcctgggcaaccagtcgggagggtgagtcccgcgcgcgacagaagcttctggcgcgaatggagaaccaagagtttctaagttcatctgcgccgtccgaggtgaccgatgggcaggtctcaacagaaatatccacttgctccgaagtcttccagaagcccattgtgctcaggattctcgacactcacagagagcttgaggagtccgaggatcccgagaaacacgagaatcccgaggaacccgaggaggtcagggagcaagaccagagagacgagtccgaggaatgtgatgagcctcatgagtcctatgagccccacgctccctatgcgccccacaagccccgggactcctatgcaccttacgaactccatgggccccatgcagcccccaaactcctcaaggcccgtgaaccccgccagctccgccacacccgtgagccccgcaagtcccgcgaggccaaggaaaccgagttgcttcccagcgccgcagtaatgatctccccctctctgatcaccagagccccgccacggcctcagctgtctttcctgggtgcaaatcctgtttcctgtgactttgtaaggaaatgtttttcttctaggaagagaaccccaaatctttcaaagcctaaaaagcaatggggaactccagacagaaaactgttttggggaaatcaagatcctattcgccctgtttcccagggtgctttgaaggctcagctgaccaaaagacttgagaaccttgcccagcccaaggaagtttcctgccactatgtacctaacagggctcaatactaccacagctgtggaagagagtctgtaatttgggagatcactcctcctgcattgtttagacaaccctccaaaaggatccagaggctgtcacagcccaatggattcaaaagacagtgtctactaaatagacccttcagtgataactcagcaagagattctcttcgaatctctgatccttctccccggatattacaactctcagtagccaaaggcacagacccaaactatcatccttcaaaaaaaatgcaaaccaagatttcactttctaccctgagtgcgattgcaactccaagaattatagagcttgcccacccaaggatcaagttagagggtctgtgctatgaaagacaaagaagtgaactgcccatccgtcctgtacctcctgctgccatgatagctaaacctagcccccgaacaatagctctagcgaagtccaagtctgttcatcaagattatctacctgaccgtgatgcccattggccagtatcttatgctactactcattccaaagcatcacctaggattcaggaactagctaatccaaataagagggctcctgtgcgtattgtgtattatgatccagatgtctttaaaaccaagccagctgctttgaaagcacagtgttctcaaaggatctgggagttgtcacaacctcttacacgttaaatacagaaagccacaacagtcagaccctggttatgtatctagaacacatattagatgacttagttccctgttgcggtactgtcagtttacattcaccccttgcttcccctcccacaaaatgagacctttagggaaaaccaccatgatcattaaatagcagttgttgctgttaacctgtcgctga

SEQ ID NO: 7694 - DNA, 1595 bp, Homo sapiens
ggctcccttccccctctgtgggtcccgcgaggagactctcgggctttgaggtgagacctgaagttccgctggccggtagtgtagcaggaaagggcaggtcctcccgggtcgtgagccagtagcctcctggggtggcaaggtgtagagaggggggcgttgaaaggacacccgctacccggcctgctttctaggggtctctttggattgaggacatcagcagcagtggaagggattttactggagacctgtcactgtcagagccttaaaatatcaccgacggggccttaatgtcaccgaggtagagagaaaagggcagtagccctagagactattgcgacacagtgtgcccctcataagtttttccagggaggggttctgtactgagttgacgccccaggagctgagcaccaggctttgcatccttgggaactcagcaaacgtttgttcagccaattgcaggtagcatggcccagggcttgattgaggtggagcgaaagttccttccagggcctggcacagaggagcggctgcaggagttggggggcaccctggagtaccgggtcaccttccgagacacctactatgacacccctgagctgagcctcatgcaggctgaccactggctgcgacgacgagaggatagtggatgggagctcaaatgtcctggagcagcaggtgtcttaggaccccacacggagtataaggaactcacagcggaacctacaattgtggcccaactctgtaaggtgtgcctgcacaggagacagcaccagccaagctgattgtgtatctacagcgtttccggcctcaagactatcagcgcctgctagaagtgaacagctccagagagaggccacaggagactgaagatcctgaccactgcctgggctaggggtgtcacttcctagaaggggaagggaactctgggtctaacggagtccactcctgggcccactgtgcctctcccctcagtgtcccttctgacagtgactcctctctctccagcgctgcctgtttcttccccctcctctaagctactcttccttgagccctccctggctgcttcctctcgctcatccgtcagatgcaatctgtgggccgcccctctcccctggccgctaagcagcctccattgatttccgctcgtgtttataggatttccacttagccgtgatcagtagttaagcacaggaaaatcccttgccaccccccctcccttggtcgatgccattgattctgccagcggctcctaaaccgccttacagctgagttagaagatgaggagaggcagcagggatttccctgccttgggatgtgggaaacagaagaaaagttgaggaaatggttgggaatcgctgttagaactctagaaattctaatctgactttgccactgtgcccagctctggcccagagggtagagtgcctcctgtggaagtttaggggcaaatttgttccctgacctggagagggttagaaagaaccaacagctgccccctccccgcccccgtgttgagacaggttctcaaggctcaggggaagatgcatacctcctatgtaagaatgctcttcccttgctgttattcatacacactt

SEQ ID NO: 7695 - DNA, 802 bp, Homo sapiens
attatgctcttcccaatgccagctggtgttcggacatgctgagcctgtaccaagaatttctggagaagactaagtctagcggctggatcaagctgccctccttcaagtccaacagagaccacatccggggactcaagctcccatctggactggcagtttcctcagacaaaggtgactgtcgcatcttcaccaggtgcatccaagtggaaggacaaggctttgagtatgtcatctttttccagccaacccagaagaagtcggtctgtcttttccaaccaggctcctacctggaggggcccccagggtttgctcacggcgggtccctggcagccatgatggacgagaccttttctaaaactgccttcctggctggagaggggctgttcacactaagtctcaacatcaggttcaaaaacttgatccccgtggactctctggttgtaatggacgtagaactggacaagattgaggaccagaagctttacatgtcctgcatcgcccacagcagttggaagaagagtctccccagtaacagtcactgtgcctgcaggagagccactgcctcccctgcctgcctcctgcctcctgcctcccctgcctgcctcctgcctcctgcctcccctgcctgcctcctgcctcccctgcctgcctcctgcctcctgcctcccctgcctgcctcctgcctcctgcctcccctgcctgcctgggacccatcaaagagcagggaggggtcctcaagcagcaattggtgaggcgagggaaaggacccttttctctgagtaaataaagtctcacagtccca

SEQ ID NO: 7696 - DNA, 1131 bp, Homo sapiens
gggctcacaaaacagctacttgatgacaccattggaattcaccccacatgtggggaggtgttcacgactttggaaatcacaaagtcgtcaggactagacatcactcagaaaggctgctgaggctaggcctgctgctgtttagttctccttgtcatattctcatttctctcaaagataagaatgctctcggataaaatgagcctgtgctcatgacagctgctctgttactcagggaccagtgcagggctgtcttacgacacttagatgagaaagtagacaaggaaagaggacagcagtgggcatctgccttgtggtcttgctgacagcgagaagcagtgggactgcttccttgacgccttagcttggagccccgttatgaggtcctctcagattgcagcgggatgtttcatgaaagcctagacccggaagaataggaggataggagactgcagcagctgacctctggaagccagagctggatgagggacctgagcgagaggagacttgggcagccggagctgaaagctgagcagcagatgccactggagcctgtgagggcacgattgagtgtggggctggcttgctgctgctcccacaccactgcagaggcgtcctctctggaacatggagacaaggtttttggacaggggtttcccagtcccctggaagagattaagagactactgaagatctccagggcactgcaagccagatctgtaccctccacccaggagaaggcaaaatgtctttctggagagcctgggcagccagaggggaaaggtcaagaaacctatcctggccctgggaaagtggagggtaaggcagagccagccatgagaaaggatgatgtttgcccaggcatgaaatgtatcagcggatgatctctcacatggaagaagccaaagcagctacacccaatggcttagcaataagaaacaccaaaccagacaaacaccactgctgctgggaaagggacctggcagaaggaaaaggctgttcagagagcagaggtatttcgtgtgagccttttagggcttcttgtctctttagaccacatgcacatattacttgtataaaataatgcaccagatacaaacaatgaaatacaagtgctgagttcgatagactcat

SEQ ID NO: 7697 - DNA, 738 bp, Homo sapiens
tcagattgcagcgggatgtttcatgaaagcctagacccggaagaataggaggataggagactgcagcagctgacctctggaagccagagctggatgagggacctgagcgagaggagacttgggcagccggagctgaaagctgagcagcagatgccactggagcctgtgagggcacgattgagtgtggggctggcttgctgctgctcccacaccactgcagaggcgtcctctctggaacatggagacaaggtttttggacaggggtttcccagtcccctggaagagattaagagactactgaagatctccagggcactgcaagccagatctgtaccctccacccaggagaaggcaaaatgtctttctggagagcctgggcagccagaggggaaaggtcaagaaacctatcctggccctgggaaagtggagggtaaggcagagccagccatgagaaaggatgatgtttgcccaggcatgaaatgtatcagcggatgatctctcacatggaagaagccaaagcagctacacccaatggcttagcaataagaaacaccaaaccagacaaacaccactgctgctgggaaagggacctggcagaaggaaaaggctgttcagagagcagaggtatttcgtgtgagccttttagggcttcttgtctctttagaccacatgcacatattacttgtataaaataatgcaccagatacaaacaatgaaatacaagtgctgagttcgata

SEQ ID NO: 7698 - DNA, 4320 bp, Homo sapiens
cgcagaaagtgccgccgctttggccactcagagcccccgggccgcggtcgtcgtacgcctgaaggcgggtcgtgccggcggccgctctagtctccgcctccgctcaggccggtcctccggggcttctcaatggtttcccggtggcctctcaatggttttcccggcggcccttgcgccgacgccaggagacttccggagcttggtgacgtcacgagcgagcttttctacccaaatacgcggcgggggaataggctcgagggcggtgagcagtgacaattgctaggcggagacagtgcagggaagagagaccttagaaaggatcaggactggcgggaggtatttaactgaaaggaatatctgcttcactgttgcaaccaaaccagatgccttcttccacttcaccagaccaaggagatgacctggagaactgcattttaagattttctgacctggatttaaaagatatgagtcttattaatcccagcagcagtcttaaagcagaattagatggcagtacaaaaaagaaatactcgtttgcaaagaaaaaggcctttgccctttttgtcaaaaccaaagaagttccaacaaaaaggagttttgaatgtaaagaaaaattgtggaaatgctgtcggcagctattcacagaccaaaccagcatccatagacatgtggcaacacaacatgctgatgaaatttatcaccagacagcttctattttaaagcaactggctgtgacattgagcacctcaaagagtctttcgtctgcagatgaaaagaaccctttaaaagagtgccttccacatagccatgacgtgtctgcttggctccctgatataagctgctttaaccctgatgagctgataagtggccagggcagtgaagaaggggaggtgctcctttattactgctaccatgacctggaggatccccaatggatctgtgcctggcagacagctctgtgtcagcacctgcacctcacaggcaagattcgaattgctgcagaaggaatcaatgggacagttggtggaagcaaattggctaccagactttatgtggaagtcatgctttccttcccattgtttaaggatgacctgtgtaaagatgattttaagaccagcaaaggaggagctcactgttttccagaattgcgtgttggtgtatttgaagaaatcgtgcccatggggatcagccccaaaaagatctcctacaagaagcctggaatccatttatccccaggtgaatttcataaagaagtagaaaagtttttatctcaggcaaatcaagaacaaagtgatactatccttcttgattgcagaaacttctatgaaagcaaaataggacgattccaaggctgcttagccccagacatcaggaaattcagttacttccctagctacgttgacaaaaatctagaacttttcagagagaagagagtgctgatgtactgtaccgggggcatccgctgtgagcggggttcagcctacctcaaagccaagggagtgtgcaaggaggtgttccagctcaagggtggcatccacaagtacctggaagagtttcctgatggcttttacaaagggaagttgtttgtttttgatgaacgctatgctctgtcctacaacagtgatgtggtgtcagagtgttcatactgtggagcccgctgggaccagtataaactctgctctactccccagtgccgccagctcgttttgacctgccctgcctgtcaaggacaaggattcacagcctgttgtgtcacatgtcaagacaaggggagcaggaaagtttcaggccctatgcaagacagctttaaagaggaatgcgagtgcacagcccgacggccacgcatacctagggaactcttgcagcatgtgcgacagcctgtgagcccagagccagggcctgatgctgatgaggatgggccagtgcttatgtgagcagcacctttggcattttcccaggccctcggtaaaagtaggtttggggtgactatacagagaaagcatggcaagactgcagaaacagagaaatcgggaacttcagttctggccgctgccaccgtggcagccgtctacacttcacagcgggaggggaggagtcacgttgtctaccacttacctgagacattctgatttggatgatgctagagcacagaaaataggtgagctgcatgggatcccaaagctgctgagggatagagcctgagcctggtggccacagcatatgccctttctgttccatgcagctggggctgttagtagtcattgcccttgtcagcagaccttctaccctggtggcaaacacatgaaagctgtggccctgggagtggcctcctaaaacaagccacttaggtcatctgccatctacccttaacctctgtctctcgcctgaggggaatctgcaagctgtgcattgggcttacctcctgcttttgtagaaataaccatcctttggtatacatggaggatagttccagaacgcctgagtatacaaaaacccaatgcatactcaagtcccacagtgggccctacagaacccacgtatgtgataaatcagccctccatgtacgcaggtttcgccccctgccaatactgtattttcaacctgtatggttgaaaaaaatccatatataagtgcagccatgcagttcaaacccatattgttcaagggtcaactgtatagtttattgaacagccacacccattcctttacacatgatctatggcagagttgaatagttgcaacagacactatgtggcctgcaaaatcggaaatttttactgtctggccttttacagaaaagtttgccagcccctgatctagaccagcagctcatctgatagaggcagaggtggccttaaagatgtggccttcttcattttctgttggtttggtttcgtttctatgagagatttcctctgatagctctgctttccccagcacttactctctgagcttttaaatgttctctctgggagcttcatataagctcggtgacatttgagccacagtttttagatcagcacctggaatacatgacacattcttactgaggtcatccagcactgccatggtggctgcccagtcttctggccagtgtgccaggcacatgtccctgtcacacaggttccaagaaacacatacgcagccatgcatagaccaacagatttaatattatattgcagttttcagcgatgcagaatgcagctgcaattgtgttttaaggagaagccaaatggggatggttgtccctgcaacatggtgccactcctgggccatgtgcagcctcagtggacactcttccatagcgctgaggccctggccccgcctccagttaccctgtactgcccactgccttacagttcagtgcgcaggccttcaccttttcatcaccagcctctctgctcagtgctctggagttcttgaccttgtcctttatcatgagatttgctgaaatcactaatgaaaataactcccaaaagcaacaaacaaaaatattagtttaactggcactgtggtatattaaaaggcacaagggcattgtggcttaacacttttgctggatcccaagagacgcacatgatgttaaaaagagatctggcagcagtactaatactacatttcagtgtaatcatcttggggtggtttggccaggatttcccaattccttgatatctggagtttcttcaccattgtccggcatcctgcggaggcttaatatacaggcgtaaggtcagcagcaatttgtctaataagtgatgagatcagtagctgaagtctctaagctgggccattactaaataccatagccatgttgatctggaaatttatccctctagtgtcttacctcacataagccatttgcccactgtgcaatatagaaaggtgttttcaaaagtatttggccgtagattttcacatccatcataaggttggcattcaataaggaaaaagttctaactccagtattaaattgtacataaatcccaaatgttcttaaagaacactcagggacatgtttgttgcctgggattggtaatgaaaggttggtttttgaaacttgaaatttcaccattggtttttttcctatcatttctgcatatccagcaaaaggaatctcatgttgactcctggcagagttcagtggcttcagtctgtctatctgttctgaggggaaaattgtgttctggatccagtaatcaatttggcaactttaatcgaggttttcaaaattccaaggagggttaataaagaatgataatcagttttatttgctaatagctaagacaaatttgtaataaagtgttttataatacttcaaaa

SEQ ID NO: 7699 - DNA, 1540 bp, Homo sapiens
agtgggctacgaacgtctggcacacatgcaaccgccccctcgggctgcctccgcctgccggctacttctttctcccgccttccgctctatgtccttccggggccacgcagaaagtgccgccgctttggccactcagagcccccgggccgcggtcgtcgtacgcctgaaggcgggtcgtgccggcggccgctctagtctccgcctccgctcaggccggtcctccggggcttctcaatggtttcccggtggcctctcaatggttttcccggcggcccttgcgccgacgccaggagacttccggagcttggtgacgtcacgagcgagcttttctacccaaatacgcggcgggggaataggctcgagggcggtgagcagtgacaattgctaggcggagacagtgcagggaagagagaccttagaaaggatcaggactggcgggaggtatttaactgaaaggaatatctgcttcactgttgcaaccaaaccagatgccttcttccacttcaccagaccaaggagatgacctggagaactgcattttaagattttctgacctggatttaaaagatatgagtcttattaatcccagcagcagtcttaaagcagaattagatggcagtacaaaaaagaaatactcgtttgcaaagaaaaaggcctttgccctttttgtcaaaaccaaagaagttccaacaaaaaggagttttgaatgtaaagaaaaattgtggaaatgctgtcggcagctattcacagaccaaaccagcatccatagacatgtggcaacacaacatgctgatgaaatttatcaccagacagcttctattttaaagcaactggctgtgacattgagcacctcaaagagtctttcgtctgcagatgaaaagaaccctttaaaagagtgccttccacatagccatgacgtgtctgcttggctccctgatataagctgctttaaccctgatgagctgataagtggccagggcagtgaagaaggggaggtgctcctttattactgctaccatgacctggaggatccccaatggatctgtgcctggcagacagctctgtgtcagcacctgcacctcacaggcaaggaatccatttatccccaggtgaatttcataaagaagtagaaaagtttttatctcaggcaaatcaagaacaaagtgatactatccttcttgattgcagaaacttctatgaaagcaaaataggacgattccaaggctgcttagccccagacatcaggaaattcagttacttccctagctacgttgacaaaaatctagaacttttcagagagaagagagtgctgatgtactgtaccgggggcatccgctgtgagcggggttcagcctacctcaaagccaagggagtgtgcaaggaggtgttccagctcaagggtggcatccacaagtacctggaagagtttcctgatggcttttacaaagggaagttgtttgtttttgatgaacgctatgctctgtcctacaacagtgatgtggtgtcaggtaggtcagcacaggctcagagcccaaactga

SEQ ID NO: 7700 - DNA, 584 bp, Homo sapiens
gaaaagaaccctttaaaagagtgccttccacatagccatgacgtgtctgcttggctccctgatataagctgctttaaccctgatgagctgataagtggccagggcagtgaagaaggggaggtgctcctttattactgctaccatgacctggaggatccccaatggatctgtgcctggcagacagctctgtgtcagcacctgcacctcacaggcaagattcgaattgctgcagaaggaatcaatgggacagttggtggaagcaaattggctaccagactttatgtggaagtcatgctttccttcccattgtttaaggatgacctgtgtaaagatgattttaagaccagcaaaggaggagctcactgttttccagaattgcgtgttggtgtatttgaagaaatcgtgcccatggggatcagccccaaaaagatctcctacaagaagcctggtatgcttgcttttagaagattgtgctttaattcacagggacaaaacttaatagacaaataagaaagctaggcactgtgatcagcagcagtcatgagtcctctctaaagcagctgtggggtggctaacacttggct

SEQ ID NO: 7701 - DNA, 1612 bp, Homo sapiens
gaaaaaggtagaattcttatgaatgtttcatgatcatgtatgtgtggttaacgcagatacatttggaagtcggttatcaaggttgctctccagctcaaggcctttgccctttttgtcaaaaccaaagaagttccaacaaaaaggagttttgaatgtaaagaaaaattgtggaaatgctgtcggcagctattcacagaccaaaccagcatccatagacatgtggcaacacaacatgctgatgaaatttatcaccagacagcttctattttaaagcaactggctgtgacattgagcacctcaaagagtctttcgtctgcagatgaaaagaaccctttaaaagagtgccttccacatagccatgacgtgtctgcttggctccctgatataagctgctttaaccctgatgagctgataagtggccagggcagtgaagaaggggaggtgctcctttattactgctaccatgacctggaggatccccaatggatctgtgcctggcagacagctctgtgtcagcacctgcacctcacaggcaaggaatccatttatccccaggtgaatttcataaagaagtagaaaagtttttatctcaggcaaatcaagaacaaagtgatactatccttcttgattgcagaaacttctatgaaagcaaaataggacgattccaaggctgcttagccccagacatcaggaaattcagttacttccctagctacgttgacaaaaatctagaacttttcagagagaagagagtgctgatgtactgtaccgggggcatccgctgtgagcggggttcagcctacctcaaagccaagggagtgtgcaaggaggtgttccagctcaagggtggcatccacaagtacctggaagagtttcctgatggcttttacaaagggaagttgtttgtttttgatgaacgctatgctctgtcctacaacagtgatgtggtgtcaggtaggtcagcacaggctcagagcccaaactgaaatgaagcacattgtcagttcactattctagaaaaatgacacagggaagacaggccagtgctcattactgagcactgaataagcagggaaaataagtacattgtgccaccattttcccagctgtggagctgagagaaccctagcccaggagtcaggaggcctgggttgggatcctggcttcaccattgctagctggacaagcccattaacatggggatcatctcacctgccctgcctgcctgtctacctgccaagagctgtactactgggctaattcagggctcttaacctggaattggtacatagatttcagggattctgtgaatttggatggaaaaataattgtatctttgttttcaataacacctcactaaaatgaagcatttcctttagttatgaatgtaggcaacaaagtaccagttgtattaatgtacctgtgactttgtcttcagtaggattcacaatactttcatatcatgttctagttgcctcagatatctcaaaatagtatttatactcatcactgcttcaaaatgaaaatagttattaggcccaccactaagagttgatatataatgtgttaataaatggcacgtcttattatatattacagattttgaaaaaga

SEQ ID NO: 7702 - DNA, 2544 bp, Homo sapiens
aattgctaggcggagacagtgcagggaagagagaccttagaaaggatcaggactggcgggaggtatttaactgaaaggaatatctgcttcactgttgcaaccaaaccagatgccttcttccacttcaccagaccaaggagatgacctggagaactgcattttaagattttctgacctggatttaaaagatatgagtcttattaatcccagcagcagtcttaaagcagaattagatggcagtacaaaaaagaaatactcgtttgcaaagaaaaaggtagaattcttatgaatgtttcatgatcatgtatgtgtggttaacgcagatacatttggaagtcggttatcaaggttgctctccagctcaaggcctttgccctttttgtcaaaaccaaagaagttccaacaaaaaggagttttgaatgtaaagaaaaattgtggaaatgctgtcggcagctattcacagaccaaaccagcatccatagacatgtggcaacacaacatgctgatgaaatttatcaccagacagcttctattttaaagcaactggctgtgacattgagcacctcaaagagtctttcgtctgcagatgaaaagaaccctttaaaagagtgccttccacatagccatgacgtgtctgcttggctccctgatataagctgctttaaccctgatgagctgataagtggccagggcagtgaagaaggggaggtgctcctttattactgctaccatgacctggaggatccccaatggatctgtgcctggcagacagctctgtgtcagcacctgcacctcacaggcaagattcgaattgctgcagaaggaatcaatgggacagttggtggaagcaaattggctaccagactttatgtggaagtcatgctttccttcccattgtttaaggatgacctgtgtaaagatgattttaagaccagcaaaggaggagctcactgttttccagaattgcgtgttggtgtatttgaagaaatcgtgcccatggggatcagccccaaaaagatctcctacaagaagcctggaatccatttatccccaggtgaatttcataaagaagtagaaaagtttttatctcaggcaaatcaagaacaaagtgatactatccttcttgattgcagaaacttctatgaaagcaaaataggacgattccaaggctgcttagccccagacatcaggaaattcagttacttccctagctacgttgacaaaaatctagaacttttcagagagaagagagtgctgatgtactgtaccgggggcatccgctgtgagcggggttcagcctacctcaaagccaagggagtgtgcaaggaggtgttccagctcaagggtggcatccacaagtacctggaagagtttcctgatggcttttacaaagggaagttgtttgtttttgatgaacgctatgctctgtcctacaacagtgatgtggtgtcagagtgttcatactgtggagcccgctgggaccagtataaactctgctctactccccagttggacactcttccatagcgctgaggccctggccccgcctccagttaccctgtactgcccactgccttacagttcagtgcgcaggccttcaccttttcatcaccagcctctctgctcagtgctctggagttcttgaccttgtcctttatcatgagatttgctgaaatcactaatgaaaataactcccaaaagcaacaaacaaaaatattagtttaactggcactgtggtatattaaaaggcacaagggcattgtggcttaacacttttgctggatcccaagagacgcacatgatgttaaaaagagatctggcagcagtactaatactacatttcagtgtaatcatcttggggtggtttggccaggatttcccaattccttgatatctggagtttcttcaccattgtccggcatcctgcggaggcttaatatacaggcgtaaggtcagcagcaatttgtctaataagtgatgagatcagtagctgaagtctctaagctgggccattactaaataccatagccatgttgatctggaaatttatccctctagtgtcttacctcacataagccatttgcccactgtgcaatatagaaaggtgttttcaaaagtatttggccgtagattttcacatccatcataaggttggcattcaataaggaaaaagttctaactccagtattaaattgtacataaatcccaaatgttcttaaagaacactcagggacatgtttgttgcctgggattggtaatgaaaggttggtttttgaaacttgaaatttcaccattggtttttttcctatcatttctgcatatccagcaaaaggaatctcatgttgactcctggcagagttcagtggcttcagtctgtctatctgttctgaggggaaaattgtgttctggatccagtaatcaatttggcaactttaatcgaggttttcaaaattccaaggagggttaataaagaatgataatcagttttatttgctaatagctaagacaaatttgtaataaagtgttttataatacttcaaaagc

SEQ ID NO: 7703 - DNA, 3076 bp, Homo sapiens
gtcccccctggaaaagggaacaatcaaagaggaaaagaccacttaacaagggggttgggaggtagttggccagctttggaatagctggtgagagagagaaactttcattaccatctagttaccacctgttctctagatgggaaaaagaaaaaaaaagtcagtaaatactggaagcagacagttaccagaagtcacccccacaaaaaaataagctgggtggtgggggtggtggttagttgttgttgctagaagacagaagacttactatttggaaaccttccccgggttccacaggatctacgagattctagtcagcaaagggagcaatgcctgtccacgtgtgtgtgaatgtatgtgtttataatgatggcttttccttcctccccagagtgttcatactgtggagcccgctgggaccagtataaactctgctctactccccagtgccgccagctcgttttgacctgccctgcctgtcaaggacaaggattcacagcctgttgtgtcacatgtcaagacaaggggagcaggaaagtttcaggccctatgcaagacagctttaaagaggaatgcgagtgcacagcccgacggccacgcatacctagggaactcttgcagcatgtgcgacagcctgtgagcccagagccagggcctgatgctgatgaggatgggccagtgcttatgtgagcagcacctttggcattttcccaggccctcggtaaaagtaggtttggggtgactatacagagaaagcatggcaagactgcagaaacagagaaatcgggaacttcagttctggccgctgccaccgtggcagccgtctacacttcacagcgggaggggaggagtcacgttgtctaccacttacctgagacattctgatttggatgatgctagagcacagaaaataggtgagctgcatgggatcccaaagctgctgagggatagagcctgagcctggtggccacagcatatgccctttctgttccatgcagctggggctgttagtagtcattgcccttgtcagcagaccttctaccctggtggcaaacacatgaaagctgtggccctgggagtggcctcctaaaacaagccacttaggtcatctgccatctacccttaacctctgtctctcgcctgaggggaatctgcaagctgtgcattgggcttacctcctgcttttgtagaaataaccatcctttggtatacatggaggatagttccagaacgcctgagtatacaaaaacccaatgcatactcaagtcccacagtgggccctacagaacccacgtatgtgataaatcagccctccatgtacgcaggtttcgccccctgccaatactgtattttcaacctgtatggttgaaaaaaatccatatataagtgcagccatgcagttcaaacccatattgttcaagggtcaactgtatagtttattgaacagccacacccattcctttacacatgatctatggcagagttgaatagttgcaacagacactatgtggcctgcaaaatcggaaatttttactgtctggccttttacagaaaagtttgccagcccctgatctagaccagcagctcatctgatagaggcagaggtggccttaaagatgtggccttcttcattttctgttggtttggtttcgtttctatgagagatttcctctgatagctctgctttccccagcacttactctctgagcttttaaatgttctctctgggagcttcatataagctcggtgacatttgagccacagtttttagatcagcacctggaatacatgacacattcttactgaggtcatccagcactgccatggtggctgcccagtcttctggccagtgtgccaggcacatgtccctgtcacacaggttccaagaaacacatacgcagccatgcatagaccaacagatttaatattatattgcagttttcagcgatgcagaatgcagctgcaattgtgttttaaggagaagccaaatggggatggttgtccctgcaacatggtgccactcctgggccatgtgcagcctcagtggacactcttccatagcgctgaggccctggccccgcctccagttaccctgtactgcccactgccttacagttcagtgcgcaggccttcaccttttcatcaccagcctctctgctcagtgctctggagttcttgaccttgtcctttatcatgagatttgctgaaatcactaatgaaaataactcccaaaagcaacaaacaaaaatattagtttaactggcactgtggtatattaaaaggcacaagggcattgtggcttaacacttttgctggatcccaagagacgcacatgatgttaaaaagagatctggcagcagtactaatactacatttcagtgtaatcatcttggggtggtttggccaggatttcccaattccttgatatctggagtttcttcaccattgtccggcatcctgcggaggcttaatatacaggcgtaaggtcagcagcaatttgtctaataagtgatgagatcagtagctgaagtctctaagctgggccattactaaataccatagccatgttgatctggaaatttatccctctagtgtcttacctcacataagccatttgcccactgtgcaatatagaaaggtgttttcaaaagtatttggccgtagattttcacatccatcataaggttggcattcaataaggaaaaagttctaactccagtattaaattgtacataaatcccaaatgttcttaaagaacactcagggacatgtttgttgcctgggattggtaatgaaaggttggtttttgaaacttgaaatttcaccattggtttttttcctatcatttctgcatatccagcaaaaggaatctcatgttgactcctggcagagttcagtggcttcagtctgtctatctgttctgaggggaaaattgtgttctggatccagtaatcaatttggcaactttaatcgaggttttcaaaattccaaggagggttaataaagaatgataatcagttttatttgctaatagctaagacaaatttgtaataaagtgttttataatacttcaaaagca

SEQ ID NO: 7704 - DNA, 1255 bp, Homo sapiens
caccttggtcacactccagagctcgcttcatccccacgagcggcacctgatctccagtgacggggagactgaggcctggcaaagaggacctgttgcctttgtgtaactggccccagcatgggggaggcattggccccagcatgggggaggcattgaccccaggcctgccaggcctggcagccacagcctggctaggtggaggttactgccttccgcaccactctggcttcctccccgtgcctgtgaagagctcggggcctgcttcctaatttgtaaacacggggcgtgtgtctcagtggctgtgagctagcgagggggtggcgagcgagccggctgcgcaggtcctgaggccccaggcctcattgttggccaacaggcagctgggggcgggctgcggccgctgattaaaggccgcctagagcagcctgtgtggcgacaggtgcccagaagcccaggaagccggtcagtgcccgccccagtcctcagggtttgtgcctctcgctcggacagtttgaggacttgctatccccgtgggaacatcaccatgtccgaggcaccccgggccgagacctttgtcttcctggacctggaagccactgggctccccagtgtggagcccgagattgccgagctgtccctctttgctgtccaccgctcctccctggagaacccggagcacgacgagtctggtgccctagtattgccccgggtcctggacaagctcacgctgtgcatgtgcccggagcgccccttcactgccaaggccagcgagatcaccggcctgagcagtgagggcctggcgcgatgccggaaggctggctttgatggcgccgtggtgcggacgctgcaggccttcctgagccgccaggcagggcccatctgccttgtggcccacaatggctttgattatgatttccccctgctgtgtgccgagctgcggcgcctgggtgcccgcctgccccgggacactgtctgcctggacacgctgccggccctgcggggcctggaccgcgcccacagccacggcacccgggcccggggccgccagggttacagcctcggcagcctcttccaccgctacttccgggcagagccaagcgcagcccactcagccgagggcgacgtgcacaccctgctcctgatcttcctgcaccgcgccgcagagctgctcgcctgggccgatgagcaggcccgtgggtgggcccacatcgagcccatgtacttgccgcctgatgaccccagcctggaggcctga

SEQ ID NO: 7705 - DNA, 3691 bp, Homo sapiens
actgcgcgggggcgggaccggggagctagctgcagactccacgttttgcaaagatcggttttgcctcagagtcaacaaactcttcagattggttccggtgtgtcctatgtttacaagtcagtggaaattaagcacaacacatataaattgaaaagtcaaataaggaaatgaattacctcccttgacggctctaattttacttggctaaagccaatttttaggttggcttgggcagaaaagtgaaaagagaatgctccactttaaccgatgtcatcatctgaaaaagataacacagaaatgtttttctagtatacatgttaaaacggataaacatgcacagcgatttctttcaagaacctttgcacttgcggaattgaggaagtcatggtattcaacccactctcttgttggagacaaaaatattatcctgatgggacctcctggtgctgggaaaacaacagtaggcagaataataggtcagaaactaggttgttgtgtcatagatgtggatgatgatatccttgaaaaaacctggaatatgagtgtgtctgaaaaattacaggatgttggtaatgagcaatttttagaagaggaaggaaaagctgtgttaaacttctctgcatctggaagtgtgatttcccttactgggtccaatccaatgcatgatgctagcatgtggcatctgaagaaaaatggaataattgtatacctggatgtacctctactagatctaatttgtcgtctaaaattaatgaagacagataggattgtaggtcagaattctggaacatctatgaaagacttacttaaatttagaagacagtattataagaagtggtatgatgctcgtgttttctgtgaaagtggggcttccccagaggaggtagctgacaaagtgctgaatgcaattaaaagataccaagatgtggactcggaaacattcatttcaacaagacacgtttggcctgaagactgtgaacagaaggtttcagcaaaattctttagtgaagctgtaattgaggggttggcttctgatggtggcctctttgttcctgcaaaggagtttccaaaattaagctgcggggagtggaaaagcctagtaggagcaacctacgtagaaagagcacagatactgttggaaagatgtatccatcctgcagacatacctgctgccaggttgggagaaatgattgaaactgcttatggggaaaactttgcctgctcaaaaattgctcctgtcaggcacctttcaggcaaccagttcatcctggagttgtttcatggaccaacaggatcatttaaagatttgtctttacagcttatgcctcatatttttgcacactgtatcccaccaagttgcaattatatgatacttgtagctacttcaggagacacagggagtgcagtcttaaatggttttagtcgtctaaataagaatgataagcaaaggatagctgtggttgcattttttcctgagaatggagtaagtgattttcaaaaagcacaaataattggcagtcagagagaaaatggatgggcagtgggtgttgagtcagattttgatttttgccagacagctataaaaagaatttttaatgattctgattttactggctttcttactgtggaatatggaacaatcttaagttcggctaactccataaactggggccgactacttccgcaggtagtttatcatgcttccgcatatcttgatcttgttagtcaaggatttatttcttttggaagcccagtcgatgtctgtattcccacaggaaactttggtaacattttagcagcagtgtatgccaaaatgatgggaatcccgattcgaaaatttatctgtgcctctaatcagaaccatgttttgactgattttataaaaacaggacattatgatctaagggaaagaaaactagcacaaaccttttcaccgtcaatagatattctcaaatcttcaaacctagaacgacatttacacttgatggctaataaagatggacagctaatgacagaattatttaatcgattagaaagtcagcatcatttccagatagaaaaggctctagttgagaaacttcagcaggattttgtagctgactggtgctctgagggagagtgcctagcagctattaactccacctataatacttcagggtatattttggatccacacactgctgttgcaaaagtggttgcagatagggtgcaagacaaaacttgccctgtgattatctcatctacagcccattactcaaagtttgcacctgctatcatgcaggctttaaagattaaagaaatcaatgagacttcatcaagtcagctctatttgctgggttcatacaatgcattacctccactgcatgaggctttattagagagaacaaaacagcaagagaagatggagtaccaggtctgtgcagctgatatgaatgtcttgaagagtcatgtggaacaacttgtccaaaatcaattcatatgaaagctttcagagtaaatttttttttctagctataagcatgcaataataaatctcaaacactgatttggagtacagtagcattttgtcttttatgtaaatatctctatatctgtttggaatttcaaaagtctgatctctagggctgacatgagaactccatgtcacctcctcagatctttaatctggaagtgacaaaaggtaacacagtgcacggacctttgagctatcatacttttgccttctgctcatgaggggtgtatcaatttccactcccacaccctcactgttatgtggaccaaaatgtctggtatactatttggcgattaaaatatttaagcccagttttcaggtactacatctgtaactagtgaatactctgttgattagaaagttaatttaccactcaaaatggctaacttgaatggaggaagtagtaaactcttctattaggatttgggccagtgttttttgtttgttttttggtgcagtttcagctcactgcaacctccgcctcccaggttcaagtgattctcctgcctcagcctcccaggtagctgggattacaggcatgcaacaccacacatggctaatttttttatttttaatagagatgaggtttcgccatgttttccaggctgatcttgaacctctgacctcaggtgatccatccacctcggcctcccaaagtgctaggattacaggcgtgagcctctgcacctggctagggccagtgtttttaaccctcctcaaattccattttggactacaactaatgtgtatctcacactgtccaaattaaagatgtactctgtccttcactctcctttggatgtgtacggttagggtgacgatgtttgaaaatcaacacataactgaaatccaggatgaaacagtaagcagaactacttagaagtgaatacagaaatgatctatttcaagaggaaggttttccaaaattaagagtacttgagtagtctcaataggagtgtatttgtagacagcagtttccctatattatttggagtcaattcttacgtaatttgttgtttatttcttcagtgaacattgtctttttctggcagctgaaactgcacacaactgatacacatatttaatttgtattcctttgtagtaatacattttaaccatgatttatgtttgtgaatttactggatgttttctttctgaattaaagattgtcaagaccaa

SEQ ID NO: 7706 - DNA, 3788 bp, Homo sapiens
actgcgcgggggcgggaccggggagctagctgcaggtacggtgctccgtctcctgtggaggctttagcggctcgtggacactgctcccccatttcctttcatttcccccgtcttctcagtgagatttccttgactccacgttttgcaaagatcggttttgcctcagagtcaacaaactcttcagattggttccggtgtgtcctatgtttacaagtcagtggaaattaagcacaacacatataaattgaaaagtcaaataaggaaatgaattacctcccttgacggctctaattttacttggctaaagccaatttttaggttggcttgggcagaaaagtgaaaagagaatgctccactttaaccgatgtcatcatctgaaaaagataacacagaaatgtttttctagtatacatgttaaaacggataaacatgcacagcgatttctttcaagaacctttgcacttgcggaattgaggaagtcatggtattcaacccactctcttgttggagacaaaaatattatcctgatgggacctcctggtgctgggaaaacaacagtaggcagaataataggtcagaaactaggttgttgtgtcatagatgtggatgatgatatccttgaaaaaacctggaatatgagtgtgtctgaaaaattacaggatgttggtaatgagcaatttttagaagaggaaggaaaagctgtgttaaacttctctgcatctggaagtgtgatttcccttactgggtccaatccaatgcatgatgctagcatgtggcatctgaagaaaaatggaataattgtatacctggatgtacctctactagatctaatttgtcgtctaaaattaatgaagacagataggattgtaggtcagaattctggaacatctatgaaagacttacttaaatttagaagacagtattataagaagtggtatgatgctcgtgttttctgtgaaagtggggcttccccagaggaggtagctgacaaagtgctgaatgcaattaaaagataccaagatgtggactcggaaacattcatttcaacaagacacgtttggcctgaagactgtgaacagaaggtttcagcaaaattctttagtgaagctgtaattgaggggttggcttctgatggtggcctctttgttcctgcaaaggagtttccaaaattaagctgcggggagtggaaaagcctagtaggagcaacctacgtagaaagagcacagatactgttggaaagatgtatccatcctgcagacatacctgctgccaggttgggagaaatgattgaaactgcttatggggaaaactttgcctgctcaaaaattgctcctgtcaggcacctttcaggcaaccagttcatcctggagttgtttcatggaccaacaggatcatttaaagatttgtctttacagcttatgcctcatatttttgcacactgtatcccaccaagttgcaattatatgatacttgtagctacttcaggagacacagggagtgcagtcttaaatggttttagtcgtctaaataagaatgataagcaaaggatagctgtggttgcattttttcctgagaatggagtaagtgattttcaaaaagcacaaataattggcagtcagagagaaaatggatgggcagtgggtgttgagtcagattttgatttttgccagacagctataaaaagaatttttaatgattctgattttactggctttcttactgtggaatatggaacaatcttaagttcggctaactccataaactggggccgactacttccgcaggtagtttatcatgcttccgcatatcttgatcttgttagtcaaggatttatttcttttggaagcccagtcgatgtctgtattcccacaggaaactttggtaacattttagcagcagtgtatgccaaaatgatgggaatcccgattcgaaaatttatctgtgcctctaatcagaaccatgttttgactgattttataaaaacaggacattatgatctaagggaaagaaaactagcacaaaccttttcaccgtcaatagatattctcaaatcttcaaacctagaacgacatttacacttgatggctaataaagatggacagctaatgacagaattatttaatcgattagaaagtcagcatcatttccagatagaaaaggctctagttgagaaacttcagcaggattttgtagctgactggtgctctgagggagagtgcctagcagctattaactccacctataatacttcagggtatattttggatccacacactgctgttgcaaaagtggttgcagatagggtgcaagacaaaacttgccctgtgattatctcatctacagcccattactcaaagtttgcacctgctatcatgcaggctttaaagattaaagaaatcaatgagacttcatcaagtcagctctatttgctgggttcatacaatgcattacctccactgcatgaggctttattagagagaacaaaacagcaagagaagatggagtaccaggtctgtgcagctgatatgaatgtcttgaagagtcatgtggaacaacttgtccaaaatcaattcatatgaaagctttcagagtaaatttttttttctagctataagcatgcaataataaatctcaaacactgatttggagtacagtagcattttgtcttttatgtaaatatctctatatctgtttggaatttcaaaagtctgatctctagggctgacatgagaactccatgtcacctcctcagatctttaatctggaagtgacaaaaggtaacacagtgcacggacctttgagctatcatacttttgccttctgctcatgaggggtgtatcaatttccactcccacaccctcactgttatgtggaccaaaatgtctggtatactatttggcgattaaaatatttaagcccagttttcaggtactacatctgtaactagtgaatactctgttgattagaaagttaatttaccactcaaaatggctaacttgaatggaggaagtagtaaactcttctattaggatttgggccagtgttttttgtttgttttttggtgcagtttcagctcactgcaacctccgcctcccaggttcaagtgattctcctgcctcagcctcccaggtagctgggattacaggcatgcaacaccacacatggctaatttttttatttttaatagagatgaggtttcgccatgttttccaggctgatcttgaacctctgacctcaggtgatccatccacctcggcctcccaaagtgctaggattacaggcgtgagcctctgcacctggctagggccagtgtttttaaccctcctcaaattccattttggactacaactaatgtgtatctcacactgtccaaattaaagatgtactctgtccttcactctcctttggatgtgtacggttagggtgacgatgtttgaaaatcaacacataactgaaatccaggatgaaacagtaagcagaactacttagaagtgaatacagaaatgatctatttcaagaggaaggttttccaaaattaagagtacttgagtagtctcaataggagtgtatttgtagacagcagtttccctatattatttggagtcaattcttacgtaatttgttgtttatttcttcagtgaacattgtctttttctggcagctgaaactgcacacaactgatacacatatttaatttgtattcctttgtagtaatacattttaaccatgatttatgtttgtgaatttactggatgttttctttctgaattaaagattgtcaagaccaa

SEQ ID NO: 7707 - DNA, 2774 bp, Homo sapiens
gtcggtgcctgagggaggccgcgatggcggccgaggccctggcggcggaggccgtggcgtcgcgcctggagcggcaggaggaggacatccgctggctgtggtcggaggtcgagcgcctgagggacgagcagctgaacgcgccctacagctgccaggcggaggggccgtgcctcacgcgggaggtggcgcagctccgggccgagaactgcgacctgcgccaccgcctgtgcagcctgcggctgtgcctcgccgaggagcggagccgccaggccacgctggagagcgcggagctagaggcggcgcaggaggccggcgcacagcctcctcctagtcaaagccaagacaaggacatgaaaaagaagaaaatgaaggaaagcgaggctgacagcgaggtgaagcatcaaccaattttcataaaagaaagattgaagctttttgaaatactgaagaaagaccatcagctcttacttgccatttatggaaaaaagggggatacaagcaacatcatcacagtaagagtggctgatgggcaaacagtgcaaggggaagtctggaaaacaacgccttaccaagtggctgctgaaattagtcaggaactggctgaaagcacggtaatagccaaagtcaatggtgaactgtgggacctggaccgcccattggaaggggactcttctctagagctgcttacatttgataatgaggaagctcaagctgtgtactggcactccagtgctcacattcttggggaggccatggagctttactatggaggccacctgtgctacggtccgcccattgaaaatggattttattatgacatgttcattgaagacagagcagtgtccagcacagaattgtcagccctggagaatatatgtaaagccatcataaaagaaaagcaaccttttgaaagactagaagtcagcaaggaaatcctcctggaaatgtttaagtacaataaatttaaatgccgcattctgaatgagaaagttaacactgcaactaccaccgtgtacaggtgcggtccattaattgacctttgcaaaggtccacatgtaagacacactggaaaaattaaaaccatcaaaatttttaagaattcctcaacatattgggagggcaatccggaaatggaaacattgcagaggatctatggaatatcctttcctgataacaagatgatgagagactgggaaaagttccaagaggaagcaaagaaccgagatcacaggaagatcgggaaggaacaagaacttttctttttccacgatttgagtcctggaagctgttttttccttcccagaggagccttcatttataatacgcttacagatttcatacgagaggaatatcacaaacgggacttcacggaggtgctctctcccaatatgtacaacagtaaactctgggaagcctcaggccactggcagcattacagcgagaacatgtttacctttgagattgaaaaggacacttttgccctcaaacccatgaattgtccagggcactgtctaatgtttgcccatcgtccacgatcttggagggaaatgcctattagatttgctgattttggagttctgcatagaaatgaactgtcggggactctcagcggcttgaccagagtgaggcgcttccagcaggacgatgctcacattttttgcacagtggagcagattgaagaagaaataaaggggtgtttgcagtttttgcaatctgtttactcaacatttggcttctcctttcaattaaacctgtcaacaaggccggaaaacttcctaggagagattgagatgtggaatgaggctgagaagcaactgcagaacagcttgatggactttggagaaccgtggaaaatgaacccaggagatggagcattttatggccctaaaattgacataaaaatcaaggatgctattggcagataccatcaatgtgctacaattcagctggacttccaactgcctattagatttaatctcacatatgttagtaaggatggggatgataagaagagacctgtgatcattcatcgagccattttgggatcagtggaaagaatgatagccattctttcagaaaactatggcggaaaatggcctttctggctatctcctcgtcaggtgatggtcatccctgtggggccaacttgtgaaaaatatgcacttcaggtatccagtgaattttttgaagaaggatttatggctgacgttgacttggatcacagttgtacactaaataagaaaatacgaaatgcacagctggctcagtataattttattttggaccggtttcttccttctgtgtggcaagaagcatggctgtagattcctgcatcatctcacaatatgggtcactagagagaacaaactttttacccacattccagaaagttctggctggctcgcatgggtctggtgtccactccttggctcatcagtggttggagaaaaggaaaagatagataatgctgtaaacgtgcgaacaagagacaacaaaattcatggagagattttagtaacttctgccattgataaactgaagaatctcaggaagacacggacactcaatgctgaggaggccttttgaagtccttccctgatatttgcttctgtgtaactttgttttgacccttaaaaatgtatttttcttaacatgttagtacttctacgactttggagccactgatgggtccactcatggcctcagctgagaaaggagacgatgaacgtgtagctgacatgcacgaagtttaatttactcatgtccacggggga

SEQ ID NO: 7708 - DNA, 5942 bp, Homo sapiens
atgtttccaaagagcaacctaacagtcacttgctgggtatggaggagcatgaggaagctctttctattgctttctctcttgctgtcccatgcagctcatttggaaggcaaaaaggataatcagttcatctggaaaccaggtccgtggggaaggtgtacaggagactgtggtcccggaggagtccagagtcgggcagtgtggtgttttcatgttgacgggtggacaagtcacctgtctaactgtggtgagagcaacaggcctccaaaggaaagaagttgtttccgagtttgtgactggcacagtgacctctttcagtgggaggtttctgactggcaccactgtgtgcttgttccttacgctcgcggtgaagtcaagcctcggactgcagagtgtgtgacggctcagcatggactgcagcaccggatggtgcgctgcattcagaagctgaaccgaactgtggttgcaaatgaaatatgcgaacactttgcccttcagcctcctacagaacaggcttgcctcattccttgtccccgggattgtgtagtatctgagttcttaccatggtccaactgtagcaagggatgtgggaagaaattgcagcatagaactcgcgcggtcatagctccccctctctttggtggtttgcaatgtccaaatctgactgagtcaagagcctgtgatgctcccatttcctgtcctcttggggaagaggaatatacatttagccttaaggttggaccatggagtaaatgcagactgcctcatcttaaagaaattaatccaagcggaagaactgttctggattttaactctgattcaaatgagcgagtcacctttaaacatcaaagttacaaagcacatcatcattcgaagtcttgggcaatagagataggttatcaaacccggcaggtttcgtgtacaagaagtgatggacaaaatgctatgttaagcctttgccttcaagattccttcccattgactgttcagtcctgcatcatgcccaaagactgtgaaacctcccagtggtcctcctggagcccctgctccaagacatgccgttcagggagtctcttgccaggatttaggagcaggagccggaacgtgaagcacatggctattggaggtggaaaggagtgtcctgaacttcttgagaaagaggcctgcattgttgaaggagaacttctgcagcaatgtcccaggtattcctggagaacttctgaatggaaagaatgccaagtctctctcctcctcgagcagcaggatccccactggcatgtgacgggacccgtgtgtggcggtgggatccagacccgggaggtgtactgtgcccagagcgtaccagcagctgccgcactgagggccaaggaagtctctagacctgtggaaaaggcattatgtgtgggacccgccccgttgccctctcagctctgcaatatcccttgctctacggactgcatagtatcttcctggtcagcctggggcctgtgcatccatgaaaactgtcatgatcctcaggggaaaaaaggatttagaacgaggcagcgccatgtcctcatggaatctacagggcctgcagggcattgccctcatttggtggagtctgttccttgtgaggatccaatgtgctaccgatggctggcatcagaagggatctgtttccctgatcatggaaaatgtggcctgggacatcgtattctgaaggccgtctgccagaatgaccgcggagaagatgtatcagggagtctttgcccagttccccctcctcctgagaggaagtcttgtgaaattccctgccgaatggactgtgtgctgagcgagtggacggagtggtcatcctgttcccagtcctgttcaaataaaaactcagatgggaaacagaccaggtcaagaactatcctggcactggctggggaaggtggaaagccatgtccccctagtcaggctctccaagagcatcgtttgtgtaatgaccattcctgtatgcagcttcactgggagacatcgccttggggcccttgttctgaggacacattggtaactgcccttaatgcaaccattggctggaatggagaagccacgtgtggtgtaggcattcagactcggagagtcttctgtgtcaagagtcacgtgggacaagtaatgaccaaaagatgtccagattctactcgacctgaaactgtgcgcccctgttttctcccatgcaaaaaagactgtattgtgactgctttcagtgagtggacaccctgcccaaggatgtgccaagcaggaaatgccacagtaaaacagtctcgatacagaatcatcatccaagaagcagccaatggaggccaggaatgcccagataccttatatgaggagagagagtgtgaagatgtttccttgtgtcctgtatatcggtggaagccacagaaatggagcccttgcatcttagtgccagagtctgtctggcagggaataacgggcagcagtgaagcctgtggaaaggggttacaaacaagagctgtctcatgcatctctgatgacaaccggtcagcagaaatgatggaatgcctcaagcagacaaacggcatgcctctccttgtgcaagaatgcacagtcccatgtcgagaagactgcaccttcactgcttggtccaagtttacgccctgctccacgaactgtgaagccacaaaaagtaggcggcgacagctcacagggaaaagcagaaagaaggagaaatgccaggattctgacctttaccctctagtggagacagaactatgtccttgtgatgaatttatatcccaaccttatggaaactggtcagattgcattcttccagaaggcagaagggagcctcaccgaggactgcgggtacaagcagacagcaaagaatgtggagaaggcctgcgctttcgagcagtagcctgttctgataaaaatggaagacctgttgacccctccttctgcagcagctctggttacattcaagaaaaatgtgtcattccctgcccatttgattgcaagttaagcgattggtctagttgggggtcttgcagttcatcttgtggaattggagtgagaattcgatccaaatggctaaaagaaaaaccttacaatggaggacgaccatgtcccaaactggatctcaagaatcagaatgctcaggtacatgaggcagtcccatgttacagtgagtgcaatcagtattcctgggttgtagaacactggtcttcatgcaaaatcaacaatgagctgaggtccctgcgctgtggaggaggaacacaatctaggaaaatcagatgtgtgaatactgcggatggtgaaggtggagcagtggatagcaacctgtgcaaccaggatgaaattcccccagaaacccagtcctgttctcttatgtgtcccaatgagtgtgtcatgtctgagtggggactttggagcaaatgcccacagtcatgcgatccccacacaatgcagagaagaactcgccacctgctaagaccatcactgaactcaaggacttgtgctgaagactcacaggtgcagccttgcctcctgaatgaaaattgcttccagttccagtacaatctaacagagtggagcacatgccagctgagtgaaaacgcaccctgtggtcaaggcgtcaggacccgcctgctaagctgtgtgtgcagtgatggcaagccagtcagcatggaccaatgtgagcagcataatttggagaagccccagagaatgagcattccctgcttggtggaatgcgtggtcaactgtcagctctcagggtggacggcttggacagagtgttcacagacctgtggccatggaggtcgaatgagccggactcgatttatcattatgccaacccaaggagaaggacggccatgccccacagagcttacccaggagaaaacctgcccagtgaccccctgctacagctgggtccttggcaactggtctgcatgtaaattggagggtggagactgtggggaaggagttcagatccgcagcctttcctgcatggtccacagtggttcaatatctcatgcagctggacgtgtcgaggatgcactgtgtggagaaatgccctttcaggacagcatcctgaagcagctgtgttctgtgccttgcccaggagactgccatttaacagaatggtcagagtggagcacatgtgaattaacctgcattgatggaagaagctttgagactgtgggccgccagtctagatcaaggacttttataattcagtcttttgagaaccaagacagctgcccccaacaggttctagaaacacgcccttgtacaggaggcaaatgttatcactacacatggaaagcaagtctttggaacaataacgaacgaactgtatggtgccagcgttcagatggcgttaatgtcacaggaggctgctcccctcaggcccgtcctgctgccattcggcagtgcattccagcctgcagaaaacctttctcctactgtacacagggtggagtctgtggttgtgagaagggctatacagagataatgaaatcaaatggtttcctggattactgcatgaaagtaccaggctcagaggataaaaaagctgatgtgaaaaacctttctgggaaaaacagacctgtgaattcaaaaatacatgatatttttaaaggatggtctcttcaaccacttgatccagatggccgagtaaaaatttgggtttatggcgtttcaggtggcgcttttctcatcatgattttcctaatatttacttcctaccttgtttgcaagaagccaaaaccacatcaaagcacacctccccaacagaagcctctgaccttagcctacgatggagacttagacatgtaatctgaaaaagaaatccaaatgtagacatcaactgccttaaccgctttctcttttgtagctctcagacttctcagttttttgaggaatctcaagatgtgatatattgggcagaatacaaatattgcaaaagtaatattgcctcaacttcatttggacatggagtcaaggattattaggtctgccattttgttttcaagttgtttgtgggtgtgttttatttttttggttttcccaagggacctgaaaacccttctcttcctgtttggaactgggaggaagaaaacatgatggaattcccacagacttgagtaaacttgatcttcagcagcataatgacaatccagaggaaaatacagtcaaggcatttactctaaatgacgagtctgacactgcattgttacgcactatattagtgcaaagtctttattcttcccatacttcaacactgagttttctagagtttactttggtttaaagactttcaaattggattgcctatttttcatgaacacagagagaatggattaccatttcagaaattctctgagtttttaacctttaaatattgtattttgttttgtagccaggggatgatggcgcttcatgggttgcagctactgaaaatagcagcgtgtgtgtaattgctggactagatgaaagctaggtcatttctgaagggaatgtgtactgaatgttagagtgtacaaatgaaatatgtggttaaattggagaatgaggtagattatttgattactaaaactgtattttaacaaaaacttatccatgtagatatagcattaaccacacacagttgtaattcagtttaatgatgacaaactctgcttttgtaatttcaattttcttatctgaatatttataaattcttctttcaaatttaattatctgacctcatttaatatacatcaaacaccgatcctgtttgtacaaagtcttgcttttataaggtttcaataatatctaaaacaacacattaaaaagctgagaccattttatgaagataattgtttgtaatcataggtgttgaaagtaaaaaggtgccatcttgtggtattgacttgtatttataacaaataaactgctcaagagactgc

SEQ ID NO: 7709 - DNA, 5849 bp, Homo sapiens
atgcataacacagcagatgaggtggttttgtatcacaaattagcaggtccgtggggaaggtgtacaggagactgtggtcccggaggagtccagagtcgggcagtgtggtgttttcatgttgacgggtggacaagtcacctgtctaactgtggtgagagcaacaggcctccaaaggaaagaagttgtttccgagtttgtgactggcacagtgacctctttcagtgggaggtttctgactggcaccactgtgtgcttgttccttacgctcgcggtgaagtcaagcctcggactgcagagtgtgtgacggctcagcatggactgcagcaccggatggtgcgctgcattcagaagctgaaccgaactgtggttgcaaatgaaatatgcgaacactttgcccttcagcctcctacagaacaggcttgcctcattccttgtccccgggattgtgtagtatctgagttcttaccatggtccaactgtagcaagggatgtgggaagaaattgcagcatagaactcgcgcggtcatagctccccctctctttggtggtttgcaatgtccaaatctgactgagtcaagagcctgtgatgctcccatttcctgtcctcttggggaagaggaatatacatttagccttaaggttggaccatggagtaaatgcagactgcctcatcttaaagaaattaatccaagcggaagaactgttctggattttaactctgattcaaatgagcgagtcacctttaaacatcaaagttacaaagcacatcatcattcgaagtcttgggcaatagagataggttatcaaacccggcaggtttcgtgtacaagaagtgatggacaaaatgctatgttaagcctttgccttcaagattccttcccattgactgttcagtcctgcatcatgcccaaagactgtgaaacctcccagtggtcctcctggagcccctgctccaagacatgccgttcagggagtctcttgccaggatttaggagcaggagccggaacgtgaagcacatggctattggaggtggaaaggagtgtcctgaacttcttgagaaagaggcctgcattgttgaaggagaacttctgcagcaatgtcccaggtattcctggagaacttctgaatggaaagaatgccaagtctctctcctcctcgagcagcaggatccccactggcatgtgacgggacccgtgtgtggcggtgggatccagacccgggaggtgtactgtgcccagagcgtaccagcagctgccgcactgagggccaaggaagtctctagacctgtggaaaaggcattatgtgtgggacccgccccgttgccctctcagctctgcaatatcccttgctctacggactgcatagtatcttcctggtcagcctggggcctgtgcatccatgaaaactgtcatgatcctcaggggaaaaaaggatttagaacgaggcagcgccatgtcctcatggaatctacagggcctgcagggcattgccctcatttggtggagtctgttccttgtgaggatccaatgtgctaccgatggctggcatcagaagggatctgtttccctgatcatggaaaatgtggcctgggacatcgtattctgaaggccgtctgccagaatgaccgcggagaagatgtatcagggagtctttgcccagttccccctcctcctgagaggaagtcttgtgaaattccctgccgaatggactgtgtgctgagcgagtggacggagtggtcatcctgttcccagtcctgttcaaataaaaactcagatgggaaacagaccaggtcaagaactatcctggcactggctggggaaggtggaaagccatgtccccctagtcaggctctccaagagcatcgtttgtgtaatgaccattcctgtatgcagcttcactgggagacatcgccttggggcccttgttctgaggacacattggtaactgcccttaatgcaaccattggctggaatggagaagccacgtgtggtgtaggcattcagactcggagagtcttctgtgtcaagagtcacgtgggacaagtaatgaccaaaagatgtccagattctactcgacctgaaactgtgcgcccctgttttctcccatgcaaaaaagactgtattgtgactgctttcagtgagtggacaccctgcccaaggatgtgccaagcaggaaatgccacagtaaaacagtctcgatacagaatcatcatccaagaagcagccaatggaggccaggaatgcccagataccttatatgaggagagagagtgtgaagatgtttccttgtgtcctgtatatcggtggaagccacagaaatggagcccttgcatcttagtgccagagtctgtctggcagggaataacgggcagcagtgaagcctgtggaaaggggttacaaacaagagctgtctcatgcatctctgatgacaaccggtcagcagaaatgatggaatgcctcaagcagacaaacggcatgcctctccttgtgcaagaatgcacagtcccatgtcgagaagactgcaccttcactgcttggtccaagtttacgccctgctccacgaactgtgaagccacaaaaagtaggcggcgacagctcacagggaaaagcagaaagaaggagaaatgccaggattctgacctttaccctctagtggagacagaactatgtccttgtgatgaatttatatcccaaccttatggaaactggtcagattgcattcttccagaaggcagaagggagcctcaccgaggactgcgggtacaagcagacagcaaagaatgtggagaaggcctgcgctttcgagcagtagcctgttctgataaaaatggaagacctgttgacccctccttctgcagcagctctggttacattcaagaaaaatgtgtcattccctgcccatttgattgcaagttaagcgattggtctagttgggggtcttgcagttcatcttgtggaattggagtgagaattcgatccaaatggctaaaagaaaaaccttacaatggaggacgaccatgtcccaaactggatctcaagaatcagaatgctcaggtacatgaggcagtcccatgttacagtgagtgcaatcagtattcctgggttgtagaacactggtcttcatgcaaaatcaacaatgagctgaggtccctgcgctgtggaggaggaacacaatctaggaaaatcagatgtgtgaatactgcggatggtgaaggtggagcagtggatagcaacctgtgcaaccaggatgaaattcccccagaaacccagtcctgttctcttatgtgtcccaatgagtgtgtcatgtctgagtggggactttggagcaaatgcccacagtcatgcgatccccacacaatgcagagaagaactcgccacctgctaagaccatcactgaactcaaggacttgtgctgaagactcacaggtgcagccttgcctcctgaatgaaaattgcttccagttccagtacaatctaacagagtggagcacatgccagctgagtgaaaacgcaccctgtggtcaaggcgtcaggacccgcctgctaagctgtgtgtgcagtgatggcaagccagtcagcatggaccaatgtgagcagcataatttggagaagccccagagaatgagcattccctgcttggtggaatgcgtggtcaactgtcagctctcagggtggacggcttggacagagtgttcacagacctgtggccatggaggtcgaatgagccggactcgatttatcattatgccaacccaaggagaaggacggccatgccccacagagcttacccaggagaaaacctgcccagtgaccccctgctacagctgggtccttggcaactggtctgcatgtaaattggagggtggagactgtggggaaggagttcagatccgcagcctttcctgcatggtccacagtggttcaatatctcatgcagctggacgtgtcgaggatgcactgtgtggagaaatgccctttcaggacagcatcctgaagcagctgtgttctgtgccttgcccaggagactgccatttaacagaatggtcagagtggagcacatgtgaattaacctgcattgatggaagaagctttgagactgtgggccgccagtctagatcaaggacttttataattcagtcttttgagaaccaagacagctgcccccaacaggttctagaaacacgcccttgtacaggaggcaaatgttatcactacacatggaaagcaagtctttggaacaataacgaacgaactgtatggtgccagcgttcagatggcgttaatgtcacaggaggctgctcccctcaggcccgtcctgctgccattcggcagtgcattccagcctgcagaaaacctttctcctactgtacacagggtggagtctgtggttgtgagaagggctatacagagataatgaaatcaaatggtttcctggattactgcatgaaagtaccaggctcagaggataaaaaagctgatgtgaaaaacctttctgggaaaaacagacctgtgaattcaaaaatacatgatatttttaaaggatggtctcttcaaccacttgatccagatggccgagtaaaaatttgggtttatggcgtttcaggtggcgcttttctcatcatgattttcctaatatttacttcctaccttgtttgcaagaagccaaaaccacatcaaagcacacctccccaacagaagcctctgaccttagcctacgatggagacttagacatgtaatctgaaaaagaaatccaaatgtagacatcaactgccttaaccgctttctcttttgtagctctcagacttctcagttttttgaggaatctcaagatgtgatatattgggcagaatacaaatattgcaaaagtaatattgcctcaacttcatttggacatggagtcaaggattattaggtctgccattttgttttcaagttgtttgtgggtgtgttttatttttttggttttcccaagggacctgaaaacccttctcttcctgtttggaactgggaggaagaaaacatgatggaattcccacagacttgagtaaacttgatcttcagcagcataatgacaatccagaggaaaatacagtcaaggcatttactctaaatgacgagtctgacactgcattgttacgcactatattagtgcaaagtctttattcttcccatacttcaacactgagttttctagagtttactttggtttaaagactttcaaattggattgcctatttttcatgaacacagagagaatggattaccatttcagaaattctctgagtttttaacctttaaatattgtattttgttttgtagccaggggatgatggcgcttcatgggttgcagctactgaaaatagcagcgtgtgtgtaattgctggactagatgaaagctaggtcatttctgaagggaatgtgtactgaatgttagagtgtacaaatgaaatatgtggttaaattggagaatgaggtagattatttgattactaaaactgtattttaacaaaaacttatccatgtagatatagcattaaccacacacagttgtaattcagtttaatgatgacaaactctgcttttgtaatttcaattttcttatctgaatatttataaattcttctttcaaatttaattatctgacctcatttaatatacatcaaacaccgatcctgtttgtacaaagtcttgcttttataaggtttcaataatatctaaaacaacacattaaaaagctgagaccattttatgaagataattgtttgtaatcataggtgttgaaagtaaaaaggtgccatcttgtggtattgacttgtatttataacaaataaactgctcaagagactgc

SEQ ID NO: 7710 - DNA, 1002 bp, Homo sapiens
atggtgcgctgcattcagaagctgaaccgaactgtggttgcaaatgaaatatgcgaacactttgcccttcagcctcctacagaacaggcttgcctcattccttgtccccgggattgtgtagtatctgagttcttaccatggtccaactgtagcaagggatgtgggaagaaattgcagcatagaactcgcgcggtcatagctccccctctctttggtggtttgcaatgtccaaatctgactgagtcaagagcctgtgatgctcccatttcctgtcctcttggggaagaggaatatacatttagccttaaggttggaccatggagtaaatgcagactgcctcatcttaaagaaattaatccaagcggaagaactgttctggattttaactctgattcaaatgagcgagtcacctttaaacatcaaagttacaaagcacatcatcattcgaagtcttgggcaatagagataggttatcaaacccggcaggtttcgtgtacaagaagtgatggacaaaatgctatgttaagcctttgccttcaagattccttcccattgactgttcagtcctgcatcatgcccaaagactgtgaaacctcccagtggtcctcctggagcccctgctccaagacatgccgttcagggagtctcttgccaggatttaggagcaggagccggaacgtgaagcacatggctattggaggtggaaaggagtgtcctgaacttcttgagaaagaggcctgcattgttgaaggagaacttctgcagcaatgtcccaggtattcctggagaacttctgaatggaaagaatgccaacaagtctttggaacaataacgaacgaactgtatggtgccagcgttcagatggcgttaatgtcacaggaggctgctcccctcaggcccgtcctgctgccattcggcagtgcattccagcctgcagaaaacctttctcctactgtacacagggtggagtctgtggttgtgagaagggctatacagagataa

SEQ ID NO: 7711 - DNA, 4122 bp, Homo sapiens
aggaacaggtaccaaggttgggtggaagaagctatatggctggagccagcttcaagggcttgaggagccaccgacaccacttccagaatggctgctatgctgcctctactggattcaggttgcagtcgggaggcggggcaggaggcggggcttgggcgggtatcactccacccctttcacgattgcagaccggccttaggacctggcgcagcacggaatgaggcttcgaggccggctaggggaggccgtcgctcatatccgacgtcaccagttcgcgccggcgatagacgaggacgccaacagcagcggagaaacgtttctctttcctctcagtttgcgcacaccatggcggcccctgcccagcagactactcagcctggcggcgggaagcgcaaaggcaaggctcagtatgtgctggccaagcgcgctcggcgctgcgacgctggcgggccccgtcagctagagcccgggctacagggcatcctcatcacctgcaatatgaacgagcgcaagtgcgtggaggaggcctacagcctcctcaacgaatacggcgacgacatgtatgggccagaaaagtttacagacaaggatcagcagccctctggaagtgagggagaggatgatgatgcggaggctgccttgaagaaagaagttggtgacattaaggcatctacagagatgaggttaagaagattccagtcagtggaaagtggagcaaataacgttgtcttcatcaggacacttgggatagagcctgagaaattggtgcatcatattctccaggatatgtacaaaaccaagaaaaagaagactcgagttattttgcgaatgttacccatctcaggcacatgcaaggcttttttagaagatatgaaaaaatatgcagaaacatttttggaaccctggtttaaagctccaaacaaagggacatttcagattgtgtacaaatctcgaaataacagtcatgtgaatagagaagaagttatcagagaattggcaggaatagtgtgcaccctcaattcagaaaataaagtggatctcaccaatccacagtacacagtggtagtagaaatcatcaaagctgtctgttgcctgagtgttgtgaaagattacatgttgtttagaaaatacaatctccaggaggtggtgaagagccctaaggatccgtcacagcttaactcaaagcagggaaatgggaaagaagctaaactggaatctgcggacaaatcagaccaaaacaacacagcagaaggaaaaaataaccagcaggtaccagagaatactgaggagctggggcagacaaaaccaacgtctaatccacaggtggtaaatgagggaggagccaaacctgaacttgcaagtcaagccacagaaggatccaagtcaaatgaaaatgacttctcataggaagtcatttggtgttggagctgacagtccagtgtcgcaattttggaaggcaagatgtgagagagacgagaaccattttaggcatagaactacagacatttctgaaaaggttggtgatgaagaacttcagtcttctgagtatacttcagtatactagtgcaacaagggacacaaagaaattctgtcttaataaagaaagctacttctcaagggtattatgtggactcagtccaagctctcctgtcccattgtgcattgtctgtgacatgcaacttacaaaactagcaattgtaacaataaatcacagccacttgacaagaaaggatattcattattttcaaatggcttttggactatcaaaaacagtaaggcttttgttcagaaatcacctttagtcaaaaggtttaagaagcaaattatttagtagcagaacttatctcaggaaaggaaaatatgcatggttggtgagaatctaataacattaaaatgctggggcaagatgcagtacaaagttgaagagactttattctcaataagttgatttactgatgatatgtcatatgatgcaaaaaaggttttgtgtcattaactgaaaagtagcagcttctctatccaggatgatgagtcaacaggtttcactaatatttgtcatgctgtagcatttgtaagatttgtaaatgatgaaattcaaagaaaactttttctattgctaggagcctgccagaacaaaggccaatatataatgttgtgacatcatatctgataaccagaggtctggtatctacactcctggtgccccatcagtggttgtctccataagtcattttgcgttattaaaaaaaaaaaaagaaatcctgatgttgacattatagcacactgctttctccacagagatgctgatatcaaaaacttgaagatacagtgaagttctgaataatgttacaaaactggttacctgtatcaaagacccatttatgcaaaaatgttaaaaaaaaaaaaaaacacccaaaacaaaaacctggacagacagcacataaacctcctgcaccatacagacatccagtggcttctcagaggaagcgttctctacaggatatttgaattgaaaggtgaattgccagagtacttacaataaaacagccagcttttgctgagtgctttggaaatgaaaaatgactacagaaagtagcctattttgcagacgtttttcatcacatgaacaaatggacaagtctctgaaaggttctggggaaaaaaatttttcttaaagcgacaagactcttagatctaaaaggaaactgacttgccaccttgccagaggaattcttgaaatgtttctgcagccacttggccttgaaaataaagggtgcaactctcaaatcttgttctaacccggctggaggaaccacaagacccaatgaaatagcattttctctccttttcccagcactagtatataacctatgaggaacccttgtctctgaatctgctcagcttgaaattttgtctctgaaggaagagaatgaactcagccctagtctgacagtcctagatttctgtgaaataagagtattcttcaacttagtgctcacactcacataccatgagggttctctgcaggggtttaggggtttcctgaatttgaaagttttttcaaggcctctttttgggtaaaacaattgaaaaggcagacaccaacaaagtctgcaaaattaactgtccagattaagaatattaaggagctgtaaaattagcttgtagaaatggacttatccttaagttttaaaaagttaggaaatcctaaaaatgttaggcttcctgcacaagtggctatgttcatttaatggctagtgaacatgggaatgtatttttatcctcctagctggtggttctgtttggtaaaccagactagaatgatttgagaggggcaaagagaataggcaggaccttccttctatagctttacatatttagaatgttaatacttaatgacattgaagttaccttgcaatgattgataagaggattattaatatcagttaggggaatagggaggataggattttggtgccttcttcagcagacttgctccaagacaaagattctattttgatagtgcaagacaaaaggactcggaagaaaattggccatatgcctacagagcatacaactctgtggaactaaattgtttttactttgtgaaagctgctattttacggaaagattttgattatacagtttgtttttaaattgtcttttatatttatttgtatttggtaagaatcggttgttacacaagctgttctttcccagttacaaaatcctgtgttcggttgtaacctgaactcattaaaagacttgttttcaggtttatcaactgtttattttcactgacatttgagcatgttattttataaatgacgggattccagggtaggaagtgctttttattccccttttgttttttcttttaaaaaattacgtcagttaaaaaaataaaaaaactgcagtcttatggtttagaaaacttgtttagctccatagaggaaagaatgttaaactttgtattttaaaacatgattctctgaggttaaacttggttttcaaatgttatttttacttgtattttgcttttggtacggccagaaatcgagcttgttttttcatagttcctgatattttcagaaaaatcaaaataaatttgttccctaaaaa

SEQ ID NO: 7712 - DNA, 4411 bp, Homo sapiens
gcagcacggaatgaggcttcgaggccggctaggggaggccgtcgctcatatccgacgtcaccagttcgcgccggcgatagacgaggacgccaacagcagcggagaaacgtttctctttcctctcagtttgcgcacaccatggcggcccctgcccagcagactactcagcctggcggcgggaagcgcaaaggcaaggctcagtatgtgctggccaagcgcgctcggcgctgcgacgctggcgggccccgtcagctagagcccgggctacagggcatcctcatcacctgcaatatgaacgagcgcaagtgcgtggaggaggcctacagcctcctcaacgaatacggcgacgacatgtatgggccagaaaagtttacagacaaggatcagcagccctctggaagtgagggagaggatgatgatgcggaggctgccttgaagaaagaagttggtgacattaaggcatctacagagatgaggttaagaagattccagtcagtggaaagtggagcaaataacgttgtcttcatcaggacacttgggatagagcctgagaaattggtgcatcatattctccaggatatgtacaaaaccaagaaaaagaagactcgagttattttgcgaatgttacccatctcaggcacatgcaaggcttttttagaagatatgaaaaaatatgcagaaacatttttggaaccctggtttaaagctccaaacaaagggacatttcagattgtgtacaaatctcgaaataacagtcatgtgaatagagaagaagttatcagagaattggcaggaatagtgtgcaccctcaattcagaaaataaagtggatctcaccaatccacagtacacagtggtagtagaaatcatcaaagctgtctgttgcctgagtgttgtgaaagattacatgttgtttagaaaatacaatctccaggaggtggtgaagagccctaaggatccgtcacagcttaactcaaagcagggaaatgggaaagaagctaaactggaatctgcggacaaatcagaccaaaacaacacagcagaaggaaaaaataaccagcaggtaccagagaatactgaggagctggggcagacaaaaccaacgtctaatccacaggtggtaaatgagggaggagccaaacctgaacttgcaagtcaagccacagaaggatccaagtcaaatgaaaatgacttctcataggaagtcatttggtgttggaggtgggtttctcacctggggctctacgagatgttgctggggctccaccttaaattgtgactaaaaacagttttttatttgtgtgctgcattatgctgttctcacagtagtgagcaatgattgcgcagccctgttaacagtttttttagggatctttcagcctttatggtattacgtagaggcagacccatgtgctgctgttgcaaagaggggaggataggagggggatgttggcctctcccaggctcctcttctgcagtgccagctgacttaagggagtgaactacctgtgaagtagaaaatcagagggaagttttcattctaaggaaggagtttttacatgccacagctcagctgtctgcctgccactttgttgtaaacattgcaaaaatgtggatcatgtaggttagaagtgaattgtttagtgaagtttttgtacttttgtgattttcttgtttatgtctgttttttttttttttttttaacatttgtgtgtaatatagctgacagtccagtgtcgcaattttggaaggcaagatgtgagagagacgagaaccattttaggcatagaactacagacatttctgaaaaggttggtgatgaagaacttcagtcttctgagtatacttcagtatactagtgcaacaagggacacaaagaaattctgtcttaataaagaaagctacttctcaagggtattatgtggactcagtccaagctctcctgtcccattgtgcattgtctgtgacatgcaacttacaaaactagcaattgtaacaataaatcacagccacttgacaagaaaggatattcattattttcaaatggcttttggactatcaaaaacagtaaggcttttgttcagaaatcacctttagtcaaaaggtttaagaagcaaattatttagtagcagaacttatctcaggaaaggaaaatatgcatggttggtgagaatctaataacattaaaatgctggggcaagatgcagtacaaagttgaagagactttattctcaataagttgatttactgatgatatgtcatatgatgcaaaaaaggttttgtgtcattaactgaaaagtagcagcttctctatccaggatgatgagtcaacaggtttcactaatatttgtcatgctgtagcatttgtaagatttgtaaatgatgaaattcaaagaaaactttttctattgctaggagcctgccagaacaaaggccaatatataatgttgtgacatcatatctgataaccagaggtctggtatctacactcctggtgccccatcagtggttgtctccataagtcattttgcgttattaaaaaaaaaaaaagaaatcctgatgttgacattatagcacactgctttctccacagagatgctgatatcaaaaacttgaagatacagtgaagttctgaataatgttacaaaactggttacctgtatcaaagacccatttatgcaaaaatgttaaaaaaaaaaaaaaacacccaaaacaaaaacctggacagacagcacataaacctcctgcaccatacagacatccagtggcttctcagaggaagcgttctctacaggatatttgaattgaaaggtgaattgccagagtacttacaataaaacagccagcttttgctgagtgctttggaaatgaaaaatgactacagaaagtagcctattttgcagacgtttttcatcacatgaacaaatggacaagtctctgaaaggttctggggaaaaaaatttttcttaaagcgacaagactcttagatctaaaaggaaactgacttgccaccttgccagaggaattcttgaaatgtttctgcagccacttggccttgaaaataaagggtgcaactctcaaatcttgttctaacccggctggaggaaccacaagacccaatgaaatagcattttctctccttttcccagcactagtatataacctatgaggaacccttgtctctgaatctgctcagcttgaaattttgtctctgaaggaagagaatgaactcagccctagtctgacagtcctagatttctgtgaaataagagtattcttcaacttagtgctcacactcacataccatgagggttctctgcaggggtttaggggtttcctgaatttgaaagttttttcaaggcctctttttgggtaaaacaattgaaaaggcagacaccaacaaagtctgcaaaattaactgtccagattaagaatattaaggagctgtaaaattagcttgtagaaatggacttatccttaagttttaaaaagttaggaaatcctaaaaatgttaggcttcctgcacaagtggctatgttcatttaatggctagtgaacatgggaatgtatttttatcctcctagctggtggttctgtttggtaaaccagactagaatgatttgagaggggcaaagagaataggcaggaccttccttctatagctttacatatttagaatgttaatacttaatgacattgaagttaccttgcaatgattgataagaggattattaatatcagttaggggaatagggaggataggattttggtgccttcttcagcagacttgctccaagacaaagattctattttgatagtgcaagacaaaaggactcggaagaaaattggccatatgcctacagagcatacaactctgtggaactaaattgtttttactttgtgaaagctgctattttacggaaagattttgattatacagtttgtttttaaattgtcttttatatttatttgtatttggtaagaatcggttgttacacaagctgttctttcccagttacaaaatcctgtgttcggttgtaacctgaactcattaaaagacttgttttcaggtttatcaactgtttattttcactgacatttgagcatgttattttataaatgacgggattccagggtaggaagtgctttttattccccttttgttttttcttttaaaaaattacgtcagttaaaaaaataaaaaaactgcagtcttatggtttagaaaacttgtttagctccatagaggaaagaatgttaaactttgtattttaaaacatgattctctgaggttaaacttggttttcaaatgttatttttacttgtattttgcttttggtacggccagaaatcgagcttgttttttcatagttcctgatattttcagaaaaatcaaaataaatttgttccct

SEQ ID NO: 7713 - DNA, 4117 bp, Homo sapiens
aggaacaggtaccaaggttgggtggaagaagctatatggctggagccagcttcaagggcttgaggagccaccgacaccacttccagaatggctgctatgctgcctctactggattcaggttgcagtcgggaggcggggcaggaggcggggcttgggcgggtatcactccacccctttcacgattgcagaccggccttaggacctggcgcagcacggaatgaggcttcgaggccggctaggggaggccgtcgctcatatccgacgtcaccagttcgcgccggcgatagacgaggacgccaacagcagcggagaaacgtttctctttcctctcagtttgcgcacaccatggcggcccctgcccagcagactactcagcctggcggcgggaagcgcaaaggcaaggctcagtatgtgctggccaagcgcgctcggcgctgcgacgctggcgggccccgtcagctagagcccgggctacagggcatcctcatcacctgcaatatgaacgagcgcaagtgcgtggaggaggcctacagcctcctcaacgaatacggcgacgacatgtatgggccagaaaagtttacagacaaggatcagcagccctctggaagtgagggagaggatgatgatgcggaggctgccttgaagaaagaagttggtgacattaaggcatctacagagatgaggttaagaagattccagtcagtggaaagtggagcaaataacgttgtcttcatcaggacacttgggatagagcctgagaaattggtgcatcatattctccaggatatgtacaaaaccaagaaaaagaagactcgagttattttgcgaatgttacccatctcaggcacatgcaaggcttttttagaagatatgaaaaaatatgcagaaacatttttggaaccctggtttaaagctccaaacaaagggacatttcagattgtgtacaaatctcgaaataacagtcatgtgaatagagaagaagttatcagagaattggcaggaatagtgtgcaccctcaattcagaaaataaagtggatctcaccaatccacagtacacagtggtagtagaaatcatcaaagctgtctgttgcctgagtgttgtgaaagattacatgttgtttagaaaatacaatctccaggaggtggtgaagagccctaaggatccgtcacagcttaactcaaagcagggaaatgggaaagaagctaaactggaatctgcggacaaatcagaccaaaacaacacagcagaaggaaaaaataaccagcaggtaccagagaatactgaggagctggggcagacaaaaccaacgtctaatccacaggtggtaaatgagggaggagccaaacctgaacttgcaagtcaagccacagaaggatccaagtcaaatgaaaatgacttctcataggaagtcatttggtgttggagctgacagtccagtgtcgcaattttggaaggcaagatgtgagagagacgagaaccattttaggcatagaactacagacatttctgaaaaggttggtgatgaagaacttcagtcttctgagtatacttcagtatactagtgcaacaagggacacaaagaaattctgtcttaataaagaaagctacttctcaagggtattatgtggactcagtccaagctctcctgtcccattgtgcattgtctgtgacatgcaacttacaaaactagcaattgtaacaataaatcacagccacttgacaagaaaggatattcattattttcaaatggcttttggactatcaaaaacagtaaggcttttgttcagaaatcacctttagtcaaaaggtttaagaagcaaattatttagtagcagaacttatctcaggaaaggaaaatatgcatggttggtgagaatctaataacattaaaatgctggggcaagatgcagtacaaagttgaagagactttattctcaataagttgatttactgatgatatgtcatatgatgcaaaaaaggttttgtgtcattaactgaaaagtagcagcttctctatccaggatgatgagtcaacaggtttcactaatatttgtcatgctgtagcatttgtaagatttgtaaatgatgaaattcaaagaaaactttttctattgctaggagcctgccagaacaaaggccaatatataatgttgtgacatcatatctgataaccagaggtctggtatctacactcctggtgccccatcagtggttgtctccataagtcattttgcgttattaaaaaaaaaaaaagaaatcctgatgttgacattatagcacactgctttctccacagagatgctgatatcaaaaacttgaagatacagtgaagttctgaataatgttacaaaactggttacctgtatcaaagacccatttatgcaaaaatgttaaaaaaaaaaaaaaacacccaaaacaaaaacctggacagacagcacataaacctcctgcaccatacagacatccagtggcttctcagaggaagcgttctctacaggatatttgaattgaaaggtgaattgccagagtacttacaataaaacagccagcttttgctgagtgctttggaaatgaaaaatgactacagaaagtagcctattttgcagacgtttttcatcacatgaacaaatggacaagtctctgaaaggttctggggaaaaaaatttttcttaaagcgacaagactcttagatctaaaaggaaactgacttgccaccttgccagaggaattcttgaaatgtttctgcagccacttggccttgaaaataaagggtgcaactctcaaatcttgttctaacccggctggaggaaccacaagacccaatgaaatagcattttctctccttttcccagcactagtatataacctatgaggaacccttgtctctgaatctgctcagcttgaaattttgtctctgaaggaagagaatgaactcagccctagtctgacagtcctagatttctgtgaaataagagtattcttcaacttagtgctcacactcacataccatgagggttctctgcaggggtttaggggtttcctgaatttgaaagttttttcaaggcctctttttgggtaaaacaattgaaaaggcagacaccaacaaagtctgcaaaattaactgtccagattaagaatattaaggagctgtaaaattagcttgtagaaatggacttatccttaagttttaaaaagttaggaaatcctaaaaatgttaggcttcctgcacaagtggctatgttcatttaatggctagtgaacatgggaatgtatttttatcctcctagctggtggttctgtttggtaaaccagactagaatgatttgagaggggcaaagagaataggcaggaccttccttctatagctttacatatttagaatgttaatacttaatgacattgaagttaccttgcaatgattgataagaggattattaatatcagttaggggaatagggaggataggattttggtgccttcttcagcagacttgctccaagacaaagattctattttgatagtgcaagacaaaaggactcggaagaaaattggccatatgcctacagagcatacaactctgtggaactaaattgtttttactttgtgaaagctgctattttacggaaagattttgattatacagtttgtttttaaattgtcttttatatttatttgtatttggtaagaatcggttgttacacaagctgttctttcccagttacaaaatcctgtgttcggttgtaacctgaactcattaaaagacttgttttcaggtttatcaactgtttattttcactgacatttgagcatgttattttataaatgacgggattccagggtaggaagtgctttttattccccttttgttttttcttttaaaaaattacgtcagttaaaaaaataaaaaaactgcagtcttatggtttagaaaacttgtttagctccatagaggaaagaatgttaaactttgtattttaaaacatgattctctgaggttaaacttggttttcaaatgttatttttacttgtattttgcttttggtacggccagaaatcgagcttgttttttcatagttcctgatattttcagaaaaatcaaaataaatttgttccct

SEQ ID NO: 7714 - DNA, 3961 bp, Homo sapiens
gcggcttccggcggcgtgacctgaccgcaagaggccaatggagtgtgggagctgaaagggtcttcgctggcggccggtaactggcggcggttgggaacggccgagtgtggctcttctggtgtttcagcttggggagagaggggtggccttcctcttgcagttgaggccggcgccgagccggacttcaggcggatctcgtggcggagcccatcttgctccctctcccaggcctttacccgctccctaggattcccgggccctgtaggtgggagttgggagacgacagtactgcttttaaagagacagtgttagggatcttggaagcacagccaacatgtgtgacattgaagaagccactaaccaactcctagatgtgaaccttcatgagaaccagaagtctgtacaagtgacagaaagtgacctcggaagtgaatctgagcttctagtcactattggagccactgtacctactggctttgagcaaacagctgcagatgaagtcagagagaaacttgggtcatcatgcaaaatcagcagagaccgtggcaagatatattttgtcatttcagtggaaagtctggcacaggttcattgtctgagatcagttgataacttatttgtggtggttcaggagtttcaagattaccagttcaaacaaacaaaggaagaagttctaaaggattttgaagacttggctggaaaactcccatggtcaaaccccttaaaagtgtggaaaattaatgccagttttaaaaagaaaaaagcaaagcgcaaaaagataaatcagaattcaagtaaagagaagattaataatggacaagaagtcaaaatcgatcagagaaatgttaaaaaagagttcactagccatgctttagattctcatatcttagattattatgaaaatccagccatcaaagaggatgtatcaacattaataggtgatgatttggcatcttgcaaagatgagactgatgaaagctcaaaagaagaaactgagcctcaagtgctgaagtttagagtcacatgcaacagggcaggagagaaacattgctttacctcaaatgaggctgcaagagattttgggggtgctgttcaagattattttaagtggaaggccgacatgaccaactttgatgtggaggttcttttgaacatccatgataatgaagtcattgtgggcattgcattgactgaagagagtctccaccgaagaaatataacacattttggacctacaactcttagatcaactcttgcctatgggatgctcaggctctgtgatcctctaccttatgatataatagtcgatccaatgtgtggaactggggcaataccaatagagggggccactgaatggtctgactgtttccatattgctggtgataataatccactggctgtgaatagagcagcaaataacattgcatctttattgaccaagagccaaattaaagaaggcaaaccctcctggggcttgcccatagatgctgttcagtgggatatctgcaatctgccattgagaactggctctgtggatattattgtaacagatttgccatttggaaaaaggatgggatccaagaagagaaactggaacctttatccagcttgcctacgggagatgagccgtgtctgcacacctaccacaggccgagctgtactacttactcaagacacaaaatgctttaccaaggcgttatctggaatgcgacacgtatggcgaaaggtggatacagtctgggtgaacgttggtggtcttcgtgctgcagtttacgttctgatacgtacacctcaagcttttgttcatccttcagaacaagacggagaaagaggaactctttggcaatgcaaagaatgaagatgactaatagtacttgtacttcccaccactggaaatgttagcataaaagaacttggagaggaaaaaagtattaacaaaactgcagtctgcactctttaaacctgtttaaggctcttcatcctggttagcaaaaggtgtgaatgtaatgtgatggaatttaaaagttttatgagaccaggcacagtggctcacgactgtaattccagcagtttaggaagccgaagtgtgcagatcacctgaggtccggagaccagcctggccaacatggtgaaaccctgtctctactagaaatacaaaaattagccaggtgtggtggcgggcgcctgtaatcccaactactcaggaggctgaggctagagaatcacttgaacccagcaggcggaggttgcggtgagtcgagatcacgccattgcactccagcctgtgcgacaagagcgaaactctgtctcaaaaagattttataagaaagcagagcttttccttgaagctcttttgaagtggtagcttaattagtattttgttgaaaatactttaaagatgcctagtgaaaagcctactaaagtgctgtgagattggggtttagaacattttattttcaggctttatggcctattttccattgtgtcaagtgcaaaactaccctggcccaaaggaagggcagagaacataattacatcttaggccacatttcattctttgcagctttgctaatccagttgctcaagttctttacctcaacctgaaggaatgaagcattattacattttgtgaatggtgttcagcctataagacgaagtctcacaagacctataggaaagtttaccatctgccttaaatattaaaatatccatctgttattcacattaatacacagaatgaaaatagaggtctaggaattatcaaaggtactgcaaaaatactgtatagaacttatttgtaaatagcacatacattgatagatggggtgtgggaccaacaaaccaaattaaaagaaattgtttttctttcagtacactaaggtgtgtgttttcaaaaccaaacacaaacctgtcaagagtatttgttggctagtttcttaaaaggccaagagaaaaaaaatgatatatctttggaaaacttttaatttgggagttatgtgagttgttactttctcctggatcacgattcacatttaattgcttttccagttgcaacaagtccttcttgagagttttgtggaaaatggtgcttccctggaacaaagagtagttgaggtttttttgtggaactcatcatagtattgtttattttggagcctctggctgcaatcagtatagattttcagtatcctattagtattataatagtactcctcttaatactttctgatgtctccattgagaataaaaggacacaatacttttgaaagaagagttcacattagcagcacagccagcaatcctcatctggtttctctgatctcctaccccacacttcataatgaatgggaaataagatgtttatgaaggttttatatcctagactggcctttttaccactatcagaattcacagctgctttgtttatgggccgaacacaaaacttttcacctgatgggagaaaccatttaaacctcaaattaagcaacccacagaaccaggaagttcaaggaccatgtctgttttcaccacgatgtctttccccacccccccaccccccactccaccccccactaagggcagggtattgtatctgccagactgggtatttgttgaacaagcgagtattttcgcctattagcttagtttttaaggaaatcattttttacttgattcatcatagctttaattctattacatactacaataaaaatttgacaagactgatacaaatatgtagtgggcaatagtttgccgtcttcttccctagtatggtgtttttcaatctggtgactagaataggcagtgggctataagcaggattcataaggcctggagctgagttatatgtgacactgccacctattcattgtgtgaccttggttttaaccttcaaagtgggtctcctggactaaaagaatgtgaaaagatggggaaataaatctgtaatctgaacatggaa

SEQ ID NO: 7715 - DNA, 730 bp, Homo sapiens
tcctttccccaagaccttgtgggggaacccgccgccagcgcggagccaccgtgactcgtagcctgacttccgtttccgggggcggcttccggcggcgtgacctgaccgcaagaggccaatggagtgtgggagctgaaagggtcttcgctggcggccggtaactggcggcggttgggaacggccgagtgtggctcttctggtgtttcagcttggggagagaggggtggccttcctcttgcagttgaggccggcgccgagccggacttcaggcggatctcgtggcggagcccatcttgctccctctcccaggcctttacccgctccctaggattcccgggccctgtaggtgggagttgggagacgtgagttctctttcattctgcgcctctcattggctctctgaccttgtgcggaacgcgtcctttagctgacctcagctgcattttttagaagatggagattgtattcacagtgactgtcagctttttaacggcgggaactgacgtagtgttaaacactgtcgtgtatcgctggcacagcacaaggacattataggacagtactgcttttaaagagacagtgttagggatcttggaagcacagccaacatgtgtgacattgaagaagccactaaccaactcctagatgtgaaccttcatgagaaccagaagtctgtacaagtgacagaaagtgacctcggaagtgaatctgagcttctagtcactattgg

SEQ ID NO: 7716 - DNA, 704 bp, Homo sapiens
ggcggcttccggcggcgtgacctgaccgcaagaggccaatggagtgtgggagctgaaagggtcttcgctggcggccgggcctcactgtgtcacccaggctggagtgcagtcctcccacctcagcctcccaagtagctggactccaggcgcccaccaccacgcccagctattttttgtgtttttggtagagatgagattttgccatcttacgcagattggtctcgaactcttggcctcaagcaatctactcacctcagctccctaaagtgctgggattacaggacagtactgcttttaaagagacagtgttagggatcttggaagcacagccaacatgtgtgacattgaagaagccactaaccaactcctagatgtgaaccttcatgagaaccagaagtctgtacaagtgacagaaagtgacctcggaagtgaatctgagcttctagtcactattggagccactgtacctactggctttgagcaaacagctgcagatgaagtcagagagaaacttgggtcatcatgcaaaatcagcagagaccgtggcaagatatattttgtcatttcagtggaaagtctggcacaggttcattgtctgagatcagttgataacttatttgtggtggttcaggagtttcaagattaccagttcaaacaaacaaaggaagaagttctaaaggattttgaagacttggctggaaaac

SEQ ID NO: 7717 - DNA, 2877 bp, Homo sapiens
agtgctcggcaaggggaagcactctctaaacgttagcaaataccatggtaggacacaaggcccctgactctccgctttcagcttactgaagatcctcaaaaccaacagcacacagcttccagcgcatgctcctttccccaagaccttgtgggggaacccgccgccagcgcggagccaccgtgactcgtagcctgacttccgtttccgggggcggcttccggcggcgtgacctgaccgcaagaggccaatggagtgtgggagctgaaagggtcttcgctggcggccggacagtactgcttttaaagagacagtgttagggatcttggaagcacagccaacatgtgtgacattgaagaagccactaaccaactcctagatgtgaaccttcatgagaaccagaagtctgtacaagtgacagaaagtgacctcggaagtgaatctgagcttctagtcactattggagccactgtacctactggctttgagcaaacagctgcagatgaagtcagagagaaacttgggtcatcatgcaaaatcagcagagaccgtggcaagatatattttgtcatttcagtggaaagtctggcacaggttcattgtctgagatcagttgataacttatttgtggtggttcaggagtttcaagattaccagttcaaacaaacaaaggaagaagttctaaaggattttgaagacttggctggaaaactcccatggtcaaaccccttaaaagtgtggaaaattaatgccagttttaaaaagaaaaaagcaaagcgcaaaaagataaatcagaattcaagtaaagagaagattaataatggacaagaagtcaaaatcgatcagagaaatgttaaaaaagagttcactagccatgctttagattctcatatcttagattattatgaaaatccagccatcaaagaggatgtatcaacattaataggtgatgatttggcatcttgcaaagatgagactgatgaaagctcaaaagaagaaactgagcctcaagtgctgaagtttagagtcacatgcaacagggcaggagagaaacattgctttacctcaaatgaggctgcaagagattttgggggtgctgttcaagattattttaagtggaaggccgacatgaccaactttgatgtggaggttcttttgaacatccatgataatgaagtcattgtgggcattgcattgactgaagagagtctccaccgaagaaatataacacattttggacctacaactcttagatcaactcttgcctatgggatgctcaggctctgtgatcctctaccttatgatataatagtcgatccaatgtgtggaactggggcaataccaatagagggggccactgaatggtctgactgtttccatattgctggtgataataatccactggctgtgaatagagcagcaaataacattgcatctttattgaccaagagccaaattaaagaaggcaaaccctcctggggcttgcccatagatgctgttcagtgggatatctgcaatctgccattgagaactggctctgtggatattattgtaacagatttgccatttggaaaaaggatgggatccaagaagagaaactggaacctttatccagcttgcctacgggagatgagccgtgtctgcacacctaccacaggccgagctgtactacttactcaagacacaaaatgctttaccaaggcgttatctggaatgcgacacgtatggcgaaaggtggatacagtctgggtgaacgttggtggtcttcgtgctgcagtttacgttctgatacgtacacctcaagcttttgttcatccttcagaacaagacggagaaagaggaactctttggcaatgcaaagaatgaagatgactaatagtacttgtacttcccaccactggaaatgttagcataaaagaacttggagaggaaaaaagtattaacaaaactgcagtctgcactctttaaacctgtttaaggctcttcatcctggttagcaaaaggtgtgaatgtaatgtgatggaatttaaaagttttatgagaccaggcacagtggctcacgactgtaattccagcagtttaggaagccgaagtgtgcagatcacctgaggtccggagaccagcctggccaacatggtgaaaccctgtctctactagaaatacaaaaattagccaggtgtggtggcgggcgcctgtaatcccaactactcaggaggctgaggctagagaatcacttgaacccagcaggcggaggttgcggtgagtcgagatcacgccattgcactccagcctgtgcgacaagagcgaaactctgtctcaaaaagattttataagaaagcagagcttttccttgaagctcttttgaagtggtagcttaattagtattttgttgaaaatactttaaagatgcctagtgaaaagcctactaaagtgctgtgagattggggtttagaacattttattttcaggctttatggcctattttccattgtgtcaagtgcaaaactaccctggcccaaaggaagggcagagaacataattacatcttaggccacatttcattctttgcagctttgctaatccagttgctcaagttctttacctcaacctgaaggaatgaagcattattacattttgtgaatggtgttcagcctataagacgaagtctcacaagacctataggaaagtttaccatctgccttaaatattaaaatatccatctgttattcacattaatacacagaatgaaaatagaggtctaggaattatcaaaggtactgcaaaaatactgtatagaacttatttgtaaatagcacatacattgatagatggggtgtgggaccaacaaaccaaattaaaagaaattgtttttctttcagt

SEQ ID NO: 7718 - DNA, 2389 bp, Homo sapiens
gggagctgaaagggtcttcgctggcggccggtaactggcggcggttgggaacggccgagtgtggctcttctggtgtttcagcttggggagagaggggtggccttcctcttgcagttgaggccggcgccgagccggacttcaggcggatctcgtggcggagcccatcttgctccctctcccaggcctttacccgctccctaggattcccgggccctgtaggtgggagttgggagacgtgagttctctttcattctgcgcctctcattggctctctgaccttgtgcggaacgcgtcctttagctgacctcagctgcattttttagaagatggagattgtattcacagtgactgtcagctttttaacggcgggaactgacgtagtgttaaacactgtcgtgtatcgctggcacagcacaaggacattataggtattctgtactcaattaagttattttgagtcacagaccttttgaaaatctcgtgtaagctatggcccctccacctctctaatacttcccccggcccccaccccaagcacacacaaaagcttatgcataggaaatttgttttactatttcggattacttccaagatctctctcctgatgcccatctatggatcccagagtctggcaatactgcttttaaagagacagtgttagggatcttggaagcacagccaacatgtgtgacattgaagaagccactaaccaactcctagatgtgaaccttcatgagaaccagaagtctgtacaagtgacagaaagtgacctcggaagtgaatctgagcttctagtcactattggagccactgtacctactggctttgagcaaacagctgcagatgaagtcagagagaaacttgggtcatcatgcaaaatcagcagagaccgtggcaagatatattttgtcatttcagtggaaagtctggcacaggttcattgtctgagatcagttgataacttatttgtggtggttcaggagtttcaagattaccagttcaaacaaacaaaggaagaagttctaaaggattttgaagacttggctggaaaactcccatggtcaaaccccttaaaagtgtggaaaattaatgccagttttaaaaagaaaaaagcaaagcgcaaaaagataaatcagaattcaagtaaagagaagattaataatggacaagaagtcaaaatcgatcagagaaatgttaaaaaagagttcactagccatgctttagattctcatatcttagattattatgaaaatccagccatcaaagaggatgtatcaacattaataggtgatgatttggcatcttgcaaagatgagactgatgaaagctcaaaagaagaaactgagcctcaagtgctgaagtttagagtcacatgcaacagggcaggagagaaacattgctttacctcaaatgaggctgcaagagattttgggggtgctgttcaagattattttaagtggaaggccgacatgaccaactttgatgtggaggttcttttgaacatccatgataatgaagtcattgtgggcattgcattgactgaagagagtctccaccgaagaaatataacacattttggacctacaactcttagatcaactcttgcctatgggatgctcaggctctgtgatcctctaccttatgatataatagtcgatccaatgtgtggaactggggcaataccaatagagggggccactgaatggtctgactgtttccatattgctggtgataataatccactggctgtgaatagagcagcaaataacattgcatctttattgaccaagagccaaattaaagaaggcaaaccctcctggggcttgcccatagatgctgttcagtgggatatctgcaatctgccattgagaactggctctgtggatattattgtaacagatttgccatttggaaaaaggatgggatccaagaagagaaactggaacctttatccagcttgcctacgggagatgagccgtgtctgcacacctaccacaggccgagctgtactacttactcaagacacaaaatgctttaccaaggcgttatctggaatgcgacacgtatggcgaaaggtggatacagtctgggtgaacgttggtggtcttcgtgctgcagtttacgttctgatacgtacacctcaagcttttgttcatccttcagaacaagacggagaaagaggaactctttggcaatgcaaagaatgaagatgactaatagtacttgtacttcccaccactggaaatgttagcataaaagaacttggagaggaaaaaagtattaacaaaactgcagtctgcactctttaaacctgtttaaggctcttcatcctggttagcaaaaggtgtgaatgtaatgtgatggaatttaaaagttttatgagaccagg

SEQ ID NO: 7719 - DNA, 2010 bp, Homo sapiens
gcttcacctctgtgcccacacctgtgaaggcctcggcccagcttcgacaactgctttgcctcaaactcagctttctaccagcagacaggacggcattactgttacgggaggccctgaagtctgagccagggccatggaggcctctgtgctgagccccacatcctgggagaaacggcgggcctggctccgtcagagccgtaactggcagacccaggtcctagaagaggaggctgccgccgccctgcaggatgtcccagatcctgagccttccagcctggatgacgttttccaagaagggaatccaatcaataaaattgaagactggctgcaggattgcggatactctgaagaaggattttctgaggaagcaggacagtttatctacaatggcttctgcagccatgggaccagctttgaagatgacttgaccctgggagcggaggccacactactggccgccaatggcaaactcttctccaggagtttcctcgagacagccaggccttgccagctacttgatcttggctgtagtttggcttccagcagcatgactggggggaccaacaagactagttcaagcatctcagaaattctggacaaagtgcaagaagatgcagaagatgtcctcttcagtctgggctttggccaagaggatcacaaagacacttctcggatacccgcccgatttttcaccaccccctctcaggccaagggcattgatttccagctcttcctgaagtcccaggtgcggaggattgaaatggaagacccctgcctcatgctggccagcaggtttaagcaggtgcaaacactggctgtcactgctgatgccttcttctgtctctactcctatgtgtctaagacacctgtccaaaagttcacaccatcccacatgttctggaattgcaaccatccaactgatgtgccatccatcaggattctgtcccgagagcctgaaccccagtcacccagagaccgccttcggaaagccatctccaagatgtgtctgtacacatgcccccgagaccggccaccaccaccccacaacacccccaaaaggaacagtttggaccaagttgtgttggaagtgatggacaaagtgaaagaagagaagcagttcctccagcaagactctgatttggggcaattctcacaggaagatcctgtgccccctgctgagggtaagaagttgcccacttctccctatccatgtgtcttctgctgtgaagaggaaacacagcagaggatgtccacagtgctagcaccatcccaaactctggattcgaaccccaaggtaccctgttgcacacattctctgcccatagaagatccacagtggagcacagacccagctcagataaggagagagctgtgtagtctaccagccaccaatacggaaacccatccagccaaggatgagactttctggaaaagaaagagcagagcaagaaagagcctcttccagaagaatctcatgggcaggaaggttaagtccttggacctgtccatcacccagcagaaatggaagcagagtgtagacagaccagaactgcgtcggtctttaagccagcagccacaggacacttttgacttggaggaggtgcaaagcaacagtgaggaggagcagagtcagagtcgctggcccagcagacccaggcacccccaccaccaccagacttttgctggcaaagactcgtgaagctttctccaccaccacaacagcatgtggtctgacagaattggcttcaaagaagaaactaaaagccacctcttgcaggaaactgcactgccctcaacatccagcccctactccttggtcctccaaacccccaaactctgcaggagaaaggcagcatggtacatggggaggaagaccagactgagcgatttggaatccacatcctaatgctgccacaagctgcatgcacaaagaccttaggcacatctcttcatttctctgtacactggtttctctactatgtgtgtattaaaatatataatgtggatgat

SEQ ID NO: 7720 - DNA, 4188 bp, Homo sapiens
atgagaccacagtcataagagtaaaacaaaaattctgatggaaataaatgcttatttggtaggaagcaaaaagcacaaaaacaagattgtctttctttttctttttctttttaaatgagaaggatccacccttgtgggaaaggaactctcaaaagacagcagtgggcctgacatcttgggcactttccaggttcttgggaggaagggagaaaagaagcagagagagagaagaaatatctactatttttatatacggtgtattcctctcatatcttaaagaaaagctttatgtagaaaaaaagattcatgacgcagcttatgtaagaataaacttgtggaatggaattagttgcagggaggaggtctgatttcgttcagttctcacagtgatctagtgtctgacttttctagggaatccaatcaataaaattgaagactggctgcaggattgcggatactctgaagaaggattttctgaggaagcaggacagtttatctacaatggcttctgcagccatgggaccagctttgaagatgacttgaccctgggagcggaggccacactactggccgccaatggcaaactcttctccaggagtttcctcgagacagccaggccttgccagctacttgatcttggctgtagtttggcttccagcagcatgactggggggaccaacaagactagttcaagcatctcagaaattctggacaaagtgcaagaagatgcagaagatgtcctcttcagtctgggctttggccaagaggatcacaaagacacttctcggatacccgcccgatttttcaccaccccctctcaggccaagggcattgatttccagctcttcctgaagtcccaggtgcggaggattgaaatggaagacccctgcctcatgctggccagcaggtttaagcaggtgcaaacactggctgtcactgctgatgccttcttctgtctctactcctatgtgtctaagacacctgtccaaaagttcacaccatcccacatgttctggaattgcaaccatccaactgatgtgccatccatcaggattctgtcccgagagcctgaaccccagtcacccagagaccgccttcggaaagccatctccaagatgtgtctgtacacatgcccccgagaccggccaccaccaccccacaacacccccaaaaggaacagtttggaccaagttgtgttggaagtgatggacaaagtgaaagaagagaagcagttcctccagcaagactctgatttggggcaattctcacaggaagatcctgtgccccctgctgagggtaagaagttgcccacttctccctatccatgtgtcttctgctgtgaagaggaaacacagcagaggatgtccacagtgctagcaccatcccaaactctggattcgaaccccaaggtaccctgttgcacacattctctgcccatagaagatccacagtggagcacagacccagctcagataaggagagagctgtgtagtctaccagccaccaatacggaaacccatccagccaaggatgagactttctggaaaagaaagagcagagcaagaaagagcctcttccagaagaatctcatgggcaggaaggttaagtccttggacctgtccatcacccagcagaaatggaagcagagtgtagacagaccagaactgcgtcggtctttaagccagcagccacaggacacttttgacttggaggaggtgcaaagcaacagtgaggaggagcagagtcagagtcgctggcccagcagacccaggcacccccaccaccaccagacttttgctggcaaagactcgtgaagctttctccaccaccacaacagcatgtggtctgacagaattggcttcaaagaagaaactaaaagccacctcttgcaggaaactgcactgccctcaacatccagcccctactccttggtcctccaaacccccaaactctgcaggagaaaggcagcatggtacatggggaggaagaccagactgagcgatttggaatccacatcctaatgctgccacaagctgcatgcacaaagaccttaggcacatctcttcatttctctgtacactggtttctctactatgtgtgtattaaaatatataatgtggatgatagtaaactgaacaaagccttaattttctcccaagctttgacattgccaagggcagttaggagacttcaggatcaagtttaggggacaagtttttttctaatactttcaaaaggcccaagtgaagagaggaaggacacctcactttctggctctaaaagcatggtacatctcacactaggattccctctgcacctctgttcatccctgtattcctaactaaattccagaaaatcttctacaacactggagtcctatttttcttcttgagacctcctttgaagaaatcaacttggagactcctccttaaatccagtttctttctctacccaaaattttgcatctttatagaaaaagagataagtaggattcagagtctcttctcctagccattgtggggggaaaaaatgctatttctgttggcagaaaacaatacaaatattttttttaaatcatggcatgtttttaaagttaactaacagctgtagtttgctttggaagttaaatgttttgtcaataaacagggcttgagcacatgcagtgctctcttaggcagtatgtggtttcagagcatcttggacacatttctcccctgagaaaatattaatattaatagaatgggagaagtaagatgcacgcatttccagaagtatattatttggctgcctaataaattgtgagacaaaagaaaaaaaaaaaaaaaacaggaagagagggacttgagggaatttgagggaaatcataaccaaaagtttaaaggaaaaaattacaccagacatgataagcagaagttgattttgttctggtgctattgccagcattaggggagaaggcacaaactgagtctgatacgtagtgaggcagagacaaaagggctagggtggaaaaatttttaaaccatctgtgtttactaattccccataccaaaagaacaaaatgaactttctcctatttcatgataaaagatagtttcacaatttggaaaaagcccccccactccaagtttcctacccttcccacccacagaaaccaggagacaggggaactatcttccttgatgttaacatttcaaagaggtggttctcaggtcctagagaaagatattcctgagttgtaaaactgggaagaggctggaagaagatttagatctcaagaaatagaaagaactacagcaaattttctaaagcaaatattcttaagggaggtcaagggcctgaagtcaggaagaaacctatttggtcaagctgaggggaaagttaaggctatcttgtcacaagagaacagaaatatctgacaatatttcatttaaagaactgtattagtccattctcacactgctataaataaatacctgagactgggtaatttatacagaaaagaggtttaattggctcacagttccgcaggctgtacaggaagcatggcaacatcagtttctggggaggcctcagggagctttaactcatggtggaaagcaaagtgggagcaggcatcttacatggtatgagcaggaggaacaaaggaaaggggaggtgctaacacttttaaatgaccagatcttgtaagaactcactcattatacagtaccaaggggagatggtgctaaacgattaatgaaaactctacccagtaatccaatcaccacccaccaggccccacctccaacaatggggattacagtttgacatgagatttgggtgaggacacagatccaaactgtcaggcctctgagcccaagctaagccatcatatcccctgtgacctgcatgtatacatccagatggcctgaagcaagtggagaatcacaaaagaagtgaaaatggcctgttgctgccttaacagatgacattactttgtgaaattccttcttctggctcagaagctcccccactgagcaccttgtgacccccacccctgcctgccagagaataatcccctttgactgtaattttccactacctacctaaatcctataaaacagccccacccctatctccctttgctgactctctttttggactcagcctgcctgcacccaggtgattaaaaagctttattgctcacac

SEQ ID NO: 7721 - DNA, 783 bp, Homo sapiens
cagcagttgaatgagttcagggagaaaggcataatctacaacatgatactttctcacttgcttcacctctgtgcccacacctgtgaaggcctcggcccagcttcgacaactgctttgcctcaaactcagctttctaccagcagacaggccctactctagtgtccatagctccaaccattgagagtacctggctgaaatcaactttgctttctgtgggtatgacctctttcttcagaagctgtagaagaaacttgttgagataaactgcagcaagatatattgaggtcagctacgagggaggatgtacacacttgagtgaggcactgcttggggcataggtacaaaacagacagaagagaagagaggtctgtctcatacatgtcccctagagcactaaaggcaaacctgggactgggccttggaaaccaagtgtggcaggaggaaggctgtatgatataaaggaagaaagcatgcatctggaactcagaacttgacggcattactgttacgggaggccctgaagtctgagccagggccatggaggcctctgtgctgagccccacatcctgggagaaacggcgggcctggctccgtcagagccgtaactggcagacccaggtcctagaagaggaggctgccgccgccctgcaggatgtcccagatcctgagccttccagcctggatgacgttttccaagaagggaatccaatcaataaaattgaagactggctgcaggattgcggatactctgaagaaggattttctgaggaagcaggacagttt

SEQ ID NO: 7722 - DNA, 523 bp, Homo sapiens
cttttgagcaggcaacagcagttgaatgagttcagggagaaaggcataatctacaacatgatactttctcacttgcttcacctctgtgcccacacctgtgaaggcctcggcccagcttcgacaactgctttgcctcaaactcagctttctaccagcagacaggccctactctagtgtccatagctccaaccattgagagtacctggctgaaatcaactttgctttctgtgggtatgacctctttcttcagaagctgtagaagaaacttgttgagataaactgcagcaagatatattgaggtcagctacgagggaggatgtacacacttgagtgaggacggcattactgttacgggaggccctgaagtctgagccagggccatggaggcctctgtgctgagccccacatcctgggagaaacggcgggcctggctccgtcagagccgtaactggcagacccaggtcctagaagaggaggctgccgccgccctgcaggatgtcccagatcctgagccttccagcct

SEQ ID NO: 7723 - DNA, 1660 bp, Homo sapiens
catagctctgcaggggaacaggatcgctggcgcctcctgggccgctaagcgaccccggggctgcccggcttagcgagtgcttcgcagagaggtagccgagtcgaggcagcgcggttcccaaggaagtcacggctgcggccaccctccagttcggacctccgggcagccgcggttgctttcagtctctgcccattgagacaaaagagcgtgacaagccgcgcgacgcggccaatcagcggggcgaggaggcggcctccccaagcagcctctggccctgaagctactgctagcaagactcgggagctggctggcgggggctgaggccgacaggcacgggagccggcgcggcgtcaagtggagctcggacgcacggaccaggcccatttccctttcatctacagcaatgttcttactcctctcctgctgtaaagccactcatcttcgatttccctgaggacttctgctcctacagactctcgacggagtaaagcttccgatagaggggaaacagattcgctactagtgttgatagtcaagttactaaggttctttatcaacgtctcggagcagatttgagaggcccctgaatcgtcccgggaattttcttcggtgagcatttgtggagactctgggatgtaggttggattaaacttctgtgatgggtccatcggcgtcttgacacaacactaagcttctcctggatctttgaaacgtagcagaaactgatgacggagcctcaaattgctacaaggtagcccggaaagagcaagagtgagtgtacttcggatgaagggaatgtggaccctcaggactaaagcagtgggagaggcctgggaggtggggcctggggagggcgaggtctgctctgaagtcaccaagctcctgatcttagaagagatggtgggcgcaggctctggaggctcaagcggaggaggggaaggaggcgagtccggaaaccctcggccaatcagagagggctggggcggcgcctgctagaaggcttagcactgcagggctctgggcgggaaggctaacctggtgcggagccagcctgggtctcagccccgcgtacggcctttcacgagtcttcaagccttcaggctttcttctagtcaagatgagtgataaaccagacttgtcggaagtggagaagtttgacaggtcaaaactgaagaaaactaatactgaagaaaaaaatactcttccctcaaaggaaactatccagcaggagaaagagtgtgttcaaacatcataaaatggggatctcctccaaagagcagatttcagcattgcctgacagtcttggttttaggcttgtttttttgtaaacctgtgtgtttgtagagatttcagacatcttctgatttcttctcacctatattccctggttaagaggtcaggggtagtgaatgtttccttaagttcctttttaaacttcccattggtatgtaaattccaaatggcagatgctgtcaataaccttgccatggatgacctttgtgtaggtagtccttgcacctcatgcaggataagccaattttaactttctacaatgggtgcctcaatagtttcataatcttcatgaagttgcatcctttggcagcttcttacagtttattttcacttccaatgtagcaataaaataataaatataatcgtt

SEQ ID NO: 7724 - DNA, 1833 bp, Homo sapiens
gtacaggaggtcggccagcagtctctgcctctgtgggggcctgctcatcacacagtagctgccgggcggcctggatgagccacgcgtgcggctggcgaaaagcactgaggaagcacccgatgtcactcacatagccctgccaggcctggcgtgaggtgagcagcaccagctcggcatcgtcgaggacgcttcggtcagctccatgccatcctcgtacgagggagctagaagcagaggtagcccttgcgcagcatctcccggcagctcctgcccgccatgccaaacttcctcgggctgcacagggcccgcagcttcacagtcttgtgcttctggagcactgcagatgtactcaacgcctctgggccccgcaggcagtggcacccgctggccagctgctcaagctggtccaggccccagtcacagggctctacaccaggtgtgctctgcaaaactggcatgggccgggaaccgatcccagaaactcagtgccattttgctaacagcatgtgttcacttcacgtctctgtgccatattttggtaattctcccaatatttcaaactttttcagatggagtctcgctctgtcacccaggcagtggtgcgatcttggctcactgcaacctccttctcccaggttcaagggattctcctgcctcagcctccccagtagctgggactacagacgtgcaccaagcccggctaatttttgtattttagtagagatggggtttcaccatgttggccaggctgatcttgaactcctcacctcagctgatttgcccacctcagcctcccaaagtgctgggattacaggtgtgagccaccatgcctggcctcaaactttgtcactattgttatattaatatttgttatggtaatctgcactcagtgatttttgatgttactactacaaattttaggggcaacacaaatcacacccatataagatagtgaatttaataagtaaatgttgtgtgttgtgactgttccaccaactggccattccccacctctctccctctccttggactgtcctattccctgagacacaacaatactgaaattaggccaatttaataacactacaatgacctctaactgttcaaataaaagaaagagctgcatgtttctcacttcatatcaaaagctacttggtaggctgaggcaggagaattgcttgaacctgggaggcggaggttgcagtgagtcgagatggcaccaccgcactccagcctgagtgacacagcaagaccttgtctcaaaaagaaaaaaaaaagatagtgattcctctgatggatctaggcaaagaaaatggaaaatcttctgggaaagaatttactatcctatatgccattaagaagatttgtgattaacaggaggaggtcaaagtatcaacatgaacaagagtttggaagaagttgatttcaactctcgtggatgactttgaggggttcaggaattcggtgcaggaaggaactcgatgtagtggatatagcaaaagaactagaattagaagtggagcctgaccatgtgactgaagtgcctccatcacatgataaagcttgatagatgagaaggtgctccttttggatgagcaaacaaagtggtttcttgagatggaatctgctcctggtgaagatgctatgaacattgttgaaatgacaacaaagaatttcgaatattacataatcttagttgataaagcagcggcatggtttgaaaggcctgactccaattttgaaagttatactgtgggtaaaatgctatgctatcaaacagcatctcatgctacagagatatctttcgtgaaaataaaagtcaatcgatgtggc

SEQ ID NO: 7725 - DNA, 910 bp, Homo sapiens
ggggaggggagccggggccccagccctgccgggaaacgggttcccagtcccggccgagagcgcgggcgccgaggggaccgacccggactccccgcaaccccccaaccgccaggccatggcgcccacggggctcctggtggccggcgcctccttcctcgcgttccgggggctgcactgggggttgcggcggctgcccacgccggaatcggccgctcgggaccgctggcagtggtggaacctctgcgtctccctggcgcacagcctgctctcggggaccggggcgctgctcggcctgtcactgtaccctcagatggccgccgaccccatccatggccacccgcgctgggctctggtgctggtggctgtgtctgtgggttacttcctggcagacggagctgacctgctgtggaaccagaccttgggcaagacctgggatcttctctgtcatcatttggtggtggtgagctgcctcagcaccgctgttctgtctggccactacgtgggcttctccatggtgtctctgctcctggaactgaactctgcctgcttgcacctgcggaagctgctgttgctttctcgccaggccccatccctggccttcagcgtgaccagctgggcctccttggccaccttggccctcttccgcctggtcccgctggggtggatgagtctgtggctgttccggcagcaccaccaggttcctcttgctctggtcaccctgggtggaattgggctggtcactgtgggcatcatgagcatcatattggggatccgtattctggtcaatgatgtcctacagtctcgaccccatccacccagccctggccatgagaaaaccagggggaccaggacacgtcgtgacaatggacctgtcaccagcaacagttcgactctcagcctgaaagactag

SEQ ID NO: 7726 - DNA, 3695 bp, Homo sapiens
ctgtgcggcacctgccccgctgacctcggctgagagagagctccagcagatccgcattaacgaggtgaagacagagatcagtgtggaaagcaagcaccagaccctgcagggcctcgccttccccctgcagcctgaggcccagcgggcactccagcagctcaagcagaaaatggtcaactacatccagatgaagctggacctagagcgggaaaccattgagctggtgcacacagagcccacggatgtggcccagctgccctcccgggtgccccgagatgctgcccgctaccacttcttcctctacaagcacacccatgagggcgacccccttgagtctgtagtgttcatctactccatgccggggtacaagtgcagcatcaaggagcgaatgctctactccagctgcaagagccgcctcctcgactccgtggagcaggacttccatctggagatcgccaagaaaggtttctgccgcagcgccctgcacccgctgtctctcctggtgcaggccatcatgctggccatgaccctggccctgggtaccttgcctgccttcctaccctgtgagctccagccccacggcctggtgaactgcaactggctgttcctgaagtctgtgccccacttctccatggcagcaccccgtggcaatgtcaccagcctttccttgtcctccaaccgcatccaccacctccatgattctgactttgcccacctgcccagcctgcggcatctcaacctcaagtggaactgcccgccggttggcctcagccccatgcacttcccctgccacatgaccatcgagcccagcaccttcttggctgtgcccaccctggaagagctaaacctgagctacaacaacatcatgactgtgcctgcgctgcccaaatccctcatatccctgtccctcagccataccaacatcctgatgctagactctgccagcctcgccggcctgcatgccctgcgcttcctattcatggacggcaactgttattacaagaacccctgcaggcaggcactggaggtggccccgggtgccctccttggcctgggcaacctcacccacctgtcactcaagtacaacaacctcactgtggtgccccgcaacctgccttccagcctggagtatctgctgttgtcctacaaccgcatcgtcaaactggcgcctgaggacctggccaatctgaccgccctgcgtgtgctcgatgtgggcggaaattgccgccgctgcgaccacgctcccaacccctgcatggagtgccctcgtcacttcccccagctacatcccgataccttcagccacctgagccgtcttgaaggcctggtgttgaaggacagttctctctcctggctgaatgccagttggttccgtgggctgggaaacctccgagtgctggacctgagtgagaacttcctctacaaatgcatcactaaaaccaaggccttccagggcctaacacagctgcgcaagcttaacctgtccttcaattaccaaaagagggtgtcctttgcccacctgtctctggccccttccttcgggagcctggtcgccctgaaggagctggacatgcacggcatcttcttccgctcactcgatgagaccacgctccggccactggcccgcctgcccatgctccagactctgcgtctgcagatgaacttcatcaaccaggcccagctcggcatcttcagggccttccctggcctgcgctacgtggacctgtcggacaaccgcatcagcggagcttcggagctgacagccaccatgggggaggcagatggaggggagaaggtctggctgcagcctggggaccttgctccggccccagtggacactcccagctctgaagacttcaggcccaactgcagcaccctcaacttcaccttggatctgtcacggaacaacctggtgaccgtgcagccggagatgtttgcccagctctcgcacctgcagtgcctgcgcctgagccacaactgcatctcgcaggcagtcaatggctcccagttcctgccgctgaccggtctgcaggtgctagacctgtcccacaataagctggacctctaccacgagcactcattcacggagctaccgcgactggaggccctggacctcagctacaacagccagccctttggcatgcagggcgtgggccacaacttcagcttcgtggctcacctgcgcaccctgcgccacctcagcctggcccacaacaacatccacagccaagtgtcccagcagctctgcagtacgtcgctgcgggccctggacttcagcggcaatgcactgggccatatgtgggccgagggagacctctatctgcacttcttccaaggcctgagcggtttgatctggctggacttgtcccagaaccgcctgcacaccctcctgccccaaaccctgcgcaacctccccaagagcctacaggtgctgcgtctccgtgacaattacctggccttctttaagtggtggagcctccacttcctgcccaaactggaagtcctcgacctggcaggaaaccagctgaaggccctgaccaatggcagcctgcctgctggcacccggctccggaggctggatgtcagctgcaacagcatcagcttcgtggcccccggcttcttttccaaggccaaggagctgcgagagctcaaccttagcgccaacgccctcaagacagtggaccactcctggtttgggcccctggcgagtgccctgcaaatactagatgtaagcgccaaccctctgcactgcgcctgtggggcggcctttatggacttcctgctggaggtgcaggctgccgtgcccggtctgcccagccgggtgaagtgtggcagtccgggccagctccagggcctcagcatctttgcacaggacctgcgcctctgcctggatgaggccctctcctgggactgtttcgccctctcgctgctggctgtggctctgggcctgggtgtgcccatgctgcatcacctctgtggctgggacctctggtactgcttccacctgtgcctggcctggcttccctggcgggggcggcaaagtgggcgagatgaggatgccctgccctacgatgccttcgtggtcttcgacaaaacgcagagcgcagtggcagactgggtgtacaacgagcttcgggggcagctggaggagtgccgtgggcgctgggcactccgcctgtgcctggaggaacgcgactggctgcctggcaaaaccctctttgagaacctgtgggcctcggtctatggcagccgcaagacgctgtttgtgctggcccacacggaccgggtcagtggtctcttgcgcgccagcttcctgctggcccagcagcgcctgctggaggaccgcaaggacgtcgtggtgctggtgatcctgagccctgacggccgccgctcccgctacgtgcggctgcgccagcgcctctgccgccagagtgtcctcctctggccccaccagcccagtggtcagcgcagcttctgggcccagctgggcatggccctgaccagggacaaccaccacttctataaccggaacttctgccagggacccacggccgaatagccgtgagccggaatcctgcacggtgccacctccacactcacctcacctctgcctgcctggtctgaccctcccctgctcgcctccctcaccccacacctgacacagagcaggcactcaataaatgctaccgaaggct

SEQ ID NO: 7727 - DNA, 2757 bp, Homo sapiens
atggcgggcgccgagaactggccgggccagcagctggagctggacgaggacgaggcgtcttgttgccgctggggcgcgcagcacgccggggcccgcgagctggctgcgctctactcgccaggcaagcgcctccaggagtggtgctctgtgatcctgtgcttcagcctcatcgcccacaacctggtccatctcctgctgctggcccgctgggaggacacacccctcgtcatactcggtgttgttgcaggggctctcattgctgacttcttgtctggcctggtacactggggtgctgacacatggggctctgtggagctgcccattgtggggaaggctttcatccgacccttccgggagcaccacattgacccgacagctatcacacggcacgacttcatcgagaccaacggggacaactgcctggtgacactgctgccgctgctaaacatggcctacaagttccgcacccacagccctgaagccctggagcagctatacccctgggagtgcttcgtcttctgcctgatcatcttcggcaccttcaccaaccagatccacaagtggtcgcacacgtactttgggctgccacgctgggtcaccctcctgcaggactggcatgtcatcctgccacgtaaacaccatcgcatccaccacgtctcaccccacgagacctacttctgcatcaccacaggagtaaaagtccctcgcaatttccgactgttggaagaactcgaagaaggccagaaaggagtaggagatggcacagttagctggggtctagaagatgacgaagacatgacacttacaagatggacagggatgataattgggcctccaagaacaatttatgaaaaccgaatatacagccttaaaatagaatgtggacctaaatacccagaagcacccccctttgtaagatttgtaacaaaaattaatatgaatggagtaaatagttctaatggagtggtggacccaagagccatatcagtgctagcaaaatggcagaattcatatagcatcaaagttgtcctgcaagagcttcggcgcctaatgatgtctaaagaaaatatgaaactccctcagccgcccgaaggacagtgttacagcaattaatcaaaaagaaaaaccacaggcccttccccttccccccaattcgatttaatcagtcttcattttccacagtagtaaattttctagatacgtcttgtagacctcaaagtaccggaaaggaagctcccattcaaaggaaatttatcttaagatactgtaaatgatactaattttttgtccatttgaaatatataagttgtgctataacaaatcatcctgtcaagtgtaaccactgtccacgtagttgaacttctgggatcaagaaagtctatttaaattgattcccatcataactggtggggcacatctaactcaactgtgaaaagacacatcacacaatcaccttgctgctgattacacggcctggggtctctgccttctccccttaccctcccgcctcccaccctccctgcaacaacagccctctagcctggggggcttgttagagtagatgtgaaggtttcaggtcgcagcctgtgggactactgctaggtgtgtggggtgtttcgcctgcacccctggtttctttaagtcttaagtgatgccccttccaaaccatcatcctgtccccacgctcctccactcccgcccttggccgaagcatagattgtaacccctccactcccctctgagattggccttcggtgaggaattcagggctttccccatatcttctctcccccacctttatcgaggggtgctgctttttctccctcctcctcaagttcctttttgcaccgtcaccacccaacaccttccatgacacttccttgctttggccagaagccatcaggtaaggttggaaagagcctctgacctcccttgtttagttttggaaccatactcactcactctccaccagcctgggaaatgaatattgggtcctcagccctgccaccctctgctgtcatcagctgatgcattgtttttagctcaggttttgataaggtgaaaagaatagtcaccagggttactcagacctgccagctctcggagtccttggtggttgaacttggagaaagaccgcatgaagatacttgtaagcacacatgatccctctgaattgttttactttcctgtaactgcttttgcttttaaaaattgaagaagttttaaacagggctttcatttggtcatccttgcaatccattggggtctagtttggaatctgacaactggaacaaaaagaaccttgaatccggtgcatgccttggttttggtgctgctgctgcttcccaagatcctcagcagggattaagaaggaacccggtgtgcacagcagatccccgaaattggtgggcttgacctcctggcaaattgctgcgtctttccacttgctgttcaggaccactaaatgctgaaatgtggatgcataccgaaataaaagcaattcattgtgtactaaaggttttttttttttttttaatttagtatttgtgtaaaaccaccttttgaagcagcaactatcaagtctgaaaagcaattgatgtttccattaatctttttctggggggaaaaccttagttctaaggatttaacatcctgtaagtgaagtttaacataacagtattccataagcagcctttttattgtcagaccattgcctgattttaatataataaaaaaaaagtgtgcgttaatatttaa

SEQ ID NO: 7728 - DNA, 2416 bp, Homo sapiens
ttgcagtgcttataactttattctgtgtaattcctatccacagtcacttctgttcatttttaatgaaaacctattgctgttattttctattatgagttaacggtgatgtgtgttttttaaattttgtatacttgctctcaccctaaaatataccttaagagacttttcccctgtttttctttctgctttccaagactccaggaaaaacagcttccatggcacattttgtacagggcacatctagaatgattgccgcagaaagttctacggagcataaagagtgtgctgaaccatcaacaagaaagaacttgatgaattctcttgaacaaaagataaggtgtttggaaaaacaaagaaaagagctcctggaagttaaccagcaatgggatcagcaatttagaagtatgaaagagttatatgaaagaaaggtagcagagctgaagacgaaactggacgccgcggaaagattcctcagcacgcgggagaaggatccgcatcagaggcagagaaaggacgacaggcagagagaggacgacaggcagcgcgacctgacccgggaccggctgcagcgggaggagaaggaaaaggaacgcctaaatgaagaattacatgaattgaaagaagagaataaacttttaaagggaaaaaatactcttgcgaacaaggaaaaggaacattacgaatgtgaaataaaacgcctcaataaggctcttcaggatgccttgaatatcaagtgttcattttccgaggactgtttgaggaagtctcgagtggaattctgccatgaggagatgagaacagaaatggaagttctgaagcagcaggtgcaaatatacgaagaagacttcaaaaaggaacgatcggatcgagagagacttaatcaagagaaagaggagctacagcaaattaatgaaacttcccaatcccagttgaacaggctgaattcccagataaaagcttgtcagatggagaaagaaaaactagaaaagcaattaaaacagatgtattgcccaccctgtaactgcggcttggttttccacctgcaagatccatgggtaccaacaggccctggagctgtgcagaagcaacgggagcacccaccagactatcagtggtatgctcttgaccagcttccgccagatgtacaacacaaggcaaatggtttatcctcagtaaagaaagtccatccgtagaagtacacactaacagagagagacaacaggcaacgagggagcgtggctgaggaccctcttctttgtttatactgaggcttgtttctgccacaaaggcacatcatctaccctgttatttgtgcctggtcatgttttcctttggtatgaatacaggaaaaggcttctgacagctaagatcctgatcaaattggaggagccagttattatacaaccaaatacaacttccagtttccttgaaatgagacttggcagatggatgatgcacgactccctgaaaatctcttcagcatattgctgttggatgcacaaaaatgattctatgatttaggcaactcagtgtttgctgcagggatattgtatgttgatttaaagtgcatatgtgtgtgtgtgtgtgtgtgtgtgtgtgtgtgtgtgtgtttcctggggtaaaaatttctgcagttgtaaacgtttaacattgctcccattcttcttccacagggccttagttctttagctatttgactacatattgttgacctcagtgatcctaaacgtagaattgaagaggtgtatatacctcattaaattaaataagtggttcaatctgaataagatggttaattggaagctattccttagacagatcatttctttaagatgatgagaaattgtgcgcctgcatcacaagacttgattatgaaagataaagtcttgggctgggtgcagtggctcatgcctataatcccagcactttgggaggctgaggcaggtggattgctttgaggccaggagttctagaccagcctggccagcatggtgaaaccccatctctactataaatacaaaaattagccaggctcgtggcacacacctataaacccagctactcaggaggcttgaggcgggaggatcacttgagcccagggaggcagaggttgctgtaagttgagatcgccactgcactccagcctgggaaatagagtgagcaagactcagtgccccctacccacccactccacaccaccaaaaaaaaaaaaaaaaaaaaaaggaagacaaagtcctgatgggatgatgatggctatatggctatgctgtgtccatatatacttacagaaatatttcagacatatggatttatagttaaatctgtgtttttccttcccttggatttgattaattttaatgaaaaacttaattctgacttctcaagccaattaaaatgaaaatggaatttattgaaa

SEQ ID NO: 7729 - DNA, 2429 bp, Homo sapiens
attccatgtggatggctcatgaacaaaaatgagaaacacgacgataaactggtaatgttcaccaatcaatctgaagattctgaaagatgtgaaagcatggagctggacaaaaaaatccaggatctgattgagagaaatgcgtctcctcatccaaaacggttcaccccagaggccatgccaactcacagaaatctatgttctctgaagactccaggaaaaacagcttccatggcacattttgtacagggcacatctagaatgattgccgcagaaagttctacggagcataaagagtgtgctgaaccatcaacaagaaagaacttgatgaattctcttgaacaaaagataaggtgtttggaaaaacaaagaaaagagctcctggaagttaaccagcaatgggatcagcaatttagaagtatgaaagagttatatgaaagaaaggtagcagagctgaagacgaaactggacgccgcggaaagattcctcagcacgcgggagaaggatccgcatcagaggcagagaaaggacgacaggcagagagaggacgacaggcagcgcgacctgacccgggaccggctgcagcgggaggagaaggaaaaggaacgcctaaatgaagaattacatgaattgaaagaagagaataaacttttaaagggaaaaaatactcttgcgaacaaggaaaaggaacattacgaatgtgaaataaaacgcctcaataaggctcttcaggatgccttgaatatcaagtgttcattttccgaggactgtttgaggaagtctcgagtggaattctgccatgaggagatgagaacagaaatggaagttctgaagcagcaggtgcaaatatacgaagaagacttcaaaaaggaacgatcggatcgagagagacttaatcaagagaaagaggagctacagcaaattaatgaaacttcccaatcccagttgaacaggctgaattcccagataaaagcttgtcagatggagaaagaaaaactagaaaagcaattaaaacagatgtattgcccaccctgtaactgcggcttggttttccacctgcaagatccatgggtaccaacaggccctggagctgtgcagaagcaacgggagcacccaccagactatcagtggtatgctcttgaccagcttccgccagatgtacaacacaaggcaaatggtttatcctcagtaaagaaagtccatccgtagaagtacacactaacagagagagacaacaggcaacgagggagcgtggctgaggaccctcttctttgtttatactgaggcttgtttctgccacaaaggcacatcatctaccctgttatttgtgcctggtcatgttttcctttggtatgaatacaggaaaaggcttctgacagctaagatcctgatcaaattggaggagccagttattatacaaccaaatacaacttccagtttccttgaaatgagacttggcagatggatgatgcacgactccctgaaaatctcttcagcatattgctgttggatgcacaaaaatgattctatgatttaggcaactcagtgtttgctgcagggatattgtatgttgatttaaagtgcatatgtgtgtgtgtgtgtgtgtgtgtgtgtgtgtgtgtgtgtttcctggggtaaaaatttctgcagttgtaaacgtttaacattgctcccattcttcttccacagggccttagttctttagctatttgactacatattgttgacctcagtgatcctaaacgtagaattgaagaggtgtatatacctcattaaattaaataagtggttcaatctgaataagatggttaattggaagctattccttagacagatcatttctttaagatgatgagaaattgtgcgcctgcatcacaagacttgattatgaaagataaagtcttgggctgggtgcagtggctcatgcctataatcccagcactttgggaggctgaggcaggtggattgctttgaggccaggagttctagaccagcctggccagcatggtgaaaccccatctctactataaatacaaaaattagccaggctcgtggcacacacctataaacccagctactcaggaggcttgaggcgggaggatcacttgagcccagggaggcagaggttgctgtaagttgagatcgccactgcactccagcctgggaaatagagtgagcaagactcagtgccccctacccacccactccacaccaccaaaaaaaaaaaaaaaaaaaaaaggaagacaaagtcctgatgggatgatgatggctatatggctatgctgtgtccatatatacttacagaaatatttcagacatatggatttatagttaaatctgtgtttttccttcccttggatttgattaattttaatgaaaaacttaattctgacttctcaagccaattaaaatgaaaatggaatttattgaaa

SEQ ID NO: 7730 - DNA, 1778 bp, Homo sapiens
gagaataaaaacatggcttttgatgaaaaatgcatttaacagattccatgtggatggctcatgaacaaaaatgagaaacacgacgataaactggtaatgttcaccaatcaatctgaagattctgaaagatgtgaaagcatggagctggacaaaaaaatccaggatctgattgagagaaatgcgtctcctcatccaaaacggttcaccccagaggccatgccaactcacagaaatctatgttctctgaagactccaggaaaaacagcttccatggcacattttgtacagggcacatctagaatgattgccgcagaaagttctacggagcataaagagtgtgctgaaccatcaacaagaaagaacttgatgaattctcttgaacaaaagataaggtgtttggaaaaacaaagaaaagagctcctggaagttaaccagcaatgggatcagcaatttagaagtatgaaagagttatatgaaagaaaggtagcagagctgaagacgaaactggacgccgcggaaagattcctcagcacgcgggagaaggatccgcatcagaggcagagaaaggacgacaggcagagagaggacgacaggcagcgcgacctgacccgggaccggctgcagcgggaggagaaggaaaaggaacgcctaaatgaagaattacatgaattgaaagaagagaataaacttttaaagggaaaaaatactcttgcgaacaaggaaaaggaacattacgaatgtgaaataaaacgcctcaataaggctcttcaggatgccttgaatatcaagtgttcattttccgaggactgtttgaggaagtctcgagtggaattctgccatgaggagatgagaacagaaatggaagttctgaagcagcaggtgcaaatatacgaagaagacttcaaaaaggaacgatcggatcgagagagacttaatcaagagaaagaggagctacagcaaattaatgaaacttcccaatcccagttgaacaggctgaattcccagataaaagcttgtcagatggagaaagaaaaactagaaaagcaattaaaacagatgtattgcccaccctgtaactgcggcttggttttccacctgcaagatccatgggtaccaacaggccctggagctgtgcagaagcaacgggagcacccagtttatcctcagtaaagaaagtccatccgtagaagtacacactaacagagagagacaacaggcaacgagggagcgtggctgaggaccctcttctttgtttatactgaggcttgtttctgccacaaaggcacatcatctaccctgttatttgtgcctggtcatgttttcctttggtatgaatacaggaaaaggcttctgacagctaagatcctgatcaaattggaggagccagttattatacaaccaaatacaacttccagtttccttgaaatgagacttggcagatggatgatgcacgactccctgaaaatctcttcagcatattgctgttggatgcacaaaaatgattctatgatttaggcaactcagtgtttgctgcagggatattgtatgttgatttaaagtgcatatgtgtgtgtgtgtgtgtgtgtgtgtgtgtgtgtgtgtgtttcctggggtaaaaatttctgcagttgtaaacgtttaacattgctcccattcttcttccacagggccttagttctttagctatttgactacatattgttgacctcagtgatcctaaacgtagaattgaagaggtgtatatacctcattaaattaaataagtggttcaatctgaa

SEQ ID NO: 7731 - DNA, 6212 bp, Homo sapiens
gcgagaggccgggcaggccgggcagggagtgcgggtcggttctgcgtgcgctgccggacgaggctcccgccgccgattgacccgcgctccgcccgtagtcgggccgggaccttggtagctaatgtccgaagaaagtgactctctgagaaccagcccttctgtggcctcactctctgaaaatgagctgccaccaccacctgagcctccgggctatgtgtgctcactgacagaagacctggtcaccaaagcccgggaagagctgcaggaaaagccggaatggagacttcgagatgtgcaggcccttcgtgacatggtgcggaaggagtaccccaacctgagcacatccctcgacgatgccttcctgctgcgcttcctccgagcccgcaagtttgattacgaccgggccctgcagctcctcgtcaactaccacagctgtagaagaagctggcccgaagtcttcaataacttgaagccatcagccttaaaagatgtccttgcttccgggttcctcaccgtgctgccccacactgaccccaggggctgccatgtcgtctgcatccgcccagacagatggataccaagcaactatccaattactgaaaacatccgagccatatacttgaccttagaaaaactcattcagtctgaagaaacccaggtgaatggaattgtaattcttgcagactacaaaggagtgagtttatcaaaagcatctcactttggcccttttatagccaaaaaggtgattggcatcctccaggatggtttccccattcggataaaagcagtccatgtggtgaatgaacctcgaatatttaaaggcatttttgccatcataaaaccatttctaaaggagaaaatagcaaacagattcttcctccatgggtctgacttgaactctctccacacaaaccttccaagaagcatcctccccaaggagtatgggggcacggctggggagctggacactgccacctggaacgcggtactgctggcttcagaagacgattttgtgaaagagttctgccaacctgttcctgcctgtgacagcatcctgggccagacgctgctgcccgagggcctgacctcagatgcacagtgtgacgactccttgcgagctgtgaagtcacagctgtactcctgctactagcccgtcccccagggtcaccatctttaattcttttccttcttttctttggagaggcacaaggagaatttaagggtccatggattcagtcttgctccttgtaattaaactgcaggatggaggaacagcctgagatatgagcatgagcccattttggggtaagcctttggttactttaattactccatggaagacatggaaaatgtccccactgattcttaaacatttggaatcccagtctgcaactattaatctggaggctatatctattttgttttgctttttggttggggggtggtgatctggttcttacacatcttggaagcaagaacaatcaggaccaaagtcactttgatcccacttttccaggagaaaaaccacctgtttggccagtgagaactacttgtatgaaataatttggccaaaccttcagtgtgaccaaatgtgagactgggagtttgtgtttttcacaggaaccctaagtatagacctctgctgctcatcaggaaacttactggagatgaaggccccagctgttgtcaccgggtttggaaagcaccttaactgaatcatgtaagcatcaggacataagcagcactttgtggtcaaatgtggaagccggagacttcaaagcacctctgggacccactggttgaagtttgcaatagaaacttaagttttcccaaatccataaagccttagccctggttctcaatagaatcagggacctagcaggaaatgattttactcaacctaaaatgctggatcccaggcccgtgtagctataagaattctggcctggatcccaggtgtacaactatggacaagatatgggcctctactttctcctctataaaatgaggctggatgaaatgtcagctagggccattttggctgctgaggctctgggatttggtttagttactgaatgttagattttctgcctagaaagataactatctagatacaagtggttggatcctgtttttgtttgtggtacatgtgtctttccaagagagatgtgtcaccaattagccctgcctttaaagaaactattatgtgtattcctgggactcactgacaccaattttctttttatagtgatggttcaattttgaaaagatggcttttgtgaggccaggttaaggtgaccaggatcttgtatgatgaattccttccatccctgagactctggtactatattgtaaacctggctacagtagttaattacttgagattctttaattttggtctctgagctgggcgtggtggttcatgcctgtaatcccagcactttgggaggccaaggtgtgcggatcacaaggtcaggagttcgagacccgcctggccaagatggtgaaaccccatctctactaaaaatacaaaaattagctgggcgtggtggcgggctcctgtagtcccagctactcgggaggctgaggcagaagaatcacgtgaacccaggaggcagaagtggcagtgagccaagatcgcaccactgcactccagcctgggcgacagagcaagactctgcctcaaaaaaaaaaaaaaaaaaaaaaaatttttttttttttggtctctggaaatgaacacaagggcaggttattcctgggtcacttctgggcccccctgccctcccagccccacttgagtttctctctctggtgtgggtgaaccagtcagcctgaatgttctgcatttcagcactttagaacctccctgtgaagattttagccttagcccaaacatcaaattagacggttcacatgatggtttttgacctatttcctttctaatgtattccacatgatcatggtgttaaatagtgaaaagtactgtgttgtgtgtgcaccttctccgtgcatttattagactaaccagtcaagcagacagctcagttagggagaaaacaatactctgaaatttgaaggccaatctgttgttactaagctgtttatctctattgcctttttaaatgtctggataagttgttggtggaaattaagttacttaacctcattaataccaattctagagaaagttcttttcaccatggatagtaaccctggatcctctacggtactggctgagctggaagtgccaaaaagcactcctggctgcttctggttccatctgatgatgatgtgacacacactgctgaaaaggcccaagcagggcaagtgggatggctgaaggagggaaggagggggttcagaacccactggcctggatgggagaactgggtggaggcttccccaagagggaagacagataaacaaaacaaaacaaaaactgggtaaagaggaatgaatcactcagccctgatgtttcaattctacactgcattcctggccagtcgcatttgttttaatgcaggcatggccacagctctcctagagaattatctcaaagaccagaagggacctggagaggcctatttcttaggtttttccagttggacaaggaaggagtggtttcactcagcttctagaaggagttggagcctaagtttatctgcctccgggagctgcttgctttgttttggctccgaagaggtatcagatagttttgacacctcaggaaacttgaaccaagctgtgaaaccaagacctccctgcgtgaaaatcaaggtggtctccttgtggcttcaccaggatgtttgtgtcaggctgtctcagcagggtggggaatgaccagccagggagcacagtgagccttactcagcactggggagcgcactggtgaggcaaacccatgaacctcaagaactgggagtatgttccttcagggagaagttctggcccattgcacaaacacttggaaattaacttttccctaaattcaagatagtgtggtgtcggaaggaaatgggacagtaaattaggagacgcgggctccacctttaccttactacgtggcctttgatgagctggcttaacatccctgagtgattccatgatagagatctatactccaaactttattcctggtatctagttggcttcactgccacagacactgtactctctctttttagaagtttttttccttttttttccccctcaattggcttatttagtaaatttaggtctgaatgaattggtacctaaaagcttccaaatctatacatttcagaatatgggaattttcttcctcttcttcccccatatcccaacatggaattctggaaaactgtgcctcttcccctgttctgccttcatgggggagagactggatgaaatctacaaaaacagccaaaagtgccaccctggcttcatgtcttgaatttctaacttgctcttggcaaaggtcgctttattttttaatttttttccttgcattttcttttttattctattgctgctgcaaaaattaaggcaaaagtagctttcgatctttcatatttcatcctggtttcacaaggagtcacttatcttaggaggtctgtaagtcaggttacaaggccgggagcggtggctcacacctgtaatcccaacactttgagcggctgaggtgggtgtatcacctgaagtccggagtttgagaccagcctggccaacatggtgaaaccccgtctctactaaaaatacaaaaaattggctgggcatggtggtgggtgcctgtaatcccagctacttgggaagctgaagcaggagaatcacttaaacccaggtggcggaggttgcagtgagccgacatcgcgccattgcactccagcctgggtgacgagtgaaactccatctcaaaaataaaaattgaaaaatcaggttacaaaacaccatttttcccgaaataagacaataagaggcttttctctgaattcctttatattgagcctttcagaattctccctgggtgggcaatttctttaaatagtatttgaccctcagatcaatcctgggaatttttttcatttgggtagcaaaagctagagtattgctgtggcgattataatacttttaaaaagttttaccattttaaagttgccaacatttaattaaggttttcctttgaagcctcctttaatttagggagtaaaatgttagctaaaccaattatatactatatactatacactgtatctcctgtggccatgagaggtgtggctataccgaacagaaacatgcctactgttcaggaaagatgtcagttctggtaacacctctctgtattgggatctgttaattttgtaaatctaaattcttctgctcttggccaggtgcagtagttcatgccctgtaatcctagaactttgggaggctgaagggggggcggatcatttgaggtcaggagtttgagaccagcctggccaacatggtgaaaccccatctctactaaaaagtacaaaaattagctgggtgtggtggtgcgtgcctgtaatcccaactacttgggaggctgaggcaggagaatcgcttgaacctgggaggcagcggttgcagtaagccaagactatgccactgcactcccgcctgggtgacaaagcaatattctgtgtcaaataaataaattcattcttctgctctcctgacttagagaaatggtttgcttaaaatgctagtaacaaacatcacagtcaacaggagcttgcttcatgcgaaggatcaatgtgatttgtggatggagatgatagtgatgaaattcctgtttcatggggctgtttttcttttcatctcactgggcagcaggtttagtgaggcagtgagatgctgctgctgtggattcttgtagctatgcctcggcttcttggcatatcaggtaggaacctgttacaagtgaaatacttgaaacctctctgaccaagagcctctgatggagtgggaggtgagctaattctctgaccagcttggggcactgtttcagccactggtcacattccttgcttcaaactgaaattcagtttggctttgagtatagggatacatggtggattcatgtacttcagtgtttgttttgaccaaagtttatttttctagtgcattttctaagtcaaagtggtgaaaatatgtaataattttagtatgcatgactcagtctgaaacaataaaaatctctgaaaaatgtg

SEQ ID NO: 7732 - DNA, 6234 bp, Homo sapiens
gagaggccgggcaggccgggcagggagtgcgggtcggttctgcgtgcgctgccggacgaggctcccgccgccgattgacccgcgctccgcccgtagtcgggccgttctgttccaagagataaccattgggaccttggtagctaatgtccgaagaaagtgactctctgagaaccagcccttctgtggcctcactctctgaaaatgagctgccaccaccacctgagcctccgggctatgtgtgctcactgacagaagacctggtcaccaaagcccgggaagagctgcaggaaaagccggaatggagacttcgagatgtgcaggcccttcgtgacatggtgcggaaggagtaccccaacctgagcacatccctcgacgatgccttcctgctgcgcttcctccgagcccgcaagtttgattacgaccgggccctgcagctcctcgtcaactaccacagctgtagaagaagctggcccgaagtcttcaataacttgaagccatcagccttaaaagatgtccttgcttccgggttcctcaccgtgctgccccacactgaccccaggggctgccatgtcgtctgcatccgcccagacagatggataccaagcaactatccaattactgaaaacatccgagccatatacttgaccttagaaaaactcattcagtctgaagaaacccaggtgaatggaattgtaattcttgcagactacaaaggagtgagtttatcaaaagcatctcactttggcccttttatagccaaaaaggtgattggcatcctccaggatggtttccccattcggataaaagcagtccatgtggtgaatgaacctcgaatatttaaaggcatttttgccatcataaaaccatttctaaaggagaaaatagcaaacagattcttcctccatgggtctgacttgaactctctccacacaaaccttccaagaagcatcctccccaaggagtatgggggcacggctggggagctggacactgccacctggaacgcggtactgctggcttcagaagacgattttgtgaaagagttctgccaacctgttcctgcctgtgacagcatcctgggccagacgctgctgcccgagggcctgacctcagatgcacagtgtgacgactccttgcgagctgtgaagtcacagctgtactcctgctactagcccgtcccccagggtcaccatctttaattcttttccttcttttctttggagaggcacaaggagaatttaagggtccatggattcagtcttgctccttgtaattaaactgcaggatggaggaacagcctgagatatgagcatgagcccattttggggtaagcctttggttactttaattactccatggaagacatggaaaatgtccccactgattcttaaacatttggaatcccagtctgcaactattaatctggaggctatatctattttgttttgctttttggttggggggtggtgatctggttcttacacatcttggaagcaagaacaatcaggaccaaagtcactttgatcccacttttccaggagaaaaaccacctgtttggccagtgagaactacttgtatgaaataatttggccaaaccttcagtgtgaccaaatgtgagactgggagtttgtgtttttcacaggaaccctaagtatagacctctgctgctcatcaggaaacttactggagatgaaggccccagctgttgtcaccgggtttggaaagcaccttaactgaatcatgtaagcatcaggacataagcagcactttgtggtcaaatgtggaagccggagacttcaaagcacctctgggacccactggttgaagtttgcaatagaaacttaagttttcccaaatccataaagccttagccctggttctcaatagaatcagggacctagcaggaaatgattttactcaacctaaaatgctggatcccaggcccgtgtagctataagaattctggcctggatcccaggtgtacaactatggacaagatatgggcctctactttctcctctataaaatgaggctggatgaaatgtcagctagggccattttggctgctgaggctctgggatttggtttagttactgaatgttagattttctgcctagaaagataactatctagatacaagtggttggatcctgtttttgtttgtggtacatgtgtctttccaagagagatgtgtcaccaattagccctgcctttaaagaaactattatgtgtattcctgggactcactgacaccaattttctttttatagtgatggttcaattttgaaaagatggcttttgtgaggccaggttaaggtgaccaggatcttgtatgatgaattccttccatccctgagactctggtactatattgtaaacctggctacagtagttaattacttgagattctttaattttggtctctgagctgggcgtggtggttcatgcctgtaatcccagcactttgggaggccaaggtgtgcggatcacaaggtcaggagttcgagacccgcctggccaagatggtgaaaccccatctctactaaaaatacaaaaattagctgggcgtggtggcgggctcctgtagtcccagctactcgggaggctgaggcagaagaatcacgtgaacccaggaggcagaagtggcagtgagccaagatcgcaccactgcactccagcctgggcgacagagcaagactctgcctcaaaaaaaaaaaaaaaaaaaaaaaatttttttttttttggtctctggaaatgaacacaagggcaggttattcctgggtcacttctgggcccccctgccctcccagccccacttgagtttctctctctggtgtgggtgaaccagtcagcctgaatgttctgcatttcagcactttagaacctccctgtgaagattttagccttagcccaaacatcaaattagacggttcacatgatggtttttgacctatttcctttctaatgtattccacatgatcatggtgttaaatagtgaaaagtactgtgttgtgtgtgcaccttctccgtgcatttattagactaaccagtcaagcagacagctcagttagggagaaaacaatactctgaaatttgaaggccaatctgttgttactaagctgtttatctctattgcctttttaaatgtctggataagttgttggtggaaattaagttacttaacctcattaataccaattctagagaaagttcttttcaccatggatagtaaccctggatcctctacggtactggctgagctggaagtgccaaaaagcactcctggctgcttctggttccatctgatgatgatgtgacacacactgctgaaaaggcccaagcagggcaagtgggatggctgaaggagggaaggagggggttcagaacccactggcctggatgggagaactgggtggaggcttccccaagagggaagacagataaacaaaacaaaacaaaaactgggtaaagaggaatgaatcactcagccctgatgtttcaattctacactgcattcctggccagtcgcatttgttttaatgcaggcatggccacagctctcctagagaattatctcaaagaccagaagggacctggagaggcctatttcttaggtttttccagttggacaaggaaggagtggtttcactcagcttctagaaggagttggagcctaagtttatctgcctccgggagctgcttgctttgttttggctccgaagaggtatcagatagttttgacacctcaggaaacttgaaccaagctgtgaaaccaagacctccctgcgtgaaaatcaaggtggtctccttgtggcttcaccaggatgtttgtgtcaggctgtctcagcagggtggggaatgaccagccagggagcacagtgagccttactcagcactggggagcgcactggtgaggcaaacccatgaacctcaagaactgggagtatgttccttcagggagaagttctggcccattgcacaaacacttggaaattaacttttccctaaattcaagatagtgtggtgtcggaaggaaatgggacagtaaattaggagacgcgggctccacctttaccttactacgtggcctttgatgagctggcttaacatccctgagtgattccatgatagagatctatactccaaactttattcctggtatctagttggcttcactgccacagacactgtactctctctttttagaagtttttttccttttttttccccctcaattggcttatttagtaaatttaggtctgaatgaattggtacctaaaagcttccaaatctatacatttcagaatatgggaattttcttcctcttcttcccccatatcccaacatggaattctggaaaactgtgcctcttcccctgttctgccttcatgggggagagactggatgaaatctacaaaaacagccaaaagtgccaccctggcttcatgtcttgaatttctaacttgctcttggcaaaggtcgctttattttttaatttttttccttgcattttcttttttattctattgctgctgcaaaaattaaggcaaaagtagctttcgatctttcatatttcatcctggtttcacaaggagtcacttatcttaggaggtctgtaagtcaggttacaaggccgggagcggtggctcacacctgtaatcccaacactttgagcggctgaggtgggtgtatcacctgaagtccggagtttgagaccagcctggccaacatggtgaaaccccgtctctactaaaaatacaaaaaattggctgggcatggtggtgggtgcctgtaatcccagctacttgggaagctgaagcaggagaatcacttaaacccaggtggcggaggttgcagtgagccgacatcgcgccattgcactccagcctgggtgacgagtgaaactccatctcaaaaataaaaattgaaaaatcaggttacaaaacaccatttttcccgaaataagacaataagaggcttttctctgaattcctttatattgagcctttcagaattctccctgggtgggcaatttctttaaatagtatttgaccctcagatcaatcctgggaatttttttcatttgggtagcaaaagctagagtattgctgtggcgattataatacttttaaaaagttttaccattttaaagttgccaacatttaattaaggttttcctttgaagcctcctttaatttagggagtaaaatgttagctaaaccaattatatactatatactatacactgtatctcctgtggccatgagaggtgtggctataccgaacagaaacatgcctactgttcaggaaagatgtcagttctggtaacacctctctgtattgggatctgttaattttgtaaatctaaattcttctgctcttggccaggtgcagtagttcatgccctgtaatcctagaactttgggaggctgaagggggggcggatcatttgaggtcaggagtttgagaccagcctggccaacatggtgaaaccccatctctactaaaaagtacaaaaattagctgggtgtggtggtgcgtgcctgtaatcccaactacttgggaggctgaggcaggagaatcgcttgaacctgggaggcagcggttgcagtaagccaagactatgccactgcactcccgcctgggtgacaaagcaatattctgtgtcaaataaataaattcattcttctgctctcctgacttagagaaatggtttgcttaaaatgctagtaacaaacatcacagtcaacaggagcttgcttcatgcgaaggatcaatgtgatttgtggatggagatgatagtgatgaaattcctgtttcatggggctgtttttcttttcatctcactgggcagcaggtttagtgaggcagtgagatgctgctgctgtggattcttgtagctatgcctcggcttcttggcatatcaggtaggaacctgttacaagtgaaatacttgaaacctctctgaccaagagcctctgatggagtgggaggtgagctaattctctgaccagcttggggcactgtttcagccactggtcacattccttgcttcaaactgaaattcagtttggctttgagtatagggatacatggtggattcatgtacttcagtgtttgttttgaccaaagtttatttttctagtgcattttctaagtcaaagtggtgaaaatatgtaataattttagtatgcatgactcagtctgaaacaataaaaatctctgaaaaatgtg

SEQ ID NO: 7733 - DNA, 926 bp, Homo sapiens
gtcggttctgcgtgcgctgccggacgaggctcccgccgccgattgacccgcgctccgcccgtagtcgggccgggaccttggtagctaatgtccgaagaaagtgactctctgagaaccagcccttctgtggcctcactctctgaaaatgagctgccaccaccacctgagcctccgggctatgtgtgctcactgacagaagacctggtcaccaaagcccgggaagagctgcaggaaaagccggaatggagacttcgagatgtgcaggcccttcgtgacatggtgcggaaggagtaccccaacctgagcacatccctcgacgatgccttcctgctgcgcttcctccgagcccgcaagtttgattacgaccgggccctgcagctcctcgtcaactaccacagctgtagaagaagctggcccgaagtcttcaataacttgaagccatcagccttaaaagatgtccttgcttccgggttcctcaccgtgctgccccacactgaccccaggggctgccatgtcgtctgcatccgcccagacagatggataccaagcaactatccaattactgaaaacatccgagccatatacttgaccttagaaaaactcattcagtctgaagaaacccaggatggtttccccattcggataaaagcagtccatgtggtgaatgaacctcgaatatttaaaggcatttttgccatcataaaaccatttctaaaggagaaaatagcaaacagattcttcctccatgggtctgacttgaactctctccacacaaaccttccaagaagcatcctccccaaggagtatgggggcacggctggggagctggacactgccacctggaacgcggtactgctggcttcagaagacgattttgtgaaagagttctgccaacctgttcctgcctgtgacagcatcctgggcca

SEQ ID NO: 7734 - DNA, 1116 bp, Homo sapiens
gagagactacaactcccagtatgcaccgcgatgcgcgcctcaccctgcatctcccagcccgcagccagctggcatcctagaccctctgccctgcgaccaacagccgggagcggaccagacaccagaactcccggaacggttgaagacggttccgctccctgtcccgcctttcgcagcccagcagtttcgccctgcggagaggagccttgctgtttccaaatctctcctgctgaagagacattggagctagggcggctagtttcacctggctgtcacaaatcctctgcaccccaggagcgccgcttggacccccgggctcgctgcgtggtccatatctaggtcgggcctctcacggagactttcccaccagtgtaataaagaggagaaaacgtcacagcggaagggcctgaccctgctgcatccactaaggaaacagctacggggatgggaccctgggagctgctgtggagcctcatccaccgcttctctgaccccacccaggctgcttcccaggcctcagggtcttagtgtggacctccgggccgtgattaatgcaggtcagcaggaccagagcgccccttggtccctcccaacacatgagggtagtttgtgtggtgaggtcagggatagtgtctgcgcttctaccctgaatagggctcccttggaaaatactttaatatctctttttaaatacccccttggaccacttttaatagttttctgatagaactaaacagtgatcattctcttaattcatgtttccattaagtttttcaggttaagtactgcacgactactcgcttctgaaactgatagacactgcctcagctccgtgcagggcagacgcacaagagcagaatctccgtgggacatctctctggagcatcaatattactgcagtatttggaagaaacaaatttaaataagttctaaggtgaagaatggaacatttaagacaagtctggaaagtcatctgcctttaataactgtcgtttgtccttaacgtcagactttctccaagaccaaaactctaagaacttatttccattcttacaaatagtaaaaatgataaatcatatcaagtcaattgaaagtcctgcctgctgctttcctaaa

SEQ ID NO: 7735 - DNA, 2026 bp, Homo sapiens
ggctccacggccacatccgcaaaaagggtactggtgaacgtgacattttcacgaagccacagcccatggtcactccctgcaaagctctgaacttgcgcattcccaggccaggccgtggttgtctttccaaggcggctcagcttgtgctttgcttggagagagcggagggcagcagcacagtgacagcgtctgggacctcagaccagtttccacagccacttatgaaagcagacggctccatgggctggaggaggtgggacgctctggaaagaactcgggtgcgagtgggaaagaaaatcgagctgagcagcgggaagtcgaagtcgcgtgagtgaggaccagacactctcgatttaggcaaaggcggggtgcacttcccaacaacacatcctcctcactggcgagaccaggcctgcccttcaagttcctctcctgatttaatccccttggcgagggtttggcatgaaatcaatggccagcaagcttggtaaacgaagccgcctacaccgccctccccctccctgcacggccgcgccccgcctccgctcctgtctcaatctgggattgtcctcctgtagccccaccatccaccgtggggaacggtggagagactacaactcccagtatgcaccgcgatgcgcgcctcaccctgcatctcccagcccgcagccagctggcatcctagaccctctgccctgcgaccaacagccgggagcggaccagacaccagaactcccggaacggttgaagacggttccgctccctgtcccgcctttcgcagcccagcagtttcgccctgcggagaggagccttgctgtttccaaatctctcctgctgaagagacattggagctagggcggctagtttcacctggtaattgtgacaccctgtctcctcgagctgcaggcttttatgcttgtcatgttcgaagtttgataccttgcagatcaacaaagggtcggtggcctctcactgcctccgcggcagggttgtcaagtttttcaggttaagtactgcacgactactcgcttctgaaactgatagacactgcctcagctccgtgcagggcagacgcacaagagcagaatctccgtgggacatctctctggagcatcaatattactgcagtatttggaagaaacaaatttaaataagttctaaggtaaagaatggaacatttaagacaagtctggaaagtcatctgcctttaataactgtcgtttgtccttaacgtcagactttctccaagacaaaaactctaagaacttatttccattcttacaaatagtaaaaatgataaatcatatcaagtcaattgaaagtcctgcctgctgctttcctaaatcacaatatggccttggtatggttttatttgtacttttgtgggggattcgtggatctttagattaaaaaaaaaaataggtttttgaacaatttttgcaagtttgcagctgttagttattgatttatttttgcaacccatctaattcttctgtctctctcctctcctcaggctcaataattccatgggtctctaaggctgtgtttattttctttaaattttgttgatttacttttatactccatttgattttttctatctctcaccttttctcagactcagtcatcccacaggtctgtaaggctctgttcattttctttaaacttttttttttcctctcctcagattggataaattatattgctatgtctctgtttctgaactatagaaaagctcaaaattactatttttatttctcattttttatatggctattttttctctgctgatgtttcacatctattcatttatgagaatattttcctttgccctcatgagcgtgtttataatagctgccttcaaattcttgtctgccgtttacatcttggacatcttggagatggctactgcctgctttttatcttgtgtatttattacattttcacgtgtcttcacgcatctcttgaattggaaattgtgccctggagactgtatacaagactggattaaaaagactggattctg

SEQ ID NO: 7736 - DNA, 2329 bp, Homo sapiens
cgtccgttgagggcccgcgccgcatggaggccggctgaggagcgccgctgcctcgcctcggtacgccgcgcggcgcggacggcgcgctccccacaggtgcaggaagccgccgcccagccatggacggggaggagcagcagccaccgcacgaggccaacgtggaacctgttgtgccgtcagaggcttcagagccggtgcccagggtgctttctggagacccccagaacctgtccgacgtggacgccttcaacctgctcctggagatgaagctgaagcggcggcgtcagcggcccaacctgccgcgcactgtgacccagttggtggctgaggacgggagcagggtgtacgtggtggggacagcccacttcagcgacgacagcaagagggacgttgtgaagaccatccgggaggtgcagcctgacgtggtggtcgtggagctctgccaatatcgtgtgtccatgctgaagatggacgagagcacgctgctgcgggaggcccaggagctcagcctggagaagctgcagcaggccgtgaggcagaacgggctcatgtcggggctgatgcagatgctgctgctgaaggtgtctgcacacatcaccgagcagctgggcatggccccaggtggcgagttcagggaggccttcaaggaggccagcaaggtgcctttctgcaagttccacctgggtgaccgacccatccccgtcaccttcaagagggccatcgcagcgctctccttctggcagaaggtcaggctggcttggggcctgtgcttcctgtcagaccccatcagcaaggatgacgtggaacgctgcaagcagaaggacctactggagcagatgatggccgagatgattggcgagttcccagacctgcaccgcaccatcgtctcggagcgcgacgtctacctaacctacatgctgcgccaggccgcgcggcgcctcgagctgcctcgggcctctgacgccgagcccaggaagtgcgtcccctccgtggtcgtgggcgtcgtgggcatgggccacgtgcctggcatcgagaagaactggagcaccgacctcaacatccaggagatcatgaccgtgcccccgccgtccgtctccggcagagtgtctcggttggccgtgaaggccgccttcttcggcctgctgggctacagcctgtactggatgggccgccgcaccgcgagcctggtcctgtcgctgcccgccgcgcagtactgcctgcagagggtgaccgaggcccggcacaagtaggagactgctccccgcccgctcgggcccctgaggagccagtgcccccgcggcacttctgggtgccaggtgcatcctagcccgcccgaggcccctgccaccccccatgggggtctgggcccggcctcgcctgccctcctgggccagtcacccctcccccagcccacccaaataaaggattatttaactgtctgagctcaggcctcccggcagcccctcccctcccacactgcaggggccgttccccagcttctggacaagacacccagctccgagggggcaggggcttataggaggggccgaggcgtgcgctgccctctcagccctggtggcaggcgggggacaatggccactgtccctacctcactgtgccttcctgtgctccggccacaggagcgtcggcccaggggcggctcctgggggctccagggcaggcgagactgggaaaggcccagccctggagctccagccgaccccaccgtgcccctggcatcctggccctggccgccacctccctggcaccgtctgcctgcagggattctgtgtttttggcttttttaatgtcttaaaatcttttactcaggtaattttaatttcagagagaaaaactgaagtaaatgtcaaaaaacaccagccttaaatccaaagggagagaattcgtgttcttgggtctgtcccgagtgggctcgcgtgcagccaaacatcagctctgggtccaggcgtggcctcagctgggagcctgtgtcctgagcccccggagcgaaggggtgcctggggcatcttggccctctctgggcagacaatgtgtgcacctatgtggaaggccaaggacatgggctgtggccaggcctgtcccgctcaggccccctgcccggcggccgtctgtgtgcggggcctccctcctggctgtccaggacacagcccgtgcagccccagcctggacccaggccatctctggttgtgtctgtgccgactcggtgttgaatcaaatcaggtgtgcgtcaggagccggctgtgtccttcctgccacactcggggattcattccttagaaactgaaataaattctaattttggaaactc

SEQ ID NO: 7737 - DNA, 2272 bp, Homo sapiens
cccgtccgttgagggcccgcgccgcatggaggccggctgaggagcgccgctgcctcgcctcggctccccacaggtgcaggaagccgccgcccagccatggacggggaggagcagcagccaccgcacgaggccaacgtggaacctgttgtgccgtcagaggcttcagagccggtgcccagggtgctttctggagacccccagaacctgtccgacgtggacgccttcaacctgctcctggagatgaagctgaagcggcggcgtcagcggcccaacctgccgcgcactgtgacccagttggtggctgaggacgggagcagggtgtacgtggtggggacagcccacttcagcgacgacagcaagagggacgttgtgaagaccatccgggaggtgcagcctgacgtggtggtcgtggagctctgccaatatcgtgtgtccatgctgaagatggacgagagcacgctgctgcgggaggcccaggagctcagcctggagaagctgcagcaggccgtgaggcagaacgggctcatgtcggggctgatgcagatgctgctgctgaaggtgtctgcacacatcaccgagcagctgggcatggccccaggtggcgagttcagggaggccttcaaggaggccagcaaggtgcctttctgcaagttccacctgggtgaccgacccatccccgtcaccttcaagagggccatcgcagcgctctccttctggcagaaggtcaggctggcttggggcctgtgcttcctgtcagaccccatcagcaaggatgacgtggaacgctgcaagcagaaggacctactggagcagatgatggccgagatgattggcgagttcccagacctgcaccgcaccatcgtctcggagcgcgacgtctacctaacctacatgctgcgccaggccgcgcggcgcctcgagctgcctcgggcctctgacgccgagcccaggaagtgcgtcccctccgtggtcgtgggcgtcgtgggcatgggccacgtgcctggcatcgagaagaactggagcaccgacctcaacatccaggagatcatgaccgtgcccccgccgtccgtctccggcagagtgtctcggttggccgtgaaggccgccttcttcggcctgctgggctacagcctgtactggatgggccgccgcaccgcgagcctggtcctgtcgctgcccgccgcgcagtactgcctgcagagggtgaccgaggcccggcacaagtaggagactgctccccgcccgctcgggcccctgaggagccagtgcccccgcggcacttctgggtgccaggtgcatcctagcccgcccgaggcccctgccaccccccatgggggtctgggcccggcctcgcctgccctcctgggccagtcacccctcccccagcccacccaaataaaggattatttaactgtctgagctcaggcctcccggcagcccctcccctcccacactgcaggggccgttccccagcttctggacaagacacccagctccgagggggcaggggcttataggaggggccgaggcgtgcgctgccctctcagccctggtggcaggcgggggacaatggccactgtccctacctcactgtgccttcctgtgctccggccacaggagcgtcggcccaggggcggctcctgggggctccagggcaggcgagactgggaaaggcccagccctggagctccagccgaccccaccgtgcccctggcatcctggccctggccgccacctccctggcaccgtctgcctgcagggattctgtgtttttggcttttttaatgtcttaaaatcttttactcaggtaattttaatttcagagagaaaaactgaagtaaatgtcaaaaaacaccagccttaaatccaaagggagagaattcgtgttcttgggtctgtcccgagtgggctcgcgtgcagccaaacatcagctctgggtccaggcgtggcctcagctgggagcctgtgtcctgagcccccggagcgaaggggtgcctggggcatcttggccctctctgggcagacaatgtgtgcacctatgtggaaggccaaggacatgggctgtggccaggcctgtcccgctcaggccccctgcccggcggccgtctgtgtgcggggcctccctcctggctgtccaggacacagcccgtgcagccccagcctggacccaggccatctctggttgtgtctgtgccgactcggtgttgaatcaaatcaggtgtgcgtcaggagccggctgtgtccttcctgccacactcggggattcattcct

SEQ ID NO: 7738 - DNA, 2172 bp, Homo sapiens
ccggtgtgcctcggcagccttgcgctgctctaatggtccggacttccgtgtgctccccacaggtgcaggaagccgccgcccagccatggacggggaggagcagcagccaccgcacgaggccaacgtggaacctgttgtgccgtcagaggcttcagagccggtgcccagggtgctttctggagacccccagaacctgtccgacgtggacgccttcaacctgctcctggagatgaagctgaagcggcggcgtcagcggcccaacctgccgcgcactgtgacccagttggtggctgaggacgggagcagggtgtacgtggtggggacagcccacttcagcgacgacagcaagagggacgttgtgaagaccatccgggaggtgcagcctgacgtggtggtcgtggagctctgccaatatcgtgtgtccatgctgaagatggacgagagcacgctgctgcgggaggcccaggagctcagcctggagaagctgcagcaggccgtgaggcagaacgggctcatgtcggggctgatgcagatgctgctgctgaaggtgtctgcacacatcaccgagcagctgggcatggccccaggtggcgagttcagggaggccttcaaggaggccagcaaggtgcctttctgcaagttccacctgggtgaccgacccatccccgtcaccttcaagagggccatcgcagcgctctccttctggcagaaggtcaggctggcttggggcctgtgcttcctgtcagaccccatcagcaaggatgacgtggaacgctgcaagcagaaggacctactggagcagatgatggccgagatgattggcgagttcccagacctgcaccgcaccatcgtctcggagcgcgacgtctacctaacctacatgctgcgccaggccgcgcggcgcctcgagctgcctcgggcctctgacgccgagcccaggaagtgcgtcccctccgtggtcgtgggcgtcgtgggcatgggccacgtgcctggcatcgagaagaactggagcaccgacctcaacatccaggagatcatgaccgtgcccccgccgtccgtctccggcagagtgtctcggttggccgtgaaggccgccttcttcggcctgctgggctacagcctgtactggatgggccgccgcaccgcgagcctggtcctgtcgctgcccgccgcgcagtactgcctgcagagggtgaccgaggcccggcacaagtaggagactgctccccgcccgctcgggcccctgaggagccagtgcccccgcggcacttctgggtgccaggtgcatcctagcccgcccgaggcccctgccaccccccatgggggtctgggcccggcctcgcctgccctcctgggccagtcacccctcccccagcccacccaaataaaggattatttaactgtctgagctcaggcctcccggcagcccctcccctcccacactgcaggggccgttccccagcttctggacaagacacccagctccgagggggcaggggcttataggaggggccgaggcgtgcgctgccctctcagccctggtggcaggcgggggacaatggccactgtccctacctcactgtgccttcctgtgctccggccacaggagcgtcggcccaggggcggctcctgggggctccagggcaggcgagactgggaaaggcccagccctggagctccagccgaccccaccgtgcccctggcatcctggccctggccgccacctccctggcaccgtctgcctgcagggattctgtgtttttggcttttttaatgtcttaaaatcttttactcaggtaattttaatttcagagagaaaaactgaagtaaatgtcaaaaaacaccagccttaaatccaaagggagagaattcgtgttcttgggtctgtcccgagtgggctcgcgtgcagccaaacatcagctctgggtccaggcgtggcctcagctgggagcctgtgtcctgagcccccggagcgaaggggtgcctggggcatcttggccctctctgggcagacaatgtgtgcacctatgtggaaggccaaggacatgggctgtggccaggcctgtcccgctcaggccccctgcccggcggccgtctgtgtgcggggcctccctcctggctgtccaggacacagcccgtgcagccccagcctggacccaggccatctctggt

SEQ ID NO: 7739 - DNA, 1926 bp, Homo sapiens
tggagccccgtgctccagaggaaactccgtgcccaactgggggctccccgccccgctgaggggcgccgcccaggagggtcccccgcgccccgcgggccctggcaggatgcacgccgccctggcggggccgctgctcgccgccctcctcgccaccgctcgcgcccgcccgcagcccccggacggaggacagtgccggccgcccggatcgcagagggacttgaactccttcctgtggacgattcggcgtgatcctccggcctacctgtttggcactattcacgtcccctacacccgcgtctgggacttcatcccggacaactccaaggcagccttccaggctagcacccgtgtctactttgagctggaccttacagacccctacaccatctcggccctggccagctgccagctgctgccgcacggggaaaacctgcaggacgtgctgccccacgagctttactggcgcttgaagcgccacctggactacgtgaagttgatgatgccctcctggatgacgcccgctcagcggggcaaggggctctatgctgactacctattcaatgccatcgcgggcaactgggagcgcaagaggcccgtctgggtgatgctcatggtaaactcgctcacagagagggacgtgcgcttccgtggtgtgcccgtgctcgacctctacctggcccagcaggctgagaagatgaagaagaccacaggggctgtggagcaggtggaggagcagtgccatcccctcaacaacgggctcaacttctcccaggtgctgtttgccctgaaccaaaccctgctgcagcaggagagtgtgcgggccgggagcctgcaggcctcctacaccacggaggacctcatcaagcactacaactgcggagacctcagcgcagtcatcttcaaccacgacacatcccagctgcccaactttatcaacaccaccctcccgccacacgagcaggtgacggcccaggagattgacagctacttccgccaggagctcatctacaagaggaatgagcgcatggggaagagggtcatggcgcttctacgggagaacgaggacaagatctgcttctttgccttcggagcaggtcactttctggggaacaacacagtcatcgacatcctgcggcaggcagggctggaggtggaccacacacccgccgggcaggccatacacagccctgccccccagagcccagcgccctctcctgaggggacctcgacgagcccggccccagtgaccccagctgccgctgtccccgaagcaccctctgtgacccccaccgccccaccagaggatgaggatccagccctgtccccacacctcctgctccccgacagcctcagccagctggaggagtttggccggcagaggaagtggcacaagaggcagagcacacaccagcggccgcggcagttcaatgacctctgggtccgcatcgaggacagcaccaccgcctcaccacccccgctgcccctgcagcccacccacagctcggggaccgccaagccccccttccagctttcagaccagctacaacagcaggacccgccagggcccgccagcagctcggcacccaccctgggccttctccccgccatcgccaccaccatcgctgtctgcttcctgctgcatagccttgggccctcctgacctcggccaccccaagtggagaagccagagaaatgacacaggggtcttcggccacacccaactgctcctgccaccacctccagggggtgcccaacacgtcgagggcagtccacatgggattggctagacactctagagctttactgtacccaagttacatcttcttttttgtagaaggatcttaatttcccatagtgctatggggctcttttgtaaaatacgtgtccatattaaaaaagaaaaatgtatttattctaccgataaaa

SEQ ID NO: 7740 - DNA, 3072 bp, Homo sapiens
tttacaaaggccccgggcgcgagaggacgtgctctgccagccagtgggaaggcaggccgcgcgcgcgggagcgcgggaggatcggcggctcgcggtcactggtccctggctcggttccccgcaccccggggctcacacttacccgcgcggaggagcagcggccgggtgtccacccccatcctgcgcccagtctcctcgattcccctcgctctgagccgggagagccgaacagctgaagagagttcactgactccccagccccaggtgggccttgtgcacatcatgaccagttttgaagatgctgacacagaagagacagtaacttgtctccagatgacggtttaccatcctggccagttgcagtgtggaatatttcagtcaataagttttaacagagagaaactcccttccagcgaagtggtgaaatttggccgaaattccaacatctgtcattatacttttcaggacaaacaggtttcccgagttcagttttctctgcagctgtttaaaaaattcaacagctcagttctctcctttgaaataaaaaatatgagtaaaaagaccaatctgatcgtggacagcagagagctgggctacctaaataaaatggacctgccatacaggtgcatggtcagattcggagagtatcagtttctgatggagaaggaagatggcgagtcattggaattttttgagactcaatttattttatctccaagatcactcttgcaagaaaacaactggccaccacacaggcccataccggagtatggcacttattcgctctgctcctcccaaagcagttctccgacagaaatggatgaaaatgagtcatgaacacagaaagtctaagaggagaaatatgatggatgaagagctctgtagatgctgtatagacactaaataagagttgattagggtagtatattatagtcatctgttatgctgtgaaatttggaattcagtattatcattttgaagtctgtaaattgtgttagtcattaacttagtcacctgttgtattctggatctacacaaaattattttaactgctcttattaatctgtgaggattaatatacaaaaagtatcctttgagatgaagtcgtgttctcaaaataaggttatattattttctttttctgcttgattttcatcttgtgttttgctttgtttttgtaaggaaccatctcttggtttggtcacatcagttcacaacagccatttgttttcaaggtcaaggctccaggcaggttgttactggtgtttgcagcctgtcagtacttgcagtactggaataggttctaggctagtgtctgcgcgtcactgtggttttagcatgggaggacttatttgagaaatactaccttacttttctatgatttctttttacagagttatagtgtgtttactcctaagatgacagttctctttgtctatattcagcatctaagacaaatatttaaacattttaaagaaccactgtgttaagtttaggattatttacttaccaaattagaagtttgacttttatgtgttatacacaatcttaaaatttcacgaattcacctttttaatagtatccatgtacataataaaatcaaagtttaattagccattttctttgaatttttttctaaataagggaaataactgttcttgggccactttacagagataaatgtatgtgaatgtttatgataaacgcttaaatatttctaaaatattaacttcaaaaaagtctttttcagttcttaaataaaaatttatttatttaagatacttattcgacttatcttaactaaggtagctatgaatgttaagtagatgaggtaaccattcagttaagttaaattgtagcattgccaggtagtgaggctcactgtacaattttccaggtaaatgaaatttcctgtagtaagaggtccgtatttttgtaacagccttttaaaaatgcttttgggaaccctccagcctcttaccaaaagaggctttaaacctcatcttgattcagactgtcagtctattcctgggcagtagtatgtgatgtccagcaccctaaccccgactccccagccctgggactattccagtagagtgaaatatttgtccctgtacaaagtggcctgaatgactgttggagttcctgtgtctggttttcctgtttattccctgtgatgcccagagtaatggcccatccaaagatgtccagatgtccatgtgctagtctccagaacttgtaactgtgttgttatgtggcaaaggggaatgaaggctgcagatggaagtaaaatagattatgctggattatctgggtgtgcccaattgatcaccggatccgtaaaagtggaagagaggcagatcaggatgtcagcgtgatgaggtgtgagacagacttgacttgctgttgctgggaggaaggggaggtcatgagccaaggaatgtggacagtctcttgaagctggaaagtgtgcattggacatctggaagccagaaaagacaaagaaatatccagaaaggaacaaagtcttgtggacaccttgattttggtccagtgagaatatgtttgacttgttaacctacaaaactttatgatgataaatttgtgttggtcgtaagccactaaatcacagtaatttgttatagcagcagatagaaaactaatatactccctttaatataaggttatctactattgattctttctaggattttagcttctggtctgatgtgggtttacagccagatcacccggcttgaattgcttacagtgtgtagtctcatggtaaaggcgttctatgagtgaagtgtatatactttaatgtgtgtatactgtcacattttgactattttggaagactttcacctctgtttcttgtctttgaggctgatgaatgtgtttctaagttataaatttaatattaagggattcatgtattattgttattgaatccaaacaatgtgttaagtaatatttagggccagaaaaatcttgtacagaataatgatttctcctaatgtaaatcttggaaagggttttgttcaacttgagaaatattaaattttttattct

SEQ ID NO: 7741 - DNA, 2660 bp, Homo sapiens
gcgcgagaggacgtgctctgccagccagtgggaaggcaggccgcgcgcgcgggagcgcgggaggatcggcggctcgcggtcactggtccctggctcggttccccgcaccccggggctcacacttacccgcgcggaggagcagcggccgggtgtccacccccatcctgcgcccagtctcctcgattcccctcgctctgagccgggagagccgaacagctgaagagagttcactgactccccagccccaggtgggccttgtgcacatcatgaccagttttgaagatgctgacacagaagagacagtaacttgtctccagatgacggtttaccatcctggccagttgcagtgtggaatatttcagtcaataagttttaacagagagaaactcccttccagcgaagtggtgaaatttggccgaaattccaacatctgtcattatacttttcaggacaaacaggtttcccgagttcagttttctctgcagctgtttaaaattcaacagctcagttctctcctttgaaataaaaaatatgagtaaaaagaccaatctgatcgtggacagcagagagctgggctacctaaataaaatggacctgccatacaggtgcatggtcagattcggagagtatcagtttctgatggagaaggaagatggcgagtcattggaattttttgagactcaatttattttatctccaagatcactcttgcaagaaaacaactggccaccacacaggcccataccggagtatggcacttattcgctctgctcctcccaaagcagttctccgacagaaatggatgaaaatgagtcatgaacacagaaagtctaagaggagaaatatgatggatgaagagctctgtagatgctgtatagacactaaataagagttgattagggtagtatattatagtcatctgttatgctgtgaaatttggaattcagtattatcattttgaagtctgtaaattgtgttagtcattaacttagtcacctgttgtattctggatctacacaaaattattttaactgctcttattaatctgtgaggattaatatacaaaaagtatcctttgagatgaagtcgtgttctcaaaataaggttatattattttctttttctgcttgattttcatcttgtgttttgctttgtttttgtaaggaaccatctcttggtttggtcacatcagttcacaacagccatttgttttcaaggtcaaggctccaggcaggttgttactggtgtttgcagcctgtcagtacttgcagtactggaataggttctaggctagtgtctgcgcgtcactgtggttttagcatgggaggacttatttgagaaatactaccttacttttctatgatttctttttacagagttatagtgtgtttactcctaagatgacagttctctttgtctatattcagcatctaagacaaatatttaaacattttaaagaaccactgtgttaagtttaggattatttacttaccaaattagaagtttgacttttatgtgttatacacaatcttaaaatttcacgaattcacctttttaatagtatccatgtacataataaaatcaaagtttaattagccattttctttgaatttttttctaaataagggaaataactgttcttgggccactttacagagataaatgtatgtgaatgtttatgataaacgcttaaatatttctaaaatattaacttcaaaaaagtctttttcagttcttaaataaaaatttatttatttaagatacttattcgacttatcttaactaaggtagctatgaatgttaagtagatgaggtaaccattcagttaagttaaattgtagcattgccaggtagtgaggctcactgtacaattttccaggtaaatgaaatttcctgtagtaagaggtccgtatttttgtaacagccttttaaaaatgcttttgggaaccctccagcctcttaccaaaagaggctttaaacctcatcttgattcagactgtcagtctattcctgggcagtagtatgtgatgtccagcaccctaaccccgactccccagccctgggactattccagtagagtgaaatatttgtccctgtacaaagtggcctgaatgactgttggagttcctgtgtctggttttcctgtttattccctgtgatgcccagagtaatggcccatccaaagatgtccagatgtccatgtgctagtctccagaacttgtaactgtgttgttatgtggcaaaggggaatgaaggctgcagatggaagtaaaatagattatgctggattatctgggtgtgcccaattgatcaccggatccgtaaaagtggaagagaggcagatcaggatgtcagcgtgatgaggtgtgagacagacttgacttgctgttgctgggaggaaggggaggtcatgagccaaggaatgtggacagtctcttgaagctggaaagtgtgcattggacatctggaagccagaaaagacaaagaaatatccagaaaggaacaaagtcttgtggacaccttgattttggtccagtgagaatatgtttgacttgttaacctacaaaactttatgatgataaatttgtgttggtcgtaagccactaaatcacagtaatttgttatagcagcagatagaaaactaatatactccctttaat

SEQ ID NO: 7742 - DNA, 769 bp, Homo sapiens
gactgagctgctccttgtgggaactgctgatgttttgacaaaagaaagagggaaggtggaactacacagtggcttttaagtttctgcttggaagtgggccttgtgcacatcatgaccagttttgaagatgctgacacagaagagacagtaacttgtctccagatgacggtttaccatcctggccagttgcagtgtggaatatttcagtcaataagttttaacagagagaaactcccttccagcgaagtggtgaaatttggccgaaattccaacatctgtcattatacttttcaggacaaacaggtttcccgagttcagttttctctgcagctgtttaaaaaattcaacagctcagttctctcctttgaaataaaaaatatgagtaaaaagaccaatctgatcgtggacagcagagagctgggctacctaaataaaatggacctgccatacaggtgcatggtcagattcggagagtatcagtttctgatggagaaggaagatggcgagtcattggaattttttgagactcaatttattttatctccaagatcactcttgcaagaaaacaactggccaccacacaggcccataccggagtatggcacttattcgctctgctcctcccaaagcagttctccgacagaaatggatgaaaatgagtcatgaacacagaaagtctaagaggagaaatatgatggatgaagagctctgtagatgctgtatagacactaaataagagttgattagggtagtatattatagtcatctg

SEQ ID NO: 7743 - DNA, 1106 bp, Homo sapiens
gtgggcaccagcccccgcgcccgcccgcccgcccagcggtccggtccaggcgcccgcgcagaatcagctgtctgagctgcccaggcggcgggggagcagcgagcgggcttcagcgagccgcaggaggcacaggcctgtcctgggtccccgcaggtctgcgcgtctgttgttcccagcgctcttggaggcctgcaaaggaagagcaacctgtccagactccccgcaggacaggaaaaagagaaatctcgacatggaaaaaccctacaataaaaatgaaggaaacctggaaaacgagggaaagccagaagatgaagtagagcctgatgatgaaggaaagtcagacgaggaagaaaagccagacgcggaggggaagacagaatgcgagggaaagcgaaaggctgagggagagccaggtgatgagggacaactggaagataagggaagccaggaaaagcagggcaagtccgaaggtgagggcaagccacaaggcgagggcaagccagcctcccaggcaaagccagagggccagccgcgggccgccgaaaagcgcccggctggagattatgtgccccggaaagcaaaaagaaaaacagacagggggacggacgattcccccaaggactctcaggaggacttacaggaaaggcatctgagcagtgaggagatgatgagagaatgtggagatgtgtcaagggctcaggaggagctaaggaaaaaacagaaaatgggtggttttcattggatgcaaagagatgtacaggatccattcgcccaaggggacaacggggtgtcaggggagtgaggggtggaggtaggggccaaagaggcttacacgatatcccatacctttaatgcctttggccttccattctgacttctctgatgagattattgtcaaccctgctttccctggtagatatttgccaggcccaatgctttaaccttaagctgatatttttgctttagatgtcaatctcgttaccagcagccttttgacccaactacagcgctctatattttagtagaggattttcacccatgtgcatggaaaagatgttcatgacacattgtaaaaaataaataaataaagaacagtttgcagaacc

SEQ ID NO: 7744 - DNA, 1877 bp, Homo sapiens
acatcccgaggaacagaagcgggcctgctcagctgtctgcaaggaccggcgttccagaccaagtggcccgctgctccgaggacccagctcgctccaggctgtgactccacatcccgaggtcgccgcctggcgaccgggcagcgaggaccggccaccccagactgcctgtgccgccgccccgagctcggacagagccgcgaccgcgaggacagcgacgcctgcacagctctggcgagatggcggcagggtccactacgctgcgcgcagtggggaagctgcaggtgcgtctggccactaagacggagccgaaaaagctagagaaatatttgcagaaactctccgccttgcccatgaccgcagacatcctggcggagactggaatcagaaagacggtgaagcgcctgcggaagcaccagcacgtgggcgactttgccagagacttagcggcccggtggaagaagctggtgctcgtggaccgaaacaccgggcctgacccgcaggaccctgaggagagcgcttcccgacagcgcttcggggaggctcttcaggagcgggaaaaggcctggggcttcccagaaaacgcgacggcccccaggagcccatctcacagccctgagcacagacggacagcacgcagaacacctccggggcaacagagacctcacccgaggtctcccagtcgcgagcccagagccgagagaaagcgccccagaatggccccagctgattccggcccccatcgggaccctccaacgcgcaccgctcccctcccgatgcccgagggccctgagcccgctgtgcccggggagcaacccggaagaggccacgctcacgccgctcagggcgggcctctgctgggtcaaggctgccagggccaaccccagggggaagcggtggggagccacagcaaggggcacaaatcgtcccgcggggcttcggctcagaaatcgcctcctgtccaggaaagccagtcagagaggctgcaggcggccgtcgctgattccgccgggccgaaaacggtgcccagccatgtcttctcggagctctgggacccctcagaggcctggatgcaggccaactacgatctgctgtccgcttttgaggccatgacctcccaggcaaacccagaagcactctccgcgccaacgctccaggaggaagctgctttccctggacgcagagtgaacgctaagatgccggtgtactcgggctccaggcctgcctgccagctccaggtgccgacgctgcgccagcagtgcctccgggtgcctaggaacaatccggacgccctcggcgacgtggaaggggtcccctactcggctcttgaacccgttctggaagggtggacgcccgatcagccgtaccgcacagagaaagacaatgccgcactcgctcgagagacagatgaattatggaggattcattgcctccaggacttcaaggaagaaaagccacaggagcacgagtcttggcgggagctgtacctgcggcttcgggacgcccgagagcagcggctgcgagtagtgaccacgaaaatccgatccgcacgtgaaaacaaacccagcggccgacagacaaagatgatctgtttcaactctgtggccaagacgccttatgatgcttccaggaggcaagagaagtctgcaggagccgctgaccccggaaatggagagatggagccagcccccaagcccgcaggaagcagccaggctccctccggcctcggggacggcgacggcggcagcgtgagcggcggcggcagcagcaaccggcacgcggcgcccgcggacaaaacccgaaaacaggctgccaagaaagtggccccgctgatggccaaggcaattcgagactacaagggaagattctcccgacgataa

SEQ ID NO: 7745 - DNA, 2618 bp, Homo sapiens
gagttcgctccggagccgcgccgccgccggcccagcatctcgggcgcccgccgcccccgccgccgccgtcagcgcggggatgtaggatgcaggcgggcgccaggttccagcggcggcggcggcagctgcagcagcagcagccccggcggcggcagcctctcctctggccgatggacgcagagccgccgccgccgccgccctgggtctggatggtgccgggctcggccgggctgctccggctcagcgcgggggtcgtggttcccccggtgctgctcgcctcggccccgccgcccgcggccccgctgctccccggtctccccggctggccggccccgagcgagccggtgctcccgctgctgccgctgccctctgcgccagactccgccgccgccgccgccgcgcaccccttccccgcgctccacgggcagtggctgtttggtggccattctccgtccctaggactgcccccctcttccacagtggagctggtgcccgtcttcccacatctctgcccttctgctcttgcaacccctattgggaaaagttggatagacaaaaggattcctaactgtaagatcttttttaataattcctttgctctggactcaacgtggatacatcctgaggagtcaaggtttttccatgggcatgaaaagcctcgtttgctggcaaatcaagtagctgtgtctctgtccaggccggctcctgcctccaggccgctccccacggtggtgttagcacctcagcccatcccaggtggctgccataacagccttaaggtgaccagcagccccgccattgccatcgccaccgccgccgccgctgccatggtctccgtggaccctgagaacctccggggcccgtccccctccagcgtgcagccgcgccacttcctgaccttggcacccatcaaaatacccctccggacgtcccccgtctcagatacaaggacagagcggggccgagtggcccgccctcctgccctgatgctgcgggcccagaagagccgggatggagacaaagaagacaaggagcctccaccgatgctggggggaggagaggacagcacagccagaggcaacaggccagtggcctccaccccggtgcccggatccccctggtgtgtggtctggacgggcgatgaccgagttttcttcttcaacccaacgatgcacctgtctgtctgggagaagcccatggacctgaaggaccgcggagacctcaacaggatcattgaggacccgccccacaaacgcaagctggaggcaccagcaactgacaacagcgatgggtccagttctgaagacaacagggaagaccaagatgtgaaaaccaagaggaaccggaccgaaggctgcgggagtcccaagccagaggaggcaaagagagaggacaaaggcacaaggacgccgcccccgcagatcctcctgcctctggaggagcgtgtgacccacttccgagacatgctgctggagagaggggtatcagcattttctacctgggagaaagaattacacaaaatcgtgtttgacccacgctatctcctgctcaactctgaggaacgaaagcagatatttgaacagtttgtcaagacaagaataaaagaagaatacaaggaaaagaaaagtaaattgctgctagccaaagaagaattcaagaaacttctagaggaatctaaagtgtctcccaggaccacgtttaaggagtttgcagagaaatacggccgggatcagaggttccgacttgttcaaaaaagaaaggaccaggagcattttttcaaccaattcatacttattcttaagaaacgggacaaggaaaacagactaaggctgcggaaaatgagatgagtttgtgaaaaaatgcaataagcccgggggttgaccctgggcgtgccgggggcgagggggtcacggtggagacggacacgggcgtggggcggccgagacctgcacggcccagcgggcaccggcactgcggggtcttcgttctcagaggattactgtttcatattgaagctctctcttttgtacattcagagtttgatgcatttctaatcaccgtgatacgtcgatcccttaattgttttaattatgcaaattacttgtaatatacacaaattatcaatccactgcaggactgtggggaagcaggaacgggagcctctgtaacaatctcaaggcatttgtgtcatcacctaagacgattggcgaaaacttttctgaaaacctttgtgaattacttcgtttctccaggattcccgcagtgttgaggaattccttactctgtccctaggtctcagtctcgtttctgagtagcagcaatagggttttcatcattcatcatagtgacaactgtgagcattccacacctggaccgtggatcacttacaggtttccaagggtggccgcgcgttcctcccagaggggcgtcccggcctggagcagggagccgtgttggttgccaccggtcctacttcaaaagaattattttgtacaaaatcatcatattaatatttgagttatttttattgtatgcccggagtttgcatgagattttttctcatcacctttgtataaaaaatttttaattttttttaatcaataaatattttaaaccag

SEQ ID NO: 7746 - DNA, 2450 bp, Homo sapiens
agccgcctcagcccccggcgtagcctctccggtgggccaggtcctccgcccgacctgccttagccggtcggagcacacacgcctggccgcggggcgcccgcataaaagtcacagccagcggaggttggaaacagccgtcgacttgggcatcggccggacgaggatggagtgaccagcgcggccctggccacacaggccctgctccacgcccctcgcccgccctcacgacggagcggagctccactcagccgctccaggaaaggaagcccaagaactccggagttccgcaactctccccagacgtccggaagcaaatcgcgtcccaggcaaaacgagctcgcttgagagcgcccttagccccgttgggctgctgcgcgcgcggcgcgggaagctgccatggaccgcggccgcccagcgggcagccccctcagcgccagcgccgagcccgcgcccctggccgccgccatccgcgactcgcgtcccgggcggaccgggccggggccggcgggccctgggggcggctcgcgttccgggagcgggcggccggcggcggcgaatgcggcgcgggagcgcagccgggtgcagaccctgcggcacgctttcctggagctgcagcgcacgctgccgtccgtgccgcccgacaccaagctgtccaagctggacgtgctgctgctggccaccacctacatcgcgcatctcacccgcagcctgcaggacgacgccgaggcgccggcggacgccgggttgggcgccctgcgcggcgatggctacctgcacccggtcaagaaatggcccatgcgatcaagattgtacatcggtgctactggtcagtttctgaagcattctgtttctggagaaaaaacaaatcatgacaacactccaacagactcacagccttaggctctcccctggtgggggctggtagaagtggtggctattgtttttaaatactatgacataattctatatttattatatgagacataacaaaatttctgaaagtttacatgtgaacccatagttggatgttcaggtttatctgtctaaatgtggaatgaaataatcagtgttatataaaacacacagcttatctgttcagtgtgagagtcactactatatagtgcaagagaaattattagaaaaaagtcacatgaaagcaaacaattgtgtatatagctaaagaatgcaatatagatattgctatagtgtatctattacaaacagaaaagttcatatctattggtgcagtcttcctagtttaaaaagataaaaatctgtgtttataatatacgagtattccttttttgtgaaaaccatactgttcttaagttgatctaagacaccatttcaattgaagaaaactgttgcagtaatatgaagatgcaataaattcaataagtagttacttttccctcttagaaaacttgtttggagtattagaaatggtttgctcagaggacagggcttggtcaccttcctagagggttattctgtatcttacagtgtttgcaacttgtggaaggcactgggaatccctgcagtccagtgtgaacaggagaccaggtgtcagcggacagcagagttcacaatgtaggtgcatgtcaccacacctggctaattcttttattttttgtagagatggagtctcactgtgttgcctaggctactcttgaaatcctggctcaataaatcctcctgcctcacctaccaaagtgttgggattataggctagagccaccgtgcctggcccagttttattgttttaatgtgaatatactcataatgtgacagaagcatatctttttgcaagaaagatatataatagttctctacatattaatatgtagaaaagtacttgcatatttaaatatttgtaaacatatttacctactcatggaaagaaataaaaagtaaaatgagatttggattcagccattcactattataagttattgacataagaagtgctaaaaagaatctttatcctaaggaatgaaatcaaaacttcttcaaagttacctcaaactgaattgtaaacactaaatttaacagcaagaatttcagaaaaatgattttcttgctaataattcttaagatttattagtttggctagtttttaaagcatttaactggggaaaaaactatgtgttgaataattagatttctaagtcatcctgttaaatagttagtagagctttgcctttgatggtattactttttaattcttctcatccagttacaagttgtattaatgccaaagaagtgtatttgttacagattttcataacattttattaaattgctagatatgatgataggttttggtatgtttacagaggagaaattgcatattttcactcagattcaaaagagcatgctcttttaatgctttaatggtgaatggtcatgataagaggtattataaaaataaagtactaatttgaaaatta

SEQ ID NO: 7747 - DNA, 12677 bp, Homo sapiens
cgcgccggggcctggtgctcggtcggcgggtgctgccgctttaagcgggggcgggactgcgcgcggccgagcggttgcgacgagggctcggctgggggtcgccggggtcgcgggccgggcctgcaggagccgggccgccgaggtcggggctggttgaactcatggacctgatacttttctcttgagaagcaaaccagcccaaaagaaaaatggcgtttgttgcaacacagggggccacggtggttgaccagaccactttgatgaaaaagtaccttcagtttgtggcagctctcacagatgtgaatacacctgatgaaacaaagttgaaaatgatgcaagaagttagtgaaaattttgagaatgtcacgtcatctcctcagtattctacattcctagaacatatcatccctcgattccttacatttctccaagatggagaagttcagtttcttcaggagaaaccagcacagcaactgcggaagctcgtacttgaaataattcatagaataccaaccaacgaacatcttcgtcctcacacaaaaaatgttttgtctgtgatgtttcgctttttagagacggaaaatgaagaaaatgttcttatttgtctaagaataattattgagctacacaaacagttcaggccaccgatcacacaagaaattcatcattttctggattttgtgaaacagatttacaaggagcttccaaaagtagtgaaccgctactttgagaaccctcaagtgatccccgagaacacagtgcctcccccagaaatggttggtatgataacaacgattgctgtgaaagtcaacccggagcgtgaggacagtgagactcgaacacattccatcattccgaggggatcactttctctgaaagtgttggcagaattgcccattattgttgttttaatgtatcagctctacaaactgaacatccacaatgttgttgctgagtttgtgcccttgatcatgaacaccattgccattcaggtgtctgcacaagcgaggcaacataagctttacaacaaggagttgtatgctgacttcattgctgctcagattaaaacattgtcatttttagcttacattatcaggatttaccaggagttggtgactaagtattctcagcagatggtgaaaggaatgctccagttactttcaaattgtccagcagagactgcacacctcagaaaggagcttctgattgctgccaaacacatcctcaccacagagctgagaaaccagttcattccttgcatggacaagctgtttgatgaatccatactaattggctcaggatatactgccagagagactctaaggcccctcgcctacagcacgctggccgacctcgtgcaccatgtccgccagcacctgcccctcagcgacctctccctcgccgtccagctcttcgccaagaacatcgacgatgagtccctgcccagcagcatccagaccatgtcctgcaagctcctgctgaacctggtggactgcatccgttccaagagcgagcaggagagtggcaatgggagagacgtcctgatgcggatgctggaggttttcgttctcaaattccacacaattgctcggtaccagctctctgccatttttaagaagtgtaagcctcagtcagaacttggagccgtggaagcagctctgcctggggtgcccactgcccctgcagctcctggccctgctccctccccagcccctgtccctgccccacctccacccccgcccccacccccacctgccacccctgtgaccccggcccccgtgcctcccttcgagaagcaaggagaaaaggacaaggaagacaagcagacattccaagtcacagactgtcgaagtttggtcaaaaccttggtgtgtggtgtcaagacaatcacgtggggcataacatcatgcaaagcacctggtgaagctcagttcattcccaacaagcagttacaacccaaagagacacagatttacatcaaacttgtgaaatatgcaatgcaagctttagatatttatcaggtccagatagcaggaaatggacagacatacatccgtgtggccaactgccagactgtgagaatgaaagaggagaaggaggtattggagcatttcgctggtgtgttcacaatgatgaaccccttaacgttcaaagaaatcttccaaactacggtcccttatatggtggagagaatctcaaaaaattatgctcttcagattgttgccaattccttcttggcaaatcctactacctctgctctgtttgctacgattctggtggaatatctccttgatcgcctgccagaaatgggctccaacgtggagctctccaacctgtacctcaagctgttcaagctggtctttggctctgtctccctctttgcagctgaaaatgaacaaatgctgaagcctcacttgcacaagattgtgaacagctctatggagctcgcgcagactgccaaggaaccctacaactacttcttgctgctacgggcgctgtttcgctctattggtggaggtagccacgatctcttgtatcaggagttcttgcctctccttccaaacctcctgcaagggctgaacatgcttcagagtggcctgcacaagcagcacatgaaggacctctttgtggagctgtgtctcaccgtccctgtgcggctgagctcgcttttgccgtacctgcccatgcttatggatcccttggtgtctgcactcaatgggtctcagacattggtcagccaaggcctcaggacgctggagctgtgtgtggacaacctgcagcccgacttcctctacgaccacatccagccggtgcgcgcagagctcatgcaggctctgtggcgcaccttacgcaaccctgctgacagcatctcccacgtggcctaccgtgtgctcggtaagtttggcggcagtaacaggaagatgctgaaggagtcgcagaagctgcactacgttgtgaccgaggttcagggccccagcatcactgtggagttttccgactgcaaagcttctctccagctccccatggagaaggccattgaaactgctctggactgcctgaaaagcgccaacactgagccctactaccggaggcaggcgtgggaagtgatcaaatgcttcctggtggccatgatgagcctggaggacaacaagcacgcactctaccagctcctggcacaccccaactttacagaaaagaccatccccaatgttatcatctcacatcgctacaaagcccaggacactccagcccggaagacttttgagcaggccctgacaggcgccttcatgtctgctgtcattaaggacctgcggcccagcgccctgccctttgtcgccagcttgatccgccactatacgatggtggcagtcgcccagcagtgtggccctttcttgctgccttgctaccaggtgggcagccagcccagcacagccatgtttcacagtgaagaaaatggctcgaaaggaatggatcctttggttctcattgatgcaattgctatttgtatggcatatgaagaaaaggagctttgcaaaatcggggaggtggccctagctgtgatatttgatgttgcaagtatcatcctgggctccaaggagagggcctgccagctgcccctgttttcttacatcgtggagcgcctgtgtgcatgttgttatgaacaggcgtggtatgcaaagctggggggtgtggtgtctattaagtttctcatggagcggctgcctctcacttgggttctccagaaccagcagacattcctgaaagcacttctctttgtcatgatggacttaactggagaggtttccaatggggcagtcgctatggcaaagaccacgctggagcagcttctgatgcggtgcgcaacgcctttaaaagacgaggagagagccgaagagatcgtggccgcccaggaaaagtctttccaccatgtgacacacgacttggttcgagaagtcacctctccaaactccactgtgaggaagcaggccatgcattcgctgcaggtgttggcccaggtcactgggaagagtgtcacggtgatcatggaaccccacaaagaggtcctgcaggatatggtcccccctaagaagcacctgctccgacaccagcctgccaacgcacagattggcctgatggaggggaacacgttctgtaccacgttgcagcccaggctcttcacaatggaccttaacgtggtggagcataaggtgttctacacagagctgttgaatttgtgtgaggctgaagattcagctttaacaaagctgccctgttataaaagccttccgtcactcgtacctttacgaattgcggcattaaatgcacttgctgcctgcaattaccttcctcagtccagggagaaaatcatcgctgcactcttcaaagccctgaattccaccaatagtgagctccaagaggccggagaagcctgtatgagaaagtttttagaaggtgctaccatagaagtcgatcaaatccacacacatatgcgacctttgctgatgatgctgggagattaccggagcttgacgctgaatgttgtgaatcgcctgacttcggtcacgaggctcttcccaaattccttcaatgataaattttgtgatcagatgatgcaacatctgcgcaagtggatggaagtggtggtgatcacccacaaagggggccagaggagcgacggaaacgaaagcatttccgagtgcgggagatgtcccttgtctccattctgtcagtttgaggaaatgaagatttgctcagcaattataaacctttttcatctgatcccggctgctcctcagacactggtgaagcctttgctagaggttgtcatgaaaacggagcgggcgatgctgatcgaggcggggagtccattccgagagcccctgatcaagttcctgactcgacatccctcgcagacagtggagctgttcatgatggaagccacactgaacgatccccagtggagcagaatgtttatgagttttttaaaacacaaagacgccagacctctgcgggatgtgctggctgccaaccccaacaggttcatcaccctgctgctgccggggggtgcccagacggctgtgcgccccggttcgcccagcaccagcaccatgcgcctggacctccagttccaggccatcaagatcataagcattatagtgaaaaacgatgactcctggctggccagccagcactctctggtgagccagttgcgacgtgtgtgggtgagtgagaacttccaagagaggcaccgcaaggagaacatggcagccaccaactggaaggagcccaagctgctggcctactgcctgctgaactactgcaaaaggaattacggagatatagaattgctgttccagctgctccgagcctttactggtcgttttctctgcaacatgacattcttaaaagagtatatggaggaagagattcccaaaaattacagcatcgctcagaaacgtgccctgttctttcgctttgtagacttcaacgaccccaacttcggagatgaattaaaagctaaagttctgcagcatatcttgaatcctgctttcttgtacagctttgagaagggggaaggagagcagctcttgggacctcccaatccagaaggagataacccagaaagcatcaccagtgtgtttattaccaaggtcctggaccccgagaagcaggcggacatgctggactcgctgcggatctacctgctgcagtacgccacgctgctggtggagcacgccccccaccacatccatgacaacaacaagaaccgcaacagcaagctgcgccgcctcatgaccttcgcctggccctgcctgctctccaaggcctgcgtggacccagcctgcaagtacagcggacacttgctcctggcgcacattatcgccaaattcgccatacacaagaagatcgtcctgcaggtttttcatagtctcctcaaggctcacgcaatggaagctcgagcgatcgtcagacaggcgatggccattctgaccccggcggtgccggccaggatggaggacgggcaccagatgctgacccactggacccggaagatcattgtggaggaggggcacaccgtcccgcagctggtccacattctgcacctgatagtgcaacacttcaaggtgtactacccggtacggcaccacttggtgcagcacatggtgagcgccatgcagaggctgggcttcacgcccagtgtcaccatcgagcagaggcggctggccgtggacctgtctgaagtcgtcatcaagtgggagctgcagaggatcaaggaccagcagccggattcagatatggacccaaattccagtggagaaggagtcaattctgtctcatcctccattaagagaggcctgtccgtggattctgcccaggaagtgaaacgctttaggacggccaccggagccatcagtgcagtctttgggaggagccagtcgctacctggagcagactctctcctcgccaagcccattgacaagcagcacacagacactgtggtgaacttccttatccgcgtggcctgtcaggttaatgacaacaccaacacagcggggtcccctggggaggtgctctctcgccggtgtgtgaaccttctgaagactgcgttgcggccagacatgtggcccaagtccgaactcaagctgcagtggttcgacaagctgctgatgactgtggagcagccaaaccaagtgaactatgggaatatctgcacgggcctagaagtgctgagcttcctgctaactgtcctccagtccccagccatcctcagtagcttcaaacctctgcagcgtggaattgccgcctgcatgacatgtggaaacaccaaggtgttgcgagccgtccacagccttctctcgcgcctgatgagcattttcccaacagagccgagtacttccagtgtggcctccaaatatgaagagctggagtgcctctacgcagccgtcggaaaggtcatctatgaagggctcaccaactacgagaaggccaccaatgccaatccctcccagctcttcgggacccttatgatcctcaagtctgcctgcagcaacaaccccagctacatagacaggctgatctccgtctttatgcgctccctgcagaagatggtccgggagcatttaaaccctcaggcagcgtcaggaagcaccgaagccacctcaggtacaagcgagctggtgatgctgagtctggagctggtgaagacgcgcctggcagtgatgagcatggagatgcggaagaacttcatccaggccatcctgacatccctcatcgaaaaatcaccagatgccaaaatcctccgggctgtggtcaaaatcgtggaagaatgggtcaagaataactccccaatggcagccaatcagacacctacactccgggagaagtccattttgcttgtgaagatgatgacttacatagaaaaacgctttccggaagaccttgaattaaatgcccagtttttagatcttgttaactatgtctacagggatgagaccctctctggcagcgagctgacggcgaaacttgagcctgcctttctctctgggctgcgctgtgcccagccactcatcagggcaaagtttttcgaggtttttgacaactccatgaaacgtcgtgtctacgagcgcttgctctatgtgacctgttcgcagaactgggaagccatggggaaccacttctggatcaagcagtgcattgagctgcttctggccgtgtgtgagaagagcacccccattggcaccagctgccaaggagccatgctcccgtccatcaccaacgtcatcaacctggccgatagccacgaccgtgccgccttcgccatggtcacacatgtcaagcaggagccccgggagcgggagaacagcgagtccaaagaggaggatgtagagatagacatcgaactagctcctggggatcagaccagcacgcccaaaaccaaagaactttcagaaaaggacattggaaaccagctgcacatgctaaccaacaggcacgacaagtttctggacactctccgagaggtgaagactggagcgctgctcagcgctttcgttcagctgtgccacatttccacgacgctggcagagaagacgtgggtccagcttttccccagattgtggaagatcctctctgacagacagcagcatgcactcgcgggtgagataagtccatttctgtgcagcggcagtcaccaggtgcagcgggactgccagcccagcgcgctgaactgctttgtggaagccatgtcccagtgcgtgccgccaatccccatccgaccctgcgtcctgaagtacctggggaagacacacaacctctggttccggtccacgctgatgttggagcaccaggcttttgaaaagggtctgagtcttcagattaagccgaagcaaacaacggagttttatgagcaggagagcatcaccccgccgcagcaggagatactggattcccttgcggagctttactccctgttacaagaggaagatatgtgggctggtctgtggcagaagcggtgcaagtactcggagacagcgactgcgattgcttacgagcagcacgggttctttgagcaggcacaagaatcctatgaaaaggcaatggataaagccaaaaaagaacatgagaggagtaacgcctcccctgctattttccctgaataccagctctgggaagaccactggattcgatgctccaaggaattgaaccagtgggaagccctgacggagtacggtcagtccaaaggccacatcaacccctacctcgtcctggagtgcgcctggcgggtgtccaactggactgccatgaaggaggcgctggtgcaggtggaagtgagctgtccgaaggagatggcctggaaggtgaacatgtaccgcggatacctggccatctgccaccccgaggagcagcagctcagcttcatcgagcgcctggtggagatggccagcagcctggccatccgcgagtggcggcggctgccccacgtagtgtcccacgtgcacacgcctctcctacaggcagcccagcaaatcatcgaactccaggaagctgcacaaatcaacgcaggcttacagccaaccaacctgggaaggaacaacagcctgcacgacatgaagacggtggtgaagacctggaggaaccgactgcccatcgtgtctgacgacttgtcccactggagcagcatcttcatgtggaggcagcatcattaccagggtaaaccgacctggtccggcatgcattcatcatcgattgtaactgcctatgagaatagctctcagcatgatcccagttcaaataacgctatgcttggggttcatgcatcagcttcagcgatcatccagtatggaaaaatcgcccggaaacaaggactggtcaatgtagctctggatatattaagtcggattcatactattccaactgttcctatcgtggattgcttccagaagattcgacagcaagttaaatgctacctccagctggcaggcgtcatgggcaaaaacgagtgcatgcagggccttgaagttattgaatctacaaatttaaaatacttcacaaaagagatgacagccgaattttatgcactgaagggaatgttcttggctcagatcaacaagtccgaggaggcaaacaaagccttctctgcagctgtgcagatgcacgatgtgctggtgaaagcctgggccatgtggggcgactacctggagaacatctttgtgaaggagcggcagctgcacctgggcgtgtctgccatcacctgctacctgcacgcctgccggcatcagaacgagagcaaatcgaggaaatacttagccaaggtgctgtggcttttgagttttgatgatgacaaaaacactttggcagatgccgtcgacaagtactgcattggtgtgccacccatccagtggctggcctggatcccacagctgctcacctgcctggttggctcggagggaaagctgctcttgaacctcattagccaggttggacgcgtgtatccccaagcggtctactttcccatccggaccctgtacctgaccctgaaaatagaacagcgggaacgctacaagagcgatccagggcccataagagcaacagcacccatgtggcgctgcagccgaatcatgcacatgcagcgagagctccaccccacccttctgtcttccctggaaggcatcgtcgatcagatggtctggttcagagaaaattggcatgaagaggttctcaggcagctccaacagggcctggcgaaatgttactccgtggcgtttgagaaaagtggagcggtgtccgatgctaaaatcaccccccacactctcaattttgtgaagaagttggtgagcacgtttggggtgggcctggagaatgtgtccaacgtctcgaccatgttctccagcgcagcctctgagtctctggcccggcgggcgcaggccactgcacaagaccctgtctttcagaagctgaaaggccagttcacgacggattttgacttcagcgttccaggatccatgaagcttcataatcttatttctaagttgaaaaagtggatcaaaatcttggaggccaagaccaagcaactccccaaattcttcctcatagaggaaaagtgccggttcttgagcaatttctcggcacagacagctgaagtggaaattcctggggagtttctgatgccaaagccaacgcattattacatcaagattgcacggttcatgccccgggtagagattgtgcagaagcacaacaccgcagcccggcggctgtacatccggggacacaatggcaagatctacccatacctcgtcatgaacgacgcctgcctcacagagtcacggcgagaggagcgtgtgttgcagctgctgcgtctgctgaacccctgtttggagaagagaaaggagaccaccaagaggcacttgtttttcacagtgccccgggttgtggcagtttccccacagatgcgcctcgtggaggacaacccctcttcactttcccttgtggagatctacaagcagcgctgcgccaagaagggcatcgagcatgacaaccccatctcccgttactatgaccggctggctacggtgcaggcgcggggaacccaagccagccaccaggtcctccgcgacatcctcaaggaggttcagagtaacatggtgccgcgcagcatgctcaaggagtgggcgctgcacaccttccccaatgccacggactactggacgttccggaagatgttcaccatccagctggctctgataggcttcgcggaattcgtcctgcatttaaatagactcaaccccgagatgttacagatcgctcaggacactggcaaactgaatgttgcctactttcgatttgacataaacgacgcgactggagacctggatgccaaccgtcctgtcccatttcgactcacgcccaacatttctgagtttctgaccaccatcggggtctccggcccgttgacagcgtccatgattgcggtcgcccggtgcttcgcccagccaaactttaaggtggatggcattctgaaaacggttctccgggacgagatcattgcttggcacaaaaaaacacaagaggacacgtcctctcctctctcggccgccgggcagccagagaacatggacagccagcaactggtgtccctggttcagaaagccgtcaccgccatcatgacccgcctgcacaacctcgcccagttcgaaggcggggaaagcaaggtgaacaccctggtggccgcggcaaacagcctggacaatctgtgccgcatggaccccgcctggcacccctggctgtgactgtggccgccacggccacccggaatgtgaagggcgctccgggctctgagcccgcagcttttacgacttctccctgcctcgttccttatattcacagaagccccatagtttcactgggttgcggttattttcctggtagtttgcgtgtaagaaagggagaatatagttttagaggaagctgaactatgacgatgctgggcgaagcggttggaaatggcagagctgaaacttattccaagctttcaaaataatcttttaagaagccaggattctccggtctggaatttctgagtgagtcctttttttatggtgtcctccctctgtgaatgtacaggcggaactgtacgaacagctcccttccatccatttttaactctttcggaaataacacctcacagcagcttcgtgcttttgtacagacctttgtaacaagtgtacagaaaactcattttgtttgagaaacaggagttgatgaacccatcatgctggtttttctctgagcacaaagttttaggctgtacacagccagccttgggaatctcgttgagcgttcggcgtggatccacggggccaggccaccctgcgggagcgccacacgcatccacttcggattcagtgggtgaagacagaactctgagagtctgcaggcggctcctgtgctttttatttctggctcttcggatgtcttctagacatttactatcactgcacctgaagaaaaaatcacttttaccttcctaatttaaaaagacaaaacagaaatgtacgttccttcgctagctttagtctttctgttcccatttttataaatctgagcattgataatgttctatctaaatttgtacagtgtgatttttttttttagaataaatattttataaaagggtt

SEQ ID NO: 7748 - DNA, 1260 bp, Homo sapiens
agcttcggaggcttctctaggggcgcatggctctgcaaccggctcagttgctgggctgtgcgagtcccaggggtcgccagggggcacatcaccgtcaggggggaaagtggcgcggagcccatcatgggtgaatcggccgccgcaaccgcatcccttttccaaaggcggcggcgggggcgaggtggtcgggtcacttttcccggaggcctaaagggcagcgcgcgttttctctcctttgggccgcccttccccgccccgccagctcccccgttccccgcggcgcccggcccctggctgcgcagacccctcttcagcctgaagctgtccgacacagaggacgtctttcctcgccgcgcggggccgctcgaggtcccggccgacagccgcgtgttcgtgcaggcggccttggcccgtccctccccgcgctggggcctggccctgcaccgctgctcagtgacgccgtcctcacgcccggccccggggcccgccctggctctgctgcgtgagggctgccccgccgacacctctgtcgccttcccgccaccgccgccgccgagcccgggtgccgcccgccccgcgcgtttcagcttccgcctgcgcccggtcttcaacgcctcggtgcagttcctgcactgccagctgagccgctgccgccgcctccggggagtccgccgggcgcctgcgcctctgacgccgccgccgccgccgccgccatcgcggtgtctgcctcaggacgaggcgtgcgccgacactggcagtggcagcgccgagggcctggctgctgacggcccccacctgcacacgctgacgcagcctatcgtggtcaccgtgccgcggccgccccccaggccgcccaagagtgtccccggccgtgcagtgcgccctgagcctcccgcgccggcccccgcggccctggaacccgcgccggtggtggcgctggtgttggcagccttcgtgctgggcgccgcgctggccgccgggctgggtctcgtctgtgcgcactcagcgccccacgcccctggcccgcccgcgagagcctcgcccagcggtccccagcccaggaggtcccagtgaggaagggatggtgcgcccccaacatggtccggagatacacccagctaccaattcgggaccaggaccaacaggaccggacccgcctccctggacctcggacctgatgaggccacgacccctgcgcttctctcctccccctgtccctcccacctgtgctcaaaataaacctctggactgaccggctaa

SEQ ID NO: 7749 - DNA, 1349 bp, Homo sapiens
gtgcagatgagaaagaggctctcagcgggagggaggcaggcgggcttgattgacacaggagagggctggctttttggagggctcttagcaacggccctggttgagccccctcagccatgagaaaatcaaatcaatgtgccattcttccaggcgcgaggcagcagcggctgcagttcaacatgaaaggaggcttcctccctgcctgctaattacctgctcttcccgatctcatcgtttctgcctttgcaaagtgctactgagaagggggaagaaacgtccgccacccatcccccttgctgcctgggggttcagacttgattgttgcccagccatatcccagccccgtctgcagggagccggaggctgctgctgctgctattgtgtggatgccgcgcgtgtcttctcttctttccagagatggctaacaggggcccgagctatggcttaagccgagaggtgcaggagaagatcgagcagaagtatgatgcggacctggagaacaagctggtggactggatcatcctgcagtgcgccgaggacatagagcacccgccccccggcagggcccattttcagaaatggttaatggacgggacggtcctgtgcaagctgataaatagtttatacccaccaggacaagagcccatacccaagatctcagagtcaaagatggcttttaagcagatggagcaaatctcccagttcctaaaagctgcggagacctatggtgtcagaaccaccgacatctttcagacggtggatctatgggaagggaaggacatggcagctgtgcagaggaccctgatggctttaggcagcgttgcagtcaccaaggatgatggctgctatcggggagagccatcctggtttcacaggaaagcccagcagaatcggagaggcttttccgaggagcagcttcgccagggacagaacgtaataggcctgcagatgggcagcaacaagggagcctcccaggcgggcatgacagggtacgggatgcccaggcagatcatgtaggacgcggcatcctgcccctggtagagaggacgaatgttccacaccatggtctctacgaaaaagaaatagttagtcaccttctgaccttctcctctttctcaaagccttctgtccctggtttttgcaagtgctgcatttccgccgagaatccgcgttgcctactgctgccacctcctgttcatttagaactatgcaaagactccgcttccgttttcctgagctcctcgggccccagagtctctgtttgattatttatttatttatttatttatttgccaaaaattctcctcttcaacttatagaatgcacctaataaagtaattagtcttgtg

SEQ ID NO: 7750 - DNA, 1488 bp, Homo sapiens
gtgcagctgctggcctcgtagacaatcggctgtctccccagaagagggaaagaattgtgcagatgagaaagaggctctcagcgggagggaggcaggcgggcttgattgacacaggagagggctggctttttggagggctcttagcaacggccctggttgagccccctcagccatgagaaaatcaaatcaatgtgccattcttccaggcgcgaggcagcagcggctgcagttcaacatgaaaggaggcttcctccctgcctgctaattacctgctcttcccgatctcatcgtttctgcctttgcaaagtgctactgagaagggggaagaaacgtccgccacccatcccccttgctgcctgggggttcagacttgattgtgaaaccccattggcttcattggctccttgatttaaaccacgcccggctttctgccctctttgctgctgctgggccaggttgcccagccatatcccagccccgtctgcagggagccggaggctgctgctgctgctattgtgtggatgccgcgcgtgtcttctcttctttccagagatggctaacaggggcccgagctatggcttaagccgagaggtgcaggagaagatcgagcagaagtatgatgcggacctggagaacaagctggtggactggatcatcctgcagtgcgccgaggacatagagcacccgccccccggcagggcccattttcagaaatggttaatggacgggacggtcctgtgcaagctgataaatagtttatacccaccaggacaagagcccatacccaagatctcagagtcaaagatggcttttaagcagatggagcaaatctcccagttcctaaaagctgcggagacctatggtgtcagaaccaccgacatctttcagacggtggatctatgggaagggaaggacatggcagctgtgcagaggaccctgatggctttaggcagcgttgcagtcaccaaggatgatggctgctatcggggagagccatcctggtttcacaggaaagcccagcagaatcggagaggcttttccgaggagcagcttcgccagggacagaacgtaataggcctgcagatgggcagcaacaagggagcctcccaggcgggcatgacagggtacgggatgcccaggcagatcatgtaggacgcggcatcctgcccctggtagagaggacgaatgttccacaccatggtctctacgaaaaagaaatagttagtcaccttctgaccttctcctctttctcaaagccttctgtccctggtttttgcaagtgctgcatttccgccgagaatccgcgttgcctactgctgccacctcctgttcatttagaactatgcaaagactccgcttccgttttcctgagctcctcgggccccagagtctctgtttgattatttatttatttatttatttatttgccaaaaattctcctcttcaacttatagaatgcacctaataaagtaattagtcttgtgtctt

SEQ ID NO: 7751 - DNA, 1164 bp, Homo sapiens
ccggaggtttattctagagttactggcgggtagctgtgcttttctttcccgtttgtaggtgaaaccccattggcttcattggctccttgatttaaaccacgcccggctttctgccctctttgctgctgctgggccaggttgcccagccatatcccagccccgtctgcagggagccggaggctgctgctgctgctattgtgtggatgccgcgcgtgtcttctcttctttccagagatggctaacaggggcccgagctatggcttaagccgagaggtgcaggagaagatcgagcagaagtatgatgcggacctggagaacaagctggtggactggatcatcctgcagtgcgccgaggacatagagcacccgccccccggcagggcccattttcagaaatggttaatggacgggacggtcctgtgcaagctgataaatagtttatacccaccaggacaagagcccatacccaagatctcagagtcaaagatggcttttaagcagatggagcaaatctcccagttcctaaaagctgcggagacctatggtgtcagaaccaccgacatctttcagacggtggatctatgggaagggaaggacatggcagctgtgcagaggaccctgatggctttaggcagcgttgcagtcaccaaggatgatggctgctatcggggagagccatcctggtttcacaggaaagcccagcagaatcggagaggcttttccgaggagcagcttcgccagggacagaacgtaataggcctgcagatgggcagcaacaagggagcctcccaggcgggcatgacagggtacgggatgcccaggcagatcatgtaggacgcggcatcctgcccctggtagagaggacgaatgttccacaccatggtctctacgaaaaagaaatagttagtcaccttctgaccttctcctctttctcaaagccttctgtccctggtttttgcaagtgctgcatttccgccgagaatccgcgttgcctactgctgccacctcctgttcatttagaactatgcaaagactccgcttccgttttcctgagctcctcgggccccagagtctctgtttgattatttatttatttatttatttatttgccaaaaattctcctcttcaacttatagaatgcacctaataaagtaattagtcttg

SEQ ID NO: 7752 - DNA, 1301 bp, Homo sapiens
ggggaaagtagcttggctattcccgacagatggacagttggtagaacggaccctcccacaggccctcatccccttgtgcagctgctggcctcgtagacaatcggctgtctccccagaagagggaaagaattgtgcagatgagaaagaggctctcagcgggagggaggcaggcgggcttgattgacacaggagagggctggctttttggagggctcttagcaacggccctggttgagccccctcagccatgagaaaatcaaatcaatgtgccattcttccaggcgcgaggcagcagcggctgcagttcaacatgaaaggaggcttcctccctgcctgctaattacctgctcttcccgatctcatcgtttctgcctttgcaaagtgctactgagaagggggaagaaacgtccgccacccatcccccttgctgcctgggggttcagacttgattagatggctaacaggggcccgagctatggcttaagccgagaggtgcaggagaagatcgagcagaagtatgatgcggacctggagaacaagctggtggactggatcatcctgcagtgcgccgaggacatagagcacccgccccccggcagggcccattttcagaaatggttaatggacgggacggtcctgtgcaagctgataaatagtttatacccaccaggacaagagcccatacccaagatctcagagtcaaagatggcttttaagcagatggagcaaatctcccagttcctaaaagctgcggagacctatggtgtcagaaccaccgacatctttcagacggtggatctatgggaagggaaggacatggcagctgtgcagaggaccctgatggctttaggcagcgttgcagtcaccaaggatgatggctgctatcggggagagccatcctggtttcacaggaaagcccagcagaatcggagaggcttttccgaggagcagcttcgccagggacagaacgtaataggcctgcagatgggcagcaacaagggagcctcccaggcgggcatgacagggtacgggatgcccaggcagatcatgtaggacgcggcatcctgcccctggtagagaggacgaatgttccacaccatggtctctacgaaaaagaaatagttagtcaccttctgaccttctcctctttctcaaagccttctgtccctggtttttgcaagtgctgcatttccgccgagaatccgcgttgcctactgctgccacctcctgttcatttagaactatgcaaagactccgcttccgttttcctgagctcctcgggccccagagtctctgtttga

SEQ ID NO: 7753 - DNA, 1177 bp, Homo sapiens
gagggctcttagcaacggccctggttgagccccctcagccatgagaaaatcaaatcaatgtgccattcttccaggcgcgaggcagcagcggctgcagttcaacatgaaaggaggcttcctccctgcctgctaattacctgctcttcccgatctcatcgtttctgcctttgcaaagtgctactgagaagggggaagaaacgtccgccacccatcccccttgctgcctgggggttcagacttgattagatggctaacaggggcccgagctatggcttaagccgagaggtgcaggagaagatcgagcagaagtatgatgcggacctggagaacaagctggtggactggatcatcctgcagtgcgccgaggacatagagcacccgccccccggcagggcccattttcagaaatggttaatggacgggacggtcctgtgcaagctgataaatagtttatacccaccaggacaagagcccatacccaagatctcagagtcaaagatggcttttaagcagatggagcaaatctcccagttcctaaaagctgcggagacctatggtgtcagaaccaccgacatctttcagacggtggatctatgggaagggaaggacatggcagctgtgcagaggaccctgatggctttaggcagcgttgcagtcaccaaggatgatggctgctatcggggagagccatcctggtttcacaggaaagcccagcagaatcggagaggcttttccgaggagcagcttcgccagggacagaacgtaataggcctgcagatgggcagcaacaagggagcctcccaggcgggcatgacagggtacgggatgccaggcagatcatgtaggacgcggcatctgcccctggtagagaggacgaatgttccacaccatggtctctacgaaaagaaatagttagtcaccttctgaccttctcctctttctcaaagccttctgtccctggtttttgcaagtgctgcatttccgccgagaatccgcgttgcctactgctgccacctcctgttcatttagaactatgcaaagactccgcttccgttttcctgagctcctcgggccccagagtctctgtttgattatttatttatttatttatttatttgccaaaaattctcctcttcaacttatagaatgcacctaataaagtaattagtcttgtgtc

SEQ ID NO: 7754 - DNA, 4166 bp, Homo sapiens
ggctcaggcaggcctggcccagagtcacgctggcaaccacgagtttgggaagcagtcgtattctctctctctctctctctctctctctcagtatccatgacagtgtgatggagagtctctgccgtgccatctgggatgcaaaccgtccctgtgttccccacgtccaggccgtagatgctccccgccggtcagtcacttagtcgtcagatcgcccgtcctggtatcacagtgcttctgttcaggttgcacactgggccacagaggatccagcaaggatgaagaaatggagcagcacagacttgggggcagctgcggacccactccaaaaggacacctgcccagaccccctggatggagaccctaactccaggccacctccagccaagccccagctctccacggccaagagccgcacccggctctttgggaagggtgactcggaggaggctttcccggtggattgccctcacgaggaaggtgagctggactcctgcccgaccatcacagtcagccctgttatcaccatccagaggccaggagacggccccaccggtgccaggctgctgtcccaggactctgtcgccgccagcaccgagaagaccctcaggctctatgatcgcaggagtatctttgaagccgttgctcagaataactgccaggatctggagagcctgctgctcttcctgcagaagagcaagaagcacctcacagacaacgagttcaaagaccctgagacagggaagacctgtctgctgaaagccatgctcaacctgcacgacggacagaacaccaccatccccctgctcctggagatcgcgcggcaaacggacagcctgaaggagcttgtcaacgccagctacacggacagctactacaagggccagacagcactgcacatcgccatcgagagacgcaacatggccctggtgaccctcctggtggagaacggagcagacgtccaggctgcggcccatggggacttctttaagaaaaccaaagggcggcctggattctacttcggtgaactgcccctgtccctggccgcgtgcaccaaccagctgggcatcgtgaagttcctgctgcagaactcctggcagacggccgacatcagcgccagggactcggtgggcaacacggtgctgcacgccctggtggaggtggccgacaacacggccgacaacacgaagtttgtgacgagcatgtacaatgagattctgatgctgggggccaaactgcacccgacgctgaagctggaggagctcaccaacaagaagggaatgacgccgctggctctggcagctgggaccgggaagatcggggtcttggcctatattctccagcgggagatccaggagcccgagtgcaggcacctgtccaggaagttcaccgagtgggcctacgggcccgtgcactcctcgctgtacgacctgtcctgcatcgacacctgcgagaagaactcggtgctggaggtgatcgcctacagcagcagcgagacccctaatcgccacgacatgctcttggtggagccgctgaaccgactcctgcaggacaagtgggacagattcgtcaagcgcatcttctacttcaacttcctggtctactgcctgtacatgatcatcttcaccatggctgcctactacaggcccgtggatggcttgcctccctttaagatggaaaaaactggagactatttccgagttactggagagatcctgtctgtgttaggaggagtctacttctttttccgagggattcagtatttcctgcagaggcggccgtcgatgaagaccctgtttgtggacagctacagtgagatgcttttctttctgcagtcactgttcatgctggccaccgtggtgctgtacttcagccacctcaaggagtatgtggcttccatggtattctccctggccttgggctggaccaacatgctctactacacccgcggtttccagcagatgggcatctatgccgtcatgatagagaagatgatcctgagagacctgtgccgtttcatgtttgtctacatcgtcttcttgttcgggttttccacagcggtggtgacgctgattgaagacgggaagaatgactccctgccgtctgagtccacgtcgcacaggtggcgggggcctgcctgcaggccccccgatagctcctacaacagcctgtactccacctgcctggagctgttcaagttcaccatcggcatgggcgacctggagttcactgagaactatgacttcaaggctgtcttcatcatcctgctgctggcctatgtaattctcacctacatcctcctgctcaacatgctcatcgccctcatgggtgagactgtcaacaagatcgcacaggagagcaagaacatctggaagctgcagagagccatcaccatcctggacacggagaagagcttccttaagtgcatgaggaaggccttccgctcaggcaagctgctgcaggtggggtacacacctgatggcaaggacgactaccggtggtgcttcagggtggacgaggtgaactggaccacctggaacaccaacgtgggcatcatcaacgaagacccgggcaactgtgagggcgtcaagcgcaccctgagcttctccctgcggtcaagcagagtttcaggcagacactggaagaactttgccctggtcccccttttaagagaggcaagtgctcgagataggcagtctgctcagcccgaggaagtttatctgcgacagttttcagggtctctgaagccagaggacgctgaggtcttcaagagtcctgccgcttccggggagaagtgaggacgtcacgcagacagcactgtcaacactgggccttaggagaccccgttgccacggggggctgctgagggaacaccagtgctctgtcagcagcctggcctggtctgtgcctgcccagcatgttcccaaatctgtgctggacaagctgtgggaagcgttcttggaagcatggggagtgatgtacatccaaccgtcactgtccccaagtgaatctcctaacagactttcaggtttttactcactttactaaacagtttggatggtcagtctctactgggacatgttaggcccttgttttctttgattttattcttttttttgagacagaatttcactcttctcacccaggctggaatgcagtggcacaattttggctccctgcaacctccgcctcctggattccagcaattctcctgcctcggcttcccaagtagctgggattacaggcacgtgccaccatgtctggctaattttttgtatttttttaatagatatggggtttcgccatgttggccaggctggtctcgaactcctgacctcaggtgatccgcccacctcggcctcccaaagtgctgggattacaggtgtgagcctccacacctggctgttttctttgattttattctttttttttttttctgtgagacagagtttcactcttgttgcccaggctggagtgcagtggtgtgatcttggctcactgcaacttctgcctcccgggttcaagcgattcttctgcttcagtctcccaagtagcttggattacaggtgagcactaccacgcccggctaatttttgtatttttaatagagacggggtttcaccatgttggccaggctggtctcgaactcttgacctcaggtgatctgcccgccttggcctcccaaagtgctgggattacaggtgtgagccgctgcgctcggccttctttgattttatattattaggagcaaaagtaaatgaagcccaggaaaacacctttgggaacaaactcttcctttgatggaaaatgcagaggcccttcctctctgtgccgtgcttgctcctcttacctgcccgggtggtttgggggtgttggtgtttcctccctggagaagatgggggaggctgtcccactcccagctctggcagaatcaagctgttgcagcagtgccttcttcatccttccttacgatcaatcacagtctccagaagatcagctcaattgctgtgcaggttaaaactacagaaccacatcccaaaggtacctggtaagaatgtttgaaagatcttccatttctaggaaccccagtcctgcttctccgcaatggcacatgcttccactccatccatactggcatcctcaaataaacagatatgtatacatatata

SEQ ID NO: 7755 - DNA, 2642 bp, Homo sapiens
agatcccttgacttgcttgcggagggagcggccggcggagggagcggcaggtggagggagtggcacgaggcatgcggagggagctgcaccgacatcacataaacgcactgggcagctcgcaggcgccattcgctcttcagacgccggagacgtaggagtgggtcttcagactccaaaggggttggactaatggcggatgctgaggcgagggctgagttcccggaggaggccagacctgacaggggcaccttgcaggtgttgcaagatatggccagccgcttgcgaatccattccatcagggccacatgctccacgagctccggccaccctacatcatgtagcagttcttctgagatcatgtctgtgctgttcttctacatcatgaggtacaagcagtcagatccagagaatccggacaacgaccgatttgtcctcgcaaagagactgtcgtttgtggatgtggcaacaggatggctcggacaaggactgggagttgcatgtggaatggcatatactggcaagtacttcgacagggccagctaccgggtgttctgcctcatgagtgatggcgagtcctcagaaggctctgtctgggaggcaatggcctttgcttcctactacagtctggacaatcttgtggcaatctttgatgtgaaccgcctgggacacagtggtgcattgcccgccgagcactgcataaacatctatcagaggcgctgcgaagcctttgggtggaacacttatgtggtggacggccgggacgtggaggcactgtgccaggtattctggcaggcttctcaggtgaagcacaagcccactgctgtggtggccaagaccttcaagggccggggcaccccaagtattgaggatgcagaaagttggcatgcaaagccaatgccgagagaaagagcagatgccattatcaaattaattgagagccagatacagaccagcaggaatcttgacccacagccccccattgaggactcacctgaagtcaacatcacagatgtaaggatgacctctccacctgattacagagttggtgacaagatagctactcggaaagcatgcggtctggctctggctaagctgggctacgcgaacaacagagtcgttgtgctggatggtgacaccaggtactctactttctctgagatattcaacaaggagtaccctgagcgcttcatcgagtgctttatggctgaacaaaacatggtgagcgtggctctgggctgtgcctcccgtggacggaccattgcttttgctagcacctttgctgcctttctgactcgagcatttgatcacatccggataggaggcctcgctgagagcaacatcaacattattggttcccactgtggggtatctgttggtgacgatggtgcttcccagatggccctggaggatatagccatgttccgaaccattcccaagtgcacgatcttctacccaactgatgccgtctccacggagcatgctgttgctctggcagccaatgccaaggggatgtgcttcattcggaccacccgaccagaaactatggttatttacaccccacaagaacgctttgagatcggacaggccaaggtcctccgccactgtgtcagtgacaaggtcacagttattggagctggaattactgtgtatgaagccttagcagctgctgatgagctttcgaaacaagatatttttatccgtgtcatcgacctgtttaccattaaacctctggatgtcgccaccatcgtctccagtgcaaaagccacagagggccggatcattacagtggaggatcactacccgcaaggtggcatcggggaagctgtctgcgcagccgtctccatggatcctgacattcaggttcattcgctggcagtgtcgggagtgccccagagtgggaagtccgaggaattgctggatatgtatggaattagtgccagacatatcatagtggccgtgaaatgcatgttgctgaactaaaatagctgttagctttggtcttttggcctctttaccctgtgtttatgtttgttccaaaaccatcatttaaatctctactgtcacattttgtttcttaaaagcaaagccagctaacaccttcattcatccctagttcggaaattcaagctaactacttaccctttaaactgtcactgcatatgcaagtaccgctctaatttttggatcattaaagggagttacacaacttttaagtgaaaaaaataggtaacaaaacaaccacctgatagtaagttttctgataagactatagataagtggtagaggtaatcaattcttccgaagtgtttccttcgtgaataactggtagaggtaatagttttttcaatgtatttccttcatgagtaaagaaaatgtggattgaagtatagattccagtagcctagtttccacagcacgataacaccatgacgcctactgctgttcccaccttgggattctgtgtgctgccatcccacctgcagctgccctggaattcccttcgctgtttgccttcatctccctccacgtttgagaggctgtcaggcagcagcgaaagcttgttaggatgtcctgtgctgcttgtgatgagagcctccacactgtactgttcaagtcaatgttaataaagcatttcaaaacca

SEQ ID NO: 7756 - DNA, 1834 bp, Homo sapiens
cggctttcctcctcctgctccaccatgtggagccgacggcagggccgcctcaggcccacggtctgcggggtggaggagctacggcgccgccggcgggagcgggaggcagcactgcggaaggcgcggagggagcagcagctggtcagcaagaggctgctgagaaacgacgccccagaggaagctggagagggatgtgtggctgcgatcctcggggaaaccgaggtgcagcagttcctgcggcaagcccagcgggggacagaggaaaaggagagagagggggctctggtcagccttcgtcgaggcttgcagcaccctgaaacacagcaaaccttcatccggctggagggcagcatgcggaccctggtcgggctcctgaccagcaaccaggccctgctgcagcttgaggcggctcggtgcctgcatgagctctctcactccgagcagtccactgttgctgaggcctgcctgccagccacttcttacctcctcacctacctctccagtcacagctcagacttcatagagctgtgtctgtatacactgggtaacctgatcgtggagagtgaggctgtgagaaggcagctcctgccacagggcattgttccagccttggctgcctgcatccagtccccccatgtggctgtgctggaagctctcggatatgccttgtcccagcttctacaggctgaggaagctccagagaagatcattccccctgcttctgccagcagctccatcttggcctccactctccctcagcacatgctacaaatgttgcaacctggcccaaagctcaaccctggggtcgctgtggagtttgcctggtgccttcattacatcatctgcagccaggtcagcaatcctctgctcattggccatggggctctgtctactctggggttgctgctgttggacttggctggggctgtccagaaaaccgaggatgcaggactggagctgctggcatgccccgtgcttcgatgtctaagcaacctgctaactgaggcagcagtggagactgtgggagggcaaatgcagctcagagatgagcgtgttgtggcagccttatttatccttctgcagttctttttccagaaacagcccagtctgctccctgagggcctttggctcctcaacaacctcactgcaaacagtcctagtttctgtacctccttgctctccctggatctgattgagcctctcttacagctgttgccagtatctaacgtggtgagcgtaatggtgctcacagttctgtgcaatgttgcagaaaagggtcctgcttactgccagcggctgtggccagggcccctgcttcccgccttgctgcacacactagccttttctgacactgaagtagtaggccagagtttggagctgctgcatctgctgttcctgtatcagccagaggctgttcaggtcttcctgcagcagtcagggctgcaagccctggaaaggcatcaggaagaggcccagctccaggatcgtgtgtatgctctccagcagacagctcttcaagggtgatcttgtttctcaatgtcactcattcccctctctcttaacatcaagcttgtttgtccagtagagcctttggagatttaggaccataatgaggtctcatgttctctgctcccacacctaagccaagacctttgggtcccagctcctccccttccactcagcactatccaggcaggaggaccaaaagggactcagtgtggtctacttactctggggccctagaatccctgcccccccgccacccttcatgtttgcttcagcagctggtagcttttgatgagacagaataaagttttatttttatattaagcta

SEQ ID NO: 7757 - DNA, 1887 bp, Homo sapiens
gttcccgccctgtgctgaggctgcgcagtcggtgccatcttctacgcccctgggagcgttgtggctgctgtttccttcggctttcctcctcctgctccaccatgtggagccgacggcagggccgcctcaggcccacggtctgcggggtggaggagctacggcgccgccggcgggagcgggaggcagcactgcggaaggcgcggagggagcagcagctggtcagcaagaggctgctgagaaacgacgccccagaggaagctggagagggatgtgtggctgcgatcctcggggaaaccgaggtgcagcagttcctgcggcaagcccagcgggggacagaggaaaaggagagagagggggctctggtcagccttcgtcgaggcttgcagcaccctgaaacacagcaaaccttcatccggctggagggcagcatgcggaccctggtcgggctcctgaccagcaaccaggccctgctgcagcttgaggcggctcggtgcctgcatgagctctctcactccgagcagtccactgttgctgaggcctgcctgccagccacttcttacctcctcacctacctctccagtcacagctcagacttcatagagctgtgtctgtatacactgggtaacctgatcgtggagagtgaggctgtgagaaggcagctcctgccacagggcattgttccagccttggctgcctgcatccagtccccccatgtggctgtgctggaagctctcggatatgccttgtcccagcttctacaggctgaggaagctccagagaagatcattccctccatcttggcctccactctccctcagcacatgctacaaatgttgcaacctggcccaaagctcaaccctggggtcgctgtggagtttgcctggtgccttcattacatcatctgcagccaggtcagcaatcctctgctcattggccatggggctctgtctactctggggttgctgctgttggacttggctggggctgtccagaaaaccgaggatgcaggactggagctgctggcatgccccgtgcttcgatgtctaagcaacctgctaactgaggcagcagtggagactgtgggagggcaaatgcagctcagagatgagcgtgttgtggcagccttatttatccttctgcagttctttttccagaaacagcccagtctgctccctgagggcctttggctcctcaacaacctcactgcaaacagtcctagtttctgtacctccttgctctccctggatctgattgagcctctcttacagctgttgccagtatctaacgtggtgagcgtaatggtgctcacagttctgtgcaatgttgcagaaaagggtcctgcttactgccagcggctgtggccagggcccctgcttcccgccttgctgcacacactagccttttctgacactgaagtagtaggccagagtttggagctgctgcatctgctgttcctgtatcagccagaggctgttcaggtcttcctgcagcagtcagggctgcaagccctggaaaggcatcaggaagaggcccagctccaggatcgtgtgtatgctctccagcagacagctcttcaagggtgatcttgtttctcaatgtcactcattcccctctctcttaacatcaagcttgtttgtccagtagagcctttggagatttaggaccataatgaggtctcatgttctctgctcccacacctaagccaagacctttgggtcccagctcctccccttccactcagcactatccaggcaggaggaccaaaagggactcagtgtggtctacttactctggggccctagaatccctgcccccccgccacccttcatgtttgcttcagcagctggtagcttttgatgagacagaataaagttttatttttatatt

SEQ ID NO: 7758 - DNA, 994 bp, Homo sapiens
agtcggtgccatcttctacgcccctgggagcgttgtggctgctgtttccttcggctttcctcctcctgctccaccatgtggagccgacggcagggccgcctcaggcccacggtctgcggggtggaggagctacggcgccgccggcgggagcgggaggcagcactgcggaaggcgcggagggagcagcagctggtcagcaagaggctgctgagaaacgacgccccagaggaagctggagagggatgtgtggctgcgatcctcggggaaaccgaggtgcagcagttcctgcggcaagcccagcgggggacagaggaaaaggagagagagggggctctggtcagccttcgtcgaggcttgcagcaccctgaaacacagcaaaccttcatccggtcagtgtggatggtgtggtggagggaggagttggggctctgagggatggaccacaagctaagcagggctctggtactcactcacataggctggagggcagcatgcggaccctggtcgggctcctgaccagcaaccaggccctgctgcagcttgaggcggctcggtgcctgcatgagctctctcactccgagcagtccactgttgctgaggcctgcctgccagccacttcttacctcctcacctacctctccagtcacagctcagacttcatagtaagccctgtcccttcctatcttgttcttggtttagattttaaaattgtgcttttgggaccagtttgagctggcaggtaggaggaagaaaacatgtttgcccttatgcctacagccatggctacacccatcatctccccaccctcttgtgagccgcaaggatagctgctccagcgtccccatcacctcccctccccatctccccacacgcagcctggcatgaaacaggccaagcccagtgcttttgttgcctgttctcaggagctgtgtctgtatacactgggtaacctgatcgtggagagtgaggctgtgagaaggcagctcctgccaca

SEQ ID NO: 7759 - DNA, 1552 bp, Homo sapiens
tacgcccctgggagcgttgtggctgctgtttccttcggctttcctcctcctgctccaccatgtggagccgacggcagggccgcctcaggcccacggtctgcggggtggaggagctacggcgccgccggcgggagcgggagcactgcggaaggcgcggagggagcagcagctggtcagcaagaggctgctgagaaacgacgccccagaggaagctggagagggatgtgtggctgcgatcctcggggaaaccgaggtgcagcagttcctgcggcaagcccagcgggggacagaggaaaaggagagagagggggctctggtcagccttcgtcgaggcttgcagcaccctgaaacacagcaaaccttcatccgtccccccatgtggctgtgctggaagctctcggatatgccttgtcccagcttctacaggctgaggaagctccagagaagatcattccctccatcttggcctccactctccctcagcacatgctacaaatgttgcaacctggcccaaagctcaaccctggggtcgctgtggagtttgcctggtgccttcattacatcatctgcagccaggtcagcaatcctctgctcattggccatggggctctgtctactctggggttgctgctgttggacttggctggggctgtccagaaaaccgaggatgcaggactggagctgctggcatgccccgtgcttcgatgtctaagcaacctgctaactgaggcagcagtggagactgtgggagggcaaatgcagctcagagatgagcgtgttgtggcagccttatttatccttctgcagttctttttccagaaacagcccagtctgctccctgagggcctttggctcctcaacaacctcactgcaaacagtcctagtttctgtacctccttgctctccctggatctgattgagcctctcttacagctgttgccagtatctaacgtggtgagcgtaatggtgctcacagttctgtgcaatgttgcagaaaagggtcctgcttactgccagcggctgtggccagggcccctgcttcccgccttgctgcacacactagccttttctgacactgaagtagtaggccagagtttggagctgctgcatctgctgttcctgtatcagccagaggctgttcaggtcttcctgcagcagtcagggctgcaagccctggaaaggcatcaggaagaggcccagctccaggatcgtgtgtatgctctccagcagacagctcttcaagggtgatcttgtttctcaatgtcactcattcccctctctcttaacatcaagcttgtttgtccagtagagcctttggagatttaggaccataatgaggtctcatgttctctgctcccacacctaagccaagacctttgggtcccagctcctccccttccactcagcactatccaggcaggaggaccaaaagggactcagtgtggtctacttactctggggccctagaatccctgcccccccgccacccttcatgtttgcttcagcagctggtagcttttgatgagacagaataaagttttatttttatatt

SEQ ID NO: 7760 - DNA, 1813 bp, Homo sapiens
cggcagcccaagggccccggcgccgggggcggcggggaaccccaaacgcaaccgggtctggagggatccccgcgccgagccagccgccgtcaccgcctccgcgccgcccctgcgggcttggcaggcgcccggcgcgcccgcactgcgcccggccgccggctcccgcggtcccaccgtgagctcgccggcccgtcgcccgctcgccatgcaaccgccgccggcctcgcgcgcgtaggcgcccgccgcaggccatgctgcccctgctcgccgcgctcctggccgccgcctgcccgctgccgcccgtccgcggcggggccgcggacgcgcccggcctcctcggggtgccctccaatgcttcagtcaacgcgtcctccgcggacgagcccatcgccccgcggctgctggcctcggcggcccccgggccccccgagcgcccgggcccggaggaggcggcggcggcggcggcgccgtgcaacatcagcgtgcagcggcagatgctgagctcgctgctcgtgcgctggggccgcccgcggggcttccagtgcgacctactgctcttctccaccaacgcgcacggccgcgctttcttcgccgccgccttccaccgcgtcgggccgccgctgctcatcgagcacctggggctggcggcgggcggcgcgcagcaggacctgcgcctctgcgtgggctgcggctgggtgcgcggtcgccgcaccggccgcctccggcccgccgccgcccccagcgccgccgccgccaccgccggggcgcccaccgcgctgccagcctaccccgcggccgagccgcccgggccgctgtggctgcagggcgagccgctgcatttctgctgcctagacttcagcctggaggagctgcagggcgagccgggctggcggctgaaccgtaagcccattgagtccacgctggtggcctgcttcatgaccctggtcatcgtggtgtggagcgtggccgccctcatctggccggtgcccatcatcgccggcttcctgcccaacggcatggaacagcgccggaccaccgccagcaccaccgcagccacccccgccgcagtgcccgcagggaccaccgcagccgccgccgccgccgccgctgccgccgccgccgcggccgtcacttcgggggtggcgaccaagtgacccgctccgctcctccctgtgtccgtcctgtgtccgcgcgcgcgggtgcctttcccgccggagactcggccggtgtgcttcgtgctgtagttatcgttagttcctcttcccgagatggggccgccgagagaccccagcgcctttgaaaagcaaggtttgtgctgcgcttccagttccgaaaagcagatgtttaagcccttggactgagggtgggatcgcagctccgaagacggagaggagggaaatggggccctttcccctctattgcatccccctgcccgactccttccccgcacccacgtgccctagattcatggcagaaaatgaccaaatcctgtgtatttgttttatatatttaataactgttttaaatgaaagttttagtaaaaaaaatacaaaacaaaaagattaaattgctattgctgtagtaagagaagctctttgtatctgaacatagttgtatttgaaatttgtggttttttaatttatttaaaattggggggagggcatgggaaggatttaacaccgatatattgttaccgctgaaaatgaactttatgaaccttttccaagttgatctatccagtgacgtggcctggtgggcgtttcttcttgtacttatgtggttttttggcttttaatacagacattttcctcca

SEQ ID NO: 7761 - DNA, 2014 bp, Homo sapiens
tgtcttgaaggtggtctgagctttctcactccaagccagtcgtgtgggaagggacactctctgagcctcagtttcctcagctgtcaacctctcagggcttgttctagtggctccgaaagccagtgggagcgagcgcgctttgcaaagccttgggcgccgggccttggcgcgcctttgccggatccttccggccacgggcggggcgagcccagaggagaagagccgaggggcggtgcccgggccagggggcggaggcaggcggctctggctccctctcgggacgctctttccttcttcctcttgttcctcctcctgcctctcttcgcttcgcctgcaaacgcggtgggggctgctcggcggtcaggagcagcaagagacagagcgacatgagagattggaccgcgggctgcactggagaatttactggtaggataattcatccctaaagagattgaagtgagcttcagaatggcaaaagaggagccccagagtatctcaagggacttgcaggaactgcagaagaagctgtctctgctgatagactccttccagaataactcaaaggtggtggcctttatgaagtctccagtgggtcagtacttggacagccatccgtttctggccttcaccttgctggtgttcattgtcatgtcggccgttcctgttggattcttcctgctcatcgtggtgcttaccaccctggctgctctgctgggggtcataatattggaaggattggtcatctctgtgggtggcttctcactgctctgcatcctctgtggtttgggcttcgtatcactcgccatgtcggggatgatgatagcatcttatgtagtggtctccagcctcatcagctgctggttttctcccaggccactgacacagcaaaacaccagttgtgactttctgccagccatgaagtctgcagaattcgaggggctttaccaggaatgagtgactgctcagaggccgggcttcttttcaagtactgctggatcatactcaccccttgggattatggcttagaagaagggggctgggtaggcaagcactccttggctgtgtcctctcgctttttcacttacttgtaggatcccgcagcagccaatttagggattgtgttgttcttgtgttggttcccatgtaaagaagcagcagagaaatgcgatggttcaacagctcgccctgccccaagtatgcagacttgaccttggcggggtcctgggcttctagagtctagcccgttgaccccaaagcctcagggcttatgtccaacggtcccattgggagcaacagtgattgtttatagttttttgttttcagaaatgagggcagctgttaattttttcactcatgtgaaacaaaatgaaaaaaaaaatccaaaacagaacaagcccttctgtggtatttgctttttatcagaaagaacagcaacatttggcctctccaagttggaaaatagagtccaaatgtaactttgtggccaagagtattttcaaaaaagtctaaaggtgtagtttccactgtaactgttgagtactgttaagtactgttaatcttttacatatttgcacttggtactgttgtattgttctaaagagcttgtcctttaagtaatttctttcttttttttttttttttttttttgtgacggagtttccctcttgttgcccaggctggagtgcaatggtgcagtctcggctcactgcaacctccaactcccaggttcaagtgagtctcgtgcctcagcctcccaagtagctgggattacaggcacccgccaccgtgcccggctagtttttttttgtattttttttagtacagatggggtttcaccatgttggtcaggctagtctcaaactcctgacctcaggtgctccacctgccttggcctcccaaagtgctgggattacaggcgtgagccactgtgcccagcctaagccatttcttaaaataaaaatgctaaaggactagtaagtaaaaataaaacttcctatgggatttcccagtggaa

SEQ ID NO: 7762 - DNA, 1905 bp, Homo sapiens
gagaagagccgaggggcggtgcccgggccagggggcggaggcaggcggctctggctccctctcgggacgctctttccttcttcctcttgttcctcctcctgcctctcttcgcttcgcctgcaaacgcggtgggggctgctcggcggtcaggagcaggttaccctccgtctgcatgcccaccatcaaggtatgaggatggtagaagctctcgtcgaaccagatggatgaagaccactaacggcttttgtttcctctggtaacagcaagagacagagcgacatgagagattggaccgcgggctgcactggagaatttactggtaggataattcatccctaaagagattgaagtgagcttcagaatggcaaaagaggagccccagagtatctcaagggacttgcaggaactgcagaagaagctgtctctgctgatagactccttccagaataactcaaaggtggtggcctttatgaagtctccagtgggtcagtacttggacagccatccgtttctggccttcaccttgctggtgttcattgtcatgtcggccgttcctgttggattcttcctgctcatcgtggtgcttaccaccctggctgctctgctgggggtcataatattggaaggattggtcatctctgtgggtggcttctcactgctctgcatcctctgtggtttgggcttcgtatcactcgccatgtcggggatgatgatagcatcttatgtagtggtctccagcctcatcagctgctggttttctcccaggccactgacacagcaaaacaccagttgtgactttctgccagccatgaagtctgcagaattcgaggggctttaccaggaatgagtgactgctcagaggccgggcttcttttcaagtactgctggatcatactcaccccttgggattatggcttagaagaagggggctgggtaggcaagcactccttggctgtgtcctctcgctttttcacttacttgtaggatcccgcagcagccaatttagggattgtgttgttcttgtgttggttcccatgtaaagaagcagcagagaaatgcgatggttcaacagctcgccctgccccaagtatgcagacttgaccttggcggggtcctgggcttctagagtctagcccgttgaccccaaagcctcagggcttatgtccaacggtcccattgggagcaacagtgattgtttatagttttttgttttcagaaatgagggcagctgttaattttttcactcatgtgaaacaaaatgaaaaaaaaaatccaaaacagaacaagcccttctgtggtatttgctttttatcagaaagaacagcaacatttggcctctccaagttggaaaatagagtccaaatgtaactttgtggccaagagtattttcaaaaaagtctaaaggtgtagtttccactgtaactgttgagtactgttaagtactgttaatcttttacatatttgcacttggtactgttgtattgttctaaagagcttgtcctttaagtaatttctttcttttttttttttttttttttttgtgacggagtttccctcttgttgcccaggctggagtgcaatggtgcagtctcggctcactgcaacctccaactcccaggttcaagtgagtctcgtgcctcagcctcccaagtagctgggattacaggcacccgccaccgtgcccggctagtttttttttgtattttttttagtacagatggggtttcaccatgttggtcaggctagtctcaaactcctgacctcaggtgctccacctgccttggcctcccaaagtgctgggattacaggcgtgagccactgtgcccagcctaagccatttcttaaaataaaaatgctaaaggactagtaagtaaaaataaaacttcctatgggatttcccagtgg

SEQ ID NO: 7763 - DNA, 1378 bp, Homo sapiens
ctgcctctcttcgcttcgcctgcaaacgcggtgggggctgctcggcggtcaggagcagcaagagacagagcgacatgagagattggaccgcgggctgcactggagaatttactggtaggataattcatccctaaagagattgaagtgagcttcagaatggcaaaagaggagccccagagtatctcaagggacttgcaggaactgcagaagaagctgtctctgctgatagactccttccagaataactcaaagctgccccaacacagcaggatctcactggactctgatgatggagtgtccaggctgggcagtgctggctccaaggtggtggcctttatgaagtctccagtgggtcagtacttggacagccatccgtttctggccttcaccttgctggtgttcattgtcatgtcggccgttcctgttggattcttcctgctcatcgtggtgcttaccaccctggctgctctgctgggggtcataatattggaaggattggtcatctctgtgggtggcttctcactgctctgcatcctctgtggtttgggcttcgtatcactcgccatgtcggggatgatgatagcatcttatgtagtggtctccagcctcatcagctgctggttttctcccaggccactgacacagcaaaacaccagttgtgactttctgccagccatgaagtctgcagaattcgaggggctttaccaggaatgagtgactgctcagaggccgggcttcttttcaagtactgctggatcatactcaccccttgggattatggcttagaagaagggggctgggtaggcaagcactccttggctgtgtcctctcgctttttcacttacttgtaggatcccgcagcagccaatttagggattgtgttgttcttgtgttggttcccatgtaaagaagcagcagagaaatgcgatggttcaacagctcgccctgccccaagtatgcagacttgaccttggcggggtcctgggcttctagagtctagcccgttgaccccaaagcctcagggcttatgtccaacggtcccattgggagcaacagtgattgtttatagttttttgttttcagaaatgagggcagctgttaattttttcactcatgtgaaacaaaatgaaaaaaaaaatccaaaacagaacaagcccttctgtggtatttgctttttatcagaaagaacagcaacatttggcctctccaagttggaaaatagagtccaaatgtaactttgtggccaagagtattttcaaaaaagtctaaaggtgtagtttccactgtaactgttgagtactgttaagtactgttaatcttttacatatttgcacttggtactgttgtattgttctaaagagcttgtcctttaagtaat

SEQ ID NO: 7764 - DNA, 10558 bp, Homo sapiens
cgccgctttgttccgggtgcggcgagggaaggcgaggctgcggcggatcatgcccatggtgtagccgccaagcggaggcatggctgccggaaggttactgctctacactggcctctcgctagcgctctgcgccctcggcatgctggccgtggccatctgctcggaccactggtacgagacggacgccaggaagcacagggacaggtgcaaggccttcaacacccgccgggtcgaccccggcttcatttacaacaataacaacaacttgccgctccgggcgagccgctcgcgcctggaccgctgggagggcaaactcctccgggcccggaatcgccggcagctgttcgccatgagccccgcggacgagtgcagccggcagtacaactccaccaacatgggcctctggaggaagtgccaccggcagggcttcgaccccgagatcgccgccctcattcggaaaggagaaattgagcgatgtacgtacatcaaataccactactcctcagcaaccatccccaggaacctcactttcaatatcacgaagaccatccgtcaggatgagtggcatgccctacacctgcgcagaatgacggctggcttcatgggcatggcggtggccatcatcctctttggctggatcatcggcgtgctgggctgctgctgggaccgaggccttatgcagtacgtggcagggctgctcttcctcatgggaggaaccttctgcatcatttcactgtgcacctgtgtggccgggatcaactttgagctgtcacgctacccacgctacctgtacggactccctgatgacatcagccatggctatggctggtccatgttctgtgcatgggggggcctgggcctcacactcatctcgggattcttctgtaccttagccccttctgttcaacctgtcccgaggaccaactaccctaaatccagacccgagaatgggacagtgtgctaaaaaacaaacccatacatacatatatatatataaatatatatatataatatacatatataaaacaaaacaaaactaaatcaagacgatgccagtgccaaggtagagttgagttggctcaggcacctgcatctcgccggactttgtgttgcctcatctctgagatggggaaagtttttccatcctgtggctcttccatcagttcttgacttttggcttcatggtctcttgaagacagagcaaacaccaccacttgcgaccgcgtcttgatccccatcactggcgaggatggggtggtgaagggacagtggaaggggtctgaggcagcacagatgtagagaaggaagtgccacccactgggtcaacgggagaggacgccacccctaaccagtcatatcacagggtaacaaagccctcagttcctagaatgtaaccaaattattgaggccattttcagaatcacttcttctcctgctcttcctgttcggacttccttcccagcccaccagcaacacacaaggagtggaagagaaaacaaactgagaaggacgttttctctttgctgccaaacttttggaccatgtttcataggtgggaagggaagagaacatgctgagaggcaagatctgcatcaatgaaaggacgcttcggtggatgctcagacaacccagtcttaccttccagctgccttacacccagtgaaacaagaggccaccctgtccccagccgcacctgcactccctgggcagactggagccttggagtcatgctgtgatgtgtgtgtgtgggtgtgcgtgcatgtgtactttgggcggtttcctttttttcttttctaccttttaaatggaaatactgcattatgactgttgtctctcttatcactgtagtggtttcatggccccagatagaggcccagagacctagaaattgtcatgagggacaggcctataagggtgccaattctgcagctacagatccctggagtggtgtgtgtgtgcgtgtgtgtgtgtgtgtgtgtgtgtgtgtgtgtgtgtggtggatgtttcttgagcgtggggttttattgtttgtgttgtgtttttttaaattgtttctggtatagctgaaatttccagagggcagaaccaagaacaaagccactgggccagaggacccccgtggttctccacattacagctctgggactctgcacgatttagtcctctaattttggaagttcaagacacagctgggcacataagccatgagagaagagggggaacacacagttcaggagagagaagaaatgttgctctggttgctgttgtacaagaacataaaccaacaagaccttcactccccattatagaagctgtcctttgtcactggacatctcccctttccctaggggtgacctctgtacaaacgaaaggaagtgggtcacatgcagagagagcacctccatttcccatgggctcaagtttgtatgatattgtgtaaattaatgcagaactcttgactctttccatcctcttcctttccctcttgatattcaaggccatgaatcccaaaataacagtcttagtggctagcacccaaacagaggtggaataaatccaccccagtgtctcgggctcatttgagcaaattagcactgcaggtgctggcaagcaaagtcagccagagagttgtgaacgctgtaggggtgggagtctgctggagtgggctggagccgctcacagtcatctcagtgagcctgctggtgcccagcagccctggggaggccaggtgagaatccctgagctggtgtagccatggtcaactgtgtagcagagaatccccttgtttcataaacaaatatgctttgggagctttgccaggcactcagcagcctttcttccactgctgtgtaatctgtttcatttacacgtcttccaacccatcttcctaccactctcctccttttctcacctactaaccacttaccttctctctcttctatcttccaccctcatctgctcctttgaactgcgtgtatgtaattcatatctggatatgatatgacatctgatgtgcatgaatggggttgaatgtggatctctctgtatgtgtatctctctggtgcattttgtgtacgtttgtgtcagtacacacctgcacacaggtgtgggtgccctactcaagacttccttaccggggactctggtcagcttctgcaaaaggtctcatgtgtgagttccctgtgtgtgggtgtgctgggcgatagggtaaggtgtgcaacgggaaaagttgttagcttccagttggggttctaaggattatttttaaaacaaaggatttattctatgagaagggaaataattttcaggaaaacccagtttttcaattgggcattttatttctaattttctttgaaaagttagatttctcccttaaggggaagggcatacttgggcttaaggaaaagtgaagaaaagtatctcagattgagaggccttttgtcttccttccaagcgtcctgaaggggctctgccgaggaagggacagacaggttcacaagcatccatttgggggagagggcttgtctatgaccacactgaaattccagcttttttccagttgcaggagagaggggaaaaattctaaatggggaaatttgctatgaaccatttaaactttttgtaagtaatcatgtttgaggatgctggctcacagacctatcattatttatatcctctttttaaaaaaaaatcccatactttcaatgaatagattatctgctctatccaattattgtctttgtgacagacatttagcaaagcttactgcatccctttgaaaccttgagagttcctgaaatgttagaaagctcccaggaaagacgtaaacaacctgggctcaactcaccagcccagagcaggggctttgagtgacttctttgatagcaggaccagataaatacgaacacactttgggatctgatcctgctgggaagcaaaagacgcccagccacatgaccaggatagaggcccctttcagacggcaagtcctggccaatgggaggacttctcaggtgaccttgatccctctagcataagggcttgaccacagattaaaacatgtgactccaaccagttacggaagctttctggctgtgaggtagctgagggagatgaggaggaggaagagaggagccttgacttgtgaggctctgtaggtcagactctgctaactccaaatcaaagtggaacccaaccttatgagggcatttagggtcaatgacctcactaaagtcaccagccgcaaccccaggtcaagttcaaacttcttactggcatatgaacatgtatgtgctttgagctccatgcaagtcaaccttgagcctggggcccattgcaacttttatttccttccctactctactaccttgagattcaggaaagtgaggtattctacctagagagaggtcccatatctttttctccttattttgggagttacggtttcttcttctgtttccgtttcctctctctctactcactcctactttctcctgcatcaactttggtcaattaacatagacaagtgattcatctgtagagaggctcctagactccaagcagcccccttccttgttcattgtggctgtaggttttataaggaggtctgtggctccctggcatcaaaatatgaaaaataaaatctgtgcctgttccagcttcaatcctcctccaagccttagcttttcaacaaccctaccctttcaacttcagggatcatggagtcacagagactggacaactcctccaaatctagacaaagactttcttaagcgccctgagcccaggtgcatatcttcccatcagggatgagtggtcccacctagcaatgcttgcctctcctgtgacaagagggtaggatatcctaggactctgagactgggccctatatctcaatattcatccacactcatgataagatgccggaaatgaatgcactgtgtgtagctgtcttgatttagtgggaggatgtgctgcttaggtctccaaagatgcccacctgggtcaaattcagaataatgaactcaggtacatcacccagaggcatttagaatggactctctcttcacctggattatgtgctgagtgttaagtgatttttcaaatatctgggggaaggagtgggaagagatacactctggtcatcctttggtgtggtttgtgggggatacttggttgattcttgtagttaaagtgaagttgcttttctgaaaatgttccctgtcttcaggggacttacccatcccaggggacacatccatcccaggggacacagccagccctttccagggaaatacgatgtttctgagtgagaggtgatttcagtgcagataggaagagctggtgcacaccagcagggttgccttccatgccatcttccagctggtgtgggatagactaagggggcagatttttaagaaccccaccagagttgacatacacacgtgattctcgtgtctgtctctcaaagctctcaatgtctggggctgtgtttgccctcttttcattgatgctgccatgatgcaaaatgtttcttaaacattattcctggttcttagaatatgtgattactgagtattggatttctttcctgaataataactgctcattgtagaaaataagaaaaataaaatacaaaaaagactacaagatttttcataatccagtcactctgaggcatctaccgcgggcccaatccaaatggtcatgacctcaaaacttccccaatgagtgcttgtctctgggttggcagctggggccatgtgagcagtgtacaccacagaaccgcactggtctgcgttgagttgaccctgtgttcctggcagcaagagtgcagggccctgagcccccagagatagcaaagaggcctaaaagtttaatgccagaccttaggggcaggatggagcagggctaaaagatgtctctttgggcctgtctgcctgctttccttccttccttttctttcctttttttttttggtcagttgccatctcaatctaatcatagatgtaagaatgcggaagccagagtaactcactcattaagctacacttgtgtaacagttactgtaaatttcactacagctctgcactgaaatgatttgtgactctgggcactgtgtcttctccatacttgaacttcctcatctacaaaatgaggataagtgataacaccttacctcatggtatattaagggtgacaaagaaattgcaaagtgatttgcaaacatgaagtgtcatatgagttatgtatgttctaattatccctcagaagaccccccgctggaatggaattctcacatcaagtgtctgtgcctcgctgctgaaggataacccagagtgcaaggtcatctttgttgctgaacagggctggacctgtcgcacttaagcacacttaaaggattctattcttcattcaggtcccccagagaaattggctccttatttttctttacctattcctagacttccttttgtctagagccagttttgcaaagggcacttttatccatctcagttattcccagaggtgacagaatgagtaaaccatatggggcaaatagcatatatgagctaaaccagttaactgttaaccaaggcacatggtcaatgccttagtatttttttttttaattctcctaacgttatttctagctgtacattcccaaaaggaatgggtggaagcaaatcagattctgaaaggtttcaatgatctttcaagtttaggatgagaccaagtctcaaggagctgggatcttctttctcttgtcagttgctgaagccagtagcttcgtcaaaaacatatgaattcatataaggaagccctttagatggtacattcactaagacgtgtctgggtgtgatcctgtttgggaaaaacagaatcctaggttctaaacaagaaaagaacgcccttcccaaagggtccgcacactttctgctttgcagcggatcaagtgtccttgtgagggtgagacttccttcaagggaagggaagccattgctctctctgtagatagagcccagctggtaacgggggagccacccaactgcaggggggtgtatgttcaggtgtgaaaaacagaaaactgggtctgaacatgaagagttgcacagcagtagttcgaagaagctggcatctctttggcaaacaccaacctcagcaaatgcaactcctacacttcattcccaaggaccaggtgttgctccttaaggaactctgtatccctctctcctctccagaaccccattcctcccactggctgagcttttcctttcctttccgggtcacccatagaccctctccgtctgtaccagtgcgtctgtgttgtgagcgtgacgaagcctttcctgtgaagagctttcatgaactcattctcatactccttccccatttccacccatggtgtgactgttttgctattcaagactatctgtaaaaatgtacaaataaaagtgaaaactgaaaataaaggggagggagattgagattaaacaaatgcaatgatgtagcccttagttttctgaggacttctgtggacggccctaaaatcctgagttagggtgggatatgaagggagggataccattgacacaggaggtttttttctggttgtttctctcacagtcatcagtgtctgcttagaactctctgttctaaaggtttttccctgtaaagtagaatgcacttcccccaaaataaaagtaaatcagcaatgtttgaagggtcatggcaagggtcatgacaaagacctgactctggggtggcatgagtggccctgtcaccggctcactcagggccttgggggagtctcattacctcaccttgtctccacgtcttctcagccaaatggggatcaggggcttccagggctctgggggtgcgcagtccccttgtgtattttgctgctatttctagagagactttgagcccttgctagtgcgtgcttactgcatggaggtaaattaggagatgttttctctctgctactcctggcctctgctttcgcccctcagaaagtgaccttgagctagcagccagtttgcactcagagtccagagccttctatctaccgtttcattctcagattccttttcccacccactttgacgatctcattttactatcagtctctactgactgagctttgctgcactgggctggggtaggagaaagagcatccaaggagatgatgtgtgaattgctttgtaatttatgactcaccatataaatgtggcttgcagtgtcagaagcagggagtctggccaagggttgctaccaaataagactgaagatggtggaggcagtggtggcgtggaggcagtaggcagaagatgtgggttgggagcagaggtaagatgaacggagctttgggaaggacagatggcagaagcaccagaaaatcctcagcaaggcagcagagaaggatcctcaaagcagtaaccctgaagtaataggaagtaggaaagaggagcagggattaggtaaatctgcagcataaacagctgtctccctgcaggactgagaagaccagctgccccagagaggggaggcacgtcgagcttggccagtgacccaacccatgattagaggcaccttcaatcccaactttcctctcctctgctgggtcacagtgatggaaccagcttcaggaaggtagtatagaccagcgtcatccaatggaaccatgatccaagccacatatgcaatttaaaatattctagtagccacattttttaaagtccaaagaaacagctaaaatcagtgaaattaatttttagactacattttaacctaacatgtcaaaaatagtatcacttcagcatggaatcaatataaaaattactgggatattttacattcttttttccaaatgaagtcttcaaaatccaatgtgattttcctcttagaaaacatctcagtctggcccagccctatttccagtgttcaatagccacacctgactactggttgctgtataggacagcacggacttaggttcttcattaggagactgatggggggggtccttcctggtgggtcactcactgccatagctcttgtcatagctgatgaaggcaggagtgagtcttattatgttggcctagagtagaaagcacagagctatgtcgaggctgctgtctcagcctctggaagttctgcttcacctgcttagtaagaggagatgaccactcctgtggactgcatgtcccatctgcccccagagggtgtcggcgctgccccagtcatgtcccttatgacctgtccaagtcctagaggccaaagcaggtcatattcttcagctgcaggaatgtcagctactgcctcccaccccttaacctgatccccttatcatatagtggggaaggggcaggcaggccttctctctgtcaagaacaaagatctctacaacatttcgtcacctgggccagtcacctgctaatatcatctcaccaatatttggagctgttttctgaatcccttaattttcttaaatatttatcttaaagtcaaatgctataaaggagataccctgggaagggcagtggccacaggcagactgggtctcctaggaggtggtggtgttggtgacaagttctacttggactgggactcaacccaccattgcctacctctcttccctgcctggagaccttccttaggattgaagaaacctcttttgtttgtgaaaaagataggtatcgagatcttaatggagagaacagaataaaatgcaaggagccaacccctgggtattctcaaagcatttcaacggtcagtataacaaggtttgattgatttaaaatataacattctgagccctgtgttactgagcaaaaatgagctgatttggtgagtatgttttatatatggtcattagacagggaccataactgacaaaactctcaaacgcctggagtgtttatggcccaccagattattgctcagtcaatataaatttatttacctttattttaatttgcatagtgctttctgattggtcagacaaggagtggtgtgtactgcaggattctaacaatgcctctgcccttggaggcagcaattcctgtggttattggtgctaaaataagataaaatattatgttaatttgttctgatatgatgtgaataaatgtgttgtttaatcttaacaagaatgctacatcttatcagatctattgtactgtctgttccttctcataattaattaattacaggaaaggcgattcaaaccagatcttgaaactattgtgatgttctgagaggtaaatttaacagggaagtgggaggggggatgaaaagggaaattgccaggttcctgtgactttgaaaggactgaggaagcagagagcatttggggacttcactgaaactgactgcatcttgcaattttctttttcgaattggcagaaatattgtatttccattgattgaagaaaaacaagtgtctggtaattaattaaatgacttgttcatggaaaaaataaataatctgtcagttgtggaatgtaaactgattaaacaattaaataaagaagattatgttgtgtgttttaaa

SEQ ID NO: 7765 - DNA, 2813 bp, Homo sapiens
ccggtcgcgtgcggacacaaggatggggacctcccagcgaggagcgctctgggcggggctccggacgcatgcgcggccctcgtacggaagcccggaaggaggggcagggggcggtggctcaggtttctccgggcggcggcggcggcggcgacggcgacggcgacggcagcggggacggcagcagtagcgggagcagcagcgtggacgcggctggcgctggcgccatgaacccgctgtaaggcgcaggctgtgcagcacggggtgcgggggaggaggaggaggacgccgcggtgaagttctccgccatgaacctgaggggcctcttccaggacttcaacccgagtaaattcctcatctatgcctgtctgctgctgttctctgtgctgctggcccttcgtttggatggcatcatacagtggagttactgggctgtctttgctccaatatggctgtggaagttaatggtcattgttggagcctcagttggaactggagtctgggcacgaaatcctcaatatcgagcagaaggagaaacgtgtgtggagtttaaagccatgttgattgcagtgggcatccacttgctcttgttgatgtttgaagttctggtctgtgacagaatcgagagaggaagccatttctggctcctggtcttcatgccgctgttctttgtttccccggtgtctgttgcagcttgcgtttggggctttcgacatgacaggtcactagagttagaaatcctgtgttctgtcaacattctccagtttatattcattgccttaagactggacaagatcatccactggccctggcttgttgtgtgtgtcccgctgtggattctcatgtcctttctgtgcctggtggtcctctactacattgtgtggtccgtcttgttcttgcgctctatggatgtgattgcagagcagcgcaggacacacataaccatggccctgagctggatgaccatcgtcgtgccccttcttacatttgagattctgctggttcacaaactggatggccacaacgccttctccagcatcccgatctttgtccccctttggctctcgttgatcacgctgatggcaaccacatttggacagaagggaggaaaccactggtggtttggtatccgcaaagatttctgtcagtttctgcttgaaatcttcccatttctacgagaatatggaaacatttcctatgatctccatcacgaagataatgaagaaaccgaagagaccccagttccggagccccctaaaatcgcacccatgtttcgaaagaaggccagggtggtcattacccagagccctgggaagtatgtgctcccacctcccaaattaaatatcgaaatgccagattagatgccacttccggggacagagcttaagtggactgggacgcactctctccgccttcctctgccccctcgttcaccccgcagaccagaaccagtactggagctgggtctccaggtacgtccatctcatgccttgtttgcatccagcgcctatcagccactcaccacgacgggacgcggaagtggcaggtgacgggggtgtgtgccagcagatgcggatgccaggaagagtgtgagaacaggggtgggattaccgtctgtctgggaggggctccaggtacccctcttccccgtcagacccactgggagatggctgcttgccaggcccccagaaggaacatctgtctatacggtgctgaaatcccaatcaaaagtattgtttagaaatgtatttctccacagggctgacctcctgcagctcgctgagcactcccaggtcctcagcactcccaggtcgtggctggggcagtcagtaggaactgtaactatgtctctgatgcaccacgtgtttagacacagcacagtccttttttctgttcctactgtggaagtagtttctctttgggcatgctgacagcagtttttcatagcctcacggatgagccctttctacgggagtgactccatgcttgtatacagagtatttatacaaatgttttagcatcttcatatgcggtgttaacccctagttctgtacagcatattctgttcaagtatttttttacaagcttgtgctgtaggcacatgccttctgctgcagaagtggacgcccgtggcacactccccccccccccgtggggtgccacgccttcatgggacattgccacttctgccctggaactcgtgcaggtacgtagtagctgctactgccagaacggcaacaccaagcaagagatggtccatgcttttctgacgttctcagaatagtggctagcttcaaacctgacaagcgctgcttgaagccggaacactagagaatgttgctgagagcagaaacggccacgcgggtcacgactatgcgtgggaaagtctcaagcttccctcctgccagcaacaagaaggctttggagtaggcatgatgttttcacgtgtgcgtgccgtttctccaagcactgcaggttccaccgtgtgtcagaggctgcaagtttaacatcctcctgcctgaaaacaaataggtcctttgctgaaaagagggtaaaaaaagagctttgatcttctcagccaggagaagagggtggtgttttcacgcgggcaactgctcgccggcctacatggggttaattcaagtctgctgcgagcacgactccgcccttggcactggcctccagcaagccctgttctctttggggtacaggggaacgggatggtttagactttcctgctcagtgtgtaaaaaatgtagctaaagccactatttttgctctccttaagctgttcaataaaccggttcctcatttta

SEQ ID NO: 7766 - DNA, 2555 bp, Homo sapiens
gtacggaagcccggaaggaggggcagggggcggtggctcaggtttctccgggcggcggcggcggcggcgacggcgacggcgacggcagcggggacggcagcagtagcgggagcagcagcgtggacgcggctggcgctggcgccatgaacccgctgtaaggcgcaggctgtgcagcacggggtgcgggggaggaggaggaggacgccgcggtgaagttctccgccatgaacctgaggggcctcttccaggacttcaacccgagagcagaaggagaaacgtgtgtggagtttaaagccatgttgattgcagtgggcatccacttgctcttgttgatgtttgaagttctggtctgtgacagaatcgagagaggaagccatttctggctcctggtcttcatgccgctgttctttgtttccccggtgtctgttgcagcttgcgtttggggctttcgacatgacaggtcactagagttagaaatcctgtgttctgtcaacattctccagtttatattcattgccttaagactggacaagatcatccactggccctggcttgttgtgtgtgtcccgctgtggattctcatgtcctttctgtgcctggtggtcctctactacattgtgtggtccgtcttgttcttgcgctctatggatgtgattgcagagcagcgcaggacacacataaccatggccctgagctggatgaccatcgtcgtgccccttcttacatttgagattctgctggttcacaaactggatggccacaacgccttctccagcatcccgatctttgtccccctttggctctcgttgatcacgctgatggcaaccacatttggacagaagggaggaaaccactggtggtttggtatccgcaaagatttctgtcagtttctgcttgaaatcttcccatttctacgagaatatggaaacatttcctatgatctccatcacgaagataatgaagaaaccgaagagaccccagttccggagccccctaaaatcgcacccatgtttcgaaagaaggccagggtggtcattacccagagccctgggaagtatgtgctcccacctcccaaattaaatatcgaaatgccagattagatgccacttccggggacagagcttaagtggactgggacgcactctctccgccttcctctgccccctcgttcaccccgcagaccagaaccagtactggagctgggtctccaggtacgtccatctcatgccttgtttgcatccagcgcctatcagccactcaccacgacgggacgcggaagtggcaggtgacgggggtgtgtgccagcagatgcggatgccaggaagagtgtgagaacaggggtgggattaccgtctgtctgggaggggctccaggtacccctcttccccgtcagacccactgggagatggctgcttgccaggcccccagaaggaacatctgtctatacggtgctgaaatcccaatcaaaagtattgtttagaaatgtatttctccacagggctgacctcctgcagctcgctgagcactcccaggtcctcagcactcccaggtcgtggctggggcagtcagtaggaactgtaactatgtctctgatgcaccacgtgtttagacacagcacagtccttttttctgttcctactgtggaagtagtttctctttgggcatgctgacagcagtttttcatagcctcacggatgagccctttctacgggagtgactccatgcttgtatacagagtatttatacaaatgttttagcatcttcatatgcggtgttaacccctagttctgtacagcatattctgttcaagtatttttttacaagcttgtgctgtaggcacatgccttctgctgcagaagtggacgcccgtggcacactccccccccccccgtggggtgccacgccttcatgggacattgccacttctgccctggaactcgtgcaggtacgtagtagctgctactgccagaacggcaacaccaagcaagagatggtccatgcttttctgacgttctcagaatagtggctagcttcaaacctgacaagcgctgcttgaagccggaacactagagaatgttgctgagagcagaaacggccacgcgggtcacgactatgcgtgggaaagtctcaagcttccctcctgccagcaacaagaaggctttggagtaggcatgatgttttcacgtgtgcgtgccgtttctccaagcactgcaggttccaccgtgtgtcagaggctgcaagtttaacatcctcctgcctgaaaacaaataggtcctttgctgaaaagagggtaaaaaaagagctttgatcttctcagccaggagaagagggtggtgttttcacgcgggcaactgctcgccggcctacatggggttaattcaagtctgctgcgagcacgactccgcccttggcactggcctccagcaagccctgttctctttggggtacaggggaacgggatggtttagactttcctgctcagtgtgtaaaaaatgtagctaaagccactatttttgctctccttaagctgttcaataaaccggttcctcatttta

SEQ ID NO: 7767 - DNA, 3665 bp, Homo sapiens
aggccacagactgggagaaaatatttgcaaagcacacatcaaaacactgacttgcacccagaacatacagagaactcttaaaaactcaaaactgcaaaaagaaacacctaaaaattggcaaaagagttgacaatttgcgaaggggatatacacatggcgaaaaagcacaggaaaagatgctcaacgccattacaggttagggaagacaaactacaaccaggatgagggcccgaaacacatggcttcagaatggtgaaactcagcaacactgacgaggccacgtgcctgggaggatgcagaggaactgggacactccagtgttactggcgggaaggcaggtggtacgggcactgtagaaaatggtttggccatctctgatgcagttaaaagcgcacttcccgtgggacttggctgccccactcctgggtataagatttacccccagagaagtgaaagcgcgcagccttgtagaaacccacacaccagtgtttgtagcagtcttgtttgcattttggatagcggccttgtttggttttcacaaaccaccctcagcggacagtcagataaactgtaggcatccatacaatggaataccactcagaactgagagggaacgacctgtggatacagggagggaacaacttggatgaatctcattagagacattatgtggatggcgggaagccagtctcaacaggttacttgtctcgcgatgccatctacataaagttccagcagagacaaaagtacagtgacagagaacagatcagtgtttgccggggctaatggtggggacggtgtgatagtgaagggacagcacggagagttttgcagggtgacagacctcttctgcatcctgccaacggctgtgcgaatctacttgtgtgaagactcagggaactcacaccaaaggaagacggtcacttttcctactgtatgatagataattaataaaaagggagaacggaggagtgtcgtcccaggaggcagggcaggagggcgaagacgtgtcacaggggagcctggccaagtggcgcccccggaactcgtcctctgggcttgtgtgtggatgagacaaggtctacctggtacgacagggacatactgggaatgcgcccttgccgtggaggcggggacccggcagcgctacgtatccagcatcaacctgtatccagcatcaacccgccaagttcactaacttggtaggggtgaggttagggatccttaggagcccaggcagccagactttctggggagcccattcccatttgtgttgccaaagtacccccagcaggttgtgggaatgttgcctgtgaagagagtctgttggggtgagatcttgtgtgtgtgcacagggtgacagttgtgtcccatttcccgggaagctgtgatggcagcagaacctagaggagcctgagagagtgtgggagagtgggcctctggaagagtagaggctgcggagccaggtgcagggctgtctgtcacccaaaggaagagggactgatgactcactgagcgtgtgtgtcccctggtggcagcaggccccatagtgaacataccataccttttctgtcctgagcgatgctcccagcagtcctgggagatggaacggtccttattcggctcacgggaaggaccgccttaactggacagacacagcaaggtgctaaagatgccttccatcagaggccaggttggaagctctaaagagacttctcttgctgttctctcacccacccccaggttgtgtgtgtcccgctgtggattctcatgtcctttctgtgcctggtggtcctctactacattgtgtggtccgtcttgttcttgcgctctatggatgtgattgcagagcagcgcaggacacacataaccatggccctgagctggatgaccatcgtcgtgccccttcttacatttgagattctgctggttcacaaactggatggccacaacgccttctccagcatcccgatctttgtccccctttggctctcgttgatcacgctgatggcaaccacatttggacagaagggaggaaaccactggtggtttggtatccgcaaagatttctgtcagtttctgcttgaaatcttcccatttctacgagaatatggaaacatttcctatgatctccatcacgaagataatgaagaaaccgaagagaccccagttccggagccccctaaaatcgcacccatgtttcgaaagaaggccagggtggtcattacccagagccctgggaagtatgtgctcccacctcccaaattaaatatcgaaatgccagattagatgccacttccggggacagagcttaagtggactgggacgcactctctccgccttcctctgccccctcgttcaccccgcagaccagaaccagtactggagctgggtctccaggtacgtccatctcatgccttgtttgcatccagcgcctatcagccactcaccacgacgggacgcggaagtggcaggtgacgggggtgtgtgccagcagatgcggatgccaggaagagtgtgagaacaggggtgggattaccgtctgtctgggaggggctccaggtacccctcttccccgtcagacccactgggagatggctgcttgccaggcccccagaaggaacatctgtctatacggtgctgaaatcccaatcaaaagtattgtttagaaatgtatttctccacagggctgacctcctgcagctcgctgagcactcccaggtcctcagcactcccaggtcgtggctggggcagtcagtaggaactgtaactatgtctctgatgcaccacgtgtttagacacagcacagtccttttttctgttcctactgtggaagtagtttctctttgggcatgctgacagcagtttttcatagcctcacggatgagccctttctacgggagtgactccatgcttgtatacagagtatttatacaaatgttttagcatcttcatatgcggtgttaacccctagttctgtacagcatattctgttcaagtatttttttacaagcttgtgctgtaggcacatgccttctgccctggaactcgtgcaggtacgtagtagctgctactgccagaacggcaacaccaagcaagagatggtccatgcttttctgacgttctcagaatagtggctagcttcaaacctgacaagcgctgcttgaagccggaacactagagaatgttgctgagagcagaaacggccacgcgggtcacgactatgcgtgggaaagtctcaagcttccctcctgccagcaacaagaaggctttggagtaggcatgatgttttcacgtgtgcgtgccgtttctccaagcactgcaggttccaccgtgtgtcagaggctgcaagtttaacatcctcctgcctgaaaacaaataggtcctttgctgaaaagagggtaaaaaaagagctttgatcttctcagccaggagaagagggtggtgttttcacgcgggcaactgctcgccggcctacatggggttaattcaagtctgctgcgagcacgactccgcccttggcactggcctccagcaagccctgttctctttggggtacaggggaacgggatggtttagactttcctgctcagtgtgtaaaaaatgtagctaaagccactatttttgctctccttaagctgttcaataaaccggttcctcatttt

SEQ ID NO: 7768 - DNA, 6168 bp, Homo sapiens
acttccgctcctcgcagcggagccggtcccctagggctcgggtcgcacggagctgacccctaacgaaatggggccgcgccaagggcggtggtggctgctgctctggctgccgcccctggccacactgcccgtgcgcggggaggcggcggcggcagcgttatcagttcgtaggtgtaaagctttgaaggaaaaagatttaattagaacgtctgagtcagactgttactgctacaatcaaaattcccaagtggagtggaaatacatatggtcaactatgcaggtgaaaattaccagtccaggcctgttcagaattgtatatatcgcagaaagacataattgccaatatccagaaaacattctatcttttatcaaatgtgtgattcataacttttggataccaaaggaatctaacgaaataaccataatcatcaatccatacagggagactgtgtgcttctctgtggagcctgtcaagaagatatttaactatatgatacatgtgaatcgaaacatcatggatttcaaactcttccttgtgtttgtggcaggagtttttcttttcttttatgcaaggaccctgagtcaaagccctactttctattactcctcgggaactgtgctaggtgttctaatgacattagtctttgtcttgctgttggtgaaaagattcattccgaagtatagcaccttttgggctctaatggttggttgttggtttgcctcagtttatattgtatgccagttgatggaagatctgaagtggctgtggtatgaaaacaggatatatgtattaggctatgtcttgatagttggatttttcagctttgttgtttgttacaagcatgggccccttgcagacgacaggagcagaagtcttctgatgtggatgctgcgactcctctccctggttctggtctatgctggtgtggccgtgcctcagtttgcctatgcagccataatcctcctcatgtcctcctggagtctgcactacccactgagagcatgcagttatatgaggtggaaaatggagcagtggtttacatcaaaagagctggtggtgaaatatcttacggaagacgagtacagggagcaagctgatgctgaaacgaacagtgctctggaggagctacgccgggcctgccgaaaacccgactttccctcatggctggtcgtctccagactccacactcctagcaaatttgcagactttgttcttggaggaagccacttgtcacctgaagaaatcagtctgcatgaagagcagtatggccttgggggtgccttcttggaagagcagctctttaacccgagtactgcctgacatgcgaccttcaagttgacttcattctggacaaggaagtgggcaaagggcagggattctattaaagttaggcagaactgttctagtgaacggtggcaaaaacatttgctgtggagaaaaacaagtcagtctggaaagggaaaccaacccattttgaagataacttagcattcttggtgacttctgctacttattgtactgtaggtggataccaaaattctgtgacagccactaccacttaccttgaatgaaggctttcattaggaacaggggaatggcgttgttcttaaggggctagtaagcatgaacaggtgctttgtcgacaccagggcactaaatctggtcttaatcccctgaacctgtgtcagaagactctgcaatactcttcctatagttcgtcagtataagtccttaaagagacctgagacatgctggaccagtgttttccaaagtacagctcacaggctactaccaagtgttggtcaataaaggtattctgaggtcaactaagattgatataaagttaaactaatgtatttcagtatctctcagaggcattcataatgctcgtgtgcactgtgaatctcccaaaggggagaaattgtgtgctgcagtttcttgcttaatttgaccacagaactctttttcatgagattaatattccttggaacacgtttggaaaatgctaatggtggtggaactgagctcatgagaggttaaataacttgtgcaagaccacactgagatgcagcactggtagaaatccagccctgatgtatcctttgactcaggtagacaagatcttcaggtgcaagcttaggagccatctccctacagccatgggcctcacaatgttggtggctttactttttatttttcaataatggccaacttgctatttaactgtgataaagggaaatgtttctgaagacattttaaagttttttatacatacgtaagatttttatatacatacgtaaggattagatactatgattactttttttgtattttgaaattgaaggcacttaagctcttgtgatattttgaattgactgatccatttaaaaaattgtttagctataggtgtttgtaacaatttcttataaaatgattttttttcttgattcatgatattaaactccagattgaaatgaggggctatgagctttgaccctgaggaaagaaggccaaaacatagatctgaggaaagatttgaacatggcaagacaatctcagggttaagatgttgctaagttgattctgagaatcaaaatcaggctttttttcctgtgatgggatcataaaaataatctttttatcaggacaaaggttatgggcgaaggatagacagaattttggcactgctgctttcctgagccaaattaagtagtttttctaaatcatgaaaaaagagcatgactatccatctggaacttcctagattgattttcaaatgatagttcctctttgaagtatttacaggtctgtttttgccagacatcttttcatactgggaacttttttttttgtaatatccactaaagttaatctgcctttatatagacttggatttttaaaaaaccaaaggatatattttccattcagatttatggtaactattttatgagtaaatagaagtttgaatatttttcttatggtttaatctgtttttttaaattatatttattggtgatataaatgtatcagatgtatcagtgcctgtgctcaccaagttcgtctcctaagaagcagtttgtgtgctacaacgtatgcgtatgagtaaataacacatgaacaatctgctggggctgccaggtacatcccagccaggacagccgctgggccagggggaagaggtactgctgagggaaggaagcagctcttcatgggcagctagccaggtgtaaccatcacagtaaaaacagccaaagagagaagaacaacagcagtccttgaggatattgttttccatgtttatttttagaggaaatcataggtttgtcagtttctgctttgtgactactgtgagaagctaaacaattagaagcattacttgtgatatttttagtgtatttatgttgttttcatttgatttgggggtgtattatagtactgatcacaattctaatccccatcaagcaatgtacagataactcttccaagaaatgtttccctcctttctttcctcccttcccttctctttctccctcacctcctgtctcctctcctcctccctttttaaaggcctttgaacagtttaaacgaccactcaataaaatggctctgcccttcacaggtggttggaagttggctttgtgcctcacacaccataggtgtataattatggagcctaacagatccctttgttattttactgcttatgcttggtgcctacaaaagcttactgttgttagcaagttgaactctttgacaccagatgtgtgggtgagatatagtgtaggtggctatgcttaaacaatcgtatcattcaagtgttatttttaaaaggttttaaaacacattttacatatcacaaaaaatgctttgtgaattagttgtatggtttgccagtaatacctagggctgaattacaggggaatgtccatctgacatgaaggacaatatttcaatttatgactttttaaaaaaatctggaaatttcatatatttagattttaagagggtttggaatagatgatggattacataaaaatatctaaatatgtggaggaattaagatcctgaaatgatgtcaactaaagaaatgctctcttacattatgctatgtgtgattgtttcccagagtgagagatgtacaattttataaattagcttttcttgtccaactgaaagcaagatagacaacataatggatgtggaagtttgaagacacctgcaggaagacagagaggtacttttaggtgacaacaggagcaagctgccttctgagagagcctgctgggtggcatgacattgaagagtgaactatttgggtgtgactgttagccttattgacttagaaccctgctttttgttattgcaccataagacctgtctcttgttagtcaattcatatagttggtacaggtagtgattcacaaccaaaaatataactagcataaggataaaaacacttgacttgatatgaccagcagattctctctcagaagacagatttacaaggggtcaaattataataaggtggctacttggtgaactgaaacaaaacaaagggagcttgttatataattcacatggttaatgtcatgaggccaaagagtttgatgcagatgccaccccccaccccagtggggctagccttgttaatgggatgagataccaggtctgttgacaaagaccacgccttcctttatgcaggtcctgccaactttttcctctctgtgactgctgtttttctaatcttcattattgacaaacatcccaccccctctgatgggcatatttttactcagatgtgttaaaatctttagtctttctctggcctaggagttggattatcttttaaaggtaactgtattttttttgttatgatccctgaatgtgaaaccttaataggtcaccagagatttgaaatgaatactatacttatctaatataaatcttggaagatacagttagtgggtagcttctctattatttaaataatttgaggcatctgtttttttagatttggtcgtttttccaaaaaagaaagactgattgaaaagagaaagggaaagaataccaacattgactagagatccatcaggcactatatgaggcaccttcgatacctcttaatttgcacctcatgaccactctgtgatatgttttggtattttcattttacagatgaggaaagacccagagaaggtaggagaaagttgctgaaggacacatatagctaaagtggtagaatcagaattcaagcccccatatgtctgcttccagggctcatattctacttcctttatttattaccatctttttaagaaagtgaaggaaatgaccccatggataaggcattcaagaggtgactacatctgctgatgttatacacataccagtcatttgtgccccgcagcaatggacactgtagtctgcggctcttgtcagtgcttctcagactgtctggggtgatggaccagtttccctctagttcatcactagtaatacttttgtaagatacactaaattattagaaaaatgaaataatctttgaaagaaaagacatacagaatataagcacgatgatcatgtcatgacaatgtcaacttgccatacatattttgaaatgtctaatttctatgttgtcacataccagcagtagtttgacagcaccagtcattgagcacactttgagtagcactggtctacatgttatttttctaagatgccagtgatcttttcaggaaacaaaaaaaatccgaccttttttcaaatgtaagtttacaatttaaaagaatagcatcctacactgactattggagagagtatggtatataatttgttaaatgattataaaattgtttacttttgttgacacctttaagaagaaaaagaaaaatgaaaattatgaaacttataacctctctcagcagacttttgcactttatggaattgtcaccatcatcacttttttccatcctcttcaacttaagttttgcttaattttgtctcttaactaactcatatccccaaccacttaatgtttacaatgcatgttggaattgaatgccttactgtacagcttactagatataggtaaatatgtatagtatggcactgtagattgggagaatggaatatgattatagatttaaatggcaataaaataatagaac

SEQ ID NO: 7769 - DNA, 1296 bp, Homo sapiens
atggagcgaagggaacatttaaccttgactttccacagtcctgaggttcccaaaataaaggggaaccggaaataccaaaggcctaccgtccctgccaagaaacatccaagtgcctcgatgtcatgccaaaggcagcagcagcttatggatcaggcacacatctacatccgaacgctctgtggcagcctctgtagttttagcctcctaatgctgatcgccatgtccccactgaactgggtacagtttctggtgatcaagaatggccttgagctctacgcaggactctggaccttatgcaaccatgagctgtgctggagccacacacccaagccaccctattatctccaatattccagggccttctttctcatctctgtctttaccatacttactggccttggctggctcttcagctcttggatccttaatcgaggaagcatgaccaccaacttggatctgaaggtatccatgctcagcttcatctcagctacctgcttgctcctctgcctcaacctgtttgtggcacaggttcactggcatactagggatgccatggagtcagatctcctatggacctattatcttaactggtgcagtgacatcttttacatgtttgctgggatcatctctcttctcaactacttaacttccagatcgcctgcctgtgatgaaaacgtcactgtgattccaacagagagatcaaggctgggggttggtccggtgactacagtatcacctgctaaagatgaagggccaaggtctgagatggaatctctaagtgtgagagagaaaaatttaccaaagtcaggactgtggtggtgataggaaaacctaactatagcttgtcttaaaagcaggggagaagctgagttgggaatggtcacataaattctgggaaactctcctaatatcatgtccatattacttgaggagacagcattaaagctgatgaaatgtcttttgcgtgcattggatccaaaatatatatgatagtcataaagtaaataactcacttaagaaaaacatttctaaaagaaaacaacaatgtttagagtcatgaatgaaagaaactagtgaaagatgcagtgtgtagaccagagacctctttgggtatcagggatctcatggaccagaatggcccgtggagaagaatgttaattacttctgtttggaattttctttattatgtgtggctttgggtatactcaggatggaaagcacttggacaaatactgttgaatctgaacttaatagcattaccagaaatggaataaatatcaatggatataagaccta

SEQ ID NO: 7770 - DNA, 1881 bp, Homo sapiens
atctttgagaccaaggcctcaagccaccaaggaaaatgaagggcctctaccaggctgctggccggattcttgttactctggggatcctcagtgtatgctctggagttattgctttctttcctgtcttttcttacaagccttggttcacaggatggagtgttcgaattgcttgtcctatctggaatggagctttggccatcacaactggtgtgcttctactgttggcttacagagagtggacccagaggtacctgggggaagctactttcacctttgtgattctgagcattatgggatgtccacttcattttgcaatagccttggaatctgctctcctgggcccatattgcttctattcattttcagggattgcagggactaattaccttggctatgcagttacctttccttatccatatgcaaaattcccattagcctgtgtggacccaccacactacgaagagtaccacctgacacttcaagccctagacctgtgcctaagctttaccctactctgtacatccttgacagtgttcatcaaactttctgcaagacttatccagaatggacacataaacatgcaactccctgctgggaacccaaaccctttttcaccataaaagaattggaaaaaactaaagttcatatgggaccaaaaaagagcccgcatacccaagacaatcctaagcaaaaagaacaaagctggaggcatcacactacctgacttcaaactattctacaaggctacagttaccaaaacagcatggtactggtaccaaaacagatatatagaccaatggaacagaacagaggcctcagaaataacaccacacatatacaaccatctgatctttgacaaacctgacaaaaacaagaaatggggaaaggattccctttttaataaatggtgctgggaaaactggttagccatatgtagaaagctgaaactggatcccttccttacaccttatataaaaattaactcaagatggattaaagacttaaatgtaagacctaaaaccataaaaaccctagaagaaaacctaggcaataccattcaggacataggcatgggcaaagacttcatgactaaaacaccaaaagcaatggcaacaaaagccaaaatagacaaatcgtatctaattaaactaaagggcttctgcatggcaaaagaaactatcatcagagtgaacaggcaacctacagaacgggagaaaattttttcaatctacccatctgacaaacagctaatatccagaatctacaaagaacttaaacaaatttacaagaaaaaaacaaacaaccacatcaaaaagtaggcaaaggacatggacacttctcaaaagaagacatttatgaagccaacagacacacataatcccaaatcatgctactataaagacacatgcacacgtatgtttattgcggcactattcacaatagtaaagacttggaaccaacccaaatatccatcaatgatagattggattaagaaaatgtggcacatatacaccatggaatactacgcagccataaaaaaggatgagttcatgtcctttgcagggacatagatgaagctggaaaccatcattctccgcaaactgtcacaaggacagaaaaccaaacaccacatgttctcactcataggtgggaattgaacaatgggaacacttggacacagggtggggaacatcacacactggggcctttcagtgggtgggaggctgggggagggatagcattaggagaaattcctaatgtagatgatgagttgatgggtgtggcaaaccaacatggcacatatatacctatgcaacaaacctgcatgttgtgcacatgtaccctagaacttagagtataataaaaaaaaagaaaacagtg

SEQ ID NO: 7771 - DNA, 723 bp, Homo sapiens
gcttgtcctatctggaatggagctttggccatcacaactggtgtgcttctactgttggcttacagagagtggacccagaggtacctgggggaagctactttcacctttgtgattctgagcattatgggatgtccacttcattttgcaatagccttggaatctgctctcctgggcccatattgcttctattcattttcagggattgcagggactaattaccttggctatgcagttacctttccttatccatatgcaaaattcccattagcctgtgtggacccaccacactacgaagagtaccacctgacacttcaagccctagacctgtgcctaagctttaccctactctgtacatccttgacagtgttcatcaaactttctgcaagacttatccagaatggacacataaacatgcaactccctgctgggaacccaaaccctttttcaccataaaaggtaaaatggtctggggatagaaaaggcctgggaccagaatataaaagcacacagattaatagaattataaaatttaagatgtttaaacaagctttatataaggtagttgaactcctttacctaaatgtcttattaaaatgggtactgcatctgactgggatgtttcccctttctagtactatgaagctgaaggcatgtaaatctgctcttttaggaaatgttaattaaacatgctaaatgggaactagtaaaatcacctaagcccac

SEQ ID NO: 7772 - DNA, 1930 bp, Homo sapiens
cccctcggggaccccctgaggaccctcggattccccccaactcccctgccctctaaaaccacttcaattcctcaactcttcccccggcccgcaggaacccccgccatggcccgttcttacggcggccgggtgctggctgcaatgaccctgctgggcatcgcggcggccgtgctggcggcgctgggcgcgcagctgctgtttcagctgcaggcgggccgcgccgagctgcgggggctgcgcgccgaggggctgggccaggagctgggcgccggccccgggctgccagaggacgcggccgggacgctgctgccgctggccgccgcgctggccgcgctggtgctcgtgctggggttcacctgcttgctgctcgccgcgctctgtggccacctgggcgccgagctggcgcgggggcctggccccaggaggtctgactggtttctctacgactgccgcctcctcagacatgtggcccttggccttttctgctgtgggatctccgtctatttagcagcactgtccatctatgccttgctacttttcgagatcgagacaggcgcagcagctgcttccatcctcggctcgggcaccctggttctggtggctgtgctgacccacactctcctccgggctgcccgggctgcccgccgtgggctccatgagttgtccccgccatcctttgaagacgacctcgcccgccctgccgaagtctccaaggccagccccagagctcagcctcagcagggtatccatcgtcggaccccctattcaacctgtccagagcctggggacccctttgggtccatggccactgccacagcacctgcagccctggagggaggctgggagagcagcctgcctgcatccagaatgcaccggacactgtcggctggcctggggcactgggacggggttacgcacgagatgcgtcgaatgctgggccacagaccagggagcatggggaaggactccacactggtgtgagcccagggatgaggaatagagacctggtgtaagaaaaggataccatagagataggttcgggttcagctgcagtagcagtaggacttgatttttctctcattttattgcatccttggcttttgtcctcaaggttgcctcgtggcacaaaataattgccagagctccagccttcacctcctcattctgagggaaagtcagaggccagcgctggctaggtgtctcctggaagtcttcccaggaagcctcgaaacccttctttttatatcccactggccagaacagagcgaaatggccataccttgctgcaggggaggctgggaaatgtggctgtccagatggatgagattctgttacaggcataaggggagcggggggcttaggcagtgattctctaagtgtctccatccatttcacagatgaggaaacggaggccccaagagaggcagtgactcaccagggggcccacggccaggactgagcaccagagccaggattctcacctgaaccccataatctccatgctgctgatgtgcaagtctcagactctgcaaaatccactgcaccccctcgggctgtgaacatttcaaatccatgtgtgccaagcttggagcagcccagggccaggggcacggctggagagctggacccaggttcctggctgtggacccatggctgagggcttagctgctttgtgcctcagtttcctcatctgtaatatggggacacgaagtggccctgtctccaagggctctgacaagacacatgacttcatgtgaggcattccggggacccccacacaataggtcctcaatgtgtgttaatcgttctcatgctgctgctgcttttggggtgtaggcatgggtagtttctggggctcaaggaaataacagaggggtctccaaaggtctcctgtcttgcacaacccacaagtaaactctgatattcacta

SEQ ID NO: 7773 - DNA, 5464 bp, Homo sapiens
caaagagggagtcccaggttcttggcagcttgcttttcctcaggatggcttctggaaggctcattaagttcgtggtttttgagctcctagagtttgccgctttctccatccccacactcgtgatcacagaacagtttgccaccgcctaccaaggaacaagggctagatctgacaacacacactactggctgatcatctcctgttctattgcctatgttgcgttagtgactctactgatctgggttcctgtaaaagttatcctgcacaagaaacgttatatttacagaaaaattaaaggatggagacctgttctgatgatgtgtgtggtcctcaccacactgccctgcctcaccttttccatagcagtgactgaggttcaaaagagcattaatgggtccgctgatgtcttacctgatatgttacctgacctgcccgtatctctggttctgttatccctgatcatggttgatattattgaaaaactcaggatatatcctcttagagggagtcaaaagagtagtgaaaatggacacatccattcaacctctttgcaacacataaaaactgtgacggagcaagtgaggcaaagtccagaaaacgctgcatctccccaggcaaccaacagcacccaggtgtcgcagccatcaggagccatgacacggagccaggagtctgtgttcatgggaccccaggagccctcctgtgactccggaatcctgagaatgatgtcccggcgagatgtccgggcagagttattcttatggagctttctcctgtggtctgacacgatagaaatggtgcgtgtggctggtcaccccaacgtgtacaagtcaagctggctatacccagtctacatattcagttttatttctctccttcgaattacattcactccccaaaaccctcttctcaattccctgagcgtcctgctgcaagatttaccattcgtttttgttagacttggtttaatcattgccctggggactatcacacccgtactgggcctgtgtaaaaatatcctcgtgactctctcttacatttacttcaattacctaaccagaatcaggattttttctgcctttgaaatgtctccattttaaaaaggaaatgggatctagtaaggcctctttgtgatacctgtgtgcacatttgtaatccttctttttttcttggggcgtaggtgtttgcactataaaggaaatgactagattgtagagaataagccatttttactaactctagcatatcagtttttttttttacatatacaaatggtgctaaatttaagtaaagtaatattcttataagttggctctcaggtatttctagaaaatgttagcagctaattttagttagttatgtatactgaggtccccaacccctggaccatggtcccagtactggtccgtgatctgttagcaagcagaccgcacagcacgtggtgaacctcaaactgagcgttcccgcctgcattccgcctcctgtcagatcagcagcagcattagatcctcataggagcccaaaccctattgtgaactgcgtatgcaagggatctagctttcgctctttaagaaaatctaatacctgatgatctgaggtgggacagtttcatcccagaacccaaccccacccccaaccctggctgtggaaaaattgtcttccacaaaactagtccctggtgccaaaaaggttggggaccactgatgtataccacgctttttctaagaatactcttcaacggagccctttaaaaaactaagaaccttttccatcaagttagcccaagaataagatttttatcttttatatagatagcattatatgaattgattgattaaatttagttttaaaaaacacacttgaaattattgaataatttttaggttatacttttttttttttttttgagacgatgtctcgctcttgtcccctaggctggagtgcgatggcgcgttctcagctcactgcaacctgtatctcccgggttcaagcgattctcctgcctcagcctcccaagtagctgggaatacaggcacctgccaccacgctggctaatttttgtatttttagtagagacgaggtttcaccatgttggccaggctggtctcaaactcctgacctcaggtgatctgcccacctcggccttccaaagtgctgggattacaggtgtgagccaccacgcccggctggattatactttttaaaaatttgaaaattgtagttttaggggttccttcaaaggtggaattatattctttattccattgtggcaagggacttttattcaataaattgatttcagcataaaaagcaattcactttaacagatatttggctcagtttaaggcttagctgtattgccagtactgaagtactaatatgagtgttgtttagtataatgaagtcaaggtacatcagtaataccaagataaagtttcataataaaaagccataaagtgaagacagagatttcaaagtaaaagaatattttatttgtggaatttgatactttgataaataatcaaagtacaagccctgtttaaaattaaaagttcggcttacaaatataatagccaatgtatcagtgtcttatgtgatactatatcatggatatattgatgttataaaataattagatacagagtcatgcaacttgctttcaccctgttgggacactctgaacagtcagcactgttcatttgatagtaattttcagatgctagagagatttgtgagaggctgataatgcaagagtaatgatttatgtagccagtttcttcaatgatctgtgataacaaatcattaagaatgagacatatggcttaagaatgaagcttaagaatttgacatatggccggctgtggtggctcacacgtgtaatcccagcactttgggaggttgaggcaggtagatcactggagtccaggagtctgagaccagcctgggcaacatggagagattctacctctacaaaaaatacaaaaattagctgggcatggtgatctgcaactatagtcccagctacttaggaggctggggcaggaagattgcttgagcccaggaggtcaaggctacagtgagctatgatcatgccactgcactccagactgggcaacagagtgacacccatctaaaaaaaataaaagagaatttgacgttgtgttattctacgctccaccaaatacctctccccttgccaccctgtctccctttccctctgttttaggatttttctcacactgtaaaagaagatttactcacagttgttaaaagcttgccttccagctttctaatttgaggtaggttctataacctctgtgggtccccgtttccacatgtaaaagatgaacataatactagtactacattaatagggttaggagggttaaagggtaaagagtcctttgagcacattttctggcaaaccataataacttgataaatgctaagcattggaacgggtaccaagtctccaagaaacaagtatctcaatgcagttttagaaatttcctgttttattcttttctgtggccctgctcaccctctgggaataatcatttcaactttgcatttgtgaaaaataatacatacaatcttaaggttacttcagactatactttttcatcgaggagtattgtattcaaaagtgatcgatctgctgaatatataaattaaaatggacacaagccttcattcatcagacatttgagtgtctgtcctctgagttcccatagaatctgaattacaccactttattcacacttacattatgtgtttacttttctgagtgtcctattaatctttattccttaaaggaaagcctgagggcatcttgtttaacaatgcatctctctcttcatcaatcaacgctgcaggtgcttacaagacttataacttaaaaaaattataatacaaggctcagcgcagtgcctcaagtgccaacagtttcggaggccttggcaggcggatcacttgaggccaagagttcgagactagcctggccaacatggtgaaacaccgtctgtactaaaaatacaaaaattagctgggtgtggtggcacgcgcctgtagtctcagctacttgggaggctgaggcaggagaatcacttgaacctgggaggcagaggttgcaatgagctgagattgcgccattgcacaccagcctgggtgacaagagtctcaaaaaaaaaattataatacaagtaattactttcgaattctgccatgggtatctttttattattaagaaaagcctgtcatcaagggattcatttatgatattcctaaatatgaaaatattttgtgtaagtatatatttatctccatattagaacttagcaacagtgctcagataaactcaaaagtattacttgagtttagaatgcattttgtatctaatattttaatatgaatgtgcctgatattttcggaagtcacaacactatacaaataatgaaggcatgtacagaagattatgtgtaggaggaaaattgagtagctaatttaatttcatttaatattttacttagagtgtatacatgtttatagactgcaagtctatgggatttaatagatattacagcaaattacactgcgaaaacattgatagttctacactgtaattaaatgttatatatattattaaaattattaggttggtgcaaaagtaattgaggtttttgccattgaaagtggtggtgcatgcctgtaatcccagctactcgggaggctgaatcagaattgcttgaacccggagggcagaggttgcagtgagctgagatctcgccactatgctccagcctgggcaacagattgagactctgtctcaaaaaaaaaaaaaagtcaagtacagttagttaaaggaatgtgcatttaaaaattaatctatgattaggctattaatatatagtctaataattttattgcattataattataaagtagttttataattttataaaattttattgatgctgtaatttttataaaattttatttattttataattttacaaaaaattctaatacctgtaatacactttttagtgccttttctttctaaaagttaatgtttgaaattacaatgtgtaaatgttatctcgtcttgtttttcttattagggccccatttcactgaatgacaattgcaatgaggcataggaaagaaaagggaaatgaaattgcttgctgaagtcctactatgttctgggcactatgctgtttgcctaatacataattgccttgtgctgtgtaccttggagcagggccttacatagtgaatatatcaatagttgttcacaaaaagagcaatataccacttagaagctacaaaacttaaaaatggctacttatactccatagaagatatagtaaataatagaagaaaaaaatgaaatggctaaagacattttgttttacaatggggctgtttttacatgttaattaaaattctatgtttaaacaaa

SEQ ID NO: 7774 - DNA, 661 bp, Homo sapiens
atggcggcggcgccagcggtgtgcgcctcgcaggggagcccgccgggtgcaccgtccgcgccggcggccgcgccagcacccgcggccggcctgggccgctgccggatggcgctgctgctggccgtggcgctggatgtggcgggcatggcggcgctgctgaccggcgtgttcgcgcagctgcaggtgcgcggccgcgacttcggggacctgctcatctactcgggcgcgctgctggtgttcctgagcctgctgggctggatcctctggtacaccggcaacatcgagatctcgcgccaggagctggagcgcgactacggcctgcggccctcggcgctcgcccgcctggcgcgcaagctctcccgccgctggtcggcgcccgccgccgcgggccagcgccccgcgcccggctcccggagagcgcgccgagccgcccgcgcgcccccgccgcccgccgccggctcccgccgcgtgcgcctgcagctcgccacgctcgaggccgggcccggggcggcgggcgcgggcagcgagtgaggcccagacaaccccttggctccagctgtcaggaccagactgagatgtgcagctgcccctacatccgtggccagacggacgctccctgtaccccctccctcctcacttggataaaaagcagatttgcctt

SEQ ID NO: 7775 - DNA, 3892 bp, Homo sapiens
acaaaggggctcctctggggagggtgggggtagatgagagtggggacttggatctgcctgccaggccgtcctgggcgctgcaggaagcaacatgacttaggtaactgcccagaggtcccaggcatcttcaagaccctggccctctccccaggtgcaccagacatgatgcagcagccgcgagtggagacagataccatcggggctggcgaggggccacagcaggcagtgccctggtcagcctgggtcacgaggcatggctgggtgcgctggtgggtgagccacatgcccccgagctggatccagtggtggagcacctcgaactggcggcaaccgctgcagcgcctgctgtggggtctggaggggatactctacctgctgctggcactgatgttgtgccatgcactcttcaccactggctcccacctgctgagctccttgtggcctgtcgtggccgcggtgtggcgccacctgctaccggctctcctgctgctggtgctcagtgctctgcctgccctcctcttcacggcctccttcctgctgctcttctccacactgctgagccttgtgggcctcctcacctccatgactcacccaggcgacactcaggatttggatcaatagaagggcaaccccatcccactgcctgtgtctgttgagccctggcctagggcctgagaccccacggggagagggagggcaatgggatcagggctccctgccttggcagggcccagacccctagtccctaacaggtagactggcctgaccccggactccttcctcaagtcaatgctgcaggttcctggtgtgaggggctgggggctttgagaagagggggcaagacagatggcttagccattggtgaaaattgcttagccaggggcagagcttgaccaagccactgatagcgcccatatggatgtgatgatacccgtggggcccccttggcaactgacagcatctttttctcatagccactcagctgtctcagcttcagactcactgagaacttctacctgggtaccactggccttgccattcctcccaccaatcccctctttccacttccaggagaaccacagactctagagagggtcccagtgacaaaaatctatcagggagaaggctggccagaagccccaggagacctcaactcactcgctctccaaaccttgcagcccacgcatcctcctccctagacttcctacttcctgcctcagtctgcatccccaagtctgagaaatgggccaactggggtcagacagcacctactcactctctaagaatcccaaggtctgttatggaaaaatgatcaagaaatcccatttcacccacttacacaatgtgtggccttggccaattaattcatttgagcctcaatgttacgtgggccacttctgtcatggggttgttgtgagtcaaagacaatatctatttgtgaagcattttgtagaagccaaaaacctgtaagatgttgttttgagctctaagaactttctgtaggcgcataagatcttttgaccccaaagactgttgaaggaacaggaagcttctctgggctttcagatcaactctctgtcctggatagaattttggccctaaaatggtaaacaagaggtcggttaagtgtgtacaagatgtaaaaggtcatgtgccatgaaatctcaaaatgtgcagatgttgaactattttgattatgaaatgcttgggcctggggctgggtgccagatgcttgcacagctgtgtgagtggggacagcacagccccagggtttccaaaactgacccagcaagccgctcaggcaccagaagggctttggaaagggcaatcctttgatgccctgaatgctggccgttcgttcacttgctggcccctccaacaaaacattgagtgatcggtaattaccaagtaaggtacatgatagacaactttatccacacctgacccccacccaagccctggccatccccaactcctgcccagttctgatccctgctttatgtataaccctaaaatccttgctcttgaagccccagacccaaggtccccctcttttgtcccataaatactcagggccttggggctagcccctagaaccctggttcatttttgccttagacttttgcaaccctccatgccacggattagatgccttcagcatcagtgccaaaacccaaggtccagtccttcctttctgtttctttgtatttctcccgcattatggcatggtagtgagagcgaggtaggacatggggctgatgtggtctcatggttggatgggttttggtgcatgagctgaggctgggcgtgagtcccagcactctcacttactaactccatgcccttagtggaaatcgctaaaccttcctcaacttcactttcctcatgggtaaaactaaggcaagaacccctgtcttagggctctggcatgtgagtgaaggacctgggaccactcctagcaccacaaattatagctatgctgtgaccatcccattttagagatgagaagtcaggcccaggatagccagttgccagtggcaaggccaggccatctgagtcctaccaggctactcaagggaaggtgaagggggcaaaggaaacacaaacaacctaactaactgaagaccccaaggcttctcaagagctcctatcagagctaaagcccaggcctagggaagtcatgagtcaagccaatctagatggcaagctgaggattcaggatcccatgtggtgagggcagagaccaggctgcctggcctagatccatcattgacttggccatgcattgctagccagggacgttgctctggagccttgggtccattccaatgaagggagagaggagtttggggccctgaccagatgctctagtggatgggatgtgggcagcagcaaggagaagaccttcttcctttccccacagactatataccttttaccctcctgcccagctggtatggggtaaggaggtgcacccagactagagagctgatgggcaatactcatcaaattagatccacatataccctaggacccagaaccccagaatgaattttcacagaggtccataagggccttgcccctcaaaatgtagtcccagaatcagcaacacaggcatcacctggaagctggttggaaatacagtctcaggccctgctccagacaggccgaatcagagtctgcatttttttttttttttttttgagacagagtcttgctctgttgtccaggctggagtgcagtggtgcaatctcggctcactgcgctccacctcccaggtccaagcaattctcctgcctcagcctcctgagtagctgggattacaggcgcctgccaccgagtccgacaaacttttgtatttttagtagagacagggtttcaccatgttggccaggctggtcttgaatccctgacctcaggtgatctgcccaccatagcctcccaaagtgctgggattacaggcgtgagccaccgtgcctggccaagagcctgcattttaacaagattcccaggtgatacattgtaccctgtttgagaagtgaagcataagggggtattatgagaatgcctattgcactgttactagtgggagcaggataggtaaagggaagggtaaaacaaggcagatgggcccaaggggcagtaattagaaggggcagaaggtacatgaaccaatcttaaaatcttagcattgaaaaagaaatggaatgagaatacaattcctcttacacaaatttaaaagcatgtcagcaaaacaagacaatttttggcaagaacacataaaaacgaaagataaacagaatggaatggacaactctaggggcaggcaagtgggagtagggtatagagataacaggcaataaagctagagagcttgcagaggcgaaacgtg

SEQ ID NO: 7776 - DNA, 1866 bp, Homo sapiens
cacaatgccccgggtgcccactcccagaatgctgaccaaagtgggaggagcactaggtcttcccgtcacctccacctctctccatgacccggctctgcttacccagacccgaagcacgtgaggatccgatcccagttcctccaaggggcctgggtgctggggaggggtcaggtagtccagtgcgtccacctgtatccacctggggccctagctgggcccagctcctggacagtgtcctatggctgggggcactaggactgacaatccaggcagtcttttccaccactggcccagccctgctgctgcttctggtcagcttcctcacctttgacctgctccataggtgcaccagacatgatgcagcagccgcgagtggagacagataccatcggggctggcgaggggccacagcaggcagtgccctggtcagcctgggtcacgaggcatggctgggtgcgctggtgggtgagccacatgcccccgagctggatccagtggtggagcacctcgaactggcggcaaccgctgcagcgcctgctgtggggtctggaggggatactctacctgctgctggcactgatgttgtgccatgcactcttcaccactggctcccacctgctgagctccttgtggcctgtcgtggccgcggtgtggcgccacctgctaccggctctcctgctgctggtgctcagtgctctgcctgccctcctcttcacggcctccttcctgctgctcttctccacactgctgagccttgtgggcctcctcacctccatgactcacccaggcgacactcaggatttggatcaatagaagggcaaccccatcccactgcctgtgtctgttgagccctggcctagggcctgagaccccacggggagagggagggcaatgggatcagggctccctgccttggcagggcccagacccctagtccctaacaggtagactggcctgaccccggactccttcctcaagtcaatgctgcaggttcctggtgtgaggggctgggggctttgagaagagggggcaagacagatggcttagccattggtgaaaattgcttagccaggggcagagcttgaccaagccactgatagcgcccatatggatgtgatgatacccgtggggcccccttggcaactgacagcatctttttctcatagccactcagctgtctcagcttcagactcactgagaacttctacctgggtaccactggccttgccattcctcccaccaatcccctctttccacttccaggagaaccacagactctagagagggtcccagtgacaaaaatctatcagggagaaggctggccagaagccccaggagacctcaactcactcgctctccaaaccttgcagcccacgcatcctcctccctagacttcctacttcctgcctcagtctgcatccccaagtctgagaaatgggccaactggggtcagacagcacctactcactctctaagaatcccaaggtctgttatggaaaaatgatcaagaaatcccatttcacccacttacacaatgtgtggccttggccaattaattcatttgagcctcaatgttacgtgggccacttctgtcatggggttgttgtgagtcaaagacaatatctatttgtgaagcattttgtagaagccaaaaacctgtaagatgttgttttgagctctaagaactttctgtaggcgcataagatcttttgaccccaaagactgttgaaggaacaggaagcttctctgggctttcagatcaactctctgtcctggatagaattttggccctaaaatggtaaacaagaggtcggttaagtgtgtacaagatgtaaaaggtcatgtgccatgaaatctcaaaatgtg

SEQ ID NO: 7777 - DNA, 571 bp, Homo sapiens
agatgagagtggggacttggatctgcctgccaggccgtcctgggcgctgcaggaagcaacatgacttaggtaactgcccagaggtgcaccagacatgatgcagcagccgcgagtggagacagataccatcggggctggcgaggggccacagcaggcagtgccctggtcagcctgggtcacgaggcatggctgggtgcgctggtgggtgagccacatgcccccgagctggatccagtggtggagcacctcgaactggcggcaaccgctgcagcgcctgctgtggggtctggaggggatactctacctgctgctggcactgatgttgtgccatgcactcttcaccactggctcccacctgctgagctccttgtggcctgtcgtggccgcggtgtggcgccacctgctaccggctctcctgctgctggtgctcagtgctctgcctgccctcctcttcacggcctccttcctgctgctcttctccacactgctgagccttgtgggcctcctcacctccatgactcacccaggcgacactcaggatttggatcaatagaagggcaaccccatccca

SEQ ID NO: 7778 - DNA, 2395 bp, Homo sapiens
cggccgcccacctgccgggtaagggcccctcgggcccgtggtcgggcatcgattggccccgcctggcgcagcccccgcccctgcagcggactgcggtgctcatcagacctgagcagttgctccggcggcgctcggggagggagccagcagcctagggcctaggcccgggccaccatggcgctgcctccaggcccagccgccctccggcacacactgctgctcctgccagcccttctgagctcaggttggggggagttggagccacaaatagatggtcagacctgggctgagcgggcacttcgggagaatgaacgccacgccttcacctgccgggtggcaggggggcctggcacccccagattggcctggtatctggatggacagctgcaggaggccagcacctcaagactgctgagcgtgggaggggaggccttctctggaggcaccagcaccttcactgtcactgcccatcgggcccagcatgagctcaactgctctctgcaggaccccagaagtggccgatcagccaacgcctctgtcatccttaatgtgcaattcaagccagagattgcccaagtcggcgccaagtaccaggaagctcagggcccaggcctcctggttgtcctgtttgccctggtgcgtgccaacccgccggccaatgtcacctggatcgaccaggatgggccagtgactgtcaacacctctgacttcctggtgctggatgcgcagaactacccctggctcaccaaccacacggtgcagctgcagctccgcagcctggcacacaacctctcggtggtggccaccaatgacgtgggtgtcaccagtgcgtcgcttccagccccaggcccctcccggcacccatctctgatatcaagtgactccaacaacctaaaactcaacaacgtgcgcctgccacgggagaacatgtccctcccgtccaaccttcagctcaatgacctcactccagattccagagcagtgaaaccagcagaccggcagatggctcagaacaacagccggccagagcttctggacccggagcccggcggcctcctcaccagccaaggtttcatccgcctcccagtgctgggctatatctatcgagtgtccagcgtgagcagtgatgagatctggctctgagccgagggcgagacaggagtattctcttggcctctggacaccctcccgttcctccaaggcatcctctacctagctaggtcaccaacgtgaagaagttatgccactgccacttttgcttgccctcctggctggggtgccctccatgtcatgcacgtgatgcatttcactgggctgtaacccgcaggggcacaggtatctttggcaaggctaccagttggacgtaagcccctcatgctgactcagggtgggccctgcatgtgatgactgggcccttccagagggagctctttggccaggggtgttcagatgtcatccagcatccaagtgtggcatggcctgctgtataccccaccccagtactccacagcaccttgtacagtaggcatgggggcgtgcctgtgtgggggacagggagggccctgcatggattttcctccttcctatgctatgtagccttgttccctcaggtaaaatttaggaccctgctagctgtgcagaacccaattgccctttgcacagaaaccaacccctgacccagcggtaccggccaagcacaaacgtcctttttgctgcacacgtctctgcccttcacttcttctcttctgtccccacctcctcttgggaattctaggttacacgttggaccttctctactacttcactgggcactagacttttctattggcctgtgccatcgcccagtattagcacaagttagggaggaagaggcaggcgatgagtctagtagcacccaggacggcttgtagctatgcatcattttcctacggcgttagcactttaagcacatcccctaggggagggggtgagtgaggggcccagagccctctttgtggcttccccacgtttggccttctgggattcactgtgagtgtcctgagctctcggggttgatggtttttctctcagcatgtctcctccaccacgggaccccagccctgaccaacccatggttgcctcatcagcaggaaggtgcccttcctggaggatggtcgccacaggcacataattcaacagtgtggaagctttaggggaacatggagaaagaaggagaccacataccccaaagtgacctaagaacactttaaaaagcaacatgtaaatgattggaaattaatatagtacagaatatatttttcccttgttgagatcttcttttgtaatgtttttcatgttactgcctagggcggtgctgagcacacagcaagtttaataaacttgactgaattcattt

SEQ ID NO: 7779 - DNA, 2442 bp, Homo sapiens
gggggtactcggcgcgggctggggaccagccggggggtggtgagccgcggccgcccacctgccgggtaagggcccctcgggcccgtggtcgggcatcgattggccccgcctggcgcagcccccgcccctgcagcggactgcggtgctcatcagacctgagcagttgctccggcggcgctcggggagggagccagcctagggcctaggcccgggccaccatggcgctgcctccaggcccagccgccctccggcacacactgctgctcctgccagcccttctgagctcaggttggggggagttggagccacaaatagatggtcagacctgggctgagcgggcacttcgggagaatgaacgccacgccttcacctgccgggtggcaggggggcctggcacccccagattggcctggtatctggatggacagctgcaggaggccagcacctcaagactgctgagcgtgggaggggaggccttctctggaggcaccagcaccttcactgtcactgcccatcgggcccagcatgagctcaactgctctctgcaggaccccagaagtggccgatcagccaacgcctctgtcatccttaatgtgcaattcaagccagagattgcccaagtcggcgccaagtaccaggaagctcagggcccaggcctcctggttgtcctgtttgccctggtgcgtgccaacccgccggccaatgtcacctggatcgaccaggatgggccagtgactgtcaacacctctgacttcctggtgctggatgcgcagaactacccctggctcaccaaccacacggtgcagctgcagctccgcagcctggcacacaacctctcggtggtggccaccaatgacgtgggtgtcaccagtgcgtcgcttccagccccaggcccctcccggcacccatctctgatatcaagtgactccaacaacctaaaactcaacaacgtgcgcctgccacgggagaacatgtccctcccgtccaaccttcagctcaatgacctcactccagattccagagcagtgaaaccagcagaccggcagatggctcagaacaacagccggccagagcttctggacccggagcccggcggcctcctcaccagccaaggtttcatccgcctcccagtgctgggctatatctatcgagtgtccagcgtgagcagtgatgagatctggctctgagccgagggcgagacaggagtattctcttggcctctggacaccctcccgttcctccaaggcatcctctacctagctaggtcaccaacgtgaagaagttatgccactgccacttttgcttgccctcctggctggggtgccctccatgtcatgcacgtgatgcatttcactgggctgtaacccgcaggggcacaggtatctttggcaaggctaccagttggacgtaagcccctcatgctgactcagggtgggccctgcatgtgatgactgggcccttccagagggagctctttggccaggggtgttcagatgtcatccagcatccaagtgtggcatggcctgctgtataccccaccccagtactccacagcaccttgtacagtaggcatgggggcgtgcctgtgtgggggacagggagggccctgcatggattttcctccttcctatgctatgtagccttgttccctcaggtaaaatttaggaccctgctagctgtgcagaacccaattgccctttgcacagaaaccaacccctgacccagcggtaccggccaagcacaaacgtcctttttgctgcacacgtctctgcccttcacttcttctcttctgtccccacctcctcttgggaattctaggttacacgttggaccttctctactacttcactgggcactagacttttctattggcctgtgccatcgcccagtattagcacaagttagggaggaagaggcaggcgatgagtctagtagcacccaggacggcttgtagctatgcatcattttcctacggcgttagcactttaagcacatcccctaggggagggggtgagtgaggggcccagagccctctttgtggcttccccacgtttggccttctgggattcactgtgagtgtcctgagctctcggggttgatggtttttctctcagcatgtctcctccaccacgggaccccagccctgaccaacccatggttgcctcatcagcaggaaggtgcccttcctggaggatggtcgccacaggcacataattcaacagtgtggaagctttaggggaacatggagaaagaaggagaccacataccccaaagtgacctaagaacactttaaaaagcaacatgtaaatgattggaaattaatatagtacagaatatatttttcccttgttgagatcttcttttgtaatgtttttcatgttactgcctagggcggtgctgagcacacagcaagtttaataaacttgactgaattcatttaca

SEQ ID NO: 7780 - DNA, 659 bp, Homo sapiens
atggcagcagaggacagggagatgatggaagcccggggtgcgggagaaagttgcccgaccttccccaagatggtgcctggtgactccaagtctgaagggaagccaagggcttatctggaggcagagtcccagaagccagactcctcctatgactacttggaagagatggaagcttgtgaggacggaggctgccaagggccgcttaaatcgctgtcccccaagtcctgccgtgctaccaaaggccaggctggcgacggacccaaacccgcagagctgcccccgacccctgggactgagcgcaatcccgagatggagctggagaaggtgcgcatggagttcgagctcacgcggctcaagtacctgcatgagaagaaccagcggcagcggcagcacgaggtggtgatggagcagctgcagcgggagcggcagcacgaggtggtgatggagcagctgcagcaagaggcggcgccccgcctgttttcaggaggcctccagaacttcctgctgccccagaaccagtttgccatgttcctgtactgcttcatcttcattcacatcatctatgtcaccaaggagatggtcttctttctcttcgccaagcactacctattctgcattgcagccattttgctctgtttgattaaaactttctggtcata

SEQ ID NO: 7781 - DNA, 2381 bp, Homo sapiens
ggaaacttttccccggcgccttcgccgccgccgcccgcgcccgggagcgcgcccttctctgcccgcggtcggtgcgctcggccggaggcgccgcggcggaacggaacccagagaagggcacgcggggcggcggcgctcggggcttgcccgcggcgagggaggctgcgcccaggtccccggccccgcgccgcgcgcccagccgcgccatgggggaggcgcccagccccgcgcccgcgctctgggactgggactacctggaccgctgcttcgcccgccaccgcgtctgcatctccttcggcctgtggatctgcgcctcctcctgctggatcgccgcccacgcgctgcttctctatctgagatgtgcacagaaacccagacaggaccagtcggcactgtgtgctgcgtgctgcctcctgaccagtctgtgtgacaccgtcggggctcttctggccagacagctcacaatccaggttttcactggtgcctacctagcagctattgacttagtgaactttatgttcattctcttcccagtctgtggatccaaattcaagtctaattcagatcgggaagcccgagagaggaagaggaggcggcagctcagggccagtgtgtttgccctggccctgccgctgagcctgggcccgtgctgggctctgtgggttgctgtcccgaaggcttcagccaccatccgggggccacagcggaggctgctagcgagcctgctgcaggaaaatactgagatcctcggctacctgctgggtagcgttgctgcctttggctcctgggcttctcggatcccccctctctccagaatttgccgggggaagacatttccctccatccacctgtggacccggctcctgtcggccctggctggcctcctctatgcctcggccattgtggcccacgaccagcaccctgagtacctgctgcgggccacaccctggttcctgacctccctcggccgtgcggcactggacctcgctattattttcctttcgtgtgtgatgaagagcaagatgagacaggccttaggatttgccaaggaagccagagagagccctgacacccaagcccttttgacctgtgcagagaaagaggaagaaaaccaggagaatttggattgggtgcctctcaccacactgtcacactgcaagtcactgaggacaatgacagcaatcagtcgctacatggagctgaccatcgagcctgtgcagcaggcaggctgcagtgccaccaggctgccaggtgacgggcagacgagcgccggagatgcgtccctgcaggaccccccgtcgtaccctcccgttcaggtcatccgggcccgggtgtcttccggcagctcctctgaggtctcctccatcaactccgacctggagcagaagtattgggaggccctaaactcggagcagtgggaccctgaagatgtgaacctcgaaggcagcaaagaaaatgtggagctactgggatcccaggtgcaccaggactctgtgaggacagcacacctgagtgatgatgattaacaccttctggagccagctcatcagctcagagcccagggtcaggagttcgttcagtaacgcagcgggaatcaatctgcactgacaccgcggcaggaactgaagctgccctggcaagtgaggaaccaggagccgtcactgagtgtggctgggctacatcatagctcatcacggagctacgactttgggtactgcggacagacctggataggcccagcattcgttctgaagatcacagttcacagaagcttttgcttcgtaaagataatccaaaggatctcagacccgctcttccttttcccttcattcccttgagagtcagccatgaacggaatacctgctaggttccaggaatgagctcacctaacagatagcaaatgtgtctggttagatctcagcagagcccattctgcaagacctggctgagccagatgagagggtgggccctgtgctggggggccttgggtcacacacaggaaccgagacctggcttccaccccccagtcacccacttgggttatctgctggaagttatcgataggactgtgtggccaaccaagtgcttgtgagatcactgacactgcaaaaacaaagcaaactgctccgggtaccaggacttcctccaacctggcaagggtgtgcgctgaggcggggcttgcaggtgagggggctgtatgcttcaggaactaactaaatgcatgcagaaggtaagaggcatgatgggaggtgttcaagcacagcaatcccatttgggagttattttgatactgcgatgagtaagggtaagggcgcatggaatggggctaaggtgggagtgaacactggggtgaataaattttaaatcaattcaagtatctc

SEQ ID NO: 7782 - DNA, 1278 bp, Homo sapiens
ctaattgctgttggctcaggaaatgtggacaatacgcaggaagggacgccgtgccttacagcgaccggcagggactcggccgtccgcgagcccagccgcccgccccgctccggccaggatgttggaggcttctctatctgagatgtgcacagaaacccagacaggaccagtcggcactgtgtgctgcgtgctgcctcctgaccagtctgtgtgacaccgtcggggctcttctggccagacagctcacaatccaggttttcactggtgcctacctagcagctattgacttagtgaactttatgttcattctcttcccagtctgtggatccaaattcaagtctaattcagatcgggaagcccgagagaggaagaggaggcggcagctcagggccagtgtgtttgccctggccctgccgctgagcctgggcccgtgctgggctctgtgggttgctgtcccgaaggcttcagccaccatccgggggccacagcggaggctgctagcgagcctgctgcaggaaaatactgagatcctcggctacctgctgggtagcgttgctgcctttggctcctgggcttctcggatcccccctctctccagaattgtgaggccgggggtggggatgggactgtgggtcacatgacagtctcagggcatctgggagcatcctgagagggtcatggggcggaggtgtggcgtcaccgtgggtgcatggacatgggctcagcttttcctgaagagcgttagtgtgtatgacagcaaggagggggtgtgtgtggagagtgggcagccaacccagggcgtcctgaggacggcgggagcctctcggggaaagcccgtgtgttcttccccatttcctatagcaaatgaaaagcaggctctgaggaagaagcccctgaggctgaacccataagagaaggagatttgacaccggacaggcagccaggtgtgaggttctgtgtagatcaagagtgtcttaggccgggcgcgggggctcacgcctggaatcccagcactttgcgaggccgaggcggggcgggtcgcttgaggtcaggagttggagactagcctgaccaacacggtgaaaccctgtctctactaaaatacaaaaattagccaggcatggtggtgcatgcttgtaatcccagctactctggaggctgaggtggagaatcgcttgaacccaggaggcagaggttgcagtgagccgagattgtgccactgcactccagcctgggcgacaagagggaaactccgtctaaaaaaaaaaaaaaaaaaaa

SEQ ID NO: 7783 - DNA, 2245 bp, Homo sapiens
cggaacggaacccagagaagggcacgcggggcggcggcgctcggggcttgcccgcggcgagggaggctgcgcccaggtccccggccccgcgccgcgcgcccagccgcgccatgggggaggcgcccagccccgcgcccgcgctctgggactgggactacctggaccgctgcttcgcccgccaccgcgtctgcatctccttcggcctgtggatctgcgcctcctcctgctggatcgccgcccacgcgctgcttctctatctgagatgtgcacagaaacccagacaggaccagtcggcactgtgtgctgcgtgctgcctcctgaccagtctgtgtgacaccgtcggggctcttctggccagacagctcacaatccaggttttcactggtgcctacctagcagctattgacttagtgaactttatgttcattctcttcccagtctgtggatccaaattcaagtctaattcagatcgggaagcccgagagaggaagaggaggcggcagctcagggccagtgtgtttgccctggccctgccgctgagcctgggcccgtgctgggctctgtgggttgctgtcccgaaggcttcagccaccatccgggggccacagcggaggctgctagcgagcctgctgcaggaaaatactgagatcctcggctacctgctgggtagcgttgctgcctttggctcctgggcttctcggatcccccctctctccagaatttgccgggggaagacatttccctccatccacctgtggacccggctcctgtcggccctggctggcctcctctatgcctcggccattgtggcccacgaccagcaccctgagtacctgctgcgggccacaccctggttcctgacctccctcggccgtgcggcactggacctcgctattattttcctttcgtgtgtgatgaagagcaagatgagacaggccttaggatttgccaaggaagccagagagagccctgacacccaagcccttttgacctgtgcagagaaagaggaagaaaaccaggagaatttggattgggtgcctctcaccacactgtcacactgcaagtcactgaggacaatgacagcaatcagtcgctacatggagctgaccatcgagcctgtgcagcaggcaggctgcagtgccaccaggctgccaggtgacgggcagacgagcgccggagatgcgtccctgcaggaccccccgtcgtaccctcccgttcaggtcatccgggcccgggtgtcttccggcagctcctctgaggtctcctccatcaactccgacctggagtgggaccctgaagatgtgaacctcgaaggcagcaaagaaaatgtggagctactgggatcccaggtgcaccaggactctgtgaggacagcacacctgagtgatgatgattaacaccttctggagccagctcatcagctcagagcccagggtcaggagttcgttcagtaacgcagcgggaatcaatctgcactgacaccgcggcaggaactgaagctgccctggcaagtgaggaaccaggagccgtcactgagtgtggctgggctacatcatagctcatcacggagctacgactttgggtactgcggacagacctggataggcccagcattcgttctgaagatcacagttcacagaagcttttgcttcgtaaagataatccaaaggatctcagacccgctcttccttttcccttcattcccttgagagtcagccatgaacggaatacctgctaggttccaggaatgagctcacctaacagatagcaaatgtgtctggttagatctcagcagagcccattctgcaagacctggctgagccagatgagagggtgggccctgtgctggggggccttgggtcacacacaggaaccgagacctggcttccaccccccagtcacccacttgggttatctgctggaagttatcgataggactgtgtggccaaccaagtgcttgtgagatcactgacactgcaaaaacaaagcaaactgctccgggtaccaggacttcctccaacctggcaagggtgtgcgctgaggcggggcttgcaggtgagggggctgtatgcttcaggaactaactaaatgcatgcagaaggtaagaggcatgatgggaggtgttcaagcacagcaatcccatttgggagttattttgatactgcgatgagtaagggtaagggcgcatggaatggggctaaggtgggagtgaacactggggtgaataaattttaaatcaattcaa

SEQ ID NO: 7784 - DNA, 2197 bp, Homo sapiens
ggcttgcccgcggcgagggaggctgcgcccaggtccccggccccgcgccgcgcgcccagccgcgccatgggggaggcgcccagccccgcgcccgcgctctgggactgggactacctggaccgctgcttcgcccgccaccgcgtctgcatctccttcggcctgtggatctgcgcctcctcctgctggatcgccgcccacgcgctgcttctctatctgagatgtgcacagaaacccagacaggaccagtcggcactgtgtgctgcgtgctgcctcctgaccagtctgtgtgacaccgtcggggctcttctggccagacagctcacaatccaggttttcactggtgcctacctagcagctattgacttagtgaactttatgttcattctcttcccagtctgtggatccaaattcaagtctaattcagatcgggaagcccgagagaggaagaggaggcggcagctcagggccagtgtgtttgccctggccctgccgctgagcctgggcccgtgctgggctctgtgggttgctgtcccgaaggcttcagccaccatccgggggccacagcggaggctgctagcgagcctgctgcaggaaaatactgagatcctcggctacctgctgggtagcgttgctgcctttggctcctgggcttctcggatcccccctctctccagaatttgccgggggaagacatttccctccatccacctgtggacccggctcctgtcggccctggctggcctcctctatgcctcggccattgtggcccacgaccagcaccctgagtacctgctgcgggccacaccctggttcctgacctccctcggccgtgcggcactggacctcgctattattttcctttcgtgtgtgatgaagagcaagatgagacaggccttaggatttgccaaggaagccagagagagccctgacacccaagcccttttgacctgtgcagagaaagaggaagaaaaccaggagaatttggattgggtgcctctcaccacactgtcacactgcaagtcactgaggacaatgacagcaatcagtcgctacatggagctgaccatcgagcctgtgcagcaggctgcagtgccaccaggctgccaggtgacgggcagacgagcgccggagatgcgtccctgcaggaccccccgtcgtaccctcccgttcaggtcatccgggcccgggtgtcttccggcagctcctctgaggtctcctccatcaactccgacctggagtgggaccctgaagatgtgaacctcgaaggcagcaaagaaaatgtggagctactgggatcccaggtgcaccaggactctgtgaggacagcacacctgagtgatgatgattaacaccttctggagccagctcatcagctcagagcccagggtcaggagttcgttcagtaacgcagcgggaatcaatctgcactgacaccgcggcaggaactgaagctgccctggcaagtgaggaaccaggagccgtcactgagtgtggctgggctacatcatagctcatcacggagctacgactttgggtactgcggacagacctggataggcccagcattcgttctgaagatcacagttcacagaagcttttgcttcgtaaagataatccaaaggatctcagacccgctcttccttttcccttcattcccttgagagtcagccatgaacggaatacctgctaggttccaggaatgagctcacctaacagatagcaaatgtgtctggttagatctcagcagagcccattctgcaagacctggctgagccagatgagagggtgggccctgtgctggggggccttgggtcacacacaggaaccgagacctggcttccaccccccagtcacccacttgggttatctgctggaagttatcgataggactgtgtggccaaccaagtgcttgtgagatcactgacactgcaaaaacaaagcaaactgctccgggtaccaggacttcctccaacctggcaagggtgtgcgctgaggcggggcttgcaggtgagggggctgtatgcttcaggaactaactaaatgcatgcagaaggtaagaggcatgatgggaggtgttcaagcacagcaatcccatttgggagttattttgatactgcgatgagtaagggtaagggcgcatggaatggggctaaggtgggagtgaacactggggtgaataaattttaaatcaattcaa

SEQ ID NO: 7785 - DNA, 2490 bp, Homo sapiens
ggaaacttttccccggcgccttcgccgccgccgcccgcgcccgggagcgcgcccttctctgcccgcggtcggtgcgctcggccggaggcgccgcggcggaacggaacccagagaagggcacgcggggcggcggcgctcggggcttgcccgcggcgagggaggctgcgcccaggtccccggccccgcgccgcgcgcccagccgcgccatgggggaggcgcccagccccgcgcccgcgctctgggactgggactacctggaccgctgcttcgcccgccaccgcgtctgcatctccttcggcctgtggatctgcgcctcctcctgctggatcgccgcccacgcgctgcttctctatctgagatgtgcacagaaacccagacaggaccagtcggcactgtgtgctgcgtgctgcctcctgaccagtctgtgtgacaccgtcggggctcttctggccagacagctcacaatccaggttttcactggtgcctacctagcagctattgacttagtgaactttatgttcattctcttcccagtctgtggatccaaattcaagtctaattcagatcgggaagcccgagagaggaagaggaggcggcagctcagggccagtgtgtttgccctggccctgccgctgagcctgggcccgtgctgggctctgtgggttgctgtcccgaaggcttcagccaccatccgggggccacagcggaggctgctagcgagcctgctgcaggaaaatactgagatcctcggctacctgctgggtagcgttgctgcctttggctcctgggcttctcggatcccccctctctccagaattgccccacctccgacactggggattacgactcaacatgagatctggcggggacaaatgtccaaaccatcccagtctccctcacgttctcccagcggacattggcgagccgctgcccagcgtcaggtgctgggcactgagatgtgccgggggaagacatttccctccatccacctgtggacccggctcctgtcggccctggctggcctcctctatgcctcggccattgtggcccacgaccagcaccctgagtacctgctgcgggccacaccctggttcctgacctccctcggccgtgcggcactggacctcgctattattttcctttcgtgtgtgatgaagagcaagatgagacaggccttaggatttgccaaggaagccagagagagccctgacacccaagcccttttgacctgtgcagagaaagaggaagaaaaccaggagaatttggattgggtgcctctcaccacactgtcacactgcaagtcactgaggacaatgacagcaatcagtcgctacatggagctgaccatcgagcctgtgcagcaggcaggctgcagtgccaccaggctgccaggtgacgggcagacgagcgccggagatgcgtccctgcaggaccccccgtcgtaccctcccgttcaggtcatccgggcccgggtgtcttccggcagctcctctgaggtctcctccatcaactccgacctggagtgggaccctgaagatgtgaacctcgaaggcagcaaagaaaatgtggagctactgggatcccaggtgcaccaggactctgtgaggacagcacacctgagtgatgatgattaacaccttctggagccagctcatcagctcagagcccagggtcaggagttcgttcagtaacgcagcgggaatcaatctgcactgacaccgcggcaggaactgaagctgccctggcaagtgaggaaccaggagccgtcactgagtgtggctgggctacatcatagctcatcacggagctacgactttgggtactgcggacagacctggataggcccagcattcgttctgaagatcacagttcacagaagcttttgcttcgtaaagataatccaaaggatctcagacccgctcttccttttcccttcattcccttgagagtcagccatgaacggaatacctgctaggttccaggaatgagctcacctaacagatagcaaatgtgtctggttagatctcagcagagcccattctgcaagacctggctgagccagatgagagggtgggccctgtgctggggggccttgggtcacacacaggaaccgagacctggcttccaccccccagtcacccacttgggttatctgctggaagttatcgataggactgtgtggccaaccaagtgcttgtgagatcactgacactgcaaaaacaaagcaaactgctccgggtaccaggacttcctccaacctggcaagggtgtgcgctgaggcggggcttgcaggtgagggggctgtatgcttcaggaactaactaaatgcatgcagaaggtaagaggcatgatgggaggtgttcaagcacagcaatcccatttgggagttattttgatactgcgatgagtaagggtaagggcgcatggaatggggctaaggtgggagtgaacactggggtgaataaattttaaatcaattcaagtatctca

SEQ ID NO: 7786 - DNA, 1508 bp, Homo sapiens
cggaacggaacccagagaagggcacgcggggcggcggcgctcggggcttgcccgcggcgagggaggctgcgcccaggtccccggccccgcgccgcgcgcccagccgcgccatgggggaggcgcccagccccgcgcccgcgctctgggactgggactacctggaccgctgcttcgcccgccaccgcgtctgcatctccttcggcctgtggatctgcgcctcctcctgctggatcgccgcccacgcgctgcttctctatctgagatgtgcacagaaacccagacaggaccagtcggcactgtgtgctgcgtgctgcctcctgaccagtctgtgtgacaccgtcggggctcttctggccagacagctcacaatccaggttttcactggtgcctacctagcagctattgacttagtgaactttatgttcattctcttcccagtctgtggatccaaattcaagtctaattcagatcgggaagcccgagagaggaagaggaggcggcagctcagggccagtgtgtttgccctggccctgccgctgagcctgggcccgtgctgggctctgtgggttgctgtcccgaaggcttcagccaccatccgggggccacagcggaggctgctagcgagcctgctgcaggaaaatactgagatcctcggctacctgctgggtagcgttgctgcctttggctcctgggcttctcggatcccccctctctccagaatttgccgggggaagacatttccctccatccacctgtggacccggctcctgtcggccctggctggcctcctctatgcctcggccattgtggcccacgaccagcaccctgagtacctgctgcgggccacaccctggttcctgacctccctcggccgtgcggcactggacctcgctattattttcctttcgtgtgtgatgaagagcaagatgagacaggccttaggatttgccaaggaagccagagagagccctgacacccaagcccttttgacctgtgcagagaaagaggaagaaaaccaggagaatttggattgggtgcctctcaccacactgtcacactgcaagtcactgaggacaatgacagcaatcagtcgctacatggagctgaccatcgagcctgtgcagcaggcaggctgcagtgccaccaggctgccaggtgacgggcagacgagcgccggagatgcgtccctgcaggaccccccgtcgtaccctcccgttcaggtcatccgggcccgggtgtcttccggcagctcctctgaggtctcctccatcaactccgacctggagaagtattgggaggccctaaactcggagcagtgggaccctgaagatgtgaacctcgaaggcagcaaagaaaatgtggagctactgggatcccaggtgcaccaggactctgtgaggacagcacacctgagtgatgatgattaacaccttctggagccagctcatcagctcagagcccagggtcaggagttcgttcagtaacgcagcgggaatcaatctgcactg

SEQ ID NO: 7787 - DNA, 2375 bp, Homo sapiens
ctgcggtgcacacggcgcctcgccccgcctcaccggcgctctatcctcgcgtctgctcccagctccgggctcccggggctgaggtggagccgcgggacgccggcagggttgtggcgcagcagtctccttcctgcgcgcgcgcctgaagtcggcgtgggcgtttgaggaagctgggatacagcatttaatgaaaaatttatgcttaagaagtaaaaatggcaggcttcctagataattttcgttggccagaatgtgaatgtattgactggagtgagagaagaaatgctgtggcatctgttgtcgcaggtatattgttttttacaggctggtggataatgattgatgcagctgtggtgtatcctaagccagaacagttgaaccatgcctttcacacatgtggtgtattttccacattggctttcttcatgataaatgctgtatccaatgctcaggtgagaggtgatagctatgaaagcggctgtttaggaagaacaggtgctcgagtttggcttttcattggtttcatgttgatgtttgggtcacttattgcttccatgtggattctttttggtgcatatgttacccaaaatactgatgtttatccgggactagctgtgttttttcaaaatgcacttatattttttagcactctgatctacaaatttggaagaaccgaagagctatggacctgagatcacttcttaagtcacattttccttttgttatattctgtttgtagataggttttttatctctcagtacacattgccaaatggagtagattgtacattaaatgttttgtttctttacatttttatgttctgagttttgaaatagttttatgaaatttctttatttttcattgcatagactgttaatatgtatataatacaagactatatgaattggataatgagtatcagttttttattcctgagatttagaacttgatctactccctgagccagggttacatcatcttgtcattttagaagtaaccactcttgtctctctggctgggcacggtggctcatgcctgtaatcccagcactttgggaggccgaggcgggccgattgcttgaggtcaagtgtttgagaccagcctggccaacatggcgaaaccccatctactaaaaatacaaaaattagccaggcatggtggtgggtgcctgtaatcccaactacctaggaggctgaggcaggagaatcgcttgaacccggggggcagaggttgtagtgagctgagtttgcgccactgcactctagcctgggggagaaagtgaaactccctctcaaaaaaaagaaggaccactctcagtatctgatttctgaagatgtacaaaaaaatatagcttcatatatctagaatgagcactgagccataaaaggttttcagcaagttgtaacttattttggcctaaaaatgaggtttttttggtaaagaaaaaatatttgttcttatgtattgaagaagtgtacttttatataatgattttttaaatgcccaaaggactagtttgaaagcttcttttaaaaagaattcctctaatatgactttatgtgagaagggataatacatgatcaaataaactcagttttttatggttactgtaaaaagactgtgtaaggcagctcagcaccatgcttctcgtaaaagcagcttcaaatatccactggggttatcttttgacaacttgccattatctgatgttacacaattcaatagcaagcaagtttgagacaatcgcagtttaaaagcatgaaccatttaacaaaaagtggaataattaaagataaagcacttcttcccaaagggaattatcacctagtgaaaaattatgcatttcatctactcagttaccgactgcaagtctctcctcgctctagctctcaagctttgggtgaatattcctgtgaaatatatcttcaacttgaaagttcatactccaatcaaaaactccttttactgagtttgcagtactgtatttgcactgtttgtattcctctgggcccttattgctacttttgctttcctttgttacacagattttgtgttgcactttttctccagaggggtgttgtagagccttggttgtatgaataataccagtggtagtgtccacggctctaatgtaagcccatttggcatcactcctctcctctctcttgagaggatttcttgtgcacagagtatgaagcagttgtggagcgctgtgcctttgtcaagataccatcttgtttgatgacttctttctttgctgttttttcttcaaaatgttagtaagctctgtcatgcttctagcaaattgtaagactaattatttgtttccacctcataacctgttgcaataaatattacttctcatacagtttaa

SEQ ID NO: 7788 - DNA, 1993 bp, Homo sapiens
actcatttataccaggaaacagacaagagaacaagaggctgccgaagacaaaacttctctgcaagcacctgtgcacagcaatgtgcgtgggcatctgtgagaagaagagaatctgtgaagtttgagcaagcggccttcccaagatgtaccgaatatctcaactgatgtcaacaccagtagcaagttcttccaggttggaaagagaatatgctggagagctgtctcccacgtgcattttcccaagtttcacctgtgattccctggatggttaccattcttttgaatgcggctccatagatcccctgacaggctcccactatacctgtcgccgaagtcccagactcctcaccaatggctactatatttggactgaagacagcttcctgtgcgacaaagatggcaacataactctgaacccatcccagaccagcgttatgtataaggagaacttagttagtacctccaaatcttggctgcatggaagtatctttggtgacatcaactcttctccaagtgaagacaactggttgaaggggaccaggaggttggacacagaccattgcaatggaaatgcagatgatttagactgttcttctctgactgatgactgggagtcagggaagatgaatgcagagtctgtgatcacctcctcttccagccacatcatatctcagcctcctggaggaaactcccatagcttgtctcttcagtcccagttgacagcttctgaacgtttccaagagaatagttcggatcattcagaaaccaggttgttgcaagaggtcttctttcaggcaatcctgcttgctgtgtgcttaatcatttctgcatgtgcaagatggtttatgggagaaatattagccagtgtcttcacatgctcattgatgataactgtagcttatgtgaaatcattgtttctcagccttgccagctatttcaaaaccactgcctgtgctcggtttgtcaaaatttgacaaccatttaggaatgccttcgatgaatgtcctccatctgaatatctggaaattgtccaacttgcagtctacttggaatcaagtgttttattggaagggagtaagcgagtaatggagaaaaagccattttagtttgactatgtgattttaaaatgatctcagtttttccatcaaaattataatatgctcatgaaaataatattaatttgccttccctttgcaaacaccggcagttgaaaggaaaaggacggggaatgtgatggaaaagagaccgcctggaataaatgtccccctatgattctttaaggcagtggttctcgagcttgaattttcattaggaaattctgtgaggagcttgtaaccagatttctgggtctgccacatgcacctatctcttgctgaattgctttaatagaataatgagagcaagtttgtctaactaataccaacctgacaacttgaataacaataaatgcaatttgtacataaaatataatgctgcaaaagtttgtcattcacctcagtggagtgacttgatattaggtggtaaccgtagatgatggttaatatgaaaatggacaggaaagaagcattttctgaaagttatattcttttgaaccacgttctaaaccaagtttttaatcttcttggggctcgtaattacctttcactttaatgtcacttaaagatataacacagaaaaatgccttgagggcaaaatataggcaaaacaccaatgcgctttcaaatgcatgaaaatggtgcagttgtacccttgagccttgactcaagggctgtagatgttccctttccaccccccacacttggtgcgtgttcacaaagcaaatatggcctgtaattcaaatttgttctatgtgatactctctgagtaaaaactcatacatgcagaaaattgtctttgctcgaaatgataatgccaaaatataactttatatataatttgcatttagtacatttttggttaaaaaataaactaataaataagtgaagtcatcagc

SEQ ID NO: 7789 - DNA, 1861 bp, Homo sapiens
actcatttataccaggaaacagacaagagaacaagaggctgccgaagacaaaacttctctgcaagcacctgtgcacagcaatgtgcgtgggcatctgtgagaagaagagaatctgtgaagtttgagcaagcggccttcccaagatgtaccgaatatctcaactgatgtcaacaccagtagcaagttcttccaggttggaaagagaatatgctggagagctgtctcccacgtgcattttcccaagtttcacctgtgattccctggatggttaccattcttttgaatgcggctccatagatcccctgacaggctcccactatacctgtcgccgaagtcccagactcctcaccaatggctactatatttggactgaagacagcttcctgtgcgacaaagatggcaacataactctgaacccatcccagaccagcgttatgtataaggagaacttagttaggatatttagaaagaaaaagagaatctgccattccttttcttctctcttcaacctcagtacctccaaatcttggctgcatggaagtatctttggtgacatcaactcttctccaagtgaagacaactggttgaaggggaccaggaggttggacacagaccattgcaatggaaatgaaaccaggttgttgcaagaggtcttctttcaggcaatcctgcttgctgtgtgcttaatcatttctgcatgtgcaagatggtttatgggagaaatattagccagtgtcttcacatgctcattgatgataactgtagcttatgtgaaatcattgtttctcagccttgccagctatttcaaaaccactgcctgtgctcggtttgtcaaaatttgacaaccatttaggaatgccttcgatgaatgtcctccatctgaatatctggaaattgtccaacttgcagtctacttggaatcaagtgttttattggaagggagtaagcgagtaatggagaaaaagccattttagtttgactatgtgattttaaaatgatctcagtttttccatcaaaattataatatgctcatgaaaataatattaatttgccttccctttgcaaacaccggcagttgaaaggaaaaggacggggaatgtgatggaaaagagaccgcctggaataaatgtccccctatgattctttaaggcagtggttctcgagcttgaattttcattaggaaattctgtgaggagcttgtaaccagatttctgggtctgccacatgcacctatctcttgctgaattgctttaatagaataatgagagcaagtttgtctaactaataccaacctgacaacttgaataacaataaatgcaatttgtacataaaatataatgctgcaaaagtttgtcattcacctcagtggagtgacttgatattaggtggtaaccgtagatgatggttaatatgaaaatggacaggaaagaagcattttctgaaagttatattcttttgaaccacgttctaaaccaagtttttaatcttcttggggctcgtaattacctttcactttaatgtcacttaaagatataacacagaaaaatgccttgagggcaaaatataggcaaaacaccaatgcgctttcaaatgcatgaaaatggtgcagttgtacccttgagccttgactcaagggctgtagatgttccctttccaccccccacacttggtgcgtgttcacaaagcaaatatggcctgtaattcaaatttgttctatgtgatactctctgagtaaaaactcatacatgcagaaaattgtctttgctcgaaatgataatgccaaaatataactttatatataatttgcatttagtacatttttggttaaaaaataaactaataaataagtgaagtcatcagc

SEQ ID NO: 7790 - DNA, 556 bp, Homo sapiens
gaggctgccgaagacaaaacttctctgcaagcacctgtgcacagcaatgtgcgtgggcatctgtgagaagaaggaatgtccaggctgataaaaactattaaaatcactctctgtgactacctgtcaatggttcaagttgttgggaaaaagacagacaccaatctccaagcactgtttgaaacttgataatgaagttgacttgtgtcagatgattaaaatacacagaatctgtgaagtttgagcaagcggccttcccaagatgtaccgaatatctcaactgatgtcaacaccagtagcaagttcttccaggttggaaagagaatatgctggagagctgtctcccacgtgcattttcccaagtttcacctgtgattccctggatggttaccattcttttgaatgcggctccatagatcccctgacaggctcccactatacctgtcgccgaagtcccagactcctcaccaatggctactatatttggactgaagacagcttcctgtgcgacaaagatggcaacataactctgaacccatcccagaccagcgttatgtat

SEQ ID NO: 7791 - DNA, 496 bp, Homo sapiens
actcatttataccaggaaacagacaagagaacaagaggctgccgaagacaaaacttctctgcaagcacctgtgcacagcaatgtgcgtgggcatctgtgagaagaaggaagcttcgtatttcagtaataattttgtcctttgtcaattggaagaagaggctgggaactccctttggaaggaacacagaatctgtgaagtttgagcaagcggccttcccaagatgtaccgaatatctcaactgatgtcaacaccagtagcaagttcttccaggttggaaagagaatatgctggagagctgtctcccacgtgcattttcccaagtttcacctgtgattccctggatggttaccattcttttgaatgcggctccatagatcccctgacaggctcccactatacctgtcgccgaagtcccagactcctcaccaatggctactatatttggactgaagacagcttcctgtgcgacaaagatggcaacataactctgaaccc

SEQ ID NO: 7792 - DNA, 818 bp, Homo sapiens
gccctgcccaaagggagctggccttcccacttcgtgctcctgtgctggggacctgggacaccagcaccctccccaccccagccagtgctttcctcctggcccatggggacgctggtggccaagctgctcctgcccaccctcagcagcctggccttcctccccactgtcagcatcgcggccaagaggcggttccacatggaggccatggtctacctcttcaccctgttcttcgtggcgctccaccatgcctgcaatggacccggcttgtctgtgctgtgcttcatgcgtcacgacatcctggagtatttcagtgtctacgggacagccctgagcatgtgggtctcgctgatggcactggccgacttcgacgaacccaagaggtcaacatttgtgatgttcggcgtcctgaccattgctgtgcggatctaccatgaccgatggggctacggggtgtactcgggccccatcggcacagccatcctcatcatcgcggcaaagtggctacagaagatgaaggagaagaagggcctgtacccagacaagagcgtctacacccagcagataggccccggcctctgcttcggggcgctggccctgatgctacgcttcttctttgaggactgggactacacttatgtccacagcttctaccactgtgccctggctatgtcctttgttctgctgctgcccaaggtcaacaagaaggctggatccccggggaccccggccaagctggactgctccaccctgtgctgtgcttgtgtctgatgctgcgcccagcccggctctgagcccctgccctccccagctcacacttg

SEQ ID NO: 7793 - DNA, 1169 bp, Homo sapiens
gcgccgccccatcccccagtggtcctcatgtggaggctggcactaggcggggttttcctggcagccgcccaggcttgtgtcttctgtcgcctcccagcccacgacttgtcaggccgcctggctcggctctgcagccagatggaggccaggcagaaggaatgtggggcctccccagacttctcggcctttgccttagatgaggtgtccatgaacaaagtcacagagaagactcacagagtcctgagggtcatggaaatcaaagaggctgtctcctcactcccttcatattggagttggcttcgaaagaccaagctccctgagtacaccagggaagctctctgtccccccgcctgcccgttgcctctgctgtctcctgcagggggcagcaccacgctgtacaactgctccacctgcaaggggacggaggtgtcctgctggccccgaaagcgctgcttcccaggaagtcaggatctttgggaagccaagattctgctcctctccatcttcggagctttcctgcttctgggtgttctgagcctcctggtggagtcccaccacctccaagcaaaaagtggcttgtgaagacgctgaaaacctcccagcctccagctctaaggggtatgcactcacaacttccacatcccttggaggggaaccagtcagccccttagtcccagctccaaagacagtctccagaccctaaaacccagacatccctgcttctggttggtgagataatgaaaaacaagaaaatccccaaaaacccagatcccccacaatcccagtgtcagatggcctcccgggaacccaggcacccacagctggaaagttcctcccctccagccctcaaccaatcacatggctgtcaacaatgccaggaaaatatctacagaaggaaagaatcccctacgccactcccaccacacccacacccccttctgcctgttccgggaaagcgggggcatctgccccagaagctattccaggccctcctatgactgatggggaatccgggaatgcatgttctggaaaactcaccccactagagtgagatcacatcagtgggttcgcgggcatgccctccctccatcgtgttaacagtttgaaatcctggcctccctcagaggcctccatcctgccaggcctaagtaaaacttgctgttcatggc

SEQ ID NO: 7794 - DNA, 1191 bp, Homo sapiens
tccaggcaagggctggagccagggctgcagagcattcctcggctcagctggggcagcgccgccccatcccccagtggtcctcatgtggaggctggcactaggcggggttttcctggcagccgcccaggcttgtgtcttctgtcgcctcccagcccacgacttgtcaggccgcctggctcggctctgcagccagatggaggccaggcagaaggaatgtggggcctccccagacttctcggcctttgccttagatgaggtgtccatgaacaaagtcacagagaagactcacagagtcctgagggtcatggaaatcaaagaggctgtctcctcactcccttcatattggagttggcttcgaaagaccaagctccctgagtacaccagggaagctctctgtccccccgcctgccggggcagcaccacgctgtacaactgctccacctgcaaggggacggaggtgtcctgctggccccgaaagcgctgcttcccaggatctttgggaagccaagattctgctcctctccatcttcggagctttcctgcttctgggtgttctgagcctcctggtggagtcccaccacctccaagcaaaaagtggcttgtgaagacgctgaaaacctcccagcctccagctctaaggggtatgcactcacaacttccacatcccttggaggggaaccagtcagccccttagtcccagctccaaagacagtctccagaccctaaaacccagacatccctgcttctggttggtgagataatgaaaaacaagaaaatccccaaaaacccagatcccccacaatcccagtgtcagatggcctcccgggaacccaggcacccacagctggaaagttcctcccctccagccctcaaccaatcacatggctgtcaacaatgccaggaaaatatctacagaaggaaagaatcccctacgccactcccaccacacccacacccccttctgcctgttccgggaaagcgggggcatctgccccagaagctattccaggccctcctatgactgatggggaatccgggaatgcatgttctggaaaactcaccccactagagtgagatcacatcagtgggttcgcgggcatgccctccctccatcgtgttaacagtttgaaatcctggcctccctcagaggcctccatcctgccaggcctaagtaaaacttgctgttcatgg

SEQ ID NO: 7795 - DNA, 1857 bp, Homo sapiens
ccgaaggtgcctgggcttgctcattcagtcacagtcacagccaccatgccagggaggacctgggagctgtgcctgctactgctgctggggctgggactggggtcccaggaggccctacccccaccctgtgagagtgagatttactgccacggggagctcctaaaccaagttcaaatggccaagctctaccaggatgacaagcagtttgtggacatgccactgtctatagctccagaacaagtcctgcagaccttcactgagctgtccagggaccacaatcacagcatccccagggagcagctgcaggcgtttgtccacgaacacttccaggccaaggggcaggagctgcagccctggacccctgcagactggaaagacagcccccagttcctgcagaagatttcagatgccaaactgcgtgcctgggcagggcagctgcatcagctctggaagaagctggggaagaagatgaagccagaggttctcagccaccctgagcggttctctctcatctactcagaacatcccttcattgtgcctggcggtcgctttgttgagttctactactgggactcctactgggtcatggagggtctgctcctctcagagatggctgagacggtgaagggcatgctgcagaacttcttggacctggtgaaaacctatgggcatgtccccaatggtgggcgcgtgtactacctgcagcggagccagcccccactcttgaccctcatgatggattgctacttgactcacaccaatgacaccgcctttctacaggaaaacattgaaacactagccttggaattggacttttggaccaagaacaggactgtctctgtgagcttggagggaaagaactacctcctgaatcgctattatgtcccttatgggggacccaggcctgagtcctacagcaaagatgtggagttggctgacaccttgccagaaggagaccgggaggctctgtgggctgagctcaaggctggggctgagtctggctgggacttctcttcacgctggctcattggaggcccaaaccccaactcgcttagcggcatccgaacaagcaaactggtgcctgttgacctgaatgccttcctatgccaagcagaggagctgatgagcaacttctattccaggctggcagggaacgactcccaggccacgaagtacagaatcctgcggtcgcagcgcttggccgccctgaacacagtcctgtgggatgagcagaccggagcctggttcgattacgaccttgagaagaagaagaaaaaccgggagttttacccatccaacctcactccactctgggccgggtgtttctctgaccctggcgtggcggacaaggctctgaaatacctggaggacaaccggatcctgacttaccagtatgggatcccgacctctctccagaagacaggccagcagtgggatttccccaatgcctgggcccccctgcaggacctggtcatcagaggcctggccaaggcacctttacgtcgggcccaggaagtggctttccagctggctcagaattggatccgaaccaattttgatgtctactcgcagaagtcagccatgtatgagaagtatgacgtcagcaacggtggacagcccggtgggggaggagaatatgaagttcaggagggatttggctggacgaatggcgtggtcctgatgctgctggaccgctatggtgaccggctgacctcaggggccaagctggctttcctggagccccactgcctggcggccacccttctgcccagcctcctgctcagcctcctgccatggtgacagccctcctctcctcacctggccccagctcctgccccattaaacctctgcaccagt

SEQ ID NO: 7796 - DNA, 3603 bp, Homo sapiens
acagcccgctgccccacgttctacctgctctcgcttgtgaactagcctctcctgagtttgtaaagatgcctcagctcctgagaaatgtcctctgtgtaattgagacattccacaaatatgccagtgaggacagtaacggggcaacactgactggcagagagctgaaacaactcatccagggcgagtttggggacttttttcagccctgtgtccttcatgctgtggaaaaaaattcaaatcttctgaatattgacagtaatggcatcatcagttttgatgaatttgttcttgcaatcttcaacttgttgaacctctgttatcttgacataaaatcattactaagttctgaactaagacaggtgactaaaccagagaaggagaagctagatgatgtggatgttcaggcaaccaccggagatggtcagtggacagtgggaacttcaccaactcaagaaaagaggatgcttccttcaggaatggcatcatcatctcagctcatccctgaagaaagtggagcagttggaaataacagagtggacccatggagagaagccaagactcacaactttccaggagaagcatctgaacacaatgatcctaagaacaaacacctggaaggagatgaacaaagtcaggaagtggctcaagatatacaaacaacagaagacaatgaaggccaacttaagacaaataagccaatggcaggatcaaaaaagaccagcagtcccacagagaggaagggacaagataaggagatctcccaggaaggagatgaaccagccagagagcaaagtgtttccaagataagagaccagtttggagaacaggaaggaaacttggcaacccaaagttcaccaccaaaagaagcaacacaaagaccatgtgaagatcaggaagttagaacagaaaaggaaaaacactctaatatacaagaaccacccctacaaagagaagatgagcccagttcacagcatgctgacctgccagaacaagctgctgccaggtcaccatctcagacacagaaatcaactgattccaaggatgtctgtagaatgtttgacactcaagaaccaggaaaggatgctgaccagacaccagctaaaacaaagaatttgggtgaacctgaggattatggcagaacatctgagacccaagaaaaagaatgtgaaacaaaggacctgccagtccaatatggtagcagaaatggttcagaaacatctgacatgagagatgaaaggaaagagaggagaggtcctgaggcccatggaacagcagggcagaaagaacgtgacagaaaaactcggccactagtcctggaaacccaaacacaggatgggaagtatcaggaactccaaggattatcaaaatcaaaagatgctgaaaaaggttctgagacacaatatctaagctcagaaggaggagatcagactcaccctgaacttgaaggaacagcagtctcaggagaagaggcagaacacaccaaagaaggcacagcagaagcatttgtgaacagcaaaaacgcacctgcagcagaaaggacactgggggcaagagaaagaacacaagatttagcaccacttgagaagcagtctgtaggagaaaatactagggtcaccaagactcatgaccaaccagttgaggaggaggatggttaccagggggaggaccctgagtcaccattcacacagagtgatgaggggtcttctgaaactcccaacagcctggcttcagaggaaggcaatagcagctcagagacaggtgaactgcctgtgcaaggggactcccagagtcaaggggaccaacatggagagtctgtgcaaggaggtcacaataataacccagatacccagaggcagggaacacctggtgagaaaaacagagctctggaggcagtggtaccagcagtcagaggagaggatgtacagctcacagaggaccaggaacagcctgccagaggagaacacaagaatcaaggcccagggaccaaaggcccaggtgcagctgtggagcccaatggacacccagaagcacaggaatccacagcaggagatgaaaatagaaagtccctggaaatagagatcacaggtgccctggatgaagacttcactgaccagctttccctaatgcagctccctggaaagggagatagcagaaatgaattaaaggtccaaggcccaagtagcaaagaagagaaaggaagagcaacagaggcccagaatactctgttagaaagtctagatgaggacaattcagcctccctcaagatacaacttgaaacaaaggaacctgtaacatcagaggaggaagatgaaagtccccaagagctggcaggagaaggtggtgaccaaaaaagtccagccaagaaagagcacaattcttcagtcccctggtcaagtcttgaaaagcagatgcagagagaccaagagccctgttctgtggagaggggtgcagtctattccagtccactataccagtacctacaggagaagatactgcagcaaacaaatgtaacccaagaggagcatcaaaagcaagttcagatagcccaggcatcaggcccagagctttgcagtgtatccctcaccagtgagatctcagattgttctgtctttttcaactacagccaagcatcacaaccatataccaggggacttccacttgatgagagtcctgctggtgcacaggaaacaccagctccccaggccttggaagataagcaaggtcaccctcagagagagaggctggtactacaaagggaggcaagcaccacaaagcaatgaatcattatcatctcaacatgcccccaatttctctcccaatcaccctcaatactcacgtgtacacattcagatgcagattaacaatcttttaaattctcttcctaaatttctacaaaaacaaataataaaatattcagcagtgggggacaccactaaagaaacatctgagcaaacaaatacagtcagtaaaactcctaccaaacaatgctacttccaaatgccaaaatgggctttgtcatgagacagtttatctcaatgtacctgtcattaaaaatggaaaaattccttccatatctttagcaggtgccagtttttccaactgattcattgaatttaaaatagagcagtaggaaattataagactctgcaataatatctcataatcataaaatattaattcatatatatagattactctgcttcatgacatttcctagaagtatttcaagttcatcctaaaattttatccttcaaaataattttagacaatgccataacttaattatgattttctagcacttgattaaagtaaatttatgactctgctcatgttcaggtgcagctgaatctatcgccatggattcattctttcaattactcatccaacaaatttttattaaatcccactccttacacaaacttttcatagcttttggctcaaataaacaatcaagaataattatgagagaaaacacaaatctaaagtatgtttgattttataagaagctcttgtaaccaaccatccagtgagtctactaagtgtttacctatatggtttgatgagggtattaaattaaaattgataattaaacaacctgatgat

SEQ ID NO: 7797 - DNA, 1292 bp, Homo sapiens
gaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaaatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggccgcccattgtgtccttgcccaggaccccgagaaccaggcgctggcgaggttttactgctacactgagaggaccattgcgaagcggctcgtcttgcggcgggatccctcggtgaagaggactctctgtcgaggctgctcttccctcctcgtcccgggcctcacctgcacccagcgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagactcagggttccagtaaccagtgatggattcaccccatctcccaaataaagtttacttgttttacatt

SEQ ID NO: 7798 - DNA, 4786 bp, Homo sapiens
ggccgcgggatggcgggcagcaggggcgcctagctgcgccgggagccggggccgccgccggagtcgttgtcgccggagcctggagccgtgaacccagccgcgccagacgccgtgtgcgccgcctcgcgcagctccgcctggccgcccggaggggccccaccgccggccgcctgtgcgccccgggccgcgggcccgccgccgagcgcaagccccgctggccgccgccatgcacgccgcggagcccccgccgcccgaggactctgggactacgccgaggccgaacttttaggtcccactgagctaggcctgcgggccgggtggggggctgatcgcggcactcccgcggaggatggatggccgagacttcgggccccagcggtccgtgcacggtcccccgccgccgctgctgtccggcctggccatggacagccaccgcgtgggcgcggccactgccggacgcttgcccgcctcgggcttgcccggcccgctgccgcccgggaagtacatggccggcctgaatctccatccgcacccgggcgaggccttcttgggcagctttgtggccagcgggatggggccctcggcctcgtcccatgggagcccagtgccactgccctctgacctgtctttccgctccccaacccctagcaacctgcccatggtgcagctgtgggccgcccacgcccatgaaggcttctcccacctgcccagtgggctgtacccatcctacctccacctgaaccacctggagccccccagcagtgggagccccctcctcagccagctgggtcagcccagcattttcgatacccagaaaggtcaggggccaggaggagacggtttctacctgcccaccgcgggggctccgggctccctgcactctcacgcgccctcggcccggacccctggcggcggccactcctcgggcgccccggccaaaggctcgtcgtcgcgggacggtccagccaaggagcgggcgggccgcggcggggagccgcctccgcttttcggcaagaaggacccgcgcgcccggggcgaggaggcctcggggccacggggcgtggtggacctgacccaggaggcgcgcgccgagggccgccaggaccgggggcccccgcgcctggctgagcgcctgtcgcccttcctggctgagtccaagaccaagaatgcggcgctgcagccgtcggtactgaccatgtgcaacggcggcgccggggacgtggggctgcccgcgctggtggccgaagcggggcgcgggggtgccaaggaggctgcccggcaggacgagggcgcgcggctgctgcggcgcacggagaccctgctccctgggccgcgcccctgcccctcaccgctgcccccgccgcccgcgccccccaaggggcctcctgcaccccccgcggccacccccgccggcgtctacaccgtcttccgcgagcagggccgtgagcaccgcgtggtggcgcccaccttcgtgccttccgtggaggccttcgacgagcgcccggggcccatccagatcgcatcccaggcgcgcgatgcccgggcccgcgagcgcgaggctggcaggccaggggtcctgcaggcgccccccggctccccgcggcctctggaccggcccgagggcctgcgcgagaagaactcggtcatccgctcgctcaagcggccgccccccgcggatgcccccacggtgcgggccacacgcgcctccccggacccccgcgcctacgtgcctgccaaggagctgctcaagcccgaggcggacccgaggccctgcgagcgtgcgccccgcggcccagccggtcctgcagcccaacaggccgccaagctcttcggcctggagcccgggcgccccccgcccaccggccctgagcataaatggaaacccttcgagctgggcaacttcgccgccacgcagatggccgtgctggccgcgcagcaccaccacagccgcgccgaagaggaggccgccgtggtcgctgcctcctcctccaagaaggcctacctggaccctggggctgtgctgccccgctcggcggccacctgcggccggccggtcgctgacatgcactctgcggcccacgggtctggagaggcctcggccatgcagagccttataaagtacagtggcagctttgcccgggacgccgtggccgtgcgccctggtggctgtggcaagaagagcccctttggaggtttgggcaccatgaaacccgagcctgcgcccacctctgcgggtgcctcccgagcccaggcccgtctcccacactccggaggccctgcagcgggcggcggccggcagctgaagcgggaccccgagaggcccgagagcgccaaagctttcgggcgcgagggctctggtgcccagggtgaggcagaagtgcgacacccgcctgtgggcattgcagtggctgtggcccggcagaaggacagtggcggcagtggccggctggggcctgggctggtagaccaggagcgctctctgtcgctgagtaacgtcaaagggcacggccgagcagatgaggactgtgtggacgaccgggccagacaccgggaggaacggctgctcggggcacggctggaccgggatcaggagaagctgctcagagagagtaaggagctggctgacctggcccgcctgcaccctaccagctgtgctcctaacggcctgaaccccaacctcatggtgacggggggcccggcgctggcgggctcaggtcgctggtctgccgaccccgcagcccatctggccacgcacccctggttgccccgctcgggcaacgcatccatgtggctcgctggacacccctacggcttgggtcccccatctctgcaccagggcatggcccctgcgttcccacctggcctggggggctccctcccgtcagcctaccagtttgtcagggacccccaatcgggccagctggtggtcattcccagtgatcaccttcctcactttgcggagctgatggagcgggccaccgtaccgcccctctggcccgccctgtacccgccgggccgcagccccctgcaccacgcccagcagctgcagctcttctcacagcagcacttcctgcggcagcaggagttcctgtacctgcagcagcaggcggcccaggccttggaactgcagaggagcgcccagctcgtgcaggagcggttgaaggcgcaggagcaccgggcggagatggaagagaaggggagcaagcggggcctggaggctgcgggcaaggctggcctggccaccgccggccccgggctgctgccgcggaagccccctggcctggccgccggccccgcgggcacctacggcaaggccgtgagcccgccaccatcaccccgcgcatcccctgtggctgccctgaaggccaaggtcatccagaagctggaggacgtgtccaagccacccgcctacgcctaccccgccacccccagctcccaccccaccagcccgccgcccgcctccccaccgcccaccccgggtatcacccgcaaggaggaggctcccgagaatgtggtcgagaagaaagacttggagttggagaaggaagcccccagccccttccaggccctgttctcagatatcccgcccaggtacccgttccaagccctgccaccgcactacgggaggccctaccctttcctgctgcagcccacggccgccgccgacgcggacggcttggcccctgatgtgccgctcccggctgatgggcccgagcgcctggcactctcacccgaagacaagcccatccgcttgtccccctccaagatcacagagccgctgcgggagggcccggaggaagaaccgctggctgagcgggaggtgaaggcagaggtggaggacatggacgagggccccacagagctgccgcctctggagtcgccgctgccactgcccgccgcggaagccatggctacccccagccctgcagggggttgtggaggtggcctgttggaggcccaggcgctgagtgccaccgggcagagctgcgcagagccctctgagtgtccagactttgtggaggggcctgaaccacgggtggattccccgggccggacagaaccctgcaccgccgccctggacctgggggtgcagctgacacccgagacactggtggaggccaaggaggagccggtggaggtgcctgtggcggtgcccgtggtggaggcagtgcccgaggaaggcctggcgcaggtggcaccgagcgagtcccagcccaccctagaaatgtcagactgtgacgtgcccgccggggagggacagtgcccgagcctggagccccaagaggccgtgcctgtactcggcagcacctgcttcctggaagaggcaagctctgaccagttcctgcccagtctggaggacccactggctggcatgaacgccctggcggcagctgcggagctgccccaggccaggcctctgccctccccgggtgctgctggagcccaggccttggagaagctggaagcagccgagagccttgtcttggagcagagcttcctgcatggcatcaccctgctaagtgagatcgcagagctggagctggagaggaggagcccaccccaaggcctcccaccgtgcatgggacagggcagcccgatgccagctggcctacctgactgtgccaggggccctgcccccaccctctcaggatggcctagacttggggaacagagccgggtggggttgcagcccggagtgtctgtcaaaggcaccaggtggagagggcccggcacaggcccaccctggtccaaaccctcacactacagaaaaccccaatggtgctga

SEQ ID NO: 7799 - DNA, 10572 bp, Homo sapiens
ggccgcgggatggcgggcagcaggggcgcctagctgcgccgggagccggggccgccgccggagtcgttgtcgccggagcctggagccgtgaacccagccgcgccagacgccgtgtgcgccgcctcgcgcagctccgcctggccgcccggaggggccccaccgccggccgcctgtgcgccccgggccgcgggcccgccgccgagcgcaagccccgctggccgccgccatgcacgccgcggagcccccgccgcccgaggactctgggactacgccgaggccgaacttttaggtcccactgagctaggcctgcgggccgggtggggggctgatcgcggcactcccgcggaggatggatggccgagacttcgggccccagcggtccgtgcacggtcccccgccgccgctgctgtccggcctggccatggacagccaccgcgtgggcgcggccactgccggacgcttgcccgcctcgggcttgcccggcccgctgccgcccgggaagtacatggccggcctgaatctccatccgcacccgggcgaggccttcttgggcagctttgtggccagcgggatggggccctcggcctcgtcccatgggagcccagtgccactgccctctgacctgtctttccgctccccaacccctagcaacctgcccatggtgcagctgtgggccgcccacgcccatgaaggcttctcccacctgcccagtgggctgtacccatcctacctccacctgaaccacctggagccccccagcagtgggagccccctcctcagccagctgggtcagcccagcattttcgatacccagaaaggtcaggggccaggaggagacggtttctacctgcccaccgcgggggctccgggctccctgcactctcacgcgccctcggcccggacccctggcggcggccactcctcgggcgccccggccaaaggctcgtcgtcgcgggacggtccagccaaggagcgggcgggccgcggcggggagccgcctccgcttttcggcaagaaggacccgcgcgcccggggcgaggaggcctcggggccacggggcgtggtggacctgacccaggaggcgcgcgccgagggccgccaggaccgggggcccccgcgcctggctgagcgcctgtcgcccttcctggctgagtccaagaccaagaatgcggcgctgcagccgtcggtactgaccatgtgcaacggcggcgccggggacgtggggctgcccgcgctggtggccgaagcggggcgcgggggtgccaaggaggctgcccggcaggacgagggcgcgcggctgctgcggcgcacggagaccctgctccctgggccgcgcccctgcccctcaccgctgcccccgccgcccgcgccccccaaggggcctcctgcaccccccgcggccacccccgccggcgtctacaccgtcttccgcgagcagggccgtgagcaccgcgtggtggcgcccaccttcgtgccttccgtggaggccttcgacgagcgcccggggcccatccagatcgcatcccaggcgcgcgatgcccgggcccgcgagcgcgaggctggcaggccaggggtcctgcaggcgccccccggctccccgcggcctctggaccggcccgagggcctgcgcgagaagaactcggtcatccgctcgctcaagcggccgccccccgcggatgcccccacggtgcgggccacacgcgcctccccggacccccgcgcctacgtgcctgccaaggagctgctcaagcccgaggcggacccgaggccctgcgagcgtgcgccccgcggcccagccggtcctgcagcccaacaggccgccaagctcttcggcctggagcccgggcgccccccgcccaccggccctgagcataaatggaaacccttcgagctgggcaacttcgccgccacgcagatggccgtgctggccgcgcagcaccaccacagccgcgccgaagaggaggccgccgtggtcgctgcctcctcctccaagaaggcctacctggaccctggggctgtgctgccccgctcggcggccacctgcggccggccggtcgctgacatgcactctgcggcccacgggtctggagaggcctcggccatgcagagccttataaagtacagtggcagctttgcccgggacgccgtggccgtgcgccctggtggctgtggcaagaagagcccctttggaggtttgggcaccatgaaacccgagcctgcgcccacctctgcgggtgcctcccgagcccaggcccgtctcccacactccggaggccctgcagcgggcggcggccggcagctgaagcgggaccccgagaggcccgagagcgccaaagctttcgggcgcgagggctctggtgcccagggtgaggcagaagtgcgacacccgcctgtgggcattgcagtggctgtggcccggcagaaggacagtggcggcagtggccggctggggcctgggctggtagaccaggagcgctctctgtcgctgagtaacgtcaaagggcacggccgagcagatgaggactgtgtggacgaccgggccagacaccgggaggaacggctgctcggggcacggctggaccgggatcaggagaagctgctcagagagagtaaggagctggctgacctggcccgcctgcaccctaccagctgtgctcctaacggcctgaaccccaacctcatggtgacggggggcccggcgctggcgggctcaggtcgctggtctgccgaccccgcagcccatctggccacgcacccctggttgccccgctcgggcaacgcatccatgtggctcgctggacacccctacggcttgggtcccccatctctgcaccagggcatggcccctgcgttcccacctggcctggggggctccctcccgtcagcctaccagtttgtcagggacccccaatcgggccagctggtggtcattcccagtgatcaccttcctcactttgcggagctgatggagcgggccaccgtaccgcccctctggcccgccctgtacccgccgggccgcagccccctgcaccacgcccagcagctgcagctcttctcacagcagcacttcctgcggcagcaggagttcctgtacctgcagcagcaggcggcccaggccttggaactgcagaggagcgcccagctcgtgcaggagcggttgaaggcgcaggagcaccgggcggagatggaagagaaggggagcaagcggggcctggaggctgcgggcaaggctggcctggccaccgccggccccgggctgctgccgcggaagccccctggcctggccgccggccccgcgggcacctacggcaaggccgtgagcccgccaccatcaccccgcgcatcccctgtggctgccctgaaggccaaggtcatccagaagctggaggacgtgtccaagccacccgcctacgcctaccccgccacccccagctcccaccccaccagcccgccgcccgcctccccaccgcccaccccgggtatcacccgcaaggaggaggctcccgagaatgtggtcgagaagaaagacttggagttggagaaggaagcccccagccccttccaggccctgttctcagatatcccgcccaggtacccgttccaagccctgccaccgcactacgggaggccctaccctttcctgctgcagcccacggccgccgccgacgcggacggcttggcccctgatgtgccgctcccggctgatgggcccgagcgcctggcactctcacccgaagacaagcccatccgcttgtccccctccaagatcacagagccgctgcgggagggcccggaggaagaaccgctggctgagcgggaggtgaaggcagaggtggaggacatggacgagggccccacagagctgccgcctctggagtcgccgctgccactgcccgccgcggaagccatggctacccccagccctgcagggggttgtggaggtggcctgttggaggcccaggcgctgagtgccaccgggcagagctgcgcagagccctctgagtgtccagactttgtggaggggcctgaaccacgggtggattccccgggccggacagaaccctgcaccgccgccctggacctgggggtgcagctgacacccgagacactggtggaggccaaggaggagccggtggaggtgcctgtggcggtgcccgtggtggaggcagtgcccgaggaaggcctggcgcaggtggcaccgagcgagtcccagcccaccctagaaatgtcagactgtgacgtgcccgccggggagggacagtgcccgagcctggagccccaagaggccgtgcctgtactcggcagcacctgcttcctggaagaggcaagctctgaccagttcctgcccagtctggaggacccactggctggcatgaacgccctggcggcagctgcggagctgccccaggccaggcctctgccctccccgggtgctgctggagcccaggccttggagaagctggaagcagccgagagccttgtcttggagcagagcttcctgcatggcatcaccctgctaagtgagatcgcagagctggagctggagaggaggagccaagagatgggaggtgcggagcgggccctggtggcgcggccctccctggagagtctgctggcagctggcagccacatgctgagggaggtgctggatgggcccgtggtggacccactcaagaacctgcggctcccgcgggagctgaagcccaacaagaagtacagctggatgcgcaagaaggaggagcggatgtatgccatgaagtcctccctggaggacatggacgccctggagctggacttccggatgcggctggccgaggtgcagcgccagtacaaggagaagcagcgtgagctggtgaagctgcagcgccgccgggactccgaggacaggcgcgaggaaccccatagaagcttggcacgcagaggccctggcaggccgcggaaacggacccacgccccgagcgccctgtcgcccccccgcaagagagggaagagcggccacagtagcggaaagctgagcagcaagtctctgctgacatcagatgattatgagctgggagcagggataagaaagagacacaaggggtctgaggaggaacatgatgccctcatcggaatggggaaagccagggggaggaaccagacttgggatgaacatgaggcctcgtcggacttcatcagtcagctaaagattaagaagaagaagatggccagcgaccaggagcagttggcaagcaagctcgacaaggccctctccctcaccaagcaggacaagttgaagtcgcccttcaagttttcggacagtgctggggggaaatcgaaaactagcgggggctgcggcaggtacttgactccttacgacagcctgctggggaagaacaggaaggcgctggccaagggcctcggcctgtctctgaaatcctccagagaaggtaaacacaaaagggcagccaaaaccaggaagatggaggtggggttcaaggccagaggccagcccaagtcggcccattccccgtttgcctcggaagtgagcagctactcttacaatacggactcagaggaagacgaagaattcctgaaggacgagtggcccgcccaaggcccctccagctccaaactgacgccttccctcctgtgtagcatggtggcaaagaacagcaaggcagctggtggccccaagctgaccaagaggggcctggcggccccccggactctgaaacccaagccggccaccagcaggaagcagccgttttgtctgctgcttcgagaggccgaggcgcgttcctccttcagcgactcttcggaggaatcgtttgaccaagatgagagctcggaggaggaggacgaggaggaggagctcgaggaggaggacgaggccagcggtggtggctacaggctgggtgcccgggagcgggccctgtcaccgggcctggaggagagtgggctgggcctgctggcacgcttcgccgccagcgccctccccagccccacggtgggtccatccctgtctgtggtacagctggaggccaagcagaaggcccggaagaaagaggagcggcagagcctgctgggcacagagttcgagtacaccgactcagagagcgaggtcaaggtgcgcaagcggtcgcctgcggggctgctgcggcccaagaaggggctgggggagccgggaccctccctggccgcacccacgcctggcgcccgcggtcccgaccccagcagcccagacaaggccaagctggcggtggagaaggggcgcaaggcccggaagctgcggggccccaaggagcctggcttcgaggcggggcccgaggccagcgacgacgacctgtggacgcggcgccgcagcgagcgcatcttcctgcacgacgcctcggctgctgcacctgcgcccgtcagcaccgcgcccgccaccaagaccagccgctgcgccaagggcggccccctgagcccgcgcaaggacgccgggcgtgcaaaggacaggaaggaccccaggaagaagaagaaagggaaagaggctgggccaggagctgggctgccgccgccccgagctcctgccttgccctctgaggccagggctcctcacgccagctccctgaccgctgccaaaaggagcaaagccaaggccaaagggaaggaggtgaagaaggagaaccgcggcaaggggggtgccgtgagcaagctgatggagagcatggcagccgaggaggactttgaacccaaccaagactcgagcttctctgaggacgagcacctgccgcgtggcggggctgtggagcggccgctgaccccggcccctcgctcctgcatcatcgacaaggatgagctgaaggacggcctgcgtgtgctcatccccatggatgacaagctgctgtacgccgggcacgtgcagaccgtgcactcgccagacatataccgcgtggtggtggagggtgagcggggcaaccggccccacatctactgtctggagcagttgctgcaggaggcgatcatcgatgtgaggccagcctccactcgcttcttgccacaagggaccaggattgcagcctactggagccagcagtaccgctgtctctacccaggcactgtggtccgagggttactggacctggaggacgatggggacttgatcaccgtggagtttgacgacggagacacgggcaggatccccctctcacatatccgcctcctgccccctgactataagatacagtgtgctgagccgtccccggcccttctggtgccaagtgccaagcgccgcagccggaagaccagcaaagacactggggagggcaaagatggtggcacggctgggtcggaggagccaggagccaaggcccgtgggcgtgggcggaaacccagcgccaaggccaagggtggtagagccgctaccctggaggaggggaacccaacagacgaggtccccagtacccccttagccctggagccgagcagcaccccaggttccaagaagagccccccagagcctgtggacaagcgagccaaggcccccaaggcgcgcccggcaccgccgcagcccagtcccgcaccacccgccttcaccagctgcccagcacccgagccatttgcagagctgccagctcctgccacctccctggccccagcacccctcatcaccatgcctgccacacgccccaagcccaagaaggcgcgggcagccgaggagtcgggtgccaagggccctcggaggccgggggaggaggccgagctgcttgtcaaactggaccacgagggtgtcacgtcacccaaaagcaagaaggctaaagaggccctgctgctccgggaggatccgggggcggggggctggcaggagcccaagagcctcctgagcctgggcagctatccccccgcggccggcagcagcgagcccaaggcaccctggcccaaggccaccgacggggacctcgcccaggagcccgggccggggctcacgttcgaggactctgggaaccccaagagcccagacaaggcccaggctgagcaggacggggccgaagagtccgagagcagcagcagcagcagtagtggcagcagtagcagcagcagcagcagcagcagcagcggctcggagacagaaggggaggaggaaggcgacaagaacggggacgggggctgcggcaccgggggccgtaactgcagcgctgccagctccagggcggcctcaccggcctcctcctcctcctcctcatcctcctcctcctcctcctcctcctcctcatcctcctcttcctcctcctcctcttcctcctcctcctcttcctcttcgtcttcctcctcttcctcctcctcctcttcctcgtcctcatcctcctcctcctcctcctcttcctcctcttcttcctccaccacagacgaggactcttcctgcagctcggacgatgaggcagcccccgcccccacggctggcccttccgcgcaggcggcgctccccaccaaggccaccaagcaggccggcaaggcgcggccctcggcccactccccaggcaagaagacgcccgcgccccagccccaggcgcctcctccgcagcccacacagcctctgcagcccaaggctcaggccggggccaagagccgacccaagaagagagagggcgtccacctccccaccaccaaggagctggccaagcggcagcgcctgccgtccgtggagaaccggcccaagatcgccgccttcctgccagcccggcagctctggaagtggttcggcaagcccacccagcggcgtggcatgaagggcaaggcccgcaagctcttctacaaggccatcgtgcgcggcaaggagatgatccgtatcggggactgtgccgtgttcctctctgccggccgccccaacctgccctacatcggccgcatccagagcatgtgggagtcgtggggcaacaacatggtggtccgcgtcaagtggttctaccaccccgaggagaccagcccgggcaagcagttccaccagggccagcactgggaccagaagtccagccgcagcctcccggcggccctgcgggtctccagccagaggaaggacttcatggagcgcgcgctataccagtcctcgcatgtggacgaaaatgacgtgcagacggtgtcgcacaagtgcctggtggtgggcctggagcagtatgagcagatgctgaagaccaagaagtaccaggacagcgagggcctgtactacctcgcgggcacctacgagcccaccacgggcatgatcttctccacggacggcgtgcccgtgctctgctgagcccgccgggccctgcgggccacctgtgccccgagggcggccagggacccatctccatcactgccatggcgcggagaccacgtgcgttgtgtgcatgcgagcgctcctgcaggcgtgtgcatggggccaggtgtgcacgtggatgcccgggtgagtgtgtgtgcatgcacgtgtgtgcacgcatgtgcacatgcctccagccccaccttccaacccctcagtgcccccaggacaggggcccctcttagctatcagggtatggccggaccggcccttcctgcccagcacgttgcaagcacttggccaggccggccctccaggctgctgctgcgtgggggcccgggtgcccccaggtccatgcagactggggattcggtggggaggggcgcttctaaggaaccaaactgacgctcactctgggcttcccaagcacccttagcatggagcccaccccaaggcctcccaccgtgcatgggacagggcagcccgatgccagctggcctacctgactgtgccaggggccctgcccccaccctctcaggatggcctagacttggggaacagagccgggtggggttgcagcccggagtgtctgtcaaaggcaccaggtggagagggcccggcacaggcccaccctggtccaaaccctcacactacagaaaaccccaatggtgctgaaactgtcgcccggccacgcctggcccctccccacccaggagggaggtggcacttcttaacctgtacagttttattgtaccaagagactcgccccgcccctgtatcataagcctttaaatggagtcaactttttaattatatatataaagataaatatatataaatatatatataaactttttaaaactgtgaaaaatagctatgaaattataaaaaaaaacattctgacgtgcagaatattattttttatttcctgttagattatagtgtctagcaccggcttcaccggcctcccagtccccagcacaccccccgcccaccccaccaagtgtactgtactcaccccccaggatagagaagtgtttgttagggagagaagagggagaggcaggagccggcccaagcccagggtccctgcttgggccccagaaagcacttaaccaggccccaagccttcaagggaaaccaaggcctcaaccagacaatcttgagggaaggaaaagccagactttgggtttgttttttgggggaattattggtttttttttttatgtttcttttggaattttgtttgttggcaaattctgtgtgatcttttttcataaaaaaaaagaaaagatttaattggaaaaataaaa

SEQ ID NO: 7800 - DNA, 8935 bp, Homo sapiens
ggccgcgggatggcgggcagcaggggcgcctagctgcgccgggagccggggccgccgccggagtcgttgtcgccggagcctggagccgtgaacccagccgcgccagacgccgtgtgcgccgcctcgcgcagctccgcctggccgcccggaggggccccaccgccggccgcctgtgcgccccgggccgcgggcccgccgccgagcgcaagccccgctggccgccgccatgcacgccgcggagcccccgccgcccgaggactctgggactacgccgaggccgaacttttaggtcccactgagctaggcctgcgggccgggtggggggctgatcgcggcactcccgcggaggatggatggccgagacttcgggccccagcggtccgtgcacggtcccccgccgccgctgctgtccggcctggccatggacagccaccgcgtgggcgcggccactgccggacgcttgcccgcctcgggcttgcccggcccgctgccgcccgggaagtacatggccggcctgaatctccatccgcacccgggcgaggccttcttgggcagctttgtggccagcgggatggggccctcggcctcgtcccatgggagcccagtgccactgccctctgacctgtctttccgctccccaacccctagcaacctgcccatggtgcagctgtgggccgcccacgcccatgaaggcttctcccacctgcccagtgggctgtacccatcctacctccacctgaaccacctggagccccccagcagtgggagccccctcctcagccagctgggtcagcccagcattttcgatacccagaaaggtcaggggccaggaggagacggtttctacctgcccaccgcgggggctccgggctccctgcactctcacgcgccctcggcccggacccctggcggcggccactcctcgggcgccccggccaaaggctcgtcgtcgcgggacggtccagccaaggagcgggcgggccgcggcggggagccgcctccgcttttcggcaagaaggacccgcgcgcccggggcgaggaggcctcggggccacggggcgtggtggacctgacccaggaggcgcgcgccgagggccgccaggaccgggggcccccgcgcctggctgagcgcctgtcgcccttcctggctgagtccaagaccaagaatgcggcgctgcagccgtcggtactgaccatgtgcaacggcggcgccggggacgtggggctgcccgcgctggtggccgaagcggggcgcgggggtgccaaggaggctgcccggcaggacgagggcgcgcggctgctgcggcgcacggagaccctgctccctgggccgcgcccctgcccctcaccgctgcccccgccgcccgcgccccccaaggggcctcctgcaccccccgcggccacccccgccggcgtctacaccgtcttccgcgagcagggccgtgagcaccgcgtggtggcgcccaccttcgtgccttccgtggaggccttcgacgagcgcccggggcccatccagatcgcatcccaggcgcgcgatgcccgggcccgcgagcgcgaggctggcaggccaggggtcctgcaggcgccccccggctccccgcggcctctggaccggcccgagggcctgcgcgagaagaactcggtcatccgctcgctcaagcggccgccccccgcggatgcccccacggtgcgggccacacgcgcctccccggacccccgcgcctacgtgcctgccaaggagctgctcaagcccgaggcggacccgaggccctgcgagcgtgcgccccgcggcccagccggtcctgcagcccaacaggccgccaagctcttcggcctggagcccgggcgccccccgcccaccggccctgagcataaatggaaacccttcgagctgggcaacttcgccgccacgcagatggccgtgctggccgcgcagcaccaccacagccgcgccgaagaggaggccgccgtggtcgctgcctcctcctccaagaaggcctacctggaccctggggctgtgctgccccgctcggcggccacctgcggccggccggtcgctgacatgcactctgcggcccacgggtctggagaggcctcggccatgcagagccttataaagtacagtggcagctttgcccgggacgccgtggccgtgcgccctggtggctgtggcaagaagagcccctttggaggtttgggcaccatgaaacccgagcctgcgcccacctctgcgggtgcctcccgagcccaggcccgtctcccacactccggaggccctgcagcgggcggcggccggcagctgaagcgggaccccgagaggcccgagagcgccaaagctttcgggcgcgagggctctggtgcccagggtgaggcagaagtgcgacacccgcctgtgggcattgcagtggctgtggcccggcagaaggacagtggcggcagtggccggctggggcctgggctggtagaccaggagcgctctctgtcgctgagtaacgtcaaagggcacggccgagcagatgaggactgtgtggacgaccgggccagacaccgggaggaacggctgctcggggcacggctggaccgggatcaggagaagctgctcagagagagtaaggagctggctgacctggcccgcctgcaccctaccagctgtgctcctaacggcctgaaccccaacctcatggtgacggggggcccggcgctggcgggctcaggtcgctggtctgccgaccccgcagcccatctggccacgcacccctggttgccccgctcgggcaacgcatccatgtggctcgctggacacccctacggcttgggtcccccatctctgcaccagggcatggcccctgcgttcccacctggcctggggggctccctcccgtcagcctaccagtttgtcagggacccccaatcgggccagctggtggtcattcccagtgatcaccttcctcactttgcggagctgatggagcgggccaccgtaccgcccctctggcccgccctgtacccgccgggccgcagccccctgcaccacgcccagcagctgcagctcttctcacagcagcacttcctgcggcagcaggagttcctgtacctgcagcagcaggcggcccaggccttggaactgcagaggagcgcccagctcgtgcaggagcggttgaaggcgcaggagcaccgggcggagatggaagagaaggggagcaagcggggcctggaggctgcgggcaaggctggcctggccaccgccggccccgggctgctgccgcggaagccccctggcctggccgccggccccgcgggcacctacggcaaggccgtgagcccgccaccatcaccccgcgcatcccctgtggctgccctgaaggccaaggtcatccagaagctggaggacgtgtccaagccacccgcctacgcctaccccgccacccccagctcccaccccaccagcccgccgcccgcctccccaccgcccaccccgggtatcacccgcaaggaggaggctcccgagaatgtggtcgagaagaaagacttggagttggagaaggaagcccccagccccttccaggccctgttctcagatatcccgcccaggtacccgttccaagccctgccaccgcactacgggaggccctaccctttcctgctgcagcccacggccgccgccgacgcggacggcttggcccctgatgtgccgctcccggctgatgggcccgagcgcctggcactctcacccgaagacaagcccatccgcttgtccccctccaagatcacagagccgctgcgggagggcccggaggaagaaccgctggctgagcgggaggtgaaggcagaggtggaggacatggacgagggccccacagagctgccgcctctggagtcgccgctgccactgcccgccgcggaagccatggctacccccagccctgcagggggttgtggaggtggcctgttggaggcccaggcgctgagtgccaccgggcagagctgcgcagagccctctgagtgtccagactttgtggaggggcctgaaccacgggtggattccccgggccggacagaaccctgcaccgccgccctggacctgggggtgcagctgacacccgagacactggtggaggccaaggaggagccggtggaggtgcctgtggcggtgcccgtggtggaggcagtgcccgaggaaggcctggcgcaggtggcaccgagcgagtcccagcccaccctagaaatgtcagactgtgacgtgcccgccggggagggacagtgcccgagcctggagccccaagaggccgtgcctgtactcggcagcacctgcttcctggaagaggcaagctctgaccagttcctgcccagtctggaggacccactggctggcatgaacgccctggcggcagctgcggagctgccccaggccaggcctctgccctccccgggtgctgctggagcccaggccttggagaagctggaagcagccgagagccttgtcttggagcagagcttcctgcatggcatcaccctgctaagtgagatcgcagagctggagctggagaggaggagccaagagatgggaggtgcggagcgggccctggtggcgcggccctccctggagagtctgctggcagctggcagccacatgctgagggaggtgctggatgggcccgtggtggacccactcaagaacctgcggctcccgcgggagctgaagcccaacaagaagtacagctggatgcgcaagaaggaggagcggatgtatgccatgaagtcctccctggaggacatggacgccctggagctggacttccggatgcggctggccgaggtgcagcgccagtacaaggagaagcagcgtgagctggtgaagctgcagcgccgccgggactccgaggacaggcgcgaggaaccccatagaagcttggcacgcagaggccctggcaggccgcggaaacggacccacgccccgagcgccctgtcgcccccccgcaagagagggaagagcggccacagtagcggaaagctgagcagcaagtctctgctgacatcagatgattatgagctgggagcagggataagaaagagacacaaggggtctgaggaggaacatgatgccctcatcggaatggggaaagccagggggaggaaccagacttgggatgaacatgaggcctcgtcggacttcatcagtcagctaaagattaagaagaagaagatggccagcgaccaggagcagttggcaagcaagctcgacaaggccctctccctcaccaagcaggacaagttgaagtcgcccttcaagttttcggacagtgctggggggaaatcgaaaactagcgggggctgcggcaggtacttgactccttacgacagcctgctggggaagaacaggaaggcgctggccaagggcctcggcctgtctctgaaatcctccagagaaggtaaacacaaaagggcagccaaaaccaggaagatggaggtggggttcaaggccagaggccagcccaagtcggcccattccccgtttgcctcggaagtgagcagctactcttacaatacggactcagaggaagacgaagaattcctgaaggacgagtggcccgcccaaggcccctccagctccaaactgacgccttccctcctgtgtagcatggtggcaaagaacagcaaggcagctggtggccccaagctgaccaagaggggcctggcggccccccggactctgaaacccaagccggccaccagcaggaagcagccgttttgtctgctgcttcgagaggccgaggcgcgttcctccttcagcgactcttcggaggaatcgtttgaccaagatgagagctcggaggaggaggacgaggaggaggagctcgaggaggaggacgaggccagcggtggtggctacaggctgggtgcccgggagcgggccctgtcaccgggcctggaggagagtgggctgggcctgctggcacgcttcgccgccagcgccctccccagccccacggtgggtccatccctgtctgtggtacagctggaggccaagcagaaggcccggaagaaagaggagcggcagagcctgctgggcacagagttcgagtacaccgactcagagagcgaggtcaaggtgcgcaagcggtcgcctgcggggctgctgcggcccaagaaggggctgggggagccgggaccctccctggccgcacccacgcctggcgcccgcggtcccgaccccagcagcccagacaaggccaagctggcggtggagaaggggcgcaaggcccggaagctgcggggccccaaggagcctggcttcgaggcggggcccgaggccagcgacgacgacctgtggacgcggcgccgcagcgagcgcatcttcctgcacgacgcctcggctgctgcacctgcgcccgtcagcaccgcgcccgccaccaagaccagccgctgcgccaagggcggccccctgagcccgcgcaaggacgccgggcgtgcaaaggacaggaaggaccccaggaagaagaagaaagggaaagaggctgggccaggagctgggctgccgccgccccgagctcctgccttgccctctgaggccagggctcctcctcctcctcctcctcctcctcctcctcatcctcctcttcctcctcctcctcttcctcctcctcctcttcctcttcgtcttcctcctcttcctcctcctcctcttcctcgtcctcatcctcctcctcctcctcctcttcctcctcttcttcctccaccacagacgaggactcttcctgcagctcggacgatgaggcagcccccgcccccacggctggcccttccgcgcaggcggcgctccccaccaaggccaccaagcaggccggcaaggcgcggccctcggcccactccccaggcaagaagacgcccgcgccccagccccaggcgcctcctccgcagcccacacagcctctgcagcccaaggctcaggccggggccaagagccgacccaagaagagagagggcgtccacctccccaccaccaaggagctggccaagcggcagcgcctgccgtccgtggagaaccggcccaagatcgccgccttcctgccagcccggcagctctggaagtggttcggcaagcccacccagcggcgtggcatgaagggcaaggcccgcaagctcttctacaaggccatcgtgcgcggcaaggagatgatccgtatcggggactgtgccgtgttcctctctgccggccgccccaacctgccctacatcggccgcatccagagcatgtgggagtcgtggggcaacaacatggtggtccgcgtcaagtggttctaccaccccgaggagaccagcccgggcaagcagttccaccagggccagcactgggaccagaagtccagccgcagcctcccggcggccctgcgggtctccagccagaggaaggacttcatggagcgcgcgctataccagtcctcgcatgtggacgaaaatgacgtgcagacggtgtcgcacaagtgcctggtggtgggcctggagcagtatgagcagatgctgaagaccaagaagtaccaggacagcgagggcctgtactacctcgcgggcacctacgagcccaccacgggcatgatcttctccacggacggcgtgcccgtgctctgctgagcccgccgggccctgcgggccacctgtgccccgagggcggccagggacccatctccatcactgccatggcgcggagaccacgtgcgttgtgtgcatgcgagcgctcctgcaggcgtgtgcatggggccaggtgtgcacgtggatgcccgggtgagtgtgtgtgcatgcacgtgtgtgcacgcatgtgcacatgcctccagccccaccttccaacccctcagtgcccccaggacaggggcccctcttagctatcagggtatggccggaccggcccttcctgcccagcacgttgcaagcacttggccaggccggccctccaggctgctgctgcgtgggggcccgggtgcccccaggtccatgcagactggggattcggtggggaggggcgcttctaaggaaccaaactgacgctcactctgggcttcccaagcacccttagcatggagcccaccccaaggcctcccaccgtgcatgggacagggcagcccgatgccagctggcctacctgactgtgccaggggccctgcccccaccctctcaggatggcctagacttggggaacagagccgggtggggttgcagcccggagtgtctgtcaaaggcaccaggtggagagggcccggcacaggcccaccctggtccaaaccctcacactacagaaaaccccaatggtgctgaaactgtcgcccggccacgcctggcccctccccacccaggagggaggtggcacttcttaacctgtacagttttattgtaccaagagactcgccccgcccctgtatcataagcctttaaatggagtcaactttttaattatatatataaagataaatatatataaatatatatataaactttttaaaactgtgaaaaatagctatgaaattataaaaaaaaacattctgacgtgcagaatattattttttatttcctgttagattatagtgtctagcaccggcttcaccggcctcccagtccccagcacaccccccgcccaccccaccaagtgtactgtactcaccccccaggatagagaagtgtttgttagggagagaagagggagaggcaggagccggcccaagcccagggtccctgcttgggccccagaaagcacttaaccaggccccaagccttcaagggaaaccaaggcctcaaccagacaatcttgagggaaggaaaagccagactttgggtttgttttttgggggaattattggtttttttttttatgtttcttttggaattttgtttgttggcaaattctgtgtgatcttttttcataaaaaaaaagaaaagatttaattgg

SEQ ID NO: 7801 - DNA, 1887 bp, Homo sapiens
ggcaaggcttcacggttttaaaccccggagcatttgacgcctaggaataaaataggaggtttgtatttacgccgtctgggcgcagccgaggagccctccccggtttcgggaggacccggcagccgccgaggcagagtccgggctggggcgcagcgcgccaccgccgccggtcacttttccgagccaggtcccgggagcctgaagccgccggcggaaggagtttggatttcatttttcagtggaaaggggctactcccgatttcatttctggccactcagtcggcaccccccgatcctgaagggcgaggcgactttctgaaacttgttactttatttttttttcccttttttctttccccctttctatttcttccgcggcctgtctcctccccgccaagacgccgtgtgcgccgcctcgcgcagctccgcctggccgcccggaggggccccaccgccggccgcctgtgcgccccgggccgcgggcccgccgccgagcgcaagccccgctggccgccgccatgcacgccgcggagcccccgccgcccgaggactctgggactacgccgaggccgaacttttaggtcccactgagctaggcctgcgggccgggtggggggctgatcgcggcactcccgcggaggatggatggccgagacttcgggccccagcggtccgtgcacggtcccccgccgccgctgctgtccggcctggccatggacagccaccgcgtgggcgcggccactgccggacgcttgcccgcctcgggcttgcccggcccgctgccgcccgggaagtacatggccggcctgaatctccatccgcacccgggtaagtgccccgcgccgtgcccgtcccctcctgtcttcccagggagatccactcggccgggtcctcctgtgcactcgcggccggggctcggcgactctccttcggtcggccacgggggtgcgggcagactcggctcccagggctgggaaactcctggtcccggagccaaggcggtggagagtgtcgcgcggctcggctaccttttccgtagcgtgcttggccctcgtgagccgaaagccggtgtggtagcccgagccaccggggcgattccaatccccggggccccggcggcacgagcctgggctggagttttcaaaatctgggcgagaaaagaacaaaccggccccgcaccccgcgagacaccgctccccgagctcgaatctttttcttggcaaacgctacttttggcgctcgtgggccctcctgggttctgttcccagctccaccactcgcgccgagccgggtccctggcagttaccgagcgccgggggatgcgggagtacgccgggggatgcgggagtacggtgaccccagccttgggaccctggcctcggggcgggcgggatgcccctttcttccccgggagaacggcggccctgggaacctgcaccccggtaggagggcggcgaccccggccctcggggaccccttgttttccagcgcgaaagagggtgcggaggtgcggcagggacaccgaaaccggaccatcgcggtcccgaacctagggggaaagaagagagcgggtcgggcagggcccaggcggcggaggggaaaaccctgggtctcacatcgagctgctggaggaggtggccgagaaggtcccgcggcctccaccatttcccgagacgggctgcccaggcgcggtggggacggtacccgggcgggcgctgcgccggggcgggagactctccctccagtcagtccgcggccgctgcagccagaggggtgggaaggagactcggggacctccagacctgcccggcggccgccccaggacacctggtccctccttcccgggctgtccctggcttttgtgcttggcgtcccaagtctcgactt

SEQ ID NO: 7802 - DNA, 10562 bp, Homo sapiens
ggccgcgggatggcgggcagcaggggcgcctagctgcgccgggagccggggccgccgccggagtcgttgtcgccggagcctggagccgtgaacccagccgcgccagacgccgtgtgcgccgcctcgcgcagctccgcctggccgcccggaggggccccaccgccggccgcctgtgcgccccgggccgcgggcccgccgccgagcgcaagccccgctggccgccgccatgcacgccgcggagcccccgccgcccgaggactctgggactacgccgaggccgaacttttaggtcccactgagctaggcctgcgggccgggtggggggctgatcgcggcactcccgcggaggatggatggccgagacttcgggccccagcggtccgtgcacggtcccccgccgccgctgctgtccggcctggccatggacagccaccgcgtgggcgcggccactgccggacgcttgcccgcctcgggcttgcccggcccgctgccgcccgggaagtacatggccggcctgaatctccatccgcacccgggcgaggccttcttgggcagctttgtggccagcgggatggggccctcggcctcgtcccatgggagcccagtgccactgccctctgacctgtctttccgctccccaacccctagcaacctgcccatggtgcagctgtgggccgcccacgcccatgaaggcttctcccacctgcccagtgggctgtacccatcctacctccacctgaaccacctggagccccccagcagtgggagccccctcctcagccagctgggtcagcccagcattttcgatacccagaaaggtcaggggccaggaggagacggtttctacctgcccaccgcgggggctccgggctccctgcactctcacgcgccctcggcccggacccctggcggcggccactcctcgggcgccccggccaaaggctcgtcgtcgcgggacggtccagccaaggagcgggcgggccgcggcggggagccgcctccgcttttcggcaagaaggacccgcgcgcccggggcgaggaggcctcggggccacggggcgtggtggacctgacccaggaggcgcgcgccgagggccgccaggaccgggggcccccgcgcctggctgagcgcctgtcgcccttcctggctgagtccaagaccaagaatgcggcgctgcagccgtcggtactgaccatgtgcaacggcggcgccggggacgtggggctgcccgcgctggtggccgaagcggggcgcgggggtgccaaggaggctgcccggcaggacgagggcgcgcggctgctgcggcgcacggagaccctgctccctgggccgcgcccctgcccctcaccgctgcccccgccgcccgcgccccccaaggggcctcctgcaccccccgcggccacccccgccggcgtctacaccgtcttccgcgagcagggccgtgagcaccgcgtggtggcgcccaccttcgtgccttccgtggaggccttcgacgagcgcccggggcccatccagatcgcatcccaggcgcgcgatgcccgggcccgcgagcgcgaggctggcaggccaggggtcctgcaggcgccccccggctccccgcggcctctggaccggcccgagggcctgcgcgagaagaactcggtcatccgctcgctcaagcggccgccccccgcggatgcccccacggtgcgggccacacgcgcctccccggacccccgcgcctacgtgcctgccaaggagctgctcaagcccgaggcggacccgaggccctgcgagcgtgcgccccgcggcccagccggtcctgcagcccaacaggccgccaagctcttcggcctggagcccgggcgccccccgcccaccggccctgagcataaatggaaacccttcgagctgggcaacttcgccgccacgcagatggccgtgctggccgcgcagcaccaccacagccgcgccgaagaggaggccgccgtggtcgctgcctcctcctccaagaaggcctacctggaccctggggctgtgctgccccgctcggcggccacctgcggccggccggtcgctgacatgcactctgcggcccacgggtctggagaggcctcggccatgcagagccttataaagtacagtggcagctttgcccgggacgccgtggccgtgcgccctggtggctgtggcaagaagagcccctttggaggtttgggcaccatgaaacccgagcctgcgcccacctctgcgggtgcctcccgagcccaggcccgtctcccacactccggaggccctgcagcgggcggcggccggcagctgaagcgggaccccgagaggcccgagagcgccaaagctttcgggcgcgagggctctggtgcccagggtgaggcagaagtgcgacacccgcctgtgggcattgcagtggctgtggcccggcagaaggacagtggcggcagtggccggctggggcctgggctggtagaccaggagcgctctctgtcgctgagtaacgtcaaagggcacggccgagcagatgaggactgtgtggacgaccgggccagacaccgggaggaacggctgctcggggcacggctggaccgggatcaggagaagctgctcagagagagtaaggagctggctgacctggcccgcctgcaccctaccagctgtgctcctaacggcctgaaccccaacctcatggtgacggggggcccggcgctggcgggctcaggtcgctggtctgccgaccccgcagcccatctggccacgcacccctggttgccccgctcgggcaacgcatccatgtggctcgctggacacccctacggcttgggtcccccatctctgcaccagggcatggcccctgcgttcccacctggcctggggggctccctcccgtcagcctaccagtttgtcagggacccccaatcgggccagctggtggtcattcccagtgatcaccttcctcactttgcggagctgatggagcgggccaccgtaccgcccctctggcccgccctgtacccgccgggccgcagccccctgcaccacgcccagcagctgcagctcttctcacagcagcacttcctgcggcagcaggagttcctgtacctgcagcagcaggcggcccaggccttggaactgcagaggagcgcccagctcgtgcaggagcggttgaaggcgcaggagcaccgggcggagatggaagagaaggggagcaagcggggcctggaggctgcgggcaaggctggcctggccaccgccggccccgggctgctgccgcggaagccccctggcctggccgccggccccgcgggcacctacggcaaggccgtgagcccgccaccatcaccccgcgcatcccctgtggctgccctgaaggccaaggtcatccagaagctggaggacgtgtccaagccacccgcctacgcctaccccgccacccccagctcccaccccaccagcccgccgcccgcctccccaccgcccaccccgggtatcacccgcaaggaggaggctcccgagaatgtggtcgagaagaaagacttggagttggagaaggaagcccccagccccttccaggccctgttctcagatatcccgcccaggtacccgttccaagccctgccaccgcactacgggaggccctaccctttcctgctgcagcccacggccgccgccgacgcggacggcttggcccctgatgtgccgctcccggctgatgggcccgagcgcctggcactctcacccgaagacaagcccatccgcttgtccccctccaagatcacagagccgctgcgggagggcccggaggaagaaccgctggctgagcgggaggtgaaggcagaggtggaggacatggacgagggccccacagagctgccgcctctggagtcgccgctgccactgcccgccgcggaagccatggctacccccagccctgcagggggttgtggaggtggcctgttggaggcccaggcgctgagtgccaccgggcagagctgcgcagagccctctgagtgtccagactttgtggaggggcctgaaccacgggtggattccccgggccggacagaaccctgcaccgccgccctggacctgggggtgcagctgacacccgagacactggtggaggccaaggaggagccggtggaggtgcctgtggcggtgcccgtggtggaggcagtgcccgaggaaggcctggcgcaggtggcaccgagcgagtcccagcccaccctagaaatgtcagactgtgacgtgcccgccggggagggacagtgcccgagcctggagccccaagaggccgtgcctgtactcggcagcacctgcttcctggaagaggcaagctctgaccagttcctgcccagtctggaggacccactggctggcatgaacgccctggcggcagctgcggagctgccccaggccaggcctctgccctccccgggtgctgctggagcccaggccttggagaagctggaagcagccgagagccttgtcttggagcagagcttcctgcatggcatcaccctgctaagtgagatcgcagagctggagctggagaggaggagccaagagatgggaggtgcggagcgggccctggtggcgcggccctccctggagagtctgctggcagctggcagccacatgctgagggaggtgctggatgggcccgtggtggacccactcaagaacctgcggctcccgcgggagctgaagcccaacaagaagtacagctggatgcgcaagaaggaggagcggatgtatgccatgaagtcctccctggaggacatggacgccctggagctggacttccggatgcggctggccgaggtgcagcgccagtacaaggagaagcagcgtgagctggtgaagctgcagcgccgccgggactccgaggacaggcgcgaggaaccccatagaagcttggcacgcagaggccctggcaggccgcggaaacggacccacgccccgagcgccctgtcgcccccccgcaagagagggaagagcggccacagtagcggaaagctgagcagcaagtctctgctgacatcagatgattatgagctgggagcagggataagaaagagacacaaggggtctgaggaggaacatgatgccctcatcggaatggggaaagccagggggaggaaccagacttgggatgaacatgaggcctcgtcggacttcatcagtcagctaaagattaagaagaagaagatggccagcgaccaggagcagttggcaagcaagctcgacaaggccctctccctcaccaagcaggacaagttgaagtcgcccttcaagttttcggacagtgctggggggaaatcgaaaactagcgggggctgcggcaggtacttgactccttacgacagcctgctggggaagaacaggaaggcgctggccaagggcctcggcctgtctctgaaatcctccagagaaggtaaacacaaaagggcagccaaaaccaggaagatggaggtggggttcaaggccagaggccagcccaagtcggcccattccccgtttgcctcggaagtgagcagctactcttacaatacggactcagaggaagacgaagaattcctgaaggacgagtggcccgcccaaggcccctccagctccaaactgacgccttccctcctgtgtagcatggtggcaaagaacagcaaggcagctggtggccccaagctgaccaagaggggcctggcggccccccggactctgaaacccaagccggccaccagcaggaagcagccgttttgtctgctgcttcgagaggccgaggcgcgttcctccttcagcgactcttcggaggaatcgtttgaccaagatgagagctcggaggaggaggacgaggaggaggagctcgaggaggaggacgaggccagcggtggtggctacaggctgggtgcccgggagcgggccctgtcaccgggcctggaggagagtgggctgggcctgctggcacgcttcgccgccagcgccctccccagccccacggtgggtccatccctgtctgtggtacagctggaggccaagcagaaggcccggaagaaagaggagcggcagagcctgctgggcacagagttcgagtacaccgactcagagagcgaggtcaaggtgcgcaagcggtcgcctgcggggctgctgcggcccaagaaggggctgggggagccgggaccctccctggccgcacccacgcctggcgcccgcggtcccgaccccagcagcccagacaaggccaagctggcggtggagaaggggcgcaaggcccggaagctgcggggccccaaggagcctggcttcgaggcggggcccgaggccagcgacgacgacctgtggacgcggcgccgcagcgagcgcatcttcctgcacgacgcctcggctgctgcacctgcgcccgtcagcaccgcgcccgccaccaagaccagccgctgcgccaagggcggccccctgagcccgcgcaaggacgccgggcgtgcaaaggacaggaaggaccccaggaagaagaagaaagggaaagaggctgggccaggagctgggctgccgccgccccgagctcctgccttgccctctgaggccagggctcctcacgccagctccctgaccgctgccaaaaggagcaaagccaaggccaaagggaaggaggtgaagaaggagaaccgcggcaaggggggtgccgtgagcaagctgatggagagcatggcagccgaggaggactttgaacccaaccaagactcgagcttctctgaggacgagcacctgccgcgtggcggggctgtggagcggccgctgaccccggcccctcgctcctgcatcatcgacaaggatgagctgaaggacggcctgcgtgtgctcatccccatggatgacaagctgctgtacgccgggcacgtgcagaccgtgcactcgccagacatataccgcgtggtggtggagggtgagcggggcaaccggccccacatctactgtctggagcagttgctgcaggaggcgatcatcgatgtgaggccagcctccactcgcttcttgccacaagggaccaggattgcagcctactggagccagcagtaccgctgtctctacccaggcactgtggtccgagggttactggacctggaggacgatggggacttgatcaccgtggagtttgacgacggagacacgggcaggatccccctctcacatatccgcctcctgccccctgactataagatacagtgtgctgagccgtccccggcccttctggtgccaagtgccaagcgccgcagccggaagaccagcaaagacactggggagggcaaagatggtggcacggctgggtcggaggagccaggagccaaggcccgtgggcgtgggcggaaacccagcgccaaggccaagggtgacagagccgctaccctggaggaggggaacccaacagacgaggtccccagtacccccttagccctggagccgagcagcaccccaggttccaagaagagccccccagagcctgtggacaagcgagccaaggcccccaaggcgcgcccggcaccgccgcagcccagtcccgcaccacccgccttcaccagctgcccagcacccgagccatttgcagagctgccagctcctgccacctccctggccccagcacccctcatcaccatgcctgccacacgccccaagcccaagaaggcgcgggcagccgaggagtcgggtgccaagggccctcggaggccgggggaggaggccgagctgcttgtcaaactggaccacgagggtgtcacgtcacccaaaagcaagaaggctaaagaggccctgctgctccgggaggatccgggggcggggggctggcaggagcccaagagcctcctgagcctgggcagctatccccccgcggccggcagcagcgagcccaaggcaccctggcccaaggccaccgacggggacctcgcccaggagcccgggccggggctcacgttcgaggactctgggaaccccaagagcccagacaaggcccaggctgagcaggacggggccgaagagtccgagagcagcagcagcagcagtagtggcagcagtagcagcagcagcagcagcagcagcagcggctcggagacagaaggggaggaggaaggcgacaagaacggggacgggggctgcggcaccgggggccgtaactgcagcgctgccagctccagggcggcctcaccggcctcctcctcctcctcctcatcctcctcctcctcctcctcctcctcctcatcctcctcttcctcctcctcctcttcctcctcctcctcttcctcttcgtcttcctcctcttcctcctcctcctcttcctcgtcctcatcctcctcctcctcctcctcttcctcctcttcttcctccaccacagacgaggactcttcctgcagctcggacgatgaggcagcccccgcccccacggctggcccttccgcgcaggcggcgctccccaccaaggccaccaagcaggccggcaaggcgcggccctcggcccactccccaggcaagaagacgcccgcgccccagccccaggcgcctcctccgcagcccacacagcctctgcagcccaaggctcaggccggggccaagagccgacccaagaagagagagggcgtccacctccccaccaccaaggagctggccaagcggcagcgcctgccgtccgtggagaaccggcccaagatcgccgccttcctgccagcccggcagctctggaagtggttcggcaagcccacccagcggcgtggcatgaagggcaaggcccgcaagctcttctacaaggccatcgtgcgcggcaaggagatgatccgtatcggggactgtgccgtgttcctctctgccggccgccccaacctgccctacatcggccgcatccagagcatgtgggagtcgtggggcaacaacatggtggtccgcgtcaagtggttctaccaccccgaggagaccagcccgggcaagcagttccaccagggccagcactgggaccagaagtccagccgcagcctcccggcggccctgcgggtctccagccagaggaaggacttcatggagcgcgcgctataccagtcctcgcatgtggacgaaaatgacgtgcagacggtgtcgcacaagtgcctggtggtgggcctggagcagtatgagcagatgctgaagaccaagaagtaccaggacagcgagggcctgtactacctcgcgggcacctacgagcccaccacgggcatgatcttctccacggacggcgtgcccgtgctctgctgagcccgccgggccctgcgggccacctgtgccccgagggcggccagggacccatctccatcactgccatggcgcggagaccacgtgcgttgtgtgcatgcgagcgctcctgcaggcgtgtgcatggggccaggtgtgcacgtggatgcccgggtgagtgtgtgtgcatgcacgtgtgtgcacgcatgtgcacatgcctccagccccaccttccaacccctcagtgcccccaggacaggggcccctcttagctatcagggtatggccggaccggcccttcctgcccagcacgttgcaagcacttggccaggccggccctccaggctgctgctgcgtgggggcccgggtgcccccaggtccatgcagactggggattcggtggggaggggcgcttctaaggaaccaaactgacgctcactctgggcttcccaagcacccttagcatggagcccaccccaaggcctcccaccgtgcatgggacagggcagcccgatgccagctggcctacctgactgtgccaggggccctgcccccaccctctcaggatggcctagacttggggaacagagccgggtggggttgcagcccggagtgtctgtcaaaggcaccaggtggagagggcccggcacaggcccaccctggtccaaaccctcacactacagaaaaccccaatggtgctgaaactgtcgcccggccacgcctggcccctccccacccaggagggaggtggcacttcttaacctgtacagttttattgtaccaagagactcgccccgcccctgtatcataagcctttaaatggagtcaactttttaattatatatataaagataaatatatataaatatatatataaactttttaaaactgtgaaaaatagctatgaaattataaaaaaaaacattctgacgtgcagaatattattttttatttcctgttagattatagtgtctagcaccggcttcaccggcctcccagtccccagcacaccccccgcccaccccaccaagtgtactgtactcaccccccaggatagagaagtgtttgttagggagagaagagggagaggcaggagccggcccaagcccagggtccctgcttgggccccagaaagcacttaaccaggccccaagccttcaagggaaaccaaggcctcaaccagacaatcttgagggaaggaaaagccagactttgggtttgttttttgggggaattattggtttttttttttatgtttcttttggaattttgtttgttggcaaattctgtgtgatcttttttcataaaaaaaaagaaaagatttaattgg

SEQ ID NO: 7803 - DNA, 1476 bp, Homo sapiens
ctcgccggcgtccgcgtccccgcgccgagctgctcgggctccctgagccccagatctgaccccttcccttcggcaacctgaacgactcccgccttccacggaagggaccgagcccgtgccaaacaggctgagcgatttgggagtgaggagccatcctaccgctttccccaacctggaaacagcaaagcgcaaggcctctgagtcagttaggtctctgccacccacgggcaaaggatgctctcctccatcctccttcctccctccaccgaaatcggagagccgcgggcctgatccaaagaggcatccccttctcgttcattccccagaggcctcaatacaaaccccaggagttggcccctctccttttgctacaaatccttgccttgcaaaggggagaggtggtttgtgctccccctactgcctatatcgacttcgcccggcagaagctagatcccaagattgctgtggctgcgcagaactgctacaaagtgactaatggggcttttactggggagatcagccctggcatgatcaaagactgcggagccacgtgggtggtcctggggcactcagagagaaggcatgtctttggggagtcagatgagctgattgggcagaaagtggcccatgctctggcagagggactcggagtaatcgcctgcattggggagaagctagatgaaagggaagctggcatcactgagaaggttgttttcgagcagacaaaggtcatcgcagataacgtgaaggactggagcaaggtcgtcctggcctatgagcctgtgtgggccattggtactggcaagactgcaacaccccaacaggcccaggaagtacacgagaagctccgaggatggctgaagtccaacgtctctgatgcggtggctcagagcacccgtatcatttatggaggctctgtgactggggcaacctgcaaggagctggccagccagcctgatgtggatggcttccttgtgggtggtgcttccctcaagcccgaattcgtggacatcatcaatgccaaacaatgagccccatccatcttccctacccttcctgccaagccagggactaagcagcccagaagcccagtaactgccctttccctgcatatgcttctgatggtgtcatctgctccttcctgtggcctcatccaaactgtatcttcctttactgtttatatcttcaccctgtaatggttgggaccaggccaatcccttctccacttactataatggttggaactaaacgtcaccaaggtggcttctccttggctgagagatggaaggcgtggtgggatttgctcctgggttccctaggccctagtgagggcagaagagaaaccatcctctcccttcttacaccgtgaggccaagatcccctcagaaggcaggagtgctgccctctcccatggtgcccgtgcctctgtgctgtgtatgtgaaccacccatgtgagggaataaacctggcactagg

SEQ ID NO: 7804 - DNA, 2214 bp, Homo sapiens
tgtgggcacgcctcagagccagaagtttatggctcccacctgctcaatctgacaggaagcttctgctccccagttctccccagccactgtggtctacagattccaggaaacccatccccctgtgacctcatggtgtgctctgttctccaccctagggaccagaaggagccaggagtaaagaactggcttacttggccgccactgggaaattctgggtaattcgagacgccctggaatttggacccactccgctgataggtggtggccagggttctagggaacacaagaggcggagccaggtggcttccctgtgctggcattcttgcctctctctctctttctctctctctgtctctcagccttgcagccgtttccctctgcgattcatgtaagtgtgactcgatttcagggaaagggaactcgcgtgggctgaggagaccggagtggacgggctggggaaggcaccgtgatgcccgcaaccccgtccctgaaggtggtccatgagctgcctgcctgtaccctctgtgcggggccgctggaggatgcggtgaccattccctgtggacacaccttctgccggctctgcctccccgcgctctcccagatgggggcccaatcctcgggcaagatcctgctctgcccgctctgccaagaggaggagcaggcagagactcccatggcccctgtgcccctgggcccgctgggagaaacttactgcgaggagcacggcgagaagatctacttcttctgcgagaacgatgccgagttcctctgtgtgttctgcagggagggtcccacgcaccaggcgcacaccgtggggttcctggacgaggccattcagccctaccgggatcgtctcaggagtcgactggaagctctgagcacggagagagatgagattgaggatgtaaagtgtcaagaagaccagaagcttcaagtgctgctgactcagatcgaaagcaagaagcatcaggtggaaacagcttttgagaggctgcagcaggagctggagcagcagcgatgtctcctgctggccaggctgagggagctggagcagcagatttggaaggagagggatgaatatatcacaaaggtctctgaggaagtcacccggcttggagcccaggtcaaggagctggaggagaagtgtcagcagccagcaagtgagcttctacaagatgtcagagtcaaccagagcaggtgtgagatgaagacttttgtgagtcctgaggccatttctcctgaccttgtcaagaagatccgtgatttccacaggaaaatactcaccctcccagagatgatgaggatgttctcagaaaacttggcgcatcatctggaaatagattcaggggtcatcactctggaccctcagaccgccagccggagcctggttctctcggaagacaggaagtcagtgaggtacacccggcagaagaagagcctgccagacagccccctgcgcttcgacggcctcccggcggttctgggcttcccgggcttctcctccgggcgccaccgctggcaggttgacctgcagctgggcgacggcggcggctgcacggtgggggtggccggggagggggtgaggaggaagggagagatgggactcagcgccgaggacggcgtctgggccgtgatcatctcgcaccagcagtgctgggccagcacctccccgggcaccgacctgccgctgagcgagatcccgcgcggcgtgagagtcgccctggactacgaggcggggcaggtgaccctccacaacgcccagacccaggagcccatcttcaccttcactgcctctttctccggcaaagtcttccctttctttgccgtctggaaaaaaggttcctgccttacgctgaaaggctgaagtggggcgcgcgaagggcggcgaagcggagacggcggctctccgggatccagctccgcccctggccagtgtgcggcccgggggctccctgtgcccgcgtgaggcgagagaacaggggacttgagtctcgaacagcggttgtttttactttatttatcttaggccctcagctccctgacgtcctgagcctccctgtgacgctctggccttctctgcacctcagagtgcagaaccacagacggcttcggctgtgcctagggcaacagccaacctaggagccagcgggctttcggggaaaaaaaagaaaaagacatctaaaataaaatgtttaaactgtttcaaaataa

SEQ ID NO: 7805 - DNA, 348 bp, Homo sapiens
atgcccgcaaccccgtccctgaaggtggtccatgagctgcctgcctgtaccctctgtgcggggccgctggaggatgcggtgaccattccctgtggacacaccttctgccggctctgcctccccgcgctctcccagatgggggcccaatcctcgggcaagatcctgctctgcccgctctgccaagaggaggagcaggcagagactcccatggcccctgtgcccctgggcccgctgggagaaacttactgcgaggagcacggcgagaagatctacttcttctgcgagaacgatgccgagttcctctgtgtaagtgaatgcagaaccacagacggcttcggctgtgcctag

SEQ ID NO: 7806 - DNA, 2214 bp, Homo sapiens
tgtgggcacgcctcagagccagaagtttatggctcccacctgctcaatctgacaggaagcttctgctccccagttctccccagccactgtggtctacagattccaggaaacccatccccctgtgacctcatggtgtgctctgttctccaccctagggaccagaaggagccaggagtaaagaactggcttacttggccgccactgggaaattctgggtaattcgagacgccctggaatttggacccactccgctgataggtggtggccagggttctagggaacacaagaggcggagccaggtggcttccctgtgctggcattcttgcctctctctctctttctctctctctgtctcttagccttgcagccgtttccctctgcgattcatgtaagtgtgactcgatttcagggaaagggaactcgcgtgggctgaggagaccggagtggacgggctggggaaggcaccgtgatgcccgcaaccccgtccctgaaggtggtccatgagctgcctgcctgtaccctctgtgcggggccgctggaggatgcggtgaccattccctgtggacacaccttctgccggctctgcctccccgcgctctcccagatgggggcccaatcctcgggcaagatcctgctctgcccgctctgccaagaggaggagcaggcagagactcccatggcccctgtgcccctgggcccgctgggagaaacttactgcgaggagcacggcgagaagatctacttcttctgcgagaacgatgccgagttcctctgtgtgttctgcagggagggtcccacgcaccaggcgcacaccgtggggttcctggacgaggccattcagccctaccgggatcgtctcaggagtcgactggaagctctgagcacggagagagatgagattgaggatgtaaagtgtcaagaagaccagaagcttcaagtgctgctgactcagatcgaaagcaagaagcatcaggtggaaacagcttttgagaggctgcagcaggagctggagcagcagcgatgtctcctgctggccaggctgagggagctggagcagcagatttggaaggagagggatgaatatatcacaaaggtctctgaggaagtcacccggcttggagcccaggtcaaggagctggaggagaagtgtcagcagccagcaagtgagcttctacaagatgtcagagtcaaccagagcaggtgtgagatgaagacttttgtgagtcctgaggccatttctcctgaccttgtcaagaagatccgtgatttccacaggaaaatactcaccctcccagagatgatgaggatgttctcagaaaacttggcgcatcatctggaaatagattcaggggtcatcactctggaccctcagaccgccagccggagcctggttctctcggaagacaggaagtcagtgaggtacacccggcagaagaagagcctgccagacagccccctgcgcttcgacggcctcccggcggttctgggcttcccgggcttctcctccgggcgccaccgctggcaggttgacctgcagctgggcgacggcggcggctgcacggtgggggtggccggggagggggtgaggaggaagggagagatgggactcagcgccgaggacggcgtctgggccgtgatcatctcgcaccagcagtgctgggccagcacctccccgggcaccgacctgccgctgagcgagatcccgcgcggcgtgagagtcgccctggactacgaggcggggcaggtgaccctccacaacgcccagacccaggagcccatcttcaccttcactgcctctttctccggcaaagtcttccctttctttgccgtctggaaaaaaggttcctgccttacgctgaaaggctgaagtggggcgcgcgaagggcggcgaagcggagacggcggctctccgggatccagctccgcccctggccagtgtgcggcccgggggctccctgtgcccgcgtgaggcgagagaacaggggacttgagtctcgaacagcggttgtttttactttatttatcttaggccctcagctccctgacgtcctgagcctccctgtgacgctctggccttctctgtacctcagagtgcagaaccacagacggcttcggctgtgcctagggcaacagccaacctaggagccagcgggctttcggggaaaaaaaagaaaaagacatctaaaataaaatgtttaaactgtttcaaaataa

SEQ ID NO: 7807 - DNA, 2217 bp, Homo sapiens
actttgatgctgtgggcacgcctcagagccagaagtttatggctcccacctgctcaatctgacaggaagcttctgctccccagttctccccagccactgtggtctacagattccaggaaacccatccccctgtgacctcatggtgtgctctgttctccaccctagggaccagaaggagccaggagtaaagaactggcttacttggccgccactgggaaattctgggtaattcgagacgccctggaatttggacccactccgctgataggtggtggccagggttctagggaacacaagaggcggagccaggtggcttccctgtgctggcattcttgcctctctctctctttctctctctctgtctcttagccttgcagccgtttccctctgcgattcatgtaagtgtgactcgatttcagggaaagggaactcgcgtgggctgaggagaccggagtggacgggctggggaaggcaccgtgatgcccgcaaccccgtccctgaaggtggtccatgagctgcctgcctgtaccctctgtgcggggccgctggaggatgcggtgaccattccctgtggacacaccttctgccggctctgcctccccgcgctctcccagatgggggcccaatcctcgggcaagatcctgctctgcccgctctgccaagaggaggagcaggcagagactcccatggcccctgtgcccctgggcccgctgggagaaacttactgcgaggagcacggcgagaagatctacttcttctgcgagaacgatgccgagttcctctgtgtgttctgcagggagggtcccacgcaccaggcgcacaccgtggggttcctggacgaggccattcagccctaccgggatcgtctcaggagtcgactggaagctctgagcacggagagagatgagattgaggatgtaaagtgtcaagaagaccagaagcttcaagtgctgctgactcagatcgaaagcaagaagcatcaggtggaaacagcttttgagaggctgcagcaggagctggagcagcagcgatgtctcctgctggccaggctgagggagctggagcagcagatttggaaggagagggatgaatatatcacaaaggtctctgaggaagtcacccggcttggagcccaggtcaaggagctggaggagaagtgtcagcagccagcaagtgagcttctacaagtgataagagagggactccacgggtgtgagatgaagacttttgtgagtcctgaggccatttctcctgaccttgtcaagaagatccgtgatttccacaggaaaatactcaccctcccagagatgatgaggatgttctcagaaaacttggcgcatcatctggaaatagattcaggggtcatcactctggaccctcagaccgccagccggagcctggttctctcggaagacaggaagtcagtgaggtacacccggcagaagaagagcctgccagacagccccctgcgcttcgacggcctcccggcggttctgggcttcccgggcttctcctccgggcgccaccgctggcaggttgacctgcagctgggcgacggcggcggctgcacggtgggggtggccggggagggggtgaggaggaagggagagatgggactcagcgccgaggacggcgtctgggccgtgatcatctcgcaccagcagtgctgggccagcacctccccgggcaccgacctgccgctgagcgagatcccgcgcggcgtgagagtcgccctggactacgaggcggggcaggtgaccctccacaacgcccagacccaggagcccatcttcaccttcactgcctctttctccggcaaagtcttccctttctttgccgtctggaaaaaaggttcctgccttacgctgaaaggctgaagtggggcgcgcgaagggcggcgaagcggagacggcggctctccgggatccagctccgcccctggccagtgtgcggcccgggggctccctgtgcccgcgtgaggcgagagaacaggggacttgagtctcgaacagcggttgtttttactttatttatcttaggccctcagctccctgacgtcctgagcctccctgtgacgctctggccttctctgtacctcagagtgcagaaccacagacggcttcggctgtgcctagggcaacagccaacctaggagccagcgggctttcggggaaaaaaaagaaaaagacatctaaaataaaatgtttaaactgtttc

SEQ ID NO: 7808 - DNA, 2214 bp, Homo sapiens
tgtgggcacgcctcagagccagaagtttatggctcccacctgctcaatctgacaggaagcttctgctccccagttctccccagccactgtggtctacagattccaggaaacccatccccctgtgacctcatggtgtgctctgttctccaccctagggaccagaaggagccaggagtaaagaactggcttacttggccgccactgggaaattctgggtaattcgagacgccctggaatttggacccactccgctgataggtggtggccagggttctagggaacacaagaggcggagccaggtggcttccctgtgctggcattcttgcctctctctctctttctctctctctgtctctcagccttgcagccgtttccctctgcgattcatgtaagtgtgactcgatttcagggaaagggaactcgcgtgggctgaggagaccggagtggacgggctggggaaggcaccgtgatgcccgcaaccccgtccctgaaggtggtccatgagctgcctgcctgtaccctatgtgcggggccgctggaggatgcggtgaccattccctgtggacacaccttctgccggctctgcctccccgcgctctcccagatgggggcccaatcctcgggcaagatcctgctctgcccgctctgccaagaggaggagcaggcagagactcccatggcccctgtgcccctgggcccgctgggagaaacttactgcgaggagcacggcgagaagatctacttcttctgcgagaacgatgccgagttcctctgtgtgttctgcagggagggtcccacgcaccaggcgcacaccgtggggttcctggacgaggccattcagccctaccgggatcgtctcaggagtcgactggaagctctgagcacggagagagatgagattgaggatgtaaagtgtcaagaagaccagaagcttcaagtgctgctgactcagatcgaaagcaagaagcatcaggtggaaacagcttttgagaggctgcagcaggagctggagcagcagcgatgtctcctgctggccaggctgagggagctggagcagcagatttggaaggagagggatgaatatatcacaaaggtctctgaggaagtcacccggcttggagcccaggtcaaggagctggaggagaagtgtcagcagccagcaagtgagcttctacaagatgtcagagtcaaccagagcaggtgtgagatgaagacttttgtgagtcctgaggccatttctcctgaccttgtcaagaagatccgtgatttccacaggaaaatactcaccctcccagagatgatgaggatgttctcagaaaacttggcgcatcatctggaaatagattcaggggtcatcactctggaccctcagaccgccagccggagcctggttctctcggaagacaggaagtcagtgaggtacacccggcagaagaagagcctgccagacagccccctgcgcttcgacggcctcccggcggttctgggcttcccgggcttctcctccgggcgccaccgctggcaggttgacctgcagctgggcgacggcggcggctgcacggtgggggtggccggggagggggtgaggaggaagggagagatgggactcagcgccgaggacggcgtctgggccgtgatcatctcgcaccagcagtgctgggccagcacctccccgggcaccgacctgccgctgagcgagatcccgcgcggcgtgagagtcgccctggactacgaggcggggcaggtgaccctccacaacgcccagacccaggagcccatcttcaccttcactgcctctttctccggcaaagtcttccctttctttgccgtctggaaaaaaggttcctgccttacgctgaaaggctgaagtggggcgcgcgaagggcggcgaagcggagacggcggctctccgggatccagctccgcccctggccagtgtgcggcccgggggctccctgtgcccgcgtgaggcgagagaacaggggacttgagtctcgaacagcggttgtttttactttatttatcttaggccctcagctccctgacgtcctgagcctccctgtgacgctctggccttctctgcacctcagagtgcagaaccacagacggcttcggctgtgcctagggcaacagccaacctaggagccagcgggctttcggggaaaaaaaagaaaaagacatctaaaataaaatgtttaaactgtttcaaaataa

SEQ ID NO: 7809 - DNA, 2214 bp, Homo sapiens; identical to SEQ ID NO: 7804

SEQ ID NO: 7810 - DNA, 491 bp, Homo sapiens
gcaagaagcatcaggtggaaacagcttttgagaggctgcagcaggagctggagcagcagcgatgtctcctgctggccaggctgagggagctggagcagcagatttggaaggagagggatgaatatatcacaaaggtctctgaggaagtcacccggcttggagcccaggtcaaggagctggaggagaagtgtcagcagccagcaagtgagcttctacaagatgtcagagtcaaccagagcaggtgtgagatgaagacttttgtgagtcctgaggccatttctcctgaccttgtcaagaagatccgtgatttccacaggaaaatactcaccctcccagagatgatgaggatgttctcagaaaacttggcgcatcatctggaaatagattcagaccgccagccggagcctggttctctcggaagacaggaagtcagtgaggtacacccggcagaagaagagcctgccagacagccccctgcgcttcgacggcct

SEQ ID NO: 7811 - DNA, 491 bp, Homo sapiens
gcaagaagcatcaggtggaaacagcttttgagaggctgcagcaggagctggagcagcagcgatgtctcctgctggccaggctgagggagctggagcagcagatttggaaggagagggatgaatatatcacaaaggtctctgaggaagtcacccggcttggagcccaggtcaaggagctggaggagaagtgtcagcagccagcaagtgagcttctacaagatgtcagagtcaaccagagcaggtgtgagatgaagacttttgtgagtcctgaggccatttctcctgaccttgtcaagaagatccgtgatttccacaggaaaatactcaccctcccagagatgatgaggatgttctcagaaaacttggcgcatcatctggaaatagattcagaccgccagccggagcctggttctctcggaagacaggaagtcagtgaggtacacccggcagaagaagaacctgccagacagccccctgcgcttcgacggcct

SEQ ID NO: 7812 - DNA, 491 bp, Homo sapiens; identical to SEQ ID NO: 7810

SEQ ID NO: 7813 - DNA, 491 bp, Homo sapiens; identical to SEQ ID NO: 7810

SEQ ID NO: 7814 - DNA, 2214 bp, Homo sapiens; identical to SEQ ID NO: 7808

SEQ ID NO: 7815 - DNA, 491 bp, Homo sapiens; identical to SEQ ID NO: 7810

SEQ ID NO: 7816 - DNA, 2214 bp, Homo sapiens
tgtgggcacgcctcagagccagaagtttatggctcccacctgctcaatctgacaggaagcttctgctccccagttctccccagccactgtggtctacagattccaggaaacccatccccctgtgacctcatggtgtgctctgttctccaccctagggaccagaaggagccaggagtaaagaactggcttacttggccgccactgggaaattctgggtaattcgagacgccctggaatttggacccactccgctgataggtggtggccagggttctagggaacacaagaggcggagccaggtggcttccctgtgctggcattcttgcctctctctctctttctctctctctgtctctcagccttgcagccgtttccctctgcgattcatgtaagtgtgactcgatttcagggaaagggaactcgcgtgggctgaggagaccggagtggacgggctggggaaggcaccgtgatgcccgcaaccccgtccctgaaggtggtccatgagctgcctgcctgtaccctctgtgcggggccgctggaggatgcggtgaccattccctgtggacacaccttctgccggctctgcctccccgcgctctcccagatgggggcccaatcctcgggcaagatcctgctctgcccgctctgccaagaggaggagcaggcagagactcccatggcccctgtgcccctgggcccgctgggagaaacttactgcgaggagcacggcgagaagatctacttcttctgcgagaacgatgccgagttcctctgtgtgttctgcagggagggtcccacgcaccaggcgcacaccgtggggttcctggacgaggccattcagccctaccgggatcgtctcaggagtcgactggaagctctgagcacggagagagatgagattgaggatgtaaagtgtcaagaagaccagaagcttcaagtgctgctgactcagatcgaaagcaagaagcatcaggtggaaacagcttttgagaggctgcagcaggagctggagcagcagcgatgtctcctgctggccaggctgagggagctggagcagcagatttggaaggagagggatgaatatatcacaaaggtctctgaggaagtcacccggcttggagcccaggtcaaggagctggaggagaagtgtcagcagccagcaagtgagcttctacaagatgtcagagtcaaccagagcaggtgtgagatgaagacttttgtgagtcctgaggccatttctcctgaccttgtcaagaagatccgtgatttccacaggaaaatactcaccctcccagagatgatgaggatgttctcagaaaacttggcgcatcatctggaaatagattcaggggtcatcactctggaccctcagaccgccagccggagcctggttctctcggaagacaggaagtcagtgaggtacacccggcagaagaagaacctgccagacagccccctgcgcttcgacggcctcccggcggttctgggcttcccgggcttctcctccgggcgccaccgctggcaggttgacctgcagctgggcgacggcggcggctgcacggtgggggtggccggggagggggtgaggaggaagggagagatgggactcagcgccgaggacggcgtctgggccgtgatcatctcgcaccagcagtgctgggccagcacctccccgggcaccgacctgccgctgagcgagatcccgcgcggcgtgagagtcgccctggactacgaggcggggcaggtgaccctccacaacgcccagacccaggagcccatcttcaccttcactgcctctttctccggcaaagtcttccctttctttgccgtctggaaaaaaggttcctgccttacgctgaaaggctgaagtggggcgcgcgaagggcggcgaagcggagacggcggctctccgggatccagctccgcccctggccagtgtgcggcccgggggctccctgtgcccgcgtgaggcgagagaacaggggacttgagtctcgaacagcggttgtttttactttatttatcttaggccctcagctccctgacgtcctgagcctccctgtgacgctctggccttctctgcacctcagagtgcagaaccacagacggcttcggctgtgcctagggcaacagccaacctaggagccagcgggctttcggggaaaaaaaagaaaaagacatctaaaataaaatgtttaaactgtttcaaaataa

SEQ ID NO: 7817 - DNA, 2214 bp, Homo sapiens; identical to SEQ ID NO: 7816

SEQ ID NO: 7818 - DNA, 2214 bp, Homo sapiens; identical to SEQ ID NO: 7808

SEQ ID NO: 7819 - DNA, 491 bp, Homo sapiens; identical to SEQ ID NO: 7810

SEQ ID NO: 7820 - DNA, 491 bp, Homo sapiens; identical to SEQ ID NO: 7811

SEQ ID NO: 7821 - DNA, 491 bp, Homo sapiens; identical to SEQ ID NO: 7810

SEQ ID NO: 7822 - DNA, 2217 bp, Homo sapiens
actttgatgctgtgggcacgcctcagagccagaagtttatggctcccacctgctcaatctgacaggaagcttctgctccccagttctccccagccactgtggtctacagattccaggaaacccatccccctgtgacctcatggtgtgctctgttctccaccctagggaccagaaggagccaggagtaaagaactggcttacttggccgccactgggaaattctgggtaattcgagacgccctggaatttggacccactccgctgataggtggtggccagggttctagggaacacaagaggcggagccaggtggcttccctgtgctggcattcttgcctctctctctctttctctctctctgtctctcagccttgcagccgtttccctctgcgattcatgtaagtgtgactcgatttcagggaaagggaactcgcgtgggctgaggagaccggagtggacgggctggggaaggcaccgtgatgcccgcaaccccgtccctgaaggtggtccatgagctgcctgcctgtaccctctgtgcggggccgctggaggatgcggtgaccattccctgtggacacaccttctgccggctctgcctccccgcgctctcccagatgggggcccaatcctcgggcaagatcctgctctgcccgctctgccaagaggaggagcaggcagagactcccatggcccctgtgcccctgggcccgctgggagaaacttactgcgaggagcacggcgagaagatctacttcttctgcgagaacgatgccgagttcctctgtgtgttctgcagggagggtcccacgcaccaggcgcacaccgtggggttcctggacgaggccattcagccctaccgggatcgtctcaggagtcgactggaagctctgagcacggagagagatgagattgaggatgtaaagtgtcaagaagaccagaagcttcaagtgctgctgactcagatcgaaagcaagaagcatcaggtggaaacagcttttgagaggctgcagcaggagctggagcagcagcgatgtctcctgctggccaggctgagggagctggagcagcagatttggaaggagagggatgaatatatcacaaaggtctctgaggaagtcacccggcttggagcccaggtcaaggagctggaggagaagtgtcagcagccagcaagtgagcttctacaagtgataagagagggactccacgggtgtgagatgaagacttttgtgagtcctgaggccatttctcctgaccttgtcaagaagatccgtgatttccacaggaaaatactcaccctcccagagatgatgaggatgttctcagaaaacttggcgcatcatctggaaatagattcaggggtcatcactctggaccctcagaccgccagccggagcctggttctctcggaagacaggaagtcagtgaggtacacccggcagaagaagaacctgccagacagccccctgcgcttcgacggcctcccggcggttctgggcttcccgggcttctcctccgggcgccaccgctggcaggttgacctgcagctgggcgacggcggcggctgcacggtgggggtggccggggagggggtgaggaggaagggagagatgggactcagcgccgaggacggcgtctgggccgtgatcatctcgcaccagcagtgctgggccagcacctccccgggcaccgacctgccgctgagcgagatcccgcgcggcgtgagagtcgccctggactacgaggcggggcaggtgaccctccacaacgcccagacccaggagcccatcttcaccttcactgcctctttctccggcaaagtcttccctttctttgccgtctggaaaaaaggttcctgccttacgctgaaaggctgaagtggggcgcgcgaagggcggcgaagcggagacggcggctctccgggatccagctccgcccctggccagtgtgcggcccgggggctccctgtgcccgcgtgaggcgagagaacaggggacttgagtctcgaacagcggttgtttttactttatttatcttaggccctcagctccctgacgtcctgagcctccctgtgacgctctggccttctctgcacctcagagtgcagaaccacagacggcttcggctgtgcctagggcaacagccaacctaggagccagcgggctttcggggaaaaaaaagaaaaagacatctaaaataaaatgtttaaactgtttc

SEQ ID NO: 7823 - DNA, 348 bp, Homo sapiens
atgcccgcaaccccgtccctgaaggtggtccatgagctgcctgcctgtaccctatgtgcggggccgctggaggatgcggtgaccattccctgtggacacaccttctgccggctctgcctccccgcgctctcccagatgggggcccaatcctcgggcaagatcctgctctgcccgctctgccaagaggaggagcaggcagagactcccatggcccctgtgcccctgggcccgctgggagaaacttactgcgaggagcacggcgagaagatctacttcttctgcgagaacgatgccgagttcctctgtgtaagtgaatgcagaaccacagacggcttcggctgtgcctag

SEQ ID NO: 7824 - DNA, 348 bp, Homo sapiens
atgcccgcaaccccgtccctgaaggtggtccatgagctgcctgcctgtaccctctgtgcggggccgctggaggatgcggtgaccattccctgtggacacaccttctgccggctctgcctccccgcgctctcccagatgggggcccaatcctcgggcaagatcctgctctgcccgctctgccaagaggaggagcaggcagagactcccatggcccctgtgcccctgggcccgctgggagaaacttactgcgaggagcacggcgagaagatctacttcttctgcgagaacgatgccgagttcctctgtgtctcagagtgcagaaccacagacggcttcggctgtgcctag

SEQ ID NO: 7825 - DNA, 2217 bp, Homo sapiens
actttgatgctgtgggcacgcctcagagccagaagtttatggctcccacctgctcaatctgacaggaagcttctgctccccagttctccccagccactgtggtctacagattccaggaaacccatccccctgtgacctcatggtgtgctctgttctccaccctagggaccagaaggagccaggagtaaagaactggcttacttggccgccactgggaaattctgggtaattcgagacgccctggaatttggacccactccgctgataggtggtggccagggttctagggaacacaagaggcggagccaggtggcttccctgtgctggcattcttgcctctctctctctttctctctctctgtctctcagccttgcagccgtttccctctgcgattcatgtaagtgtgactcgatttcagggaaagggaactcgcgtgggctgaggagaccggagtggacgggctggggaaggcaccgtgatgcccgcaaccccgtccctgaaggtggtccatgagctgcctgcctgtaccctatgtgcggggccgctggaggatgcggtgaccattccctgtggacacaccttctgccggctctgcctccccgcgctctcccagatgggggcccaatcctcgggcaagatcctgctctgcccgctctgccaagaggaggagcaggcagagactcccatggcccctgtgcccctgggcccgctgggagaaacttactgcgaggagcacggcgagaagatctacttcttctgcgagaacgatgccgagttcctctgtgtgttctgcagggagggtcccacgcaccaggcgcacaccgtggggttcctggacgaggccattcagccctaccgggatcgtctcaggagtcgactggaagctctgagcacggagagagatgagattgaggatgtaaagtgtcaagaagaccagaagcttcaagtgctgctgactcagatcgaaagcaagaagcatcaggtggaaacagcttttgagaggctgcagcaggagctggagcagcagcgatgtctcctgctggccaggctgagggagctggagcagcagatttggaaggagagggatgaatatatcacaaaggtctctgaggaagtcacccggcttggagcccaggtcaaggagctggaggagaagtgtcagcagccagcaagtgagcttctacaagtgataagagagggactccacgggtgtgagatgaagacttttgtgagtcctgaggccatttctcctgaccttgtcaagaagatccgtgatttccacaggaaaatactcaccctcccagagatgatgaggatgttctcagaaaacttggcgcatcatctggaaatagattcaggggtcatcactctggaccctcagaccgccagccggagcctggttctctcggaagacaggaagtcagtgaggtacacccggcagaagaagagcctgccagacagccccctgcgcttcgacggcctcccggcggttctgggcttcccgggcttctcctccgggcgccaccgctggcaggttgacctgcagctgggcgacggcggcggctgcacggtgggggtggccggggagggggtgaggaggaagggagagatgggactcagcgccgaggacggcgtctgggccgtgatcatctcgcaccagcagtgctgggccagcacctccccgggcaccgacctgccgctgagcgagatcccgcgcggcgtgagagtcgccctggactacgaggcggggcaggtgaccctccacaacgcccagacccaggagcccatcttcaccttcactgcctctttctccggcaaagtcttccctttctttgccgtctggaaaaaaggttcctgccttacgctgaaaggctgaagtggggcgcgcgaagggcggcgaagcggagacggcggctctccgggatccagctccgcccctggccagtgtgcggcccgggggctccctgtgcccgcgtgaggcgagagaacaggggacttgagtctcgaacagcggttgtttttactttatttatcttaggccctcagctccctgacgtcctgagcctccctgtgacgctctggccttctctgcacctcagagtgcagaaccacagacggcttcggctgtgcctagggcaacagccaacctaggagccagcgggctttcggggaaaaaaaagaaaaagacatctaaaataaaatgtttaaactgtttc

SEQ ID NO: 7826 - DNA, 2217 bp, Homo sapiens
actttgatgctgtgggcacgcctcagagccagaagtttatggctcccacctgctcaatctgacaggaagcttctgctccccagttctccccagccactgtggtctacagattccaggaaacccatccccctgtgacctcatggtgtgctctgttctccaccctagggaccagaaggagccaggagtaaagaactggcttacttggccgccactgggaaattctgggtaattcgagacgccctggaatttggacccactccgctgataggtggtggccagggttctagggaacacaagaggcggagccaggtggcttccctgtgctggcattcttgcctctctctctctttctctctctctgtctctcagccttgcagccgtttccctctgcgattcatgtaagtgtgactcgatttcagggaaagggaactcgcgtgggctgaggagaccggagtggacgggctggggaaggcaccgtgatgcccgcaaccccgtccctgaaggtggtccatgagctgcctgcctgtaccctctgtgcggggccgctggaggatgcggtgaccattccctgtggacacaccttctgccggctctgcctccccgcgctctcccagatgggggcccaatcctcgggcaagatcctgctctgcccgctctgccaagaggaggagcaggcagagactcccatggcccctgtgcccctgggcccgctgggagaaacttactgcgaggagcacggcgagaagatctacttcttctgcgagaacgatgccgagttcctctgtgtgttctgcagggagggtcccacgcaccaggcgcacaccgtggggttcctggacgaggccattcagccctaccgggatcgtctcaggagtcgactggaagctctgagcacggagagagatgagattgaggatgtaaagtgtcaagaagaccagaagcttcaagtgctgctgactcagatcgaaagcaagaagcatcaggtggaaacagcttttgagaggctgcagcaggagctggagcagcagcgatgtctcctgctggccaggctgagggagctggagcagcagatttggaaggagagggatgaatatatcacaaaggtctctgaggaagtcacccggcttggagcccaggtcaaggagctggaggagaagtgtcagcagccagcaagtgagcttctacaagtgataagagagggactccacgggtgtgagatgaagacttttgtgagtcctgaggccatttctcctgaccttgtcaagaagatccgtgatttccacaggaaaatactcaccctcccagagatgatgaggatgttctcagaaaacttggcgcatcatctggaaatagattcaggggtcatcactctggaccctcagaccgccagccggagcctggttctctcggaagacaggaagtcagtgaggtacacccggcagaagaagagcctgccagacagccccctgcgcttcgacggcctcccggcggttctgggcttcccgggcttctcctccgggcgccaccgctggcaggttgacctgcagctgggcgacggcggcggctgcacggtgggggtggccggggagggggtgaggaggaagggagagatgggactcagcgccgaggacggcgtctgggccgtgatcatctcgcaccagcagtgctgggccagcacctccccgggcaccgacctgccgctgagcgagatcccgcgcggcgtgagagtcgccctggactacgaggcggggcaggtgaccctccacaacgcccagacccaggagcccatcttcaccttcactgcctctttctccggcaaagtcttccctttctttgccgtctggaaaaaaggttcctgccttacgctgaaaggctgaagtggggcgcgcgaagggcggcgaagcggagacggcggctctccgggatccagctccgcccctggccagtgtgcggcccgggggctccctgtgcccgcgtgaggcgagagaacaggggacttgagtctcgaacagcggttgtttttactttatttatcttaggccctcagctccctgacgtcctgagcctccctgtgacgctctggccttctctgcacctcagagtgcagaaccacagacggcttcggctgtgcctagggcaacagccaacctaggagccagcgggctttcggggaaaaaaaagaaaaagacatctaaaataaaatgtttaaactgtttc

SEQ ID NO: 7827 - DNA, 348 bp, Homo sapiens; identical to SEQ ID NO: 7805

SEQ ID NO: 7828 - DNA, 348 bp, Homo sapiens; identical to SEQ ID NO: 7823

SEQ ID NO: 7829 - DNA, 2217 bp, Homo sapiens; identical to SEQ ID NO: 7825

SEQ ID NO: 7830 - DNA, 2217 bp, Homo sapiens; identical to SEQ ID NO: 7822

SEQ ID NO: 7831 - DNA, 2217 bp, Homo sapiens; identical to SEQ ID NO: 7826

SEQ ID NO: 7832 - DNA, 348 bp, Homo sapiens; identical to SEQ ID NO: 7823

SEQ ID NO: 7833 - DNA, 2217 bp, Homo sapiens; identical to SEQ ID NO: 7825

SEQ ID NO: 7834 - DNA, 348 bp, Homo sapiens; identical to SEQ ID NO: 7805

SEQ ID NO: 7835 - DNA, 348 bp, Homo sapiens; identical to SEQ ID NO: 7805

SEQ ID NO: 7836 - DNA, 1730 bp, Homo sapiens
ccccaggtccccacgccccgggccgggccgcagcctcctgggcttcgtgggggcagacccagcctttcccggcagcgagcgctcggccaggtgcactaggcgctgtgcgggccccccttccccgcggagccatggaggctgtggaactcgccagaaaactgcaggaggaagctacgtgctccatctgtctggattacttcacagaccctgtgatgaccacctgtggccacaacttctgccgagcctgcatccagctgagctgggaaaaggcgaggggcaagaaggggaggcggaagcggaagggctccttcccctgccccgagtgcagagagatgtccccgcagaggaacctgctgcccaaccggctgctgaccaaggtggccgagatggcgcagcagcatcctggtctgcagaagcaagacctgtgccaggagcaccacgagcccctcaagcttttctgccagaaggaccagagccccatctgtgtggtgtgcagggagtcccgggagcaccggctgcacagggtgctgcccgccgaggaggcagtgcaggggtacaagttgaagctggaggaggacatggagtaccttcgggagcagatcaccaggacagggaatctgcaggccagggaggagcagagcttagccgagtggcagggcaaggtgaaggagcggagagaacgcattgtgctggagtttgagaagatgaacctctacctggtggaagaagagcagaggctcctccaggctctggagacggaagaagaggagactgccagcaggctccgggagagcgtggcctgcctggaccggcagggtcactctctggagctgctgctgctgcagctggaggagcggagcacacaggggcccctccagatgctgcaggacatgaaggaacccctgagcaggaagaacaacgtgagtgtgcagtgcccagaggttgcccccccaaccagacccaggactgtgtgcagagttcccggacagattgaagtgctaagaggctttctagaggatgtggtgcctgatgccacctccgcgtacccctacctcctcctgtatgagagccgccagaggcgctacctcggctcttcgccggagggcagtgggttctgcagcaaggaccgatttgtggcttacccctgtgctgtgggccagacggccttctcctctgggaggcactactgggaggtgggcatgaacatcaccggggacgcgttgtgggccctgggtgtgtgcagggacaacgtgagccggaaagacagggtccccaagtgccccgaaaacggcttctgggtggtgcagctgtccaaggggaccaagtacttatccaccttctctgccctaaccccggtcatgctgatggagcctcccagccacatgggcatcttcctggacttcgaagccggggaagtgtccttctacagtgtaagcgatgggtcccacctgcacacctactcccaggccaccttcccaggccccctgcagcctttcttctgcctgggggctccgaagtctggtcagatggtcatctccacagtgaccatgtgggtgaaaggatagacacagaccgggggactcgggcactgctcctggctctgcagaaggtgtgggccttctgcttactgcaggccacctgccagggttctctggcatcacgctggcagccattagacacacaggggggtttctcaaattctaaatataattgtgattagaactgtcaaa

SEQ ID NO: 7837 - DNA, 808 bp, Homo sapiens
ctgggcttcgtgggggcagacccagcctttcccggcagcgagcgctcggccaggtgcactaggcgctgtgcgggccccccttccccgcggtgagtagcccccaccccgccgcctaggctaccctcctgtggcgcctgggccacgacctaagcctaacccggtcctcctcgccctccaacgcccggccttcccgcctccgccggccgccgcgtccctggaggggctagcgcgcttcaacaagagtccctcaagcgggaacctgcctcgtgtctcccaggagccatggaggctgtggaactcgccagaaaactgcaggaggaagctacgtgctccatctgtctggattacttcacagaccctgtgatgaccacctgtggccacaacttctgccgagcctgcatccagctgagctgggaaaaggcgaggggcaagaaggggaggcggaagcggaagggctccttcccctgccccgagtgcagagagatgtccccgcagaggaacctgctgcccaaccggctgctgaccaaggtggccgagatggcgcagcagcatcctggtctgcagaagcaagacctgtgccaggagcaccacgagcccctcaagcttttctgccagaaggaccagagccccatctgtgtggtgtgcagggagtcccgggagcaccggctgcacagggtgctgcccgccgaggaggcagtgcaggggtacaagttgaagctggaggaggacatggagtaccttcgggagcagatcaccaggacagggaatctgcaggccagggaggagcagagcttagccgagtggcagg

SEQ ID NO: 7838 - DNA, 2652 bp, Homo sapiens
agatctccactgcgtggggtcgcgagtgttgagattgcagggggcatctatgtgcatgcttgtgtgcctgtgcgtgtgtgcgcgcgtgtacctgtgtgtacatgcatgtatgtttaccgatatgtgcatctgtgcctgtgtgtgctgtgtttgtggatcagtgtttctgtgcgtacatgtttgtatttgtgtggtgtgtatgcgtgggtatgcgtgtgtgcacatgcacgtttgtatacatacatgggtatgtgtatgggtgttcgtctgtgcgtacatgcacacgcgtgttttttctgaaccccacctcactaccgaatggaagagagcttttttcctctgatagcccatcccttcttcctttggtgtacggggttttgttaaagaaaaaattctgacatttgaaaggctctttagtcaggctacttgcaatgggagagttgcgccagcaaagacagctggggatgtatgggggagttggagtggggatctgggtggggtcagtggatggaaagtgattaagggaaggctccaagggtaggggcttctccctaagctgacctagcaggcttctccagaaaggcaggttgaaggcctagccggcaacggtctgtcggggaggaggagctgatgagatgtggagctgggggtagccagcagcaggcggaagtggacgggtagggtccaggcccagtggagaggagaggcggaggggcctgcagagcattggtcagggagggtctgtgtagtttctggggaggcatctgtgtctgttgttgacaaggctaaaaatgatgactctggactctctaactggactgcagtcctagccctcctctgtaaagggaggctgtacaggacggttgcacactgccggcgcccagatcatcgggctgctccctccaactctctccagagtccctcaagcgggaacctgcctcgtgtctcccaggagccatggaggctgtggaactcgccagaaaactgcaggaggaagctacgtgctccatctgtctggattacttcacagaccctgtgatgaccacctgtggccacaacttctgccgagcctgcatccagctgagctgggaaaaggcgaggggcaagaaggggaggcggaagcggaagggctccttcccctgccccgagtgcagagagatgtccccgcagaggaacctgctgcccaaccggctgctgaccaaggtggccgagatggcgcagcagcatcctggtctgcagaagcaagacctgtgccaggagcaccacgagcccctcaagcttttctgccagaaggaccagagccccatctgtgtggtgtgcagggagtcccgggagcaccggctgcacagggtgctgcccgccgaggaggcagtgcaggggtacaagttgaagctggaggaggacatggagtaccttcgggagcagatcaccaggacagggaatctgcaggccagggaggagcagagcttagccgagtggcagggcaaggtgaaggagcggagagaacgcattgtgctggagtttgagaagatgaacctctacctggtggaagaagagcagaggctcctccaggctctggagacggaagaagaggagactgccagcaggctccgggagagcgtggcctgcctggaccggcagggtcactctctggagctgctgctgctgcagctggaggagcggagcacacaggggcccctccagatgctgcaggacatgaaggaacccctgagcaggaagaacaacgtgagtgtgcagtgcccagaggttgcccccccaaccagacccaggactgtgtgcagagttcccggacagattgaagtgctaagaggctttctagaggatgtggtgcctgatgccacctccgcgtacccctacctcctcctgtatgagagccgccagaggcgctacctcggctcttcgccggagggcagtgggttctgcagcaaggaccgatttgtggcttacccctgtgctgtgggccagacggccttctcctctgggaggcactactgggaggtgggcatgaacatcaccggggacgcgttgtgggccctgggtgtgtgcagggacaacgtgagccggaaagacagggtccccaagtgccccgaaaacggcttctgggtggtgcagctgtccaaggggaccaagtacttatccaccttctctgccctaaccccggtcatgctgatggagcctcccagccacatgggcatcttcctggacttcgaagccggggaagtgtccttctacagtgtaagcgatgggtcccacctgcacacctactcccaggccaccttcccaggccccctgcagcctttcttctgcctgggggctccgaagtctggtcagatggtcatctccacagtgaccatgtgggtgaaaggatagacacagaccgggggactcgggcactgctcctggctctgcagaaggtgtgggccttctgcttactgcaggccacctgccagggttctctggcatcacgctggcagccattagacacacaggggggtttctcaaattctaaatataattgtgattagaactgtcaaacattaagagggtatactgacagatgcttcctagaggaaacttttgaaagcccctgcgttctgagtggaccgatttctaaatccatacctacacacc

SEQ ID NO: 7839 - DNA, 1748 bp, Homo sapiens
cgggccgggccgcagcctcctgggcttcgtgggggcagacccagcctttcccggcagcgagcgctcggccaggtgcactaggcgctgtgcgggccccccttccccgcgagtccctcaagcgggaacctgcctcgtgtctcccaggagccatggaggctgtggaactcgccagaaaactgcaggaggaagctacgtgctccatctgtctggattacttcacagaccctgtgatgaccacctgtggccacaacttctgccgagcctgcatccagctgagctgggaaaaggcgaggggcaagaaggggaggcggaagcggaagggctccttcccctgccccgagtgcagagagatgtccccgcagaggaacctgctgcccaaccggctgctgaccaaggtggccgagatggcgcagcagcatcctggtctgcagaagcaagacctgtgccaggagcaccacgagcccctcaagcttttctgccagaaggaccagagccccatctgtgtggtgtgcagggagtcccgggagcaccggctgcacagggtgctgcccgccgaggaggcagtgcaggggtacaagttgaagctggaggaggacatggagtaccttcgggagcagatcaccaggacagggaatctgcaggccagggaggagcagagcttagccgagtggcagggcaaggtgaaggagcggagagaacgcattgtgctggagtttgagaagatgaacctctacctggtggaagaagagcagaggctcctccaggctctggagacggaagaagaggagactgccagcaggctccgggagagcgtggcctgcctggaccggcagggtcactctctggagctgctgctgctgcagctggaggagcggagcacacaggggcccctccagatgctgcaggacatgaaggaacccctgagcaggaagaacaacgtgagtgtgcagtgcccagaggttgcccccccaaccagacccaggactgtgtgcagagttcccggacagattgaagtgctaagaggctttctagaggatgtggtgcctgatgccacctccgcgtacccctacctcctcctgtatgagagccgccagaggcgctacctcggctcttcgccggagggcagtgggttctgcagcaaggaccgatttgtggcttacccctgtgctgtgggccagacggccttctcctctgggaggcactactgggaggtgggcatgaacatcaccggggacgcgttgtgggccctgggtgtgtgcagggacaacgtgagccggaaagacagggtccccaagtgccccgaaaacggcttctgggtggtgcagctgtccaaggggaccaagtacttatccaccttctctgccctaaccccggtcatgctgatggagcctcccagccacatgggcatcttcctggacttcgaagccggggaagtgtccttctacagtgtaagcgatgggtcccacctgcacacctactcccaggccaccttcccaggccccctgcagcctttcttctgcctgggggctccgaagtctggtcagatggtcatctccacagtgaccatgtgggtgaaaggatagacacagaccgggggactcgggcactgctcctggctctgcagaaggtgtgggccttctgcttactgcaggccacctgccagggttctctggcatcacgctggcagccattagacacacaggggggtttctcaaattctaaatataattgtgattagaactgtcaaa

SEQ ID NO: 7840 - DNA, 1731 bp, Homo sapiens
agtcccggccgccgaacactccctcgcccagcattcccctcccccgccgccccccagcccccgctgacgccacaaagtccctaggcctcccgaccccaggtccccacgccccgggccgggccgcagcctcctgggcttcgtgggggcagacccagcctttcccggcagcgagcgctcggccaggtgcactaggcgctgtgcgggccccccttccccgcggtgagtagcccccaccccgccgcctaggctaccctcctgtggcgcctgggccacgacctaagcctaacccggtcctcctcgccctccaacgcccggccttcccgcctccgccggccgccgcgtccctggaggggctagcgcgcttcaacaaggagccatggaggctgtggaactcgccagaaaactgcaggaggaagctacgtgctccatctgtctggattacttcacagaccctgtgatgaccacctgtggccacaacttctgccgagcctgcatccagctgagctgggaaaaggcgaggggcaagaaggggaggcggaagcggaagggctccttcccctgccccgagtgcagagagatgtccccgcagaggaacctgctgcccaaccggctgctgaccaaggtggccgagatggcgcagcagcatcctggtctgcagaagcaagacctgtgccaggagcaccacgagcccctcaagcttttctgccagaaggaccagagccccatctgtgtggtgtgcagggagtcccgggagcaccggctgcacagggtgctgcccgccgaggaggcagtgcaggggtacaagttgaagctggaggaggacatggagtaccttcgggagcagatcaccaggacagggaatctgcaggccagggaggagcagagcttagccgagtggcagggcaaggtgaaggagcggagagaacgcattgtgctggagtttgagaagatgaacctctacctggtggaagaagagcagaggctcctccaggctctggagacggaagaagaggagactgccagcaggctccgggagagcgtggcctgcctggaccggcagggtcactctctggagctgctgctgctgcagctggaggagcggagcacacaggggcccctccagatgctgcaggacatgaaggaacccctgagcaggaagaacaacgtgagtgtgcagtgcccagaggttgcccccccaaccagacccaggactgtgtgcagagttcccggacagattgaagtgctaagaggctttctaggtaagtgggcacccagggccaggacctctgacccaggatctcttggcgatgccccactgtaccccctagcctcggaagccaccaatggggggggttctacaagtgcactgcctggtgacggtcactggctattcactgtgccttcgtagggcggcgttactggtggttctaattcatgggatgaatcttgttgagttcccagtggtctctctgcccagccccctgtaccttattgccaccaaggcccacacacaattggtgtgtggaagcatcaagtaaccccagattcacagcaggggaggcctctgcggagttaggggaccattggccacatccaccactagggcccggggactcccacctttgaccctgaatgccccacacctctccccatctctccaccaccacgcccatctacagaggatgtggtgcctgatgccacctccgcgtacccctacctcctcctgtatga

SEQ ID NO: 7841 - DNA, 551 bp, Homo sapiens
acgccccgggccgggccgcagcctcctgggcttcgtgggggcagacccagcctttcccggcagcgagcgctcggccaggtgcactaggcgctgtgcgggccccccttccccgcggtgagtagcccccaccccgccgcctaggctaccctcctgtggcgcctgggccacgacctaagcctaacccggtcctcctcgccctccaacgcccggccttcccgcctccgccggccgccgcgtccctggaggggctagcgcgcttcaacaagtcctagccctcctctgtaaagggaggctgtacaggacggttgcacactgccggcgcccagatcatcgggctgctccctccaactctctccagagtccctcaagcgggaacctgcctcgtgtctcccaggagccatggaggctgtggaactcgccagaaaactgcaggaggaagctacgtgctccatctgtctggattacttcacagaccctgtgatgaccacctgtggccacaacttctgccgagcctgcatccagctgagctgggaaaaggcgaggggcaagaa

SEQ ID NO: 7842 - DNA, 3255 bp, Homo sapiens
agactttacaccaaatctcagaagattcagaacttagatgagtggggcccaggacaggaaccctggagccttggaaggaggggagccccatctccccagaagagcagtgaccccagcagagaggggcctggtgtatcactggaggaaatagcctgccaaggaatacacgtcttcagaagaaattctgtgtggcttcaagagactgatcaaattgtgagaggaaaacagcctacccggtcctcttttcttcaatacaaaatgagataataggggttggaaggaaaaccttcaagacctatggaagtcagttgcagccagctcatcacatagaggtgcaggtgaggtgtattttcatcacggtggaaaattctggctgcttcatctccatctctagagccaatattggagcttttcaataaaagctatggcctcaaccaccagcaccaagaagatgatggaggaagccacctgctccatctgcctgagcctgatgacgaacccagtaagcatcaactgtggacacagctactgccacttgtgtataacagacttctttaaaaacccaagccaaaagcaactgaggcaggagacattctgctgtccccagtgtcgggctccatttcatatggatagcctccgacccaacaagcagctgggaagcctcattgaagccctcaaagagacggatcaagaaatgtcatgtgaggaacacggagagcagttccacctgttctgcgaagacgaggggcagctcatctgctggcgctgtgagcgggcaccacagcacaaagggcacaccacagctcttgttgaagacgtatgccagggctacaaggaaaagctccagaaagctgtgacaaaactgaagcaacttgaagacagatgtacggagcagaagctgtccacagcaatgcgaataactaaatggaaagagaaggtacagattcagagacaaaaaatccggtctgactttaagaatctccagtgtttcctacatgaggaagagaagtcttatctctggaggctggagaaagaagaacaacagactctgagtagactgagggactatgaggctggtctggggctgaagagcaatgaactcaagagccacatcctggaactggaggaaaaatgtcagggctcagcccagaaattgctgcagaatgtgaatgacactttgagcaggagttgggctgtgaagctggaaacatcagaggctgtctccttggaacttcatactatgtgcaatgtttccaagctttacttcgatgtgaagaaaatgttaaggagtcatcaagttagtgtgactctggatccagatacagctcatcacgaactaattctctctgaggatcggagacaagtgactcgtggatacacccaggagaatcaggacacatcttccaggagatttactgccttcccctgtgtcttgggttgtgaaggcttcacctcaggaagacgttactttgaagtggatgttggcgaaggaaccggatgggatttaggagtttgtatggaaaatgtgcagaggggcactggcatgaagcaagagcctcagtctggattctggaccctcaggctgtgcaaaaagaaaggctatgtagcacttacttctcccccaacttcccttcatctgcatgagcagcccctgcttgtgggaatttttctggactatgaggccggagttgtatccttttataacgggaatactggctgccacatctttactttcccgaaggcttccttctctgatactctccggccctatttccaggtttatcaatattctcctttgtttctgcctcccccaggtgactaaggaaaagagcagaagctccttggtttaaccagcacagagaaaataatataaatcccataagggcagacgtttggtctgttttcttcgctgtcatttccttagtagttagactagtgctgagattttagtggatatataattgatttatgttgaatatatggacttagcaactaaaaataccacagatggttaacctggactggggcaaagcaagataatagtgatgatcgtatgttgctgtctccatccgtctttaatgggtcagggctttgatttccaagggtcttcaggtgatgagtaggggtacccacaagtcagaaggtctgcgttctcctagtttgtttgctgccatttgaactcatgtagggaatgaaagaaagctgcaattatccgccaactgcatttaaaacaaaacaaaacagaaaaatcaaaataacattgactcttccaaccactgacatgttgtttaataatctaagcggcagtcctggaggctaccagacttactgagttctacctgagaaacagccaagcaaagtgtgagagaagggttaagactggcttacaatgagatgcttcaaatgaaaagggaattatgagtaaaattgaactttgatgggggattcagttctggaaaagaatttggtattttccagtctgctaggaccaattaccttgaaatattttaaaatctcagtaaatagttattgctgaaatggctgttggcagttcttattatgattcagagaagagcaaatagaccttaacttcattttgaaaaagaccaaattaccatacccgagtgagtaatgacaggactacaactaaaacataaacaacattaatgatgaccataaaaagtcacaaaattgctaaatgttataatttagagttgacataaaaattgatggccaggcatggtggctcacgcctgtaatcccagaactatgtgaggctgaggcaggtggatcacttgaggtcaggagttcaacaccagcctggccaacatggtgaaaccctgtctctactaaaaatacaaaaattagccgggcatggtggtaggggcctgtaacccagctactcgtgaggccaaggcaggagaattgcttgagcctgcagcagctgcagtaagccaagatcatgctgtgcctcaaggaaaaaaaaaattaatgtttactgatatttgttgaagtcctacaacatcacctctgagaataggagaaatgaagcaacagttgtgtctagatgtcagaggcatggctgggcctccatctctgcctaagggagatataaaagagttcaaactattgcccatgttccccagggtcagaagttctaattatgatgatagaggctgggttgtaagtagtaagtgaagggtagcagaatatgccatctttggcataagaagtattttgagttgaagacaattg

SEQ ID NO: 7843 - DNA, 2788 bp, Homo sapiens
aaaagctatggcctcaaccaccagcaccaagaagatgatggaggaagccacctgctccatctgcctgagcctgatgacgaacccagtaagcatcaactgtggacacagctactgccacttgtgtataacagacttctttaaaaacccaagccaaaagcaactgaggcaggagacattctgctgtccccagtgtcgggctccatttcatatggatagcctccgacccaacaagcagctgggaagcctcattgaagccctcaaagagacggatcaagaaatgtcatgtgaggaacacggagagcagttccacctgttctgcgaagacgaggggcagctcatctgctggcgctgtgagcgggcaccacagcacaaagggcacaccacagctcttgttgaagacgtatgccagggctacaaggaaaagctccagaaagctgtgacaaaactgaagcaacttgaagacagatgtacggagcagaagctgtccacagcaatgcgaataactaaatggaaagagaaggtacagattcagagacaaaaaatccggtctgactttaagaatctccagtgtttcctacatgaggaagagaagtcttatctctggaggctggagaaagaagaacaacagactctgagtagactgagggactatgaggctggtctggggctgaagagcaatgaactcaagagccacatcctggaactggaggaaaaatgtcagggctcagcccagaaattgctgcagaatgtgaatgacactttgagcaggagttgggctgtgaagctggaaacatcagaggctgtctccttggaacttcatactatgtgcaatgtttccaagctttacttcgatgtgaagaaaatgttaaggagtcatcaagttagtgtgactctggatccagatacagctcatcacgaactaattctctctgaggatcggagacaagtgactcgtggatacacccaggagaatcaggacacatcttccaggagatttactgccttcccctgtgtcttgggttgtgaaggcttcacctcaggaagacgttactttgaagtggatgttggcgaaggaaccggatgggatttaggagtttgtatggaaaatgtgcagaggggcactggcatgaagcaagagcctcagtctggattctggaccctcaggctgtgcaaaaagaaaggctatgtagcacttacttctcccccaacttcccttcatctgcatgagcagcccctgcttgtgggaatttttctggactatgaggccggagttgtatccttttataacgggaatactggctgccacatctttactttcccgaaggcttccttctctgatactctccggccctatttccaggtttatcaatattctcctttgtttctgcctcccccaggtgactaaggaaaagagcagaagctccttggtttaaccagcacagagaaaataatataaatcccataagggcagacgtttggtctgttttcttcgctgtcatttccttagtagttagactagtgctgagattttagtggatatataattgatttatgttgaatatatggacttagcaactaaaaataccacagatggttaacctggactggggcaaagcaagataatagtgatgatcgtatgttgctgtctccatccgtctttaatgggtcagggctttgatttccaagggtcttcaggtgatgagtaggggtacccacaagtcagaaggtctgcgttctcctagtttgtttgctgccatttgaactcatgtagggaatgaaagaaagctgcaattatccgccaactgcatttaaaacaaaacaaaacagaaaaatcaaaataacattgactcttccaaccactgacatgttgtttaataatctaagcggcagtcctggaggctaccagacttactgagttctacctgagaaacagccaagcaaagtgtgagagaagggttaagactggcttacaatgagatgcttcaaatgaaaagggaattatgagtaaaattgaactttgatgggggattcagttctggaaaagaatttggtattttccagtctgctaggaccaattaccttgaaatattttaaaatctcagtaaatagttattgctgaaatggctgttggcagttcttattatgattcagagaagagcaaatagaccttaacttcattttgaaaaagaccaaattaccatacccgagtgagtaatgacaggactacaactaaaacataaacaacattaatgatgaccataaaaagtcacaaaattgctaaatgttataatttagagttgacataaaaattgatggccaggcatggtggctcacgcctgtaatcccagaactatgtgaggctgaggcaggtggatcacttgaggtcaggagttcaacaccagcctggccaacatggtgaaaccctgtctctactaaaaatacaaaaattagccgggcatggtggtaggggcctgtaacccagctactcgtgaggccaaggcaggagaattgcttgagcctgcagcagctgcagtaagccaagatcatgctgtgcctcaaggaaaaaaaaaattaatgtttactgatatttgttgaagtcctacaacatcacctctgagaataggagaaatgaagcaacagttgtgtctagatgtcagaggcatggctgggcctccatctctgcctaagggagatataaaagagttcaaactattgcccatgttccccagggtcagaagttctaattatgatgatagaggctgggttgtaagtagtaagtgaagggtag

SEQ ID NO: 7844 - DNA, 1874 bp, Homo sapiens
gttaacttcctgacccaggaagtggcagcaacagaggggactagcagcgaatatactttacaccaaatctcagaagattcagaacttagatgagtggggcccaggacaggaaccctggagccttggaaggaggggagccccatctccccagaagagcagtgaccccagcagagaggggcctggtgtatcactggaggaaatagcctgccaaggaatacacgtcttcagaagaaattctgtgtggcttcaagagactgatcaaattgtgagaggaaaacagcctacccggtcctcttttcttcaatacaaaatgagataataggggttggaaggaaaaccttcaagacctatggaagtcagttgcagccagctcatcacatagaggtgcaggtgaggtgtattttcatcacggtggaaaattctggctgcttcatctccatctctagagccaatattggagcttttcaataaaagctatggcctcaaccaccagcaccaagaagatgatggaggaagccacctgctccatctgcctgagcctgatgacgaacccagtaagcatcaactgtggacacagctactgccacttgtgtataacagacttctttaaaaacccaagccaaaagcaactgaggcaggagacattctgctgtccccagtgtcgggctccatttcatatggatagcctccgacccaacaagcagctgggaagcctcattgaagccctcaaagagacggatcaagaaatgtcatgtgaggaacacggagagcagttccacctgttctgcgaagacgaggggcagctcatctgctggcgctgtgagcgggcaccacagcacaaagggcacaccacagctcttgttgaagacgtatgccagggctacaaggaaaagctccagaaagctgtgacaaaactgaagcaacttgaagacagatgtacggagcagaagctgtccacagcaatgcgaataactaaatggaaagagaaggtacagattcagagacaaaaaatccggtctgactttaagaatctccagtgtttcctacatgaggaagagaagtcttatctctggaggctggagaaagaagaacaacagactctgagtagactgagggactatgaggctggtctggggctgaagagcaatgaactcaagagccacatcctggaactggaggaaaaatgtcagggctcagcccagaaattgctgcagaatgtgaatgacactttgagcaggagttgggctgtgaagctggaaacatcagaggctgtctccttggaacttcatactatgtgcaatgtttccaagctttacttcgatgtgaagaaaatgttaaggagtcatcaagttagtgtgactctggatccagatacagctcatcacgaactaattctctctgaggatcggagacaagtgactcgtggatacacccaggagaatcaggacacatcttccaggagatttactgccttcccctgtgtcttgggttgtgaaggcttcacctcaggaagacgttactttgaagtggatgttggcgaaggaaccggatgggatttaggagtttgtatggaaaatgtgcagaggggcactggcatgaagcaagagcctcagtctggattctggaccctcaggctgtgcaaaaagaaaggctatgtagcacttacttctcccccaacttcccttcatctgcatgagcagcccctgcttgtgggaatttttctggactatgaggccggagttgtatccttttataacgggaatactggctgccacatctttactttcccgaaggcttccttctctgatactctccggccctatttccaggtttatcaatattctcctttgtttctgcctcccccaggtgactaa

SEQ ID NO: 7845 - DNA, 1640 bp, Homo sapiens
ggaggctgacagggtaggaacgaggccatgatccctttgcagaaggacaaccaggaggagggtgtctgccccatctgccaggagagcctgaaggaggccgtgagcaccaactgcggacatctcttctgtcgagtgtgcctgacacagcatgtggagaaggcctcagcctctggggtcttctgctgccccctctgccggaagccctgttctgaggaggtgctagggacaggctatatctgccccaaccaccagaagagggtgtgcaggttctgtgaggagagcagacttcttctatgtgtggaatgcctggtgtcccctgaacacatgtctcatcatgaactgaccattgaaaatgccctcagccactacaaggaacgactcaatcgccggagcaggaagctcagaaaggacattgcagaacttcagcggctcaaggctcagcaggagaagaaactgcaggctctgcagcagtggctgggccagctggagcacatgccagcagaagcggccagaatccttgacatctccagggcagtaacacagctcagaagcctggtcattgatctggaaaggacggccaaggaattagacaccaacacactgaagaatgctggtgacttactgaacaggagtgctccacagaaattagaggttatttatccccagttggagaaaggagtcagtgaattgcttcttcagccccctcagaagctctgacctgttcatccctgggacacctcacttcaggctcacctcagcctcctctctctccttcctccaacctgtccaggcccccactgggtctacccagtgcatcttcgggcctgccagctcctgaacatgtcaccatttcttcatgtccacagtcatcacctgatgcctgaccctctgactcttggacgatagccagcctccttccaggacaggctcatgcttggggctgccactgtggaggtcggggcccatggtctccaggagcatttgtgaaatctccattttgcctgtaaactgatggtagtgcccatctctcacaatctcattcaaataggatcctccaggcctctgaatggcccgagctcatcagcagtgacaccacctcacatgtggagcccagctgagttcctgcagtacttgttgtctgtaccactcacctggcacttatttattattgttgtggaagacagactcaaagacagcctcccttcatgatcctcacctcttggaattcatgcccttgtttggtcccctccccttgagtgtaagtgggatctgtgacttgcttctaatgaatggaataaggcaaaggtgatagggtgtcactctggcaactgtgttgcattgtatagaactcctccttgctggcccacccttttagagcccctcctaggagccaagagcagcttccagccaacaacaagcagaggccctcagtcttgtggctgcaagaacctgaattctgccaacaacccgagtgagcttggaagcagattcttccccaactgagccggataagaacctagtccagccaacaccttgattatagtcttgtgagtacctaagctgaggacccagtgaagctgtgccaaaatttcccacccacagaaacagtgtgacaataaatgtgtgtgtgtttttttgtt

SEQ ID NO: 7846 - DNA, 2004 bp, Homo sapiens
gtgtatgaaaaataatttcaagtttaacaaacacaaggaaaccgcagggtccatgtcaaagctgatgagctatttctgaaactcgtgcagaattgtggtttgtgtggtctatgtcacggcacccttgagggagagtgggcaattgcctgaacttggaggctgtgtcctgtccccaggctgctccagggctgcctccttccgactgggccttcttatctgggactgttgagggcaacaggccttccgaagaccagtgaagaaggaggccctgcaaacaggaggctgacagggtaggaacgaggccatgatccctttgcagaaggacaaccaggaggagggtgtctgccccatctgccaggagagcctgaaggaggccgtgagcaccaactgcggacatctcttctgtcgagtgtgcctgacacagcatgtggagaaggcctcagcctctggggtcttctgctgccccctctgccggaagccctgttctgaggaggtgctagggacaggctatatctgccccaaccaccagaagagggtgtgcaggttctgtgaggagagcagacttcttctatgtgtggaatgcctggtgtcccctgaacacatgtctcatcatgaactgaccattgaaaatgccctcagccactacaaggaacgactcaatcgccggagcaggaagctcagaaaggacattgcagaacttcagcggctcaaggctcagcaggagaagaaactgcaggctctgcagtttcaggtagaccacgggaaccacaggctggaggctgggccggagagccagcaccaaaccagggaacagctgggtgccctccctcagcagtggctgggccagctggagcacatgccagcagaagcggccagaatccttgacatctccagggcagtaacacagctcagaagcctggtcattgatctggaaaggacggccaaggaattagacaccaacacactgaagaatgctggtgacttactgaacaggagtgctccacagaaattagaggttatttatccccagttggagaaaggagtcagtgaattgcttcttcagccccctcagaagctctgacctgttcatccctgggacacctcacttcaggctcacctcagcctcctctctctccttcctccaacctgtccaggcccccactgggtctacccagtgcatcttcgggcctgccagctcctgaacatgtcaccatttcttcatgtccacagtcatcacctgatgcctgaccctctgactcttggacgatagccagcctccttccaggacaggctcatgcttggggctgccactgtggaggtcggggcccatggtctccaggagcatttgtgaaatctccattttgcctgtaaactgatggtagtgcccatctctcacaatctcattcaaataggatcctccaggcctctgaatggcccgagctcatcagcagtgacaccacctcacatgtggagcccagctgagttcctgcagtacttgttgtctgtaccactcacctggcacttatttattattgttgtggaagacagactcaaagacagcctcccttcatgatcctcacctcttggaattcatgcccttgtttggtcccctccccttgagtgtaagtgggatctgtgacttgcttctaatgaatggaataaggcaaaggtgatagggtgtcactctggcaactgtgttgcattgtatagaactcctccttgctggcccacccttttagagcccctcctaggagccaagagcagcttccagccaacaacaagcagaggccctcagtcttgtggctgcaagaacctgaattctgccaacaacccgagtgagcttggaagcagattcttccccaactgagccggataagaacctagtccagccaacaccttgattatagtcttgtgagtacctaagctgaggacccagtgaagctgtgccaaaatttcccacccacagaaacagtgtgacaataaatgtgtgtgtgtttttttgtt

SEQ ID NO: 7847 - DNA, 2086 bp, Homo sapiens
ataagaaccactcatctgctggccatctctccaggtctggagccagagaagatgatctgaaattgtagcaggagaaattgaggtgtatgaaaaataatttcaagtttaacaaacacaaggaaaccgcagggtccatgtcaaagctgatgagctatttctgaaactcgtgcagaattgtggtttgtgtggtctatgtcacggcacccttgagggagagtgggcaattgcctgaacttggaggctgtgtcctgtccccaggctgctccagggctgcctccttccgactgggccttcttatctgggactgttgagggcaacaggccttccgaagaccagtgaagaaggaggccctgcaaacaggaggctgacagggtaggaacgaggccatgatccctttgcagaaggacaaccaggaggagggtgtctgccccatctgccaggagagcctgaaggaggccgtgagcaccaactgcggacatctcttctgtcgagtgtgcctgacacagcatgtggagaaggcctcagcctctggggtcttctgctgccccctctgccggaagccctgttctgaggaggtgctagggacaggctatatctgccccaaccaccagaagagggtgtgcaggttctgtgaggagagcagacttcttctatgtgtggaatgcctggtgtcccctgaacacatgtctcatcatgaactgaccattgaaaatgccctcagccactacaaggaacgactcaatcgccggagcaggaagctcagaaaggacattgcagaacttcagcggctcaaggctcagcaggagaagaaactgcaggctctgcagtttcaggtagaccacgggaaccacaggctggaggctgggccggagagccagcaccaaaccagggaacagctgggtgccctccctcagcagtggctgggccagctggagcacatgccagcagaagcggccagaatccttgacatctccagggcagtaacacagctcagaagcctggtcattgatctggaaaggacggccaaggaattagacaccaacacactgaagaatgctggtgacttactgaacaggagtgctccacagaaattagaggttatttatccccagttggagaaaggagtcagtgaattgcttcttcagccccctcagaagctctgacctgttcatccctgggacacctcacttcaggctcacctcagcctcctctctctccttcctccaacctgtccaggcccccactgggtctacccagtgcatcttcgggcctgccagctcctgaacatgtcaccatttcttcatgtccacagtcatcacctgatgcctgaccctctgactcttggacgatagccagcctccttccaggacaggctcatgcttggggctgccactgtggaggtcggggcccatggtctccaggagcatttgtgaaatctccattttgcctgtaaactgatggtagtgcccatctctcacaatctcattcaaataggatcctccaggcctctgaatggcccgagctcatcagcagtgacaccacctcacatgtggagcccagctgagttcctgcagtacttgttgtctgtaccactcacctggcacttatttattattgttgtggaagacagactcaaagacagcctcccttcgtgatcctcacctcttggaattcatgcccttgtttggtcccctccccttgagtgtaagtgggatctgtgacttgcttctaatgaatggaataaggcaaaggtgatagggtgtcactctggcaactgtgttgcattgtatagaactcctccttgctggcccacccttttagagcccctcctaggagccaagagcagcttccagccaacaacaagcagaggccctcagtcttgtggctgcaagaacctgaattctgccaacaacccgagtgagcttggaagcagattcttccccaactgagccggataagaacctagtccagccaacaccttgattatagtcttgtgagtacctaagctgaggacccagtgaagctgtgccaaaatttcccacccacagaaacagtgtgacaataaatgtgtgtgtgtttttttgtt

SEQ ID NO: 7848 - DNA, 2086 bp, Homo sapiens
ataagaaccactcatctgctggccatctctccaggtctggagccagagaagatgatctgaaattgtagcaggagaaattgaggtgtatgaaaaataatttcaagtttaacaaacacaaggaaaccgcagggtccatgtcaaagctgatgagctatttctgaaactcgtgcagaattgtggtttgtgtggtctatgtcacggcacccttgagggagagtgggcaattgcctgaacttggaggctgtgtcctgtccccaggctgctccagggctgcctccttccgactgggccttcttatctgggactgttgagggcaacaggccttccgaagaccagtgaagaaggaggccctgcaaacaggaggctgacagggtaggaacgaggccatgatccctttgcagaaggacaaccaggaggagggtgtctgccccatctgccaggagagcctgaaggaggccgtgagcaccaactgcggacatctcttctgtcgagtgtgcctgacacagcatgtggagaaggcctcagcctctggggtcttctgctgccccctctgccggaagccctgttctgaggaggtgctagggacaggctatatctgccccaaccaccagaagagggtgtgcaggttctgtgaggagagcagacttcttctatgtgtggaatgcctggtgtcccctgaacacatgtctcatcatgaactgaccattgaaaatgccctcagccactacaaggaacgactcaatcgccggagcaggaagctcagaaaggacattgcagaacttcagcggctcaaggctcagcaggagaagaaactgcaggctctgcagtttcaggtagaccacgggaaccacaggctggaggctgggccggagagccagcaccaaaccagggaacagctgggtgccctccctcagcagtggctgggccagctggagcacatgccagcagaagcggccagaatccttgacatctccagggcagtaacacagctcagaagcctggtcattgatctggaaaggacggccaaggaattagacaccaacacactgaagaatgctggtgacttactgaacaggagtgctccacagaaattagaggttatttatccccagttggagaaaggagtcagtgaattgcttcttcagccccctcagaagctctgacctgttcatccctgggacacctcacttcaggctcacctcagcctcctctctctccttcctccaacctgtccaggcccccactgggtctacccagtgcatcttcgggcctgccagctcctgaacatgtcaccatttcttcatgtccacagtcatcacctgatgcctgaccctctgactcttggacgatagccagcctccttccaggacaggctcatgcttggggctgccactgtggaggtcggggcccatggtctccaggagcatttgtgaaatctccattttgcctgtaaactgatggtagtgcccatctctcacaatctcattcaaataggatcctccaggcctctgaatggcccgagctcatcagcagtgacaccacctcacatgtggagcccagctgagttcctgcagtacttgttgtctgtaccactcacctggcacttatttattattgttgtggaagacagactcaaagacagcctcccttcatgatcctcacctcttggaattcatgcccttgtttggtcccctccccttgagtgtaagtgggatctgtgacttgcttctaatgaatggaataaggcaaaggtgatagggtgtcactctggcaactgtgttgcattgtatagaactcctccttgctggcccacccttttagagcccctcctaggagccaagagcagcttccagccaacaacaagcagaggccctcagtcttgtggctgcaagaacctgaattctgccaacaacccgagtgagcttggaagcagattcttccccaactgagccggataagaacctagtccagccaacaccttgattatagtcttgtgagtacctaagctgaggacccagtgaagctgtgccaaaatttcccacccacagaaacagtgtgacaataaatgtgtgtgtgtttttttgtt

SEQ ID NO: 7849 - DNA, 1640 bp, Homo sapiens
ggaggctgacagggtaggaacgaggccatgatccctttgcagaaggacaaccaggaggagggtgtctgccccatctgccaggagagcctgaaggaggccgtgagcaccaactgcggacatctcttctgtcgagtgtgcctgacacagcatgtggagaaggcctcagcctctggggtcttctgctgccccctctgccggaagccctgttctgaggaggtgctagggacaggctatatctgccccaaccaccagaagagggtgtgcaggttctgtgaggagagcagacttcttctatgtgtggaatgcctggtgtcccctgaacacatgtctcatcatgaactgaccattgaaaatgccctcagccactacaaggaacgactcaatcgccggagcaggaagctcagaaaggacattgcagaacttcagcggctcaaggctcagcaggagaagaaactgcaggctctgcagcagtggctgggccagctggagcacatgccagcagaagcggccagaatccttgacatctccagggcagtaacacagctcagaagcctggtcattgatctggaaaggacggccaaggaattagacaccaacacactgaagaatgctggtgacttactgaacaggagtgctccacagaaattagaggttatttatccccagttggagaaaggagtcagtgaattgcttcttcagccccctcagaagctctgacctgttcatccctgggacacctcacttcaggctcacctcagcctcctctctctccttcctccaacctgtccaggcccccactgggtctacccagtgcatcttcgggcctgccagctcctgaacatgtcaccatttcttcatgtccacagtcatcacctgatgcctgaccctctgactcttggacgatagccagcctccttccaggacaggctcatgcttggggctgccactgtggaggtcggggcccatggtctccaggagcatttgtgaaatctccattttgcctgtaaactgatggtagtgcccatctctcacaatctcattcaaataggatcctccaggcctctgaatggcccgagctcatcagcagtgacaccacctcacatgtggagcccagctgagttcctgcagtacttgttgtctgtaccactcacctggcacttatttattattgttgtggaagacagactcaaagacagcctcccttcgtgatcctcacctcttggaattcatgcccttgtttggtcccctccccttgagtgtaagtgggatctgtgacttgcttctaatgaatggaataaggcaaaggtgatagggtgtcactctggcaactgtgttgcattgtatagaactcctccttgctggcccacccttttagagcccctcctaggagccaagagcagcttccagccaacaacaagcagaggccctcagtcttgtggctgcaagaacctgaattctgccaacaacccgagtgagcttggaagcagattcttccccaactgagccggataagaacctagtccagccaacaccttgattatagtcttgtgagtacctaagctgaggacccagtgaagctgtgccaaaatttcccacccacagaaacagtgtgacaataaatgtgtgtgtgtttttttgtt

SEQ ID NO: 7850 - DNA, 1640 bp, Homo sapiens
ggaggctgacagggtaggaacaaggccatgatccctttgcagaaggacaaccaggaggagggtgtctgccccatctgccaggagagcctgaaggaggccgtgagcaccaactgcggacatctcttctgtcgagtgtgcctgacacagcatgtggagaaggcctcagcctctggggtcttctgctgccccctctgccggaagccctgttctgaggaggtgctagggacaggctatatctgccccaaccaccagaagagggtgtgcaggttctgtgaggagagcagacttcttctatgtgtggaatgcttggtgtcccctgaacacatgtctcatcatgaactgaccattgaaaatgccctcagccactacaaggaacgactcaatcgccggagcaggaagctcagaaaggacattgcagaacttcagcggctcaaggctcagcaggagaagaaactgcaggctctgcagcagtggctgggccagctggagcacatgccagcagaagcggccagaatccttgacatctccagggcagtaacacagctcagaagcctggtcattgatctggaaaggatggccaaggaattagacaccaacacactgaagaatgctggtgacttactgaacaggagtgctccacagaaattagaggttatttatccccagttgaagaaaggagtcagtgaattgcttcttcagccccctcagaagctctgacctgttcatccctgggacacctcacttcaggctcacctcagcctcctctctctccttcctccaacctgtccaggcccccactgggtctacccagtgcatcttcgggcctgccagctcctgaacatgtcaccatttcttcatgtccacagtcatcacctgatgcctgaccctctgactcttggacgatagccagcctccttccaggacaggctcatgcttggggctgccactgtggaggtcggggcccatggtctccaggagcatttgtgaaatctccattttgcctgtaaactgatggtagtgcccatctctcacaatctcattcaaataggatcctccaggcctctgaatggcccgagctcatcagcagtgacatcacctcacatgtggagcccagctgagttcctgcagtacttgttgtctgtaccactcacctggcacttatttattattgttgtggaagacagactcaaagacagcctcccttcgtgatcctcacctcttggaattcatgcccttgtttggtcccctccccttgagtgtaagtgggatctgtgacttgcttctaatcaatggaataaggcaaaggtgatagggtgtcactctggcaactgtgttgcattgtatagaactcctccttgctggcccacccttttagagcccctcctaggagccaagagcagcttccagccaacaacaagcagaggccctcagtcttgtggctgcaagaacctgaattctgccaacaacctgagtgagcttggaagcagattcttccccaactgagccggataagaacctagtccagccaacaccttgattatagtcttgtgagtacctaagctgaggacccagtgaagctgtgccaaaatttcccacccacagaaacagtgtgacaataaatgtgtgtgtgtttttttgtt

SEQ ID NO: 7851 - DNA, 1640 bp, Homo sapiens; identical to SEQ ID NO: 7849

SEQ ID NO: 7852 - DNA, 2086 bp, Homo sapiens
ataagaaccactcgtctgctggccatctctccaggtctggagccagagaagatgatctgaaattgtagcaggagaaattgaggtgtatgaaaaataatttcaagtttaacaaacacaaggaaaccgcagggtccatgtcaaagctgatgagctatttctgaaactcgtgcagaattgtggtttgtgtggtctatgtcacggcacccttgagggagagtgggcaattgcctgaacttggaggctgtgtcctgtccccaggctgctccagggctgcctccttccgactgggccttcttatctgggactgttgagggcaacaggccttccgaagaccagtgaagaaggaggccctgcagacaggaggctgacagggtaggaacaaggccatgatccctttgcagaaggacaaccaggaggagggtgtctgccccatctgccaggagagcctgaaggaggccgtgagcaccaactgcggacatctcttctgtcgagtgtgcctgacacagcatgtggagaaggcctcagcctctggggtcttctgctgccccctctgccggaagccctgttctgaggaggtgctagggacaggctatatctgccccaaccaccagaagagggtgtgcaggttctgtgaggagagcagacttcttctatgtgtggaatgcttggtgtcccctgaacacatgtctcatcatgaactgaccattgaaaatgccctcagccactacaaggaacgactcaatcgccggagcaggaagctcagaaaggacattgcagaacttcagcggctcaaggctcagcaggagaagaaactgcaggctctgcagtttcaggtagaccacgggaaccacaggctggaggctgggccggagagccagcaccaaaccagggaacagctgggtgccctcccccagcagtggctgggccagctggagcacatgccagcagaagcggccagaatccttgacatctccagggcagtaacacagctcagaagcctggtcattgatctggaaaggatggccaaggaattagacaccaacacactgaagaatgctggtgacttactgaacaggagtgctccacagaaattagaggttatttatccccagttgaagaaaggagtcagtgaattgcttcttcagccccctcagaagctctgacctgttcatccctgggacacctcacttcaggctcacctcagcctcctctctctccttcctccaacctgtccaggcccccactgggtctacccagtgcatcttcgggcctgccagctcctgaacatgtcaccatttcttcatgtccacagtcatcacctgatgcctgaccctctgactcttggacgatagccagcctccttccaggacaggctcatgcttggggctgccactgtggaggtcggggcccatggtctccaggagcatttgtgaaatctccattttgcctgtaaactgatggtagtgcccatctctcacaatctcattcaaataggatcctccaggcctctgaatggcccgagctcatcagcagtgacatcacctcacatgtggagcccagctgagttcctgcagtacttgttgtctgtaccactcacctggcacttatttattattgttgtggaagacagactcaaagacagcctcccttcgtgatcctcacctcttggaattcatgcccttgtttggtcccctccccttgagtgtaagtgggatctgtgacttgcttctaatcaatggaataaggcaaaggtgatagggtgtcactctggcaactgtgttgcattgtatagaactcctccttgctggcccacccttttagagcccctcctaggagccaagagcagcttccagccaacaacaagcagaggccctcagtcttgtggctgcaagaacctgaattctgccaacaacctgagtgagcttggaagcagattcttccccaactgagccggataagaacctagtccagccaacaccttgattatagtcttgtgagtacctaagctgaggacccagtgaagctgtgccaaaatttcccacccacagaaacagtgtgacaataaatgtgtgtgtgtttttttgtt

SEQ ID NO: 7853 - DNA, 1640 bp, Homo sapiens; identical to SEQ ID NO: 7849

SEQ ID NO: 7854 - DNA, 2086 bp, Homo sapiens
ataagaaccactcgtctgctggccatctctccaggtctggagccagagaagatgatctgaaattgtagcaggagaaattgaggtgtatgaaaaataatttcaagtttaacaaacacaaggaaaccgcagggtccatgtcaaagctgatgagctatttctgaaactcgtgcagaattgtggtttgtgtggtctatgtcacggcacccttgagggagagtgggcaattgcctgaacttggaggctgtgtcctgtccccaggctgctccagggctgcctccttccgactgggccttcttatctgggactgttgagggcaacaggccttccgaagaccagtgaagaaggaggccctgcagacaggaggctgacagggtaggaacaaggccatgatccctttgcagaaggacaaccaggaggagggtgtctgccccatctgccaggagagcctgaaggaggccgtgagcaccaactgcggacatctcttctgtcgagtgtgcctgacacagcatgtggagaaggcctcagcctctggggtcttctgctgccccctctgccggaagccctgttctgaggaggtgctagggacaggctatatctgccccaaccaccagaagagggtgtgcaggttctgtgaggagagcagacttcttctatgtgtggaatgcctggtgtcccctgaacacatgtctcatcatgaactgaccattgaaaatgccctcagccactacaaggaacgactcaatcgccggagcaggaagctcagaaaggacattgcagaacttcagcggctcaaggctcagcaggagaagaaactgcaggctctgcagtttcaggtagaccacgggaaccacaggctggaggctgggccggagagccagcaccaaaccagggaacagctgggtgccctcccccagcagtggctgggccagctggagcacatgccagcagaagcggccagaatccttgacatctccagggcagtaacacagctcagaagcctggtcattgatctggaaaggatggccaaggaattagacaccaacacactgaagaatgctggtgacttactgaacaggagtgctccacagaaattagaggttatttatccccagttgaagaaaggagtcagtgaattgcttcttcagccccctcagaagctctgacctgttcatccctgggacacctcacttcaggctcacctcagcctcctctctctccttcctccaacctgtccaggcccccactgggtctacccagtgcatcttcgggcctgccagctcctgaacatgtcaccatttcttcatgtccacagtcatcacctgatgcctgaccctctgactcttggacgatagccagcctccttccaggacaggctcatgcttggggctgccactgtggaggtcggggcccatggtctccaggagcatttgtgaaatctccattttgcctgtaaactgatggtagtgcccatctctcacaatctcattcaaataggatcctccaggcctctgaatggcccgagctcatcagcagtgacatcacctcacatgtggagcccagctgagttcctgcagtacttgttgtctgtaccactcacctggcacttatttattattgttgtggaagacagactcaaagacagcctcccttcgtgatcctcacctcttggaattcatgcccttgtttggtcccctccccttgagtgtaagtgggatctgtgacttgcttctaatcaatggaataaggcaaaggtgatagggtgtcactctggcaactgtgttgcattgtatagaactcctccttgctggcccacccttttagagcccctcctaggagccaagagcagcttccagccaacaacaagcagaggccctcagtcttgtggctgcaagaacctgaattctgccaacaacctgagtgagcttggaagcagattcttccccaactgagccggataagaacctagtccagccaacaccttgattatagtcttgtgagtacctaagctgaggacccagtgaagctgtgccaaaatttcccacccacagaaacagtgtgacaataaatgtgtgtgtgtttttttgtt

SEQ ID NO: 7855 - DNA, 2086 bp, Homo sapiens
ataagaaccactcatctgctggccatctctccaggtctagagccagagaagatgatctgaaattgtagcaggagaaattgaggtgtatgaaaaataatttcaagtttaacaaacacaaggaaaccgcagggtccatgtcaaagctgatgagctatttctgaaactcgtgaagaattgtggtttgtgtggtctatgtcacggcacccttgagggagagtgggcaattgcctgaacttggaggctgtgtcctgtccccaggctgctccagggctgcctccttccgactgggccttcttatctgggactgttgagggcaacaggccttccgaagaccagtgaagaaggaggccctgcaaacaggaggctgacagggtaggaacgaggccatgatccctttgcagaaggacaaccaggaggagggtgtctgccccatctgccaggagagcctgaaggaggccgtgagcaccaactgcggacatctcttctgtcgagtgtgcctgacacagcatgtggagaaggcctcagcctctggggtcttctgctgccccctctgccggaagccctgttctgaggaggtgctagggacaggctatatctgccccaaccaccagaagagggtgtgcaggttctgtgaggagagcagacttcttctatgtgtggaatgcctggtgtcccctgaacacatgtctcatcatgaactgaccattgaaaatgccctcagccactgcaaggaacgactcaatcgccggagcaggaagctcagaaaggacattgcagaacttcagcggctcaaggctcagcaggagaagaaactgcaggctctgcagtttcaggtagaccacgggaaccacaggctggaggctgggccggagagccagcaccaaaccagggaacagctgggtgccctccctcagcagtggctgggccagctggagcacatgccagcagaagcggccagaatccttgacatctccagggcagtaacacagctcagaagcctggtcattgatctggaaaggacggccaaggaattagacaccaacacactgaagaatgctggtgacttactgaacaggagtgctccacagaaattagaggttatttatccccagttggagaaaggagtcagtgaattgcttcttcagccccctcagaagctctgacctgttcatccctgggacacctcacttcaggctcacctcagcctcctctctctccttcctccaacctgtccaggcccccactgggtctacccagtgcatcttcgggcctgccagctcctgaacatgtcaccatttcttcatgtccacagtcatcacctgatgcctgaccctctgactcttggacgatagccagcctccttccaggacaggctcatgcttggggctgccactgtggaggtcggggcccatggtctccaggagcatttgtgaaatctccattttgcctgtaaactgatggtagtgcccatctctcacaatctcattcaaataggatcctccaggcctctgaatggcccaagctcatcagcagtgacaccacctcacatgtggagcccagctgagttcctgcagtacttgttgtctgtaccactcacctggcacttatttattattgttgtggaagacagactcaaagacagcctcccttcgtgatcctcacctcttggaattcatgcccttgtttggtcccctccccttgagtgtaagtgggatctgtgacttgcttctaatgaatggaataaggcaaaggtgatagggtgtcactctggcaactgtgttgcattgtatagaactcctccttgctggcccacccttttagagcccctcctaggagccaagagcagcttccagccaacaacaagcagaggccctcagtcttgtggctgcaagaacctgaattctgccaacaacccgagtgagcttggaagcagattcttccccaactgagccggataagaacctagtccagccaacaccttgattatagtcttgtgagtacctaagctgaggacccagtgaagctgtgccaaaatttcccacccacagaaacagtgtgacaataaatgtgtgtgtgtttttttgtt

SEQ ID NO: 7856 - DNA, 2066 bp, Homo sapiens
ggccatctctccaggtctagagccagagaagatgatctgaaattgtagcaggagaaattgaggtgtatgaaaaataatttcaagtttaacaaacacaaggaaaccgcagggtccatgtcaaagctgatgagctatttctgaaactcgtgaagaattgtggtttgtgtggtctatgtcacggcacccttgagggagagtgggcaattgcctgaacttggaggctgtgtcctgtccccaggctgctccagggctgcctccttccgactgggccttcttatctgggactgttgagggcaacaggccttccgaagaccagtgaagaaggaggccctgcaaacaggaggctgacagggtaggaacgaggccatgatccctttgcagaaggacaaccaggaggagggtgtctgccccatctgccaggagagcctgaaggaggccgtgagcaccaactgcggacatctcttctgtcgagtgtgcctgacacagcatgtggagaaggcctcagcctctggggtcttctgctgccccctctgccggaagccctgttctgaggaggtgctagggacaggctatatctgccccaaccaccagaagagggtgtgcaggttctgtgaggagagcagacttcttctatgtgtggaatgcctggtgtcccctgaacacatgtctcatcatgaactgaccattgaaaatgccctcagccactacaaggaacgactcaatcgccggagcaggaagctcagaaaggacattgcagaacttcagcggctcaaggctcagcaggagaagaaactgcaggctctgcagtttcaggtagaccacgggaaccacaggctggaggctgggccggagagccagcaccaaaccagggaacagctgggtgccctccctcagcagtggctgggccagctggagcacatgccagcagaagcggccagaatccttgacatctccagggcagtaacacagctcagaagcctggtcattgatctggaaaggacggccaaggaattagacaccaacacactgaagaatgctggtgacttactgaacaggagtgctccacagaaattagaggttatttatccccagttggagaaaggagtcagtgaattgcttcttcagccccctcagaagctctgacctgttcatccctgggacacctcacttcaggctcacctcagcctcctctctctccttcctccaacctgtccaggcccccactgggtctacccagtgcatcttcgggcctgccagctcctgaacatgtcaccatttcttcatgtccacagtcatcacctgatgcctgaccctctgactcttggacgatagccagcctccttccaggacaggctcatgcttggggctgccactgtggaggtcggggcccatggtctccaggagcatttgtgaaatctccattttgcctgtaaactgatggtagtgcccatctctcacaatctcattcaaataggatcctccaggcctctgaatggcccaagctcatcagcagtgacaccacctcacatgtggagcccagctgagttcctgcagtacttgttgtctgtaccactcacctggcacttatttattattgttgtggaagacagactcaaagacagcctcccttcgtgatcctcacctcttggaattcatgcccttgtttggtcccctccccttgagtgtaagtgggatctgtgacttgcttctaatgaatggaataaggcaaaggtgatagggtgtcactctggcaactgtgttgcattgtatagaactcctccttgctggcccacccttttagagcccctcctaggagccaagagcagcttccagccaacaacaagcagaggccctcagtcttgtggctgcaagaacctgaattctgccaacaacccgagtgagcttggaagcagattcttccccaactgagccggataagaacctagtccagccaacaccttgattatagtcttgtgagtacctaagctgaggacccagtgaagctgtgccaaaatttcccacccacagaaacagtgtgacaataaatgtgtgtgtgtttttttgtt

SEQ ID NO: 7857 - DNA, 2086 bp, Homo sapiens
ataagaaccactcatctgctggccatctctccaggtctagagccagagaagatgatctgaaattgtagcaggagaaattgaggtgtatgaaaaataatttcaagtttaacaaacacaaggaaaccgcagggtccatgtcaaagctgatgagctatttctgaaactcgtgaagaattgtggtttgtgtggtctatgtcacggcacccttgagggagagtgggcaattgcctgaacttggaggctgtgtcctgtccccaggctgctccagggctgcctccttccgactgggccttcttatctgggactgttgagggcaacaggccttccgaagaccagtgaagaaggaggccctgcaaacaggaggctgacagggtaggaacgaggccatgatccctttgcagaaggacaaccaggaggagggtgtctgccccatctgccaggagagcctgaaggaggccgtgagcaccaactgcggacatctcttctgtcgagtgtgcctgacacagcatgtggagaaggcctcagcctctggggtcttctgctgccccctctgccggaagccctgttctgaggaggtgctagggacaggctatatctgccccaaccaccagaagagggtgtgcaggttctgtgaggagagcagacttcttctatgtgtggaatgcctggtgtcccctgaacacatgtctcatcatgaactgaccattgaaaatgccctcagccactacaaggaacgactcaatcgccggagcaggaagctcagaaaggacattgcagaacttcagcggctcaaggctcagcaggagaagaaactgcaggctctgcagtttcaggtagaccacgggaaccacaggctggaggctgggccggagagccagcaccaaaccagggaacagctgggtgccctccctcagcagtggctgggccagctggagcacatgccagcagaagcggccagaatccttgacatctccagggcagtaacacagctcagaagcctggtcattgatctggaaaggacggccaaggaattagacaccaacacactgaagaatgctggtgacttactgaacaggagtgctccacagaaattagaggttatttatccccagttggagaaaggagtcagtgaattgcttcttcagccccctcagaagctctgacctgttcatccctgggacacctcacttcaggctcacctcagcctcctctctctccttcctccaacctgtccaggcccccactgggtctacccagtgcatcttcgggcctgccagctcctgaacatgtcaccatttcttcatgtccacagtcatcacctgatgcctgaccctctgactcttggacgatagccagcctccttccaggacaggctcatgcttggggctgccactgtggaggtcggggcccatggtctccaggagcatttgtgaaatctccattttgcctgtaaactgatggtagtgcccatctctcacaatctcattcaaataggatcctccaggcctctgaatggcccgagctcatcagcagtgacaccacctcacatgtggagcccagctgagttcctgcagtacttgttgtctgtaccactcacctggcacttatttattattgttgtggaagacagactcaaagacagcctcccttcgtgatcctcacctcttggaattcatgcccttgtttggtcccctccccttgagtgtaagtgggatctgtgacttgcttctaatgaatggaataaggcaaaggtgatagggtgtcactctggcaactgtgttgcattgtatagaactcctccttgctggcccacccttttagagcccctcctaggagccaagagcagcttccagccaacaacaagcagaggccctcagtcttgtggctgcaagaacctgaattctgccaacaacccgagtgagcttggaagcagattcttccccaactgagccggataagaacctagtccagccaacaccttgattatagtcttgtgagtacctaagctgaggacccagtgaagctgtgccaaaatttcccacccacagaaacagtgtgacaataaatgtgtgtgtgtttttttgtt

SEQ ID NO: 7858 - DNA, 1640 bp, Homo sapiens
ggaggctgacagggtaggaacgaggccatgatccctttgcagaaggacaaccaggaggagggtgtctgccccatctgccaggagagcctgaaggaggccgtgagcaccaactgcggacatctcttctgtcgagtgtgcctgacacagcatgtggagaaggcctcagcctctggggtcttctgctgccccctctgccggaagccctgttctgaggaggtgctagggacaggctatatctgccccaaccaccagaagagggtgtgcaggttctgtgaggagagcagacttcttctatgtgtggaatgcctggtgtcccctgaacacatgtctcatcatgaactgaccattgaaaatgccctcagccactacaaggaacgactcaatcgccggagcaggaagctcagaaaggacattgcagaacttcagcggctcaaggctcagcaggagaagaaactgcaggctctgcagcagtggctgggccagctggagcacatgccagcagaagcggccagaatccttgacatctccagggcagtaacacagctcagaagcctggtcattgatctggaaaggacggccaaggaattagacaccaacacactgaagaatgctggtgacttactgaacaggagtgctccacagaaattagaggttatttatccccagttggagaaaggagtcagtgaattgcttcttcagccccctcagaagctctgacctgttcatccctgggacacctcacttcaggctcacctcagcctcctctctctccttcctccaacctgtccaggcccccactgggtctacccagtgcatcttcgggcctgccagctcctgaacatgtcaccatttcttcatgtccacagtcatcacctgatgcctgaccctctgactcttggacgatagccagcctccttccaggacaggctcatgcttggggctgccactgtggaggtcggggcccatggtctccaggagcatttgtgaaatctccattttgcctgtaaactgatggtagtgcccatctctcacaatctcattcaaataggatcctccaggcctctgaatggcccaagctcatcagcagtgacaccacctcacatgtggagcccagctgagttcctgcagtacttgttgtctgtaccactcacctggcacttatttattattgttgtggaagacagactcaaagacagcctcccttcgtgatcctcacctcttggaattcatgcccttgtttggtcccctccccttgagtgtaagtgggatctgtgacttgcttctaatgaatggaataaggcaaaggtgatagggtgtcactctggcaactgtgttgcattgtatagaactcctccttgctggcccacccttttagagcccctcctaggagccaagagcagcttccagccaacaacaagcagaggccctcagtcttgtggctgcaagaacctgaattctgccaacaacccgagtgagcttggaagcagattcttccccaactgagccggataagaacctagtccagccaacaccttgattatagtcttgtgagtacctaagctgaggacccagtgaagctgtgccaaaatttcccacccacagaaacagtgtgacaataaatgtgtgtgtgtttttttgtt

SEQ ID NO: 7859 - DNA, 2086 bp, Homo sapiens; identical to SEQ ID NO: 7847

SEQ ID NO: 7860 - DNA, 1640 bp, Homo sapiens
ggaggctgacagggtaggaacgaggccatgatccctttgcagaaggacaaccaggaggagggtgtctgccccatctgccaggagagcctgaaggaggccgtgagcaccaactgcggacatctcttctgtcgagtgtgcctgacacagcatgtggagaaggcctcagcctctggggtcttctgctgccccctctgccggaagccctgttctgaggaggtgctagggacaggctatatctgccccaaccaccagaagagggtgtgcaggttctgtgaggagagcagacttcttctatgtgtggaatgcctggtgtcccctgaacacatgtctcatcatgaactgaccattgaaaatgccctcagccactgcaaggaacgactcaatcgccggagcaggaagctcagaaaggacattgcagaacttcagcggctcaaggctcagcaggagaagaaactgcaggctctgcagcagtggctgggccagctggagcacatgccagcagaagcggccagaatccttgacatctccagggcagtaacacagctcagaagcctggtcattgatctggaaaggacggccaaggaattagacaccaacacactgaagaatgctggtgacttactgaacaggagtgctccacagaaattagaggttatttatccccagttggagaaaggagtcagtgaattgcttcttcagccccctcagaagctctgacctgttcatccctgggacacctcacttcaggctcacctcagcctcctctctctccttcctccaacctgtccaggcccccactgggtctacccagtgcatcttcgggcctgccagctcctgaacatgtcaccatttcttcatgtccacagtcatcacctgatgcctgaccctctgactcttggacgatagccagcctccttccaggacaggctcatgcttggggctgccactgtggaggtcggggcccatggtctccaggagcatttgtgaaatctccattttgcctgtaaactgatggtagtgcccatctctcacaatctcattcaaataggatcctccaggcctctgaatggcccaagctcatcagcagtgacaccacctcacatgtggagcccagctgagttcctgcagtacttgttgtctgtaccactcacctggcacttatttattattgttgtggaagacagactcaaagacagcctcccttcgtgatcctcacctcttggaattcatgcccttgtttggtcccctccccttgagtgtaagtgggatctgtgacttgcttctaatgaatggaataaggcaaaggtgatagggtgtcactctggcaactgtgttgcattgtatagaactcctccttgctggcccacccttttagagcccctcctaggagccaagagcagcttccagccaacaacaagcagaggccctcagtcttgtggctgcaagaacctgaattctgccaacaacccgagtgagcttggaagcagattcttccccaactgagccggataagaacctagtccagccaacaccttgattatagtcttgtgagtacctaagctgaggacccagtgaagctgtgccaaaatttcccacccacagaaacagtgtgacaataaatgtgtgtgtgtttttttgtt

SEQ ID NO: 7861 - DNA, 1640 bp, Homo sapiens
ggaggctgacagggtaggaacaaggccatgatccctttgcagaaggacaaccaggaggagggtgtctgccccatctgccaggagagcctgaaggaggccgtgagcaccaactgcggacatctcttctgtcgagtgtgcctgacacagcatgtggagaaggcctcagcctctggggtcttctgctgccccctctgccggaagccctgttctgaggaggtgctagggacaggctatatctgccccaaccaccagaagagggtgtgcaggttctgtgaggagagcagacttcttctatgtgtggaatgcctggtgtcccctgaacacatgtctcatcatgaactgaccattgaaaatgccctcagccactacaaggaacgactcaatcgccggagcaggaagctcagaaaggacattgcagaacttcagcggctcaaggctcagcaggagaagaaactgcaggctctgcagcagtggctgggccagctggagcacatgccagcagaagcggccagaatccttgacatctccagggcagtaacacagctcagaagcctggtcattgatctggaaaggatggccaaggaattagacaccaacacactgaagaatgctggtgacttactgaacaggagtgctccacagaaattagaggttatttatccccagttgaagaaaggagtcagtgaattgcttcttcagccccctcagaagctctgacctgttcatccctgggacacctcacttcaggctcacctcagcctcctctctctccttcctccaacctgtccaggcccccactgggtctacccagtgcatcttcgggcctgccagctcctgaacatgtcaccatttcttcatgtccacagtcatcacctgatgcctgaccctctgactcttggacgatagccagcctccttccaggacaggctcatgcttggggctgccactgtggaggtcggggcccatggtctccaggagcatttgtgaaatctccattttgcctgtaaactgatggtagtgcccatctctcacaatctcattcaaataggatcctccaggcctctgaatggcccgagctcatcagcagtgacatcacctcacatgtggagcccagctgagttcctgcagtacttgttgtctgtaccactcacctggcacttatttattattgttgtggaagacagactcaaagacagcctcccttcgtgatcctcacctcttggaattcatgcccttgtttggtcccctccccttgagtgtaagtgggatctgtgacttgcttctaatcaatggaataaggcaaaggtgatagggtgtcactctggcaactgtgttgcattgtatagaactcctccttgctggcccacccttttagagcccctcctaggagccaagagcagcttccagccaacaacaagcagaggccctcagtcttgtggctgcaagaacctgaattctgccaacaacctgagtgagcttggaagcagattcttccccaactgagccggataagaacctagtccagccaacaccttgattatagtcttgtgagtacctaagctgaggacccagtgaagctgtgccaaaatttcccacccacagaaacagtgtgacaataaatgtgtgtgtgtttttttgtt

SEQ ID NO: 7862 - DNA, 2004 bp, Homo sapiens
gtgtatgaaaaataatttcaagtttaacaaacacaaggaaaccgcagggtccatgtcaaagctgatgagctatttctgaaactcgtgcagaattgtggtttgtgtggtctatgtcacggcacccttgagggagagtgggcaattgcctgaacttggaggctgtgtcctgtccccaggctgctccagggctgcctccttccgactgggccttcttatctgggactgttgagggcaacaggccttccgaagaccagtgaagaaggaggccctgcaaacaggaggctgacagggtaggaacgaggccatgatccctttgcagaaggacaaccaggaggagggtgtctgccccatctgccaggagagcctgaaggaggccgtgagcaccaactgcggacatctcttctgtcgagtgtgcctgacacagcatgtggagaaggcctcagcctctggggtcttctgctgccccctctgccggaagccctgttctgaggaggtgctagggacaggctatatctgccccaaccaccagaagagggtgtgcaggttctgtgaggagagcagacttcttctatgtgtggaatgcctggtgtcccctgaacacatgtctcatcatgaactgaccattgaaaatgccctcagccactacaaggaacgactcaatcgccggagcaggaagctcagaaaggacattgcagaacttcagcggctcaaggctcagcaggagaagaaactgcaggctctgcagtttcaggtagaccacgggaaccacaggctggaggctgggccggagagccagcaccaaaccagggaacagctgggtgccctccctcagcagtggctgggccagctggagcacatgccagcagaagcggccagaatccttgacatctccagggcagtaacacagctcagaagcctggtcattgatctggaaaggacggccaaggaattagacaccaacacactgaagaatgctggtgacttactgaacaggagtgctccacagaaattagaggttatttatccccagttggagaaaggagtcagtgaattgcttcttcagccccctcagaagctctgacctgttcatccctgggacacctcacttcaggctcacctcagcctcctctctctccttcctccaacctgtccaggcccccactgggtctacccagtgcatcttcgggcctgccagctcctgaacatgtcaccatttcttcatgtccacagtcatcacctgatgcctgaccctctgactcttggacgatagccagcctccttccaggacaggctcatgcttggggctgccactgtggaggtcggggcccatggtctccaggagcatttgtgaaatctccattttgcctgtaaactgatggtagtgcccatctctcacaatctcattcaaataggatcctccaggcctctgaatggcccgagctcatcagcagtgacaccacctcacatgtggagcccagctgagttcctgcagtacttgttgtctgtaccactcacctggcacttatttattattgttgtggaagacagactcaaagacagcctcccttcgtgatcctcacctcttggaattcatgcccttgtttggtcccctccccttgagtgtaagtgggatctgtgacttgcttctaatgaatggaataaggcaaaggtgatagggtgtcactctggcaactgtgttgcattgtatagaactcctccttgctggcccacccttttagagcccctcctaggagccaagagcagcttccagccaacaacaagcagaggccctcagtcttgtggctgcaagaacctgaattctgccaacaacccgagtgagcttggaagcagattcttccccaactgagccggataagaacctagtccagccaacaccttgattatagtcttgtgagtacctaagctgaggacccagtgaagctgtgccaaaatttcccacccacagaaacagtgtgacaataaatgtgtgtgtgtttttttgtt

SEQ ID NO: 7863 - DNA, 2004 bp, Homo sapiens
gtgtatgaaaaataatttcaagtttaacaaacacaaggaaaccgcagggtccatgtcaaagctgatgagctatttctgaaactcgtgaagaattgtggtttgtgtggtctatgtcacggcacccttgagggagagtgggcaattgcctgaacttggaggctgtgtcctgtccccaggctgctccagggctgcctccttccgactgggccttcttatctgggactgttgagggcaacaggccttccgaagaccagtgaagaaggaggccctgcaaacaggaggctgacagggtaggaacgaggccatgatccctttgcagaaggacaaccaggaggagggtgtctgccccatctgccaggagagcctgaaggaggccgtgagcaccaactgcggacatctcttctgtcgagtgtgcctgacacagcatgtggagaaggcctcagcctctggggtcttctgctgccccctctgccggaagccctgttctgaggaggtgctagggacaggctatatctgccccaaccaccagaagagggtgtgcaggttctgtgaggagagcagacttcttctatgtgtggaatgcctggtgtcccctgaacacatgtctcatcatgaactgaccattgaaaatgccctcagccactgcaaggaacgactcaatcgccggagcaggaagctcagaaaggacattgcagaacttcagcggctcaaggctcagcaggagaagaaactgcaggctctgcagtttcaggtagaccacgggaaccacaggctggaggctgggccggagagccagcaccaaaccagggaacagctgggtgccctccctcagcagtggctgggccagctggagcacatgccagcagaagcggccagaatccttgacatctccagggcagtaacacagctcagaagcctggtcattgatctggaaaggacggccaaggaattagacaccaacacactgaagaatgctggtgacttactgaacaggagtgctccacagaaattagaggttatttatccccagttggagaaaggagtcagtgaattgcttcttcagccccctcagaagctctgacctgttcatccctgggacacctcacttcaggctcacctcagcctcctctctctccttcctccaacctgtccaggcccccactgggtctacccagtgcatcttcgggcctgccagctcctgaacatgtcaccatttcttcatgtccacagtcatcacctgatgcctgaccctctgactcttggacgatagccagcctccttccaggacaggctcatgcttggggctgccactgtggaggtcggggcccatggtctccaggagcatttgtgaaatctccattttgcctgtaaactgatggtagtgcccatctctcacaatctcattcaaataggatcctccaggcctctgaatggcccaagctcatcagcagtgacaccacctcacatgtggagcccagctgagttcctgcagtacttgttgtctgtaccactcacctggcacttatttattattgttgtggaagacagactcaaagacagcctcccttcgtgatcctcacctcttggaattcatgcccttgtttggtcccctccccttgagtgtaagtgggatctgtgacttgcttctaatgaatggaataaggcaaaggtgatagggtgtcactctggcaactgtgttgcattgtatagaactcctccttgctggcccacccttttagagcccctcctaggagccaagagcagcttccagccaacaacaagcagaggccctcagtcttgtggctgcaagaacctgaattctgccaacaacccgagtgagcttggaagcagattcttccccaactgagccggataagaacctagtccagccaacaccttgattatagtcttgtgagtacctaagctgaggacccagtgaagctgtgccaaaatttcccacccacagaaacagtgtgacaataaatgtgtgtgtgtttttttgtt

SEQ ID NO: 7864 - DNA, 2004 bp, Homo sapiens
gtgtatgaaaaataatttcaagtttaacaaacacaaggaaaccgcagggtccatgtcaaagctgatgagctatttctgaaactcgtgaagaattgtggtttgtgtggtctatgtcacggcacccttgagggagagtgggcaattgcctgaacttggaggctgtgtcctgtccccaggctgctccagggctgcctccttccgactgggccttcttatctgggactgttgagggcaacaggccttccgaagaccagtgaagaaggaggccctgcaaacaggaggctgacagggtaggaacgaggccatgatccctttgcagaaggacaaccaggaggagggtgtctgccccatctgccaggagagcctgaaggaggccgtgagcaccaactgcggacatctcttctgtcgagtgtgcctgacacagcatgtggagaaggcctcagcctctggggtcttctgctgccccctctgccggaagccctgttctgaggaggtgctagggacaggctatatctgccccaaccaccagaagagggtgtgcaggttctgtgaggagagcagacttcttctatgtgtggaatgcctggtgtcccctgaacacatgtctcatcatgaactgaccattgaaaatgccctcagccactacaaggaacgactcaatcgccggagcaggaagctcagaaaggacattgcagaacttcagcggctcaaggctcagcaggagaagaaactgcaggctctgcagtttcaggtagaccacgggaaccacaggctggaggctgggccggagagccagcaccaaaccagggaacagctgggtgccctccctcagcagtggctgggccagctggagcacatgccagcagaagcggccagaatccttgacatctccagggcagtaacacagctcagaagcctggtcattgatctggaaaggacggccaaggaattagacaccaacacactgaagaatgctggtgacttactgaacaggagtgctccacagaaattagaggttatttatccccagttggagaaaggagtcagtgaattgcttcttcagccccctcagaagctctgacctgttcatccctgggacacctcacttcaggctcacctcagcctcctctctctccttcctccaacctgtccaggcccccactgggtctacccagtgcatcttcgggcctgccagctcctgaacatgtcaccatttcttcatgtccacagtcatcacctgatgcctgaccctctgactcttggacgatagccagcctccttccaggacaggctcatgcttggggctgccactgtggaggtcggggcccatggtctccaggagcatttgtgaaatctccattttgcctgtaaactgatggtagtgcccatctctcacaatctcattcaaataggatcctccaggcctctgaatggcccgagctcatcagcagtgacaccacctcacatgtggagcccagctgagttcctgcagtacttgttgtctgtaccactcacctggcacttatttattattgttgtggaagacagactcaaagacagcctcccttcgtgatcctcacctcttggaattcatgcccttgtttggtcccctccccttgagtgtaagtgggatctgtgacttgcttctaatgaatggaataaggcaaaggtgatagggtgtcactctggcaactgtgttgcattgtatagaactcctccttgctggcccacccttttagagcccctcctaggagccaagagcagcttccagccaacaacaagcagaggccctcagtcttgtggctgcaagaacctgaattctgccaacaacccgagtgagcttggaagcagattcttccccaactgagccggataagaacctagtccagccaacaccttgattatagtcttgtgagtacctaagctgaggacccagtgaagctgtgccaaaatttcccacccacagaaacagtgtgacaataaatgtgtgtgtgtttttttgtt

SEQ ID NO: 7865 - DNA, 2004 bp, Homo sapiens; identical to SEQ ID NO: 7862

SEQ ID NO: 7866 - DNA, 2539 bp, Homo sapiens
aatgccagcctatgagcttcctggtagggacaccagctgtgaagtcctcataacagccaacttcttgcaactttcaagctgacggcctcaggaatgggaggaaggactcctccactggagaactgatagcagtattctggtagaggaggcatcaagagtcctgggaggccggtggtaatcatgtaggcaccatggaaactgctatgtgcgtttgctgtccatgttgtacatggcagagatgttgtcctcagttatgctcctgtctgtgctgcaagttcatcttcacctcagagcggaactgcacctgcttcccctgcccttacaaagatgagcggaactgccagttctgccactgcacctgttctgagagccccaactgccattggtgttgctgctcttgggccaatgatcccaactgtaagtgctgctgcacagccagcagcaatctcaactgctactactatgagagccgctgctgccgcaataccatcatcactttccacaagggccgcctcaggagcatccatacctcctccaagactgccctgcgcactgggagcagcgatacccaggtggatgaagtaaagtcaataccagccaacagtcacctggtgaaccacctcaattgccccatgtgcagccggctgcgcctgcactcattcatgctgccctgcaaccacagcctgtgcgagaagtgcctgcggcagctgcagaagcacgccgaggtcaccgagaacttcttcatcctcatctgcccagtgtgcgaccgctcgcactgcatgccctacagcaacaagatgcagctgcccgagaactacctgcacgggcgtctcaccaagcgctacatgcaggagcacggctacctcaagtggcgctttgaccgctcctccgggcccatcctctgccaggtctgccgcaacaagcgcatcgcttacaagcgctgcatcacctgccgcctcaacctgtgcaacgactgcctcaaggccttccactcggatgtggccatgcaagaccacgtctttgtggacaccagcgccgaggaacaggacgagaagatctgcatccaccacccatccagccgcatcatcgagtactgccgcaatgacaacaaattgctctgcaccttctgcaagttctctttccacaatggccacgacaccattagcctcatcgacgcctgctccgagagggccgcctcactcttcagcgccatcgccaagttcaaagcagtccgatatgaaattgataatgacctaatggaattcaacatcttaaaaaacagctttaaagctgacaaggaggcaaagcgaaaagagatcagaaatggctttctcaagttgcgcagcattcttcaggagaaagagaagatcatcatggagcagatagagaatctagaagtgtccaggcagaaggaaattgaaaaatatgtgtatgttacaaccatgaaagtgaacgagatggatggtctgatcgcctactccaaggaagccctgaaggagactggccaggtggcattcctgcagtcagccaagatcctggtggaccagatcgaggacggcatccagaccacctacaggcctgacccacagctccggctgcactcaataaactacgtgcccttggactttgttgagctttccagtgccatccatgagctcttccccacagggcccaagaaggtacgctcctcaggggactccctgccctccccctaccccgtgcactcagaaacaatgattgccaggaaggtcactttcagcacccacagcctcggcaaccagcacatataccagcgaagctcctccatgttgtccttcagcaacactgacaagaaggccaaggtgggtctggaggcctgtgggagagcccagtcagccacccccgccaaacccacagacggcctctacacctactggagtgctggagcagacagccagtctgtacagaacagcagcagcttccacaactggtactcattcaacgatggctctgtgaagaccccaggcccaattgttatctaccagactctggtgtacccaagagctgccaaggtttactggacatgtccagcagaagacgtggactcttttgagatggaattctatgaagtcattacttctcctcctaacaacgtacaaatggagctctgtggacaaattcgggacataatgcagcaaaatctggagctgcacaacctgacccccaacacagaatacgtgtttaaagttagagccatcaatgataatggtcctgggcaatggagtgatatctgcaaggtggtaacaccagatggacatgggaagaaccgagctaagtggggcctgctgaagaatatccagtctgccctccagaagcacttctgagccccttcagagcaggaaacaacctcagactcatcacaaagtagacatatacacacacatatatgtatgtatatttttctcaccacattcttcaaggaggttgtagacaaatgtttccatgacctctcagctttccaacaggaatcttgtaagagctaataaaaggaaatacctga

SEQ ID NO: 7867 - DNA, 1682 bp, Homo sapiens
acagagtagctttgcaactggctttggggacttccgaaagctaccagcactgcactgtgagactctcatccctgagctgaattcatctgattcgacggcaagctttggtgagaacatagatatatttctgaggaaaatggactcagacttctcacatgccttccagaaggaactcacctgcgtcatctgtttgaactacctggtagaccctgtcaccatctgctgtgggcacagcttctgtaggccctgtctctgcctttcgtgggaggaagcccaaagtcctgcaaactgccctgcatgcagggaaccatcaccgaaaatggacttcaaaaccaatattcttctgaagaatttagtgaccattgccagaaaagccagtctctggcaattcctgagctctgagaaacaaatatgtgggacccataggcaaacaaagaagatgttctgtgacatggacaagagtctcctctgcttgctgtgctccaactctcaggagcacggggctcacaaacaccatcccatcgaagaggcagctgaggaacaccgggagaaactcttaaagcaaatgaggattttatggaaaaagattcaagaaaatcagagaaatctatatgaggagggaagaacagccttcctctggaggggcaatgtggttttacgggcacagatgatcaggaatgagtataggaagctgcatccggttctccataaggaagaaaaacaacatttagagagactgaacaaggaataccaagagatttttcagcaactccagagaagttgggtcaaaatggatcaaaagagtaaacacttgaaagaaatgtatcaggaactaatggaaatgtgtcataaaccagatgtggagctgctccaggatttgggagacatcgtggcaaggagtgagtccgtgctgctgcacatgccccagcctgtgaatccagagctcactgcaggacccatcactggactggtgtacaggctcaaccgcttccgagtggaaatttccttccattttgaagtaaccaatcacaatatcaggctctttgaggatgtgagaagttggatgtttagacgtggacctttgaattctgacagatctgactattttgctgcatggggagccagggtcttctcctttgggaaacactactgggagctggatgtggacaactcttgtgactgggctctgggagtctgtaacaactcctggataaggaagaatagcacaatggttaactctgaggacatatttcttcttttgtgtctgaaggtggataatcatttcaatctcttgaccacctccccagtgtttcctcactacatagagaaacctctgggccgggttggtgtgtttcttgattttgaaagtggaagtgtgagttttttgaatgtcaccaagagttccctcatatggagttacccagctggctccttaacttttcctgtcaggcctttcttttacactggccacagatgatcaggattaagaaaacttactgtttgggaactccatatacaagggagcccttcactgttgatacaaagaaatcatactgttcaggcttttttgtactttagtgtcacttcattttattgctattaaataaaaaatttgtaaaaggcaaaactttttgtacattttcttacaattaaaataatctcttatggaccattacctaaaa

SEQ ID NO: 7868 - DNA, 3061 bp, Homo sapiens
atggcagagggtgaggatatgcagaccttcacttccatcatggacgcactggtccgcatcagtaccagcatgaagaacatggagaaggaactgctgtgcccagtgtgtcaagagatgtacaagcagccactggtgctgccctgtacccacaacgtgtgccaggcctgtgcccgagaggtcttgggccagcagggctacataggacatggtggggaccccagctccgagcccacctctcctgcctccaccccttccacccgcagcccccgcctctcccgcagaactctccccaagccagaccgcctggaccggctgcttaagtcaggctttgggacataccctgggaggaagcgaggtgctttgcacccccaagtgatcatgttcccgtgcccagcctgccaaggtgatgtggagcttggggagcggggtctggcagggcttttccggaacctgaccctggagcgtgtggtggagcggtaccgccagagtgtgagtgtgggaggtgccatcctgtgccagttgtgcaagcccccaccactagaggccaccaagggctgcacagagtgccgcgccaccttctgcaatgagtgcttcaagctcttccacccctggggcacccagaaggcccagcatgagcccaccctgcctaccctctccttccgacccaagggccttatgtgcccagaccacaaggaagaggtgacccactactgcaagacatgccaacgcctggtatgtcaactctgccgggtgcggcgcacccacagcgggcacaagatcacaccagtgctcagtgcctaccaggccctcaaggacaagctgacaaagagcctgacatacatcctgggaaaccaggacacggtacagacccagatctgtgagctggaggaggccgtgaggcacaccgaggtgagtggtcagcaggccaaggaggaggtgtcgcagctggtgcgggggctgggggctgtgctggaggagaagcgggcatcactgcttcaggccattgaagaatgccagcaggagcggctggcccgtctcagcgcccagatccaggagcaccggagcctgctggatggctcaggtctggtgggctatgcccaggaagtacttaaggaaacagaccagccttgctttgtgcaagccgccaagcagctgcacaacaggattgcccgagccactgaagccctccagacattccggccagctgccagctcctccttccgccattgccagctcgacgtgggacgtgagatgaagctgctgacagagcttaacttcctgcgagtgcctgaggcccccgtcattgacacccagcgcacctttgcctatgatcagatcttcctgtgctggcggctgcccccccattcaccacctgcctggcactataccgttgagttccggcgcacggatgtgcctgctcagccaggccccacccgctggcagcggcgggaggaggtgaggggcaccagtgccctgcttgagaaccccgacacgggctctgtgtatgtgctgcgtgtccgcggctgcaacaaggccggctacggcgaatacagtgaagatgtgcacctgcacacgcccccggcacctgtcctgcacttcttcctcgatagccgctggggcgcaagccgagagcggctggctatcagcaaggaccagcgagcagtacggagtgttccagggctgcccctgctgctggctgctgaccggctgctgaccggctgccacctgagtgtggatgtggtcctgggcgacgtggctgtgacccagggccgcagctactgggcctgcgccgtagacccagcctcctacttggtcaaggtgggcgtcgggctggagagcaagcttcaagaaagtttccagggtgcccccgatgtgatcagccccaggtacgacccggacagcgggcacgacagcggtgccgaggatgccacagtggaggcgtcgccacccttcgctttcctaaccattggcatgggcaagatcctgctggggtcgggggcaagctcaaacgcagggctgacagggagggatggccccacagccggctgcacagtgcccctgccaccccgcctgggcatctgcctggactatgagcggggccgggtttccttcctggatgctgtttccttccgtgggctcttggagtgccccctggactgctcagggcctgtgtgccctgccttttgcttcatcgggggtggcgcagtacagctccaggagccagtgggcactaagcctgagaggaaagtcaccattgggggcttcgccaagctggactgagccttccaggcccctcatgcagacctggggtcctcctgggccctggcccccaaacctcttggcacccggttgttaccccctggcagcttctcccccaaactctcctaccatgtggccctgctccttctcccgtgtctgtcttcccacagttttctcttgacccaggggctctcttctgcccacctctctggatggcccccgttctctccattgcttgttagccaggcccccacccccactgagtctgccctatgacctgcctttggcatgttacccaagccatggagagagccccttctccatccctgtcctgtgccccccaggctgattgggagggagggcacctggaacactgggcatgatctccagctctgcccttgccctgccaagctccctgccctgttgatgctgaactacagccttgggacaggcaggctttggggctggacgctgtccaggcattcctggtgaggggaaggggaccctgtcatcctgctttatttatttgggtcccaacaccccgcagccgcatgccccttatgtccctcttctccctcttgcatgctttacctgtcccacacccatgccaatgtgccaagtctcccttggggacccagctgagtctgggtgttcccattgggttgggccaggcaaggcctctggtgcccgctgccgtccccctgcagtgggctctgctaggcctgtgctgagcaacagctgttattgtcatggtttataaacaataaactgtgatgccaggcacatctctgccttccctgag

SEQ ID NO: 7869 - DNA, 3127 bp, Homo sapiens
ggggttcgcagccgcagccgggatcgggcacccaggggcgggcgggcacggtagggccatggcagagggtgaggatatgcagaccttcacttccatcatggacgcactggtccgcatcagtgtgagttaagaccagcatgaagaacatggagaaggaactgctgtgcccagtgtgtcaagagatgtacaagcagccactggtgctgccctgtacccacaacgtgtgccaggcctgtgcccgagaggtcttgggccagcagggctacataggacatggtggggaccccagctccgagcccacctctcctgcctccaccccttccacccgcagcccccgcctctcccgcagaactctccccaagccagaccgcctggaccggctgcttaagtcaggctttgggacataccctgggaggaagcgaggtgctttgcacccccaagtgatcatgttcccgtgcccagcctgccaaggtgatgtggagcttggggagcggggtctggcagggcttttccggaacctgaccctggagcgtgtggtggagcggtaccgccagagtgtgagtgtgggaggtgccatcctgtgccagttgtgcaagcccccaccactagaggccaccaagggctgcacagagtgccgcgccaccttctgcaatgagtgcttcaagctcttccacccctggggcacccagaaggcccagcatgagcccaccctgcctaccctctccttccgacccaagggccttatgtgcccagaccacaaggaagaggtgacccactactgcaagacatgccaacgcctggtatgtcaactctgccgggtgcggcgcacccacagcgggcacaagatcacaccagtgctcagtgcctaccaggccctcaaggacaagctgacaaagagcctgacatacatcctgggaaaccaggacacggtacagacccagatctgtgagctggaggaggccgtgaggcacaccgaggtgagtggtcagcaggccaaggaggaggtgtcgcagctggtgcgggggctgggggctgtgctggaggagaagcgggcatcactgcttcaggccattgaagaatgccagcaggagcggctggcccgtctcagcgcccagatccaggagcaccggagcctgctggatggctcaggtctggtgggctatgcccaggaagtacttaaggaaacagaccagccttgctttgtgcaagccgccaagcagctgcacaacaggattgcccgagccactgaagccctccagacattccggccagctgccagctcctccttccgccattgccagctcgacgtgggacgtgagatgaagctgctgacagagcttaacttcctgcgagtgcctgaggcccccgtcattgacacccagcgcacctttgcctatgatcagatcttcctgtgctggcggctgcccccccattcaccacctgcctggcactataccgttgagttccggcgcacggatgtgcctgctcagccaggccccacccgctggcagcggcgggaggaggtgaggggcaccagtgccctgcttgagaaccccgacacgggctctgtgtatgtgctgcgtgtccgcggctgcaacaaggccggctacggcgaatacagtgaagatgtgcacctgcacacgcccccggcacctgtcctgcacttcttcctcgatagccgctggggcgcaagccgagagcggctggctatcagcaaggaccagcgagcagtacggagtgttccagggctgcccctgctgctggctgctgaccggctgctgaccggctgccacctgagtgtggatgtggtcctgggcgacgtggctgtgacccagggccgcagctactgggcctgcgccgtagacccagcctcctacttggtcaaggtgggcgtcgggctggagagcaagcttcaagaaagtttccagggtgcccccgatgtgatcagccccaggtacgacccggacagcgggcacgacagcggtgccgaggatgccacagtggaggcgtcgccacccttcgctttcctaaccattggcatgggcaagatcctgctggggtcgggggcaagctcaaacgcagggctgacagggagggatggccccacagccggctgcacagtgcccctgccaccccgcctgggcatctgcctggactatgagcggggccgggtttccttcctggatgctgtttccttccgtgggctcttggagtgccccctggactgctcagggcctgtgtgccctgccttttgcttcatcgggggtggcgcagtacagctccaggagccagtgggcactaagcctgagaggaaagtcaccattgggggcttcgccaagctggactgagccttccaggcccctcatgcagacctggggtcctcctgggccctggcccccaaacctcttggcacccggttgttaccccctggcagcttctcccccaaactctcctaccatgtggccctgctccttctcccgtgtctgtcttcccacagttttctcttgacccaggggctctcttctgcccacctctctggatggcccccgttctctccattgcttgttagccaggcccccacccccactgagtctgccctatgacctgcctttggcatgttacccaagccatggagagagccccttctccatccctgtcctgtgccccccaggctgattgggagggagggcacctggaacactgggcatgatctccagctctgcccttgccctgccaagctccctgccctgttgatgctgaactacagccttgggacaggcaggctttggggctggacgctgtccaggcattcctggtgaggggaaggggaccctgtcatcctgctttatttatttgggtcccaacaccccgcagccgcatgccccttatgtccctcttctccctcttgcatgctttacctgtcccacacccatgccaatgtgccaagtctcccttggggacccagctgagtctgggtgttcccattgggttgggccaggcaaggcctctggtgcccgctgccgtccccctgcagtgggctctgctaggcctgtgctgagcaacagctgttattgtcatggtttataaacaataaactgtgatgccaggcacatctctgccttccctg

SEQ ID NO: 7870 - DNA, 2666 bp, Homo sapiens
attaagcccggggttcgcagccgcagccgggatcgggcacccaggggcgggcgggcacggtagggccatggcagagggtgaggatatgcagaccttcacttccatcatggacgcactggtccgcatcagtaccagcatgaagaacatggagaaggaactgctgtgcccagtgtgtcaagagatgtacaagcagccactggtgctgccctgtacccacaacgtgtgccaggcctgtgcccgagaggtcttgggccagcagggctacataggacatggtggggaccccagctccgagcccacctctcctgcctccaccccttccacccgcagcccccgcctctcccgcagaactctccccaagccagaccgcctggaccggctgcttaagtcaggctttgggacataccctgggaggaagcgaggtgctttgcacccccaagtgatcatgttcccgtgcccagcctgccaaggtgatgtggagcttggggagcggggtctggcagggcttttccggaacctgaccctggagcgtgtggtggagcggtaccgccagagtgtgagtgtgggaggtgccatcctgtgccagttgtgcaagcccccaccactagaggccaccaagggctgcacagagtgccgcgccaccttctgcaatgagtgcttcaagctcttccacccctggggcacccagaaggcccagcatgagcccaccctgcctaccctctccttccgacccaagggccttatgtgcccagaccacaaggaagaggtgacccactactgcaagacatgccaacgcctggtatgtcaactctgccgggtgcggcgcacccacagcgggcacaagatcacaccagtgctcagtgcctaccaggccctcaaggacaagctgacaaagagcctgacatacatcctgggaaaccaggacacggtacagacccagatctgtgagctggaggaggccgtgaggcacaccgaggtgagtggtcagcaggccaaggaggaggtgtcgcagctggtgcgggggctgggggctgtgctggaggagaagcgggcatcactgcttcaggccattgaagaatgccagcaggagcggctggcccgtctcagcgcccagatccaggagcaccggagcctgctggatggctcaggtctggtgggctatgcccaggaagtacttaaggaaacagaccagccttgctttgtgcaagccgccaagcagctgcacaacaggattgcccgagccactgaagccctccagacattccggccagctgccagctcctccttccgccattgccagctcgacgtgggacgtgagatgaagctgctgacagagcttaacttcctgcgagtgcctgaggcccccgtcattgacacccagcgcacctttgcctatgatcagatcttcctgtgctggcggctgcccccccattcaccacctgcctggcactataccgttgagttccggcgcacggatgtgcctgctcagccaggccccacccgctggcagcggcgggaggaggtgaggggcaccagtgccctgcttgagaaccccgacacgggctctgtgtatgtgctgcgtgtccgcggctgcaacaaggccggctacggcgaatacagtgaagatgtgcacctgcacacgcccccggcacctgtcctgcacttcttcctcgatagccgctggggcgcaagccgagagcggctggctatcagcaaggaccagcgagcagtacggagtgttccagggctgcccctgctgctggctgctgaccggctgctgaccggctgccacctgagtgtggatgtggtcctgggcgacgtggctgtgacccagggccgcagctactgggcctgcgccgtagacccagcctcctacttggtcaaggtgggcgtcgggctggagagcaagcttcaagaaagtttccagggtgcccccgatgtgatcagccccaggtcagacccctctggaagggatggggtgtgggggtcctggtgggagtgaggggcacagaaggggtggcaagtggagcacagacttgctagggtggggctgggaggggattaggaggaagtagtaggagcctggaagccaggctgggaggcctgtgtccaggagacgcatgggctcagcaaaagggcttttgaggactgattttcagagcatgtcgtgtggtcagggaaagggatgatagaagagggagccatctctgcttccttccaaccatctgtcactctggatcaacacaccatctctccaagcatctgtgtcctttcttcctaacactccatttccaacataccttctccataaaacctttgctctccaagacctccttcacccgtatcttaaaattcttcccttagccggatgcggtggctcacgcctgtaatcccagcactttgggaggctgaggcaggcaaatcactggaggtcgagagttcgagaccagcttgaccaacatggagtgaccccatctctactaaaaatacaaaaaaaatagctgggcgtggtagcgcatgcctgtaaccccggctactcgtgaggctgaggcaggagaatcacttgaacccgggaggtggaggttgcggtgagccaagattgtgtcattgcactgcagcctgggcgacaaaagcaaaactccttctcaaaaaaaaaaaaaaaaaaa

SEQ ID NO: 7871 - DNA, 1864 bp, Homo sapiens
cacacccccactgggctcctgcattaagcccggggttcgcagccgcagccgggatcgggcacccaggggcgggcgggcacggtagggccatggcagagggtgaggatatgcagaccttcacttccatcatggacgcactggtccgcatcagtaccagcatgaagaacatggagaaggaactgctgtgcccagtgtgtcaagagatgtacaagcagccactggtgctgccctgtacccacaacgtgtgccaggcctgtgcccgagaggtcttgggccagcagggctacataggacatggtggggaccccagctccgagcccacctctcctgcctccaccccttccacccgcagcccccgcctctcccgcagaactctccccaagccagaccgcctggaccggctgcttaagtcaggctttgggacataccctgggaggaagcgaggtgctttgcacccccaagtgatcatgttcccgtgcccagcctgccaaggtgatgtggagcttggggagcggggtctggcagggcttttccggaacctgaccctggagcgtgtggtggagcggtaccgccagagtgtgagtgtgggaggtgccatcctgtgccagttgtgcaagcccccaccactagaggccaccaagggctgcacagagtgccgcgccaccttctgcaatgagtgcttcaagctcttccacccctggggcacccagaaggcccagcatgagcccaccctgcctaccctctccttccgacccaagggccttatgtgcccagaccacaaggaagaggtgacccactactgcaagacatgccaacgcctggtatgtcaactctgccgggtgcggcgcacccacagcgggcacaagatcacaccagtgctcagtgcctaccaggccctcaaggacaagctgacaaagagcctgacatacatcctgggaaaccaggacacggtacagacccagatctgtgagctggaggaggccgtgaggcacaccgaggtgagtggtcagcaggccaaggaggaggtgtcgcagctggtgcgggggctgggggctgtgctggaggagaagcgggcatcactgcttcaggccattgaagaatgccagcaggagcggctggcccgtctcagcgcccagatccaggagcaccggagcctgctggatggctcaggtctggtgggctatgcccaggaagtacttaaggaaacagaccagccttgctttgtgcaagccgccaagcagctgcacaacaggattgcccgagccactgaagccctccagacattccggccagctgccagctcctccttccgccattgccagctcgacgtgggacgtgagatgaagctgctgacagagcttaacttcctgcgagtgcctgaggcccccgtcattgacacccagcgcacctttgcctatgatcagatcttcctgtgctggcggctgcccccccattcaccacctgcctggcactataccgttgagttccggcgcacggatgtgcctgctcagccaggccccacccgctggcagcggcgggaggaggtgaggggcaccagtgccctgcttgagaaccccgacacgggctctgtgtatgtgctgcgtgtccgcggctgcaacaaggccggctacggcgaatacagtgaagatgtgcacctgcacacgcccccggcacctggaatacaaaacttagccaggcgtggtggtgcgtgcctacaattccagctactcgggaggctgaggtaggagaatcgcttgaacctgggaggcggaggttgcagtgagctgagatcgcgccactggactccagcctggacaacagagcaagactccgacgtctcggaaaaataaataaataaataaat

SEQ ID NO: 7872 - DNA, 3180 bp, Homo sapiens
cccactgggctcctgcattaagcccggggttcgcagccgcagccgggatcgggcacccaggggcgggcgggcacggtagggccatggcagagggtgaggatatgcagaccttcacttccatcatggacgcactggtccgcatcagtaccagcatgaagaacatggagaaggaactgctgtgcccagtgtgtcaagagatgtacaagcagccactggtgctgccctgtacccacaacgtgtgccaggcctgtgcccgagaggtcttgggccagcagggctacataggacatggtggggaccccagctccgagcccacctctcctgcctccaccccttccacccgcagcccccgcctctcccgcagaactctccccaagccagaccgcctggaccggctgcttaagtcaggctttgggacataccctgggaggaagcgaggtgctttgcacccccaagtgatcatgttcccgtgcccagcctgccaaggtgatgtggagcttggggagcggggtctggcagggcttttccggaacctgaccctggagcgtgtggtggagcggtaccgccagagtgtgagtgtgggaggtgccatcctgtgccagttgtgcaagcccccaccactagaggccaccaagggctgcacagagtgccgcgccaccttctgcaatgagtgcttcaagctcttccacccctggggcacccagaaggcccagcatgagcccaccctgcctaccctctccttccgacccaagggccttatgtgcccagaccacaaggaagaggtgacccactactgcaagacatgccaacgcctggtatgtcaactctgccgggtgcggcgcacccacagcgggcacaagatcacaccagtgctcagtgcctaccaggccctcaaggacaagctgacaaagagcctgacatacatcctgggaaaccaggacacggtacagacccagatctgtgagctggaggaggccgtgaggcacaccgaggtgagtggtcagcaggccaaggaggaggtgtcgcagctggtgcgggggctgggggctgtgctggaggagaagcgggcatcactgcttcaggccattgaagaatgccagcaggagcggctggcccgtctcagcgcccagatccaggagcaccggagcctgctggatggctcaggtctggtgggctatgcccaggaagtacttaaggaaacagaccagccttgctttgtgcaagccgccaagcagctgcacaacaggattgcccgagccactgaagccctccagacattccggccagctgccagctcctccttccgccattgccagctcgacgtgggacgtgagatgaagctgctgacagagcttaacttcctgcgaggctgtggccaccgcggactctgctccggagcaccccagtgcctgaggcccccgtcattgacacccagcgcacctttgcctatgatcagatcttcctgtgctggcggctgcccccccattcaccacctgcctggcactataccgttgagttccggcgcacggatgtgcctgctcagccaggccccacccgctggcagcggcgggaggaggtgaggggcaccagtgccctgcttgagaaccccgacacgggctctgtgtatgtgctgcgtgtccgcggctgcaacaaggccggctacggcgaatacagtgaagatgtgcacctgcacacgcccccggcacctgtcctgcacttcttcctcgatagccgctggggcgcaagccgagagcggctggctatcagcaaggaccagcgagcagtacggagtgttccagggctgcccctgctgctggctgctgaccggctgctgaccggctgccacctgagtgtggatgtggtcctgggcgacgtggctgtgacccagggccgcagctactgggcctgcgccgtagacccagcctcctacttggtcaaggtgggcgtcgggctggagagcaagcttcaagaaagtttccagggtgcccccgatgtgatcagccccaggtacgacccggacagcgggcacgacagcggtgccgaggatgccacagtggaggcgtcgccacccttcgctttcctaaccattggcatgggcaagatcctgctggggtcgggggcaagctcaaacgcagggctgacagggagggatggccccacagccggctgcacagtgcccctgccaccccgcctgggcatctgcctggactatgagcggggccgggtttccttcctggatgctgtttccttccgtgggctcttggagtgccccctggactgctcagggcctgtgtgccctgccttttgcttcatcgggggtggcgcagtacagctccaggagccagtgggcactaagcctgagaggaaagtcaccattgggggcttcgccaagctggactgagccttccaggcccctcatgcagacctggggtcctcctgggccctggcccccaaacctcttggcacccggttgttaccccctggcagcttctcccccaaactctcctaccatgtggccctgctccttctcccgtgtctgtcttcccacagttttctcttgacccaggggctctcttctgcccacctctctggatggcccccgttctctccattgcttgttagccaggcccccacccccactgagtctgccctatgacctgcctttggcatgttacccaagccatggagagagccccttctccatccctgtcctgtgccccccaggctgattgggagggagggcacctggaacactgggcatgatctccagctctgcccttgccctgccaagctccctgccctgttgatgctgaactacagccttgggacaggcaggctttggggctggacgctgtccaggcattcctggtgaggggaaggggaccctgtcatcctgctttatttatttgggtcccaacaccccgcagccgcatgccccttatgtccctcttctccctcttgcatgctttacctgtcccacacccatgccaatgtgccaagtctcccttggggacccagctgagtctgggtgttcccattgggttgggccaggcaaggcctctggtgcccgctgccgtccccctgcagtgggctctgctaggcctgtgctgagcaacagctgttattgtcatggtttataaacaataaactgtgatgccaggcacatctctgccttccctg

SEQ ID NO: 7873 - DNA, 2444 bp, Homo sapiens
cccaccccctaccccgacgggcgctgttcgaggctggtcccgggagcatgcgcagtgacacctcaacccccagccctcctcacacccccactgggctcctgcattaagcccggggttcgcagccgcagccgggatcgggcacccaggggcgggcgggcacggtagggccatggcagagggtgaggatatgcagaccttcacttccatcatggacgcactggtccgcatcagtctgcgcccctgaccgggatggctgcgaagagagggaccaagaccagcatgaagaacatggagaaggaactgctgtgcccagtgtgtcaagagatgtacaagcagccactggtgctgccctgtacccacaacgtgtgccaggcctgtgcccgagaggtcttgggccagcagggctacataggacatggtggggaccccagctccgagcccacctctcctgcctccaccccttccacccgcagcccccgcctctcccgcagaactctccccaagccagaccgcctggaccggctgcttaagtcaggctttgggacataccctgggaggaagcgaggtgctttgcacccccaagtgatcatgttcccgtgcccagcctgccaaggtgatgtggagcttggggagcggggtctggcagggcttttccggaacctgaccctggagcgtgtggtggagcggtaccgccagagtgtgagtgtgggaggtgccatcctgtgccagttgtgcaagcccccaccactagaggccaccaagggctgcacagagtgccgcgccaccttctgcaatgagtgcttcaagctcttccacccctggggcacccagaaggcccagcatgagcccaccctgcctaccctctccttccgacccaagggccttatgtgcccagaccacaaggaagaggtgacccactactgcaagacatgccaacgcctggtatgtcaactctgccgggtgcggcgcacccacagcgggcacaagatcacaccagtgctcagtgcctaccaggccctcaaggacaagctgacaaagagcctgacatacatcctgggaaaccaggacacggtacagacccagatctgtgagctggaggagaagcgggcatcactgcttcaggccattgaagaatgccagcaggagcggctggcccgtctcagcgcccagatccaggagcaccggagcctgctggatggctcaggtctggtgggctatgcccaggaagtacttaaggaaacagaccagccttgctttgtgcaagccgccaagcagctgcacaacaggattgcccgagccactgaagccctccagacattccggccagctgccagctcctccttccgccattgccagctcgacgtgggacgtgagatgaagctgctgacagagcttaacttcctgcgagtgcctgaggcccccgtcattgacacccagcgcacctttgcctatgatcagatcttcctgtgctggcggctgcccccccattcaccacctgcctggcactataccgttgagttccggcgcacggatgtgcctgctcagccaggccccacccgctggcagcggcgggaggaggtgaggggcaccagtgccctgcttgagaaccccgacacgggctctgtgtatgtgctgcgtgtccgcggctgcaacaaggccggctacggcgaatacagtgaagatgtgcacctgcacacgcccccggcacctgtcctgcacttcttcctcgatagccgctggggcgcaagccgagagcggctggctatcagcaaggaccagcgagcagtacggagtgttccagggctgcccctgctgctggctgctgaccggctgctgaccggctgccacctgagtgtggatgtggtcctgggcgacgtggctgtgacccagggccgcagctactgggcctgcgccgtagacccagcctcctacttggtcaaggtgggcgtcgggctggagagcaagcttcaagaaagtttccagggtgcccccgatgtgatcagccccaggtacgacccggacagcgggcacgacagcggtgccgaggatgccacagtggaggcgtcgccacccttcgctttcctaaccattggcatgggcaagatcctgctggggtcgggggcaagctcaaacgcagggctgacagggagggatggccccacagccggctgcacagtgcccctgccaccccgcctgggcatctgcctggactatgagcggggccgggtttccttcctggatgctgtttccttccgtgggctcttggagtgccccctggactgctcagggcctgtgtgccctgccttttgcttcatcgggggtggcgcagtacagctccaggagccagtgggcactaagcctgagaggaaagtcaccattgggggcttcgccaagctggactgagccttccaggcccctcatgcagacctggggtcctcctgggc

SEQ ID NO: 7874 - DNA, 1858 bp, Homo sapiens
ataatgcgtcgagggggcatcctcggccaccgccctggtcctcaggctttcctcgtacctggtgcgtctgctgccactctgtacaagaccagcatgaagaacatggagaaggaactgctgtgcccagtgtgtcaagagatgtacaagcagccactggtgctgccctgtacccacaacgtgtgccaggcctgtgcccgagaggtcttgggccagcagggctacataggacatggtggggaccccagctccgagcccacctctcctgcctccaccccttccacccgcagcccccgcctctcccgcagaactctccccaagccagaccgcctggaccggctgcttaagtcaggctttgggacataccctgggaggaagcgaggtgctttgcacccccaagtgatcatgttcccgtgcccagcctgccaaggtgatgtggagcttggggagcggggtctggcagggcttttccggaacctgaccctggagcgtgtggtggagcggtaccgccagagtgtgagtgtgggaggtgccatcctgtgccagttgtgcaagcccccaccactagaggccaccaagggctgcacagagtgccgcgccaccttctgcaatgagtgcttcaagctcttccacccctggggcacccagaaggcccagcatgagcccaccctgcctaccctctccttccgacccaagggccttatgtgcccagaccacaaggaagaggtgacccactactgcaagacatgccaacgcctggtatgtcaactctgccgggtgcggcgcacccacagcgggcacaagatcacaccagtgctcagtgcctaccaggccctcaaggacaagctgacaaagagcctgacatacatcctgggaaaccaggacacggtacagacccagatctgtgagctggaggaggccgtgaggcacaccgaggtgagtggtcagcaggccaaggaggaggtgtcgcagctggtgcgggggctgggggctgtgctggaggagaagcgggcatcactgcttcaggccattgaagaatgccagcaggagcggctggcccgtctcagcgcccagatccaggagcaccggagcctgctggatggctcaggtctggtgggctatgcccaggaagtacttaaggaaacagaccagccttgctttgtgcaagccgccaagcagctgcacaacaggattgcccgagccactgaagccctccagacattccggccagctgccagctcctccttccgccattgccagctcgacgtgggacgtgagatgaagctgctgacagagcttaacttcctgcgaggctgtggccaccgcggactctgctccggagcaccccagtgcctgaggcccccgtcattgacacccagcgcacctttgcctatgatcagatcttcctgtgctggcggctgcccccccattcaccacctgcctggcactataccgttgagttccggcgcacggatgtgcctgctcagccaggccccacccgctggcagcggcgggaggaggtgaggggcaccagtgccctgcttgagaaccccgacacgggctctgtgtatgtgctgcgtgtccgcggctgcaacaaggccggctacggcgaatacagtgaagatgtgcacctgcacacgcccccggcacctgtcctgcacttcttcctcgatagccgctggggcgcaagccgagagcggctggctatcagcaaggaccagcgagcagtacggagtgttccagggctgcccctgctgctggctgctgaccggctgctgaccggctgccacctgagtgtggatgtggtcctgggcgacgtggctgtgacccagggccgcagctactgggcctgcgccgtaga

SEQ ID NO: 7875 - DNA, 2389 bp, Homo sapiens
acacccccactgggctcctgcattaagcccggggttcgcagccgcagccgggatcgggcacccaggggcgggcgggcacggtagggccatggcagagggtgaggatatgcagaccttcacttccatcatggacgcactggtccgcatcagtgctttgggacataccctgggaggaagcgaggtgctttgcacccccaagtgatcatgttcccgtgcccagcctgccaaggtgatgtggagcttggggagcggggtctggcagggcttttccggaacctgaccctggagcgtgtggtggagcggtaccgccagagtgtgagtgtgggaggtgccatcctgtgccagttgtgcaagcccccaccactagaggccaccaagggctgcacagagtgccgcgccaccttctgcaatgagtgcttcaagctcttccacccctggggcacccagaaggcccagcatgagcccaccctgcctaccctctccttccgacccaagggccttatgtgcccagaccacaaggaagaggtgacccactactgcaagacatgccaacgcctggtatgtcaactctgccgggtgcggcgcacccacagcgggcacaagatcacaccagtgctcagtgcctaccaggccctcaaggacaagctgacaaagagcctgacatacatcctgggaaaccaggacacggtacagacccagatctgtgagctggaggaggccgtgaggcacaccgaggtgagtggtcagcaggccaaggaggaggtgtcgcagctggtgcgggggctgggggctgtgctggaggagaagcgggcatcactgcttcaggccattgaagaatgccagcaggagcggctggcccgtctcagcgcccagatccaggagcaccggagcctgctggatggctcaggtctggtgggctatgcccaggaagtacttaaggaaacagaccagccttgctttgtgcaagccgccaagcagctgcacaacaggattgcccgagccactgaagccctccagacattccggccagctgccagctcctccttccgccattgccagctcgacgtgggacgtgagatgaagctgctgacagagcttaacttcctgcgagtgcctgaggcccccgtcattgacacccagcgcacctttgcctatgatcagatcttcctgtgctggcggctgcccccccattcaccacctgcctggcactataccgttgagttccggcgcacggatgtgcctgctcagccaggccccacccgctggcagcggcgggaggaggtgaggggcaccagtgccctgcttgagaaccccgacacgggctctgtgtatgtgctgcgtgtccgcggctgcaacaaggccggctacggcgaatacagtgaagatgtgcacctgcacacgcccccggcacctgtcctgcacttcttcctcgatagccgctggggcgcaagccgagagcggctggctatcagcaaggaccagcgagcagtacggagtgttccagggctgcccctgctgctggctgctgaccggctgctgaccggctgccacctgagtgtggatgtggtcctgggcgacgtggctgtgacccagggccgcagctactgggcctgcgccgtagacccagcctcctacttggtcaaggtgggcgtcgggctggagagcaagcttcaagaaagtttccagggtgcccccgatgtgatcagccccaggtacgacccggacagcgggcacgacagcggtgccgaggatgccacagtggaggcgtcgccacccttcgctttcctaaccattggcatgggcaagatcctgctggggtcgggggcaagctcaaacgcagggctgacagggagggatggccccacagccggctgcacagtgcccctgccaccccgcctgggcatctgcctggactatgagcggggccgggtttccttcctggatgctgtttccttccgtgggctcttggagtgccccctggactgctcagggcctgtgtgccctgccttttgcttcatcgggggtggcgcagtacagctccaggagccagtgggcactaagcctgagaggaaagtcaccattgggggcttcgccaagctggactgagccttccaggcccctcatgcagacctggggtcctcctgggccctggcccccaaacctcttggcacccggttgttaccccctggcagcttctcccccaaactctcctaccatgtggccctgctccttctcccgtgtctgtcttcccacagttttctcttgacccaggggctctcttctgcccacctctctggatggcccccgttctctccattgcttgttagccaggcccccacccccactgagtctgccctatgacctgcctttggcatgttacccaagccat

SEQ ID NO: 7876 - DNA, 1445 bp, Homo sapiens
cttagagggagctgtgttttggtgacctctgaaactcagtactgcagcgaatgagctcctgaccttgaggagtacttaacagaattatgtctcgaagaatcattgtgggaacccttcaaagaacccagcgaaacatgaattctggaatctcgcaagtcttccagagggaactcacctgccccatctgcatgaactacttcatagacccggtcaccatagactgtgggcacagcttttgcaggccctgtttctacctcaactggcaagacatcccaattcttactcagtgctttgaatgcataaagacaatacagcagagaaacctcaaaactaacattcgattgaagaagatggcttcccttgccagaaaagccagtctctggctattcctgagctctgaggagcaaatgtgtggcattcacagggagacaaagaagatgttctgtgaagtggacaggagcctgctctgtttgctgtgctccagctctcaggagcaccggtatcacagacactgtcccgctgagtgggctgctgaggaacactgggagaagcttttaaagaaaatgcagtctttatgggaaaaagcttgtgaaaatcagagaaacctgaatgtggaaaccaccagaatcagccactggaaggcttttggagacatattatacaggagtgagtccgtgctgctgcacatgccccagcctctgaatctagcgctcagggcagggcccatcactggactgagggacaggctcaaccaattctgagtggatattactctgcatcacaatgaagccaacagtcatatcttccgatgtggagatttgagaagcatttgtattggatgtgaccgtcaaaatccgccccatatcactgcaacacctacaagttttcttgcatggggtgctcagactttcacctctggcaaatattactgggaggtccatgtgggggactcttggaattgggcttttggtgtctgtaataagtattggaaagggaagaatcagaatggcaatatatatggagaggagggactctttagtcttgggtgtgttaagaacgacattcagtgcagtctctttaccacctccccaattacactgcagtatgtcccaagacctaccaaccatgtagaattattcctggattgtgaagctagaactgtgagcttcgttgatgttagtcaaagctcccctatatacaccatccctaattgctccttctcacttcctctcagacctatctttttctgtattctcctctgaccagagacaaatcagaaatgtgttcatctgctgtgggaacccctttatcccagaaagccctcttccttgtgccttatcaaacaggacaaataggttcggttttatgtcttgaattgcattctaatgttattaaaactcatttattgtgttactattaaatgtagtaaaaacactaaaagtata

SEQ ID NO: 7877 - DNA, 2163 bp, Homo sapiens
ctaatcttccagttgccccctattgactttaaaccaaagctttgattcatgaccactgggatccagccagcgggggatttcttttcctgatggactgtacccaggatctcacatttgcttaagcagctcccacaattgggttcttataaaaggacacggaagagacaagctcagttttctctgaaggagaaggactgcacttagaactgcattttggcgacctctgaaattcagtactgcagtgaatgagcttctgatcttgaggtgaacttaacaaaattatttttggaaaaatcgttgtgggaaccattaaaagaactccaggaaacatgaattctggaatcttacaggtctttcagggggaactcatctgccccctgtgcatgaactacttcatagacccggtcaccatagactgtgggcacagcttttgcaggccttgtttctacctcaactggcaagacatcccatttcttgtccagtgctctgaatgcacaaagtcaaccgagcagataaacctcaaaaccaacattcatttgaagaagatggcttctcttgccagaaaagtcagtctctggctattcctgagctctgaggagcaaatgtgtggcactcacagggagacaaagaagatattctgtgaagtggacaggagcctgctctgtttgctgtgctccagctctcaggagcaccggtatcacagacaccgtcccattgagtgggctgctgaggaacaccgggagaagcttttacagaaaatgcagtctttgtgggaaaaagcttgtgaaaatcacagaaacctgaatgtggaaaccaccagaaccagatgctggaaggattatgtgaatttaaggctagaagcaattagagctgagtatcagaagatgcctgcatttcatcatgaagaagaaaaacataatttggagatgctgaaaaagaaggggaaagaaatttttcatcgacttcatttaagtaaagccaaaatggctcataggatggagattttaagaggaatgtatgaggagctgaacgaaatgtgccataaaccagatgtggagctacttcaggcttttggagacatattacacaggagtgagtccgtgctgctgcacatgccccagcctctgaatccagagctcagtgcagggcccatcactggactgagggacaggctcaaccaattccgagtgcatattactctgcatcatgaagaagccaacaatgatatctttctgtatgaaattttgagaagcatgtgtattggatgtgaccatcaagatgtaccctatttcactgcaacacctagaagttttcttgcatggggtgttcagactttcacctcgggcaaatattactgggaggtccatgtaggggactcctggaattgggcttttggtgtctgtaatatgtatcggaaagagaagaatcagaatgagaagatagatggaaaggcgggactctttcttcttgggtgtgttaagaatgacattcaatgcagtctctttaccacctccccacttatgctgcaatatatcccaaaacctaccagccgagtaggattattcctggattgtgaggctaagactgtgagctttgttgatgttaatcaaagctccctaatatacaccatccctaattgctctttctcacctcctctcaggcctatcttttgctgtattcacttctgaccagagacaaatcagaaatgtgttcacatgctgtgggaacccctttatcccaggaagtcctcttccttgtgccttaacatacaggacaaataggctctattttatgtcttgaattgccttctaatgttatcaaaactcatttattgtgttactattaaatatgctgaaaacgctaaaagtatacgtattggttctttattaaataatttttgaaaaatcattattcatgatcatggcatacagtatattctcttttttttctttatttatgactgtcactgagtgaaataatagatgacagacatgtctgaatgaagtaaaaatcaatggaagacagtcgggatcttttgcttcatgcaaaaaacttggagtgaagtctcaatgataactgggaaatgtttttcttcctctttatctaactatattacacttatccatcaggtttcattgtattaatctatcctttgaggtaata

SEQ ID NO: 7878 - DNA, 1670 bp, Homo sapiens
ctaatcttccagttgccccctattgactttaaaccaaagctttgattcatgaccactgggatccagccagcgggggatttcttttcctggtggactgtacccaggatctcacatttgcttaagcagcccccacaattgggttcttataaaaggacacggaagagacaagctcagttttctctgaaggagaaggactgcacttagaactgcattttggcgacctctgaaattcagtactgcagtgaatgagcttctgaccttgaggtgaacttaacaaaattatttttggaaaaatcgttgtgggaaccattaaaagaactccaggaaacatgaattctggaatcttacaggtctttcagggggaactcatctgccccctgtgcatgaactacttcatagacccggtcaccatagactgtgggcacagcttttgcaggccttgtttctacctcaactggcaagacatcccatttcttgtccagtgctctgaatgcacaaagtcaacagagcagataaacctcaaaaccaacattcatttgaagaagatggcttctcttgccagaaaagtcagtctctggctattcctgagctctgaggagcaaatgtgtggcactcacagggagacaaagaagatattctgtgaagtggacaggagcctgctctgtttgctgtgctccagctctcaggagcaccggtatcacagacaccgtcccattgagtgggctgctgaggaacaccgggagaagcttttacagaaaatgcagtctttgtgggaaaaagcttgtgaaaatcacagaaacctgaatgtggaaaccaccagaaccagatgctggaaggattatgtgaatttaaggctagaagcaattagagctgagtatcagaagatgcctgcatttcatcatgaagaagaaaaacataatttggagatgctgaaaaagaaggggaaagaaatttttcatcgacttcatttaagtaaagccaaaatggctcataggatggagattttaagaggaatgtatgaggagctgaacgaaatgtgccataaaccagatgtggagctacttcaggatttgggagacatggtggcaaggagtgagtccgtgctgctgcacatgctccagcctgtgaatccagagctccctacagggcccatcacaggaccggtggacaggctcaaccacttccgagtggaaatttccttcacttgggaaggaaccaattacaatatcgggctgtttgaggatgtgagaagtttgatgtttagacgtggatctttgaattctgacagatctgactattttgctgcatggggagcctgggtcttctcctctggcaaacactactgggagctggatgtggacaactcttgggactgggctctgggagtctgtaaggactcctggataaggaagaatagcacaatgtttaactctaaggacatatttcttcttttatgtgtgaaggtggataatcatttcagtctcttgaccacctccccaatgtttcctcactatgtagagaaacctctggtccgagttggtgtgtttcttaattttgaaagtggaagtgtgagttttttgaatgtcaccaagaattccctcatatggaattacccagctggctccttaaattttcctgtcaggtctttcttttacactggccacagatga

SEQ ID NO: 7879 - DNA, 2163 bp, Homo sapiens
ctaatcttccagttgccccctattgactttaaaccaaagctttgattcatgaccactgggatccagccagcgggggatttcttttcctggtggactgtacccaggatctcacatttgcttaagcagcccccacaattgggttcttataaaaggacacggaagagacaagctcagttttctctgaaggagaaggactgcacttagaactgcattttggcgacctctgaaattcagtactgcagtgaatgagcttctgaccttgaggtgaacttaacaaaattatttttggaaaaatcgttgtgggaaccattaaaagaactccaggaaacatgaattctggaatcttacaggtctttcagggggaactcatctgccccctgtgcatgaactacttcatagacccggtcaccatagactgtgggcacagcttttgcaggccttgtttctacctcaactggcaagacatcccatttcttgtccagtgctctgaatgcacaaagtcaacagagcagataaacctcaaaaccaacattcatttgaagaagatggcttctcttgccagaaaagtcagtctctggctattcctgagctctgaggagcaaatgtgtggcactcacagggagacaaagaagatattctgtgaagtggacaggagcctgctctgtttgctgtgctccagctctcaggagcaccggtatcacagacaccgtcccattgagtgggctgctgaggaacaccgggagaagcttttacagaaaatgcagtctttgtgggaaaaagcttgtgaaaatcacagaaacctgaatgtggaaaccaccagaaccagatgctggaaggattatgtgaatttaaggctagaagcaattagagctgagtatcagaagatgcctgcatttcatcatgaagaagaaaaacataatttggagatgctgaaaaagaaggggaaagaaatttttcatcgacttcatttaagtaaagccaaaatggctcataggatggagattttaagaggaatgtatgaggagctgaacgaaatgtgccataaaccagatgtggagctacttcaggcttttggagacatattacacaggagtgagtccgtgctgctgcacatgccccagcctctgaatccagagctcagtgcagggcccatcactggactgagggacaggctcaaccaattccgagtgcatattactctgcatcatgaagaagccaacagtgatatctttctgtatgaaattttgagaagcatgtgtattggatgtgaccatcaagatgtaccctatttcactgcaacacctagaagttttcttgcatggggtgttcagactttcacctcgggcaaatattactgggaggtccatgtaggggactcctggaattgggcttttggtgtctgtaatatgtatcggaaggagaagaatcagaatgagaagatagatggaaaggagggactctttcttcttgggtgtattaagaatgacattcaatgcagtctctttaccacctccccacttatgctgcaatatatcccaaaacctaccagccgagtaggattattcctggattgtgaggctaagactgtgagctttgttgatgttaatcaaagctccctaatatacaccatccctaattgctctttctcacctcctctcaggcctatcttttgctgtattcacttctgaccagagacaaatcagaaatgtgttcacatgctgtgggaacccctttatcccaggaagtcctcttccttgtgccttaacatacaggacaaataggctctattttatgtcttgaattgccttctaatgttatcaaaactcatttattgtgttactattaaatatgctgaaaacgctaaaagtatacgtattggttctttattaaataatttttgaaaaatcattattcatgatcatggcatacagtatattctcttttttttctttatttatgactgtcactgagtgaaataatagatgacagacatgtctgaatgaagtaaaaatcaatggaagacagtcgggatcttttgcttcatgcaaaaaacttggagtgaagtctcaatgataactgggaaatgtttttcttcctctttatctaactatattacacttatccatcaggtttcattgtattaatctatcctttgaggtaata

SEQ ID NO: 7880 - DNA, 2241 bp, Homo sapiens
gctgcatctgaggcggacgccgcagtgtagggcacaccctgagggtagcgagagacgtgacaggaccgagcagctgggggctgcagcctgctctgtccccaccgatcccagagagaggctgtgagtctggatctgggcgttcgcaccctgagagagggggtcaaagctcccctgcggccccgaggaagaagagcaaggttgaggacagcctcgggtcaccagagtagtttggaggcaggcctgcaggcgcgtccccgctcctcagctccaagctgacgtatctacacctgccggcgggcattaagatggctggttatgccactactcccagccccatgcagacccttcaggaggaagcggtgtgtgccatctgcttggattacttcaaggaccccgtgtccatcagctgtgggcacaacttctgccgagggtgtgtgacccagctgtggagtaaggaggacgaggaggaccagaacgaggaggaagatgaatgggaggaggaggaggacgaggaagcggtgggggccatggatggatgggacggctccattcgagaggtgttgtatcgggggaatgctgacgaagagttgttccaagaccaagatgacgatgaactctggctcggtgacagtggtataactaattgggacaacgtagactatatgtgggacgaggaggaagaagaagaagaggaagatcaggactattacctaggaggcttgagacctgacctgagaattgatgtctaccgagaagaagaaatactggaagcatacgatgaggacgaagatgaagagctgtatcctgacatccacccgcctccttccttgccccttccagggcagttcacctgcccccagtgccgaaagagctttacacgtcgcagctttcgtcccaacttgcagctggccaacatggtccagataattcgccagatgtgccccactccttatcggggaaaccggagtaatgatcagggcatgtgctttaaacaccaggaagccctgaaactcttctgtgaggtggacaaagaggccatctgtgtggtgtgccgagaatccaggagccacaaacagcacagcgtgctgcctttggaggaggtggtgcaggagtaccaggaaataaagttggaaacaactctggtgggaatacttcagatagagcaagaaagcattcacagcaaggcctataatcagtaagatgtgtgaaaagttgggtagccacaggaggtgttcattaaggatatgattccatttatatagctatttctattgcataaccaggacagttttattgttttgaggtcaatgttcttttaaaatttgattttctgtaagaagaggctttttggcccagaaagccttacttattttacatcttccagtttgtccatcccatgagttagagttcgtcttgactctgcaagctagaatcaaagaattatgaaagtaagatcatttagatttgaccaagggcaccattaaatggtgtcaggttttaggaagcagacgggtgtataaaaagaaaatgaacaaagatttcacttattggggatcaggcataactggatgcctggattgtcctgccacccagctgccaccaataaaatcattcatcactctgcaagagggaccagatgcttccatcatcagtactccttgtttttctgttatctcctttgaggtagctaaaaatggcagccaaaaaaaaatgttgaggcttttctcaagtatatactcatgttattttgcagaagatagggtcaacttcttcagttgagttatctgaaagtgttgggcagtgacaccatgccaaacactgttaaattcatgccattaaaaacagtggagtgttctgcaaagcccgattctctgcagctttaagactggacagtattgaaatattcacaggaatcttccaagccgtgaaagcttaatattaaacagcccttttaattgcaaaggagaaaaaaatggagacacttgtgaaaccttgcattctgagtgctgccacaaataaattaaggaattccagaatttcttcatctacttctgcagtcttaactctgaattaatgactgtatatatcaaacttcagatcttaaaaaacatcagctcgcaagaggctgaggcaggagaatgacatgaacctgggaggcggagcttgcagtaagccgagactgagccactgcactccagcctgggcaatagagcaagactccatctcaaaaaaaaaaaaaaa

SEQ ID NO: 7881 - DNA, 3225 bp, Homo sapiens
gggagacggtgcgggcggccgggagcgcagccctccgggaggcgggtcatggcctgggcgccgcccggggagcggctgcgcgaggatgcgcggtgcccggtgtgcctggatttcctgcaggagccggtcagcgtggactgcggccacagcttctgcctcaggtgcatctccgagttctgcgagaagtcggacggcgcgcagggcggcgtctacgcctgtccgcagtgccggggccccttccggccctcgggctttcgccccaaccggcagctggcgggcctggtggagagcgtgcggcggctggggttgggcgcggggcccggggcgcggcgatgcgcgcggcacggcgaggacctgagccgcttctgcgaggaggacgaggcggcgctgtgctgggtgtgcgacgccggccccgagcacaggacgcaccgcacggcgccgctgcaggaggccgccggcagctaccaggtaaagctccagatggctctggaacttatgaggaaagagttggaggacgccttgactcaggaggccaacgtggggaaaaagactgtcatttggaaggagaaagtggaaatgcagaggcagcgcttcagattggagtttgagaagcatcgtggctttctggcccaggaggagcaacggcagctgaggcggctggaggcggaggagcgagcgacgctgcagagactgcgggagagcaagagccggctggtccagcagagcaaggccctgaaggagctggcggatgagctgcaggagaggtgccagcgcccggccctgggtctgctggagggtgtgagaggagtcctgagcagaagtaaggctgtcacaaggctggaagcagagaacatccccatggaactgaagacagcatgctgcatccctgggaggagggagctcttaaggaagttccaagtggatgtaaagctggatcccgccacggcgcacccgagtctgctcttgaccgccgacctgcgcagtgtgcaggatggagaaccatggagggatgtccccaacaaccctgagcgatttgacacatggccctgcatcctgggtttgcagagcttctcatcagggaggcattactgggaggttctggtgggagaaggagcagagtggggtttaggggtctgtcaagacacactgccaagaaagggggaaaccacgccatctcctgagaatggggtctgggccctgtggctgctgaaagggaatgagtacatggtccttgcctccccatcagtgcctcttctccaactggaaagtcctcgctgcattgggattttcttggactatgaagccggtgaaatttcattctacaatgtcacagatggatcttatatctacacattcaaccaactcttctctggtcttcttcggccttactttttcatctgtgatgcaactcctcttatcttgccacccacaacaatagcagggtcaggaaattgggcatccagggatcatttagatcctgcttctgatgtaagagatgatcatctctaaaattctgttcccaagatgcagtcctagcgtagcgaacgttcctggagtggggtgaaggatatcaatatactaagttttaacagataccccatttaggtcagcacttgattcgttgttgctgtgaaatatgtccatgggacaaaagagggaatatgaaatatttgcatatgggaagattatagagcataataattttgtaaatggagcaatctcaacctctatttctagatcacattttcttgatgtcttccttcaaattaatgaccttggattacataaggatttctatgcattcattataatttgttattcctttcaatatccttgtatttcaaatcttccatataagaattagacatggcaattcttaaattgattcagaatggtctgatactattccagtatcacctccttaattctgtttctcctcgttttcctgattttccttctcattctctccttccccgctctgtctctctctccctgtcactctctctctcttgttccttattttttgtttcttacctcttactgtttaacctgttgcttccttctggattaatacatttagagccattcctttatatggtcacatttcctatgactttactcaattacttttaaaatcctttctattctgagactaatttttaagaattacaaagctcattcttctgaatctaatatcactaactcctagactttttccgttttctttggatacactttaagtaggaatttatcagaattttcattcaactcgttctttaatgcagatatttactagttataagaccttaaggctgggtgcagtggctcacgcctgtaatcccagcactttgggaggctgaggcgggtggatcacaagctcaggagttcaagaccagcctggccaacatggtgaaaccctgtctctactaaaaaaaaaaaaaaaatagaaaaattagctgggcatggtggcaggagcctgtaatcccagctattctggaggtggagacaggagaattgcttgaaccctggaggcggaggttgcagtgagccaatatctcaccactgtactccagcccagtgcgagactccatctcaaaaaagaaaaaagacctcaaacaacacttctctctctcttttagctgcttgttatggttcctatacatggaacaattatactggcctcactgtgttatggtaaatatttaaggtcatatttgatattgctggtttgaattcagcttttccatttaaatacattataatgatgatgatgaaatcatgataatatttaacttatttttaaagtatattctgtacctttccaacaaaaaggttaaaagtcattgaaggctaaccttactgccttctttgtatcactgtcttctaaataattattatgtctgggtacagtggctcacgcctgtaatcccagcactttgggaggccgaggtgggcagatcacgaggtcaggagattgagaccatcctggctaacacagtgaaaccccgtctctactaaaaatacaaaaagaaattagctgggcgtggtggtgggtgcctgttgtcccagctacttgggaggctgaggcaggagaatggcatgaacccaggaggcagagcttgtagtgagccgagatcgcgccactgcactccagccggggcaacagagcaagactccatctcaaaaataaataaataaataaataaataaataaataaataaata

SEQ ID NO: 7882 - DNA, 1500 bp, Homo sapiens
caggtcatcagtttgccccatcattggttaaggtggtattctctacattataaagctcgatggagtttgtgacagccctggtgaacctccaagaggagtctagctgtcccatctgtctggagtacttgaaagacccagtgaccatcaactgtgggcacaacttctgtcgctcctgcctcagtgtatcctggaaggatctagatgatacctttccctgtcctgtctgccgtttttgctttccatacaagagcttcaggaggaacccccagctccgtaatttgactgaaattgctaaacaactccagattaggaggagcaagagaaagaggcagaaagagaatgccatgtgtgaaaaacacaaccagtttctgaccctcttctgtgttaaagatctagagatcttatgtacacagtgcagtttctccactaaacaccagaagcactacatttgccctattaagaaagctgcctcttatcacagagaaattctagaaggtagccttgagcccttgaggaataatatagaacgagttgaaaaagtgataattctgcaaggcagcaaatcagtggagctgaaaaagaaggtagaatataagagggaagaaataaattctgagtttgagcaaataagattgtttttacagaatgaacaagagatgattcttaggcagatacaagatgaagagatgaacattttagcaaaactaaatgaaaaccttgtagaactttcagattatgtttccacattaaaacatctactgagggaggtagagggcaagtctgtgcagtcaaacctggaattactgacacaagctaagagtatgcaccacaagtatcaaaacctaaaatgccctgaactcttttcatttagattaacaaaatatggtttcagtcttcctcctcaatattctggcttggacagaattatcaagccatttcaagtagatgtgattctagatctcaacacagcacatcctcaacttcttgtctctgaggatagaaaagctgtgcgatatgaaagaaaaaaacgaaacatttgttatgacccaaggagattttatgtctgccctgctgtcctaggctctcagagatttagttctggccgacattactgggaagtagaagtgggaaacaaacctaaatggatattgggtgtgtgtcaagactgtcttcttaggaactggcaggatcagccatcagttctgggcggattctgggcaattgggcgatacatgaagagtggttatgttgcgtcaggtcctaagacaacccagcttctgccagtagtaaaacccagtaaaattggtatttttctggactatgaattgggtgatctttccttttataatatgaatgataggtctattctctatacttttaacgattgtttcacagaagccgtttggccttatttctatactggaacagattccgaacctcttaaaatctgctcagtatcagattctgaaagataaggaactggtaaatgggtctgtttca

SEQ ID NO: 7883 - DNA, 389 bp, Homo sapiens
aaactcgaaaaccaaggcgcccagggttgtgtgagggtttccgctctgcgccccgcggggttccatgggtcctgcacagcatcaggcctgagccgccggtccaactgctccagctcgatggagtttgtgacagccctggtgaacctccaagaggagtctagctgtcccatctgtctggagtacttgaaagacccagtgaccatcaactgtgggcacaacttctgtcgctcctgcctcagtgtatcctggaaggatctagatgatacctttccctgtcctgtctgccgtttttgctttccatacaagagcttcaggaggaacccccagctccgtaatttgactgaaattgctaaacaactccagattaggaggagcaagagaaagaggca

SEQ ID NO: 7884 - DNA, 1674 bp, Homo sapiens
caggtcatcagtttgccccatcattggttaaggtggtattctctacattataaagggatgaccgctgtattataacctgtggctagtttattgaagaagaaaatcattacacttagattcagacgggctcggccgggcgcggtggctcacgcctgtaatcccagcactttgggaggccgaggcgggtggatcatgaggtcaggagatcgagaccatcctggctaacaagctcgatggagtttgtgacagccctggtgaacctccaagaggagtctagctgtcccatctgtctggagtacttgaaagacccagtgaccatcaactgtgggcacaacttctgtcgctcctgcctcagtgtatcctggaaggatctagatgatacctttccctgtcctgtctgccgtttttgctttccatacaagagcttcaggaggaacccccagctccgtaatttgactgaaattgctaaacaactccagattaggaggagcaagagaaagaggcagaaagagaatgccatgtgtgaaaaacacaaccagtttctgaccctcttctgtgttaaagatctagagatcttatgtacacagtgcagtttctccactaaacaccagaagcactacatttgccctattaagaaagctgcctcttatcacagagaaattctagaaggtagccttgagcccttgaggaataatatagaacgagttgaaaaagtgataattctgcaaggcagcaaatcagtggagctgaaaaagaaggtagaatataagagggaagaaataaattctgagtttgagcaaataagattgtttttacagaatgaacaagagatgattcttaggcagatacaagatgaagagatgaacattttagcaaaactaaatgaaaaccttgtagaactttcagattatgtttccacattaaaacatctactgagggaggtagagggcaagtctgtgcagtcaaacctggaattactgacacaagctaagagtatgcaccacaagtatcaaaacctaaaatgccctgaactcttttcatttagattaacaaaatatggtttcagtcttcctcctcaatattctggcttggacagaattatcaagccatttcaagtagatgtgattctagatctcaacacagcacatcctcaacttcttgtctctgaggatagaaaagctgtgcgatatgaaagaaaaaaacgaaacatttgttatgacccaaggagattttatgtctgccctgctgtcctaggctctcagagatttagttctggccgacattactgggaagtagaagtgggaaacaaacctaaatggatattgggtgtgtgtcaagactgtcttcttaggaactggcaggatcagccatcagttctgggcggattctgggcaattgggcgatacatgaagagtggttatgttgcgtcaggtcctaagacaacccagcttctgccagtagtaaaacccagtaaaattggtatttttctggactatgaattgggtgatctttccttttataatatgaatgataggtctattctctatacttttaacgattgtttcacagaagccgtttggccttatttctatactggaacagattccgaacctcttaaaatctgctcagtatcagattctgaaagataaggaactggtaaatgggtctgtttca

SEQ ID NO: 7885 - DNA, 1888 bp, Homo sapiens
acttccggtggagcagccaaccaccgcgctggtcaattgtatgcctaaaactcgaaaaccaaggcgcccagggttgtgtgagggtttccgctctgcgccccgcggggttccatgggtcctgcacagcatcaggcctgagccgccggtccaactgctccaggtcatcagtttgccccatcattggttaaggtggtattctctacattataaagctcgatggagtttgtgacagccctggtgaacctccaagaggagtctagctgtcccatctgtctggagtacttgaaagacccagtgaccatcaactgtgggcacaacttctgtcgctcctgcctcagtgtatcctggaaggatctagatgatacctttccctgtcctgtctgccgtttttgctttccatacaagagcttcaggaggaacccccagctccgtaatttgactgaaattgctaaacaactccagattaggaggagcaagagaaagaggcagaaagagaatgccatgtgtgaaaaacacaaccagtttctgaccctcttctgtgttaaagatctagagatcttatgtacacagtgcagtttctccactaaacaccagaagcactacatttgccctattaagaaagctgcctcttatcacagagaaattctagaaggtagccttgagcccttgaggaataatatagaacgagttgaaaaagtgataattctgcaaggcagcaaatcagtggagctgaaaaagaaggtagaatataagagggaagaaataaattctgagtttgagcaaataagattgtttttacagaatgaacaagagatgattcttaggcagatacaagatgaagagatgaacattttagcaaaactaaatgaaaaccttgtagaactttcagattatgtttccacattaaaacatctactgagggaggtagagggcaagtctgtgcagtcaaacctggaattactgacacaagctaagagtatgcaccacaagtatcaaaacctaaaatgccctgaactcttttcatttagattaacaaaatatggtttcagtcttcctcctcaatattctggcttggacagaattatcaagccatttcaagtagatgtgattctagatctcaacacagcacatcctcaacttcttgtctctgaggatagaaaagctgtgcgatatgaaagaaaaaaacgaaacatttgttatgacccaaggagattttatgtctgccctgctgtcctaggctctcagagatttagttctggccgacattactgggaagtagaagtgggaaacaaacctaaatggatattgggtgtgtgtcaagactgtcttcttaggaactggcaggatcagccatcagttctgggcggattctgggcaattgggcgatacatgaagagtggttatgttgcgtcaggtcctaagacaacccagcttctgccagtagtaaaacccagtaaaattggtatttttctggactatgaattgggtgatctttccttttataatatgaatgataggtctattctctatacttttaacgattgtttcacagaagccgtttggccttatttctatactggaacagattccgaacctcttaaaatctgctcagtatcagattctgaaagataaggaactggtaaatgggtctgtttcagtttttgtaggtaacttagccagtaaatttaatctcatttctggactctttaagttttaccactgaaaaccagagtcgatttttctcctaaatttttggcaactataagatgttcataatgccactttcatatattctatgaatatcaattgtcaggtgctttgatttctaagataaaatattttagaattatgttacttaacatgtccaataaaatgttttcaaattgcc

SEQ ID NO: 7886 - DNA, 1582 bp, Homo sapiens
aactgccaaccaccgcgcaggctgagccccaggcaggaagcagcccacttggtggggttggggtatgagtccttcctcgcgggggctcggtgggtcctgagtattctttggccggatttgctgatccgtctgctccagcataggttcacaaagtacagtccgcaggccagcagcatcatctgggaacttaggaaaaaaccagccctactgagtcagaaactggggatgtggcccaggcaatcttttaccaagacctccaggtgattataatgcaaggaaggattccctatcttggacctgaggctgctttcttgaagaaaacttgactttatttcatttagtgggaagagcagcagcccagctattaagttctaatatgcaataggctgcaggctgtgaagtgttcgtggcagtagactctgaagctaaggagctgagggcttaacaagtttctagaagctgccatcaacatgccaagtcagtaaaactgatagttgatcagatttcaaggtctggggagtatatccactgtgtactgggtcttgagctctagagagctaggccttgctaaaataaaagaattaccttacctaccatctttgttcaagtctcaatggaatttgttacggccctggctgacctccgagcagaggctagctgtcccatctgtctggactacttgaaagacccagtgaccatcagctgtgggcataacttctgtctctcctgcatcattatgtcctggaaggatctacatgatagtttcccctgccccttttgccacttttgctgtccagaaaggaaatttataagcaatccccagctgggtagtttgactgaaattgctaagcaactccagataagaagcaagaagaggaagaggcaggaagagaagcatgtgtgtaagaagcataatcaggttttgactttcttctgtcagaaagacctagagcttttatgtccaaggtgcagtttgtccactgatcaccagcatcactgtgtttggcccataaagaaggctgcctcctatcataggaaaaaactggaggaatacaatgcaccgtggaaggagagagtggaactaattgaaaaagtcataactatgcaaaccaggaaatcactggaactgaagaaaaagatggagtctccttctgtcaccaggctggagtgcagttgcacgatctcggctcacttcaacctccgcctcccgggatcaagcgattcttctgcctctggctcctgagtagctgggactacagagatggttgcccaggctggtctggaactcctgacctcaagcgatcttcctgccttgacctcccaaagtgctgggattatagccatgctgccaaccatgtgtagggtatgtatatgttcctataccataataaaattttaattacatttgtaaggtatgtaattatatgtatttctgtataatatgtacatataaatatgctaattaatacaagaacatattgaattataatcaatatatataattttagatgtatattggaatgtttatctttctaataatacaaaactgatggttaaaaaataaaatgcacaaactccccaa

SEQ ID NO: 7887 - DNA, 3437 bp, Homo sapiens
ccactacctctagactgccctcccgggctggcgtcccacggagtctcagccgcgcaccccttcctcgcgttaccctccttccggacagcaccccctcccttctccggtagctcctacccctgcctgtgcgggcctcgtccccgcgcccagccctcggtgctgcctccgacagcgccgcgctctctcagccgcccccctgcccctcgggcccccctctctgctgcccctggcgccatggcgtgcagcctcaaggacgagctgctgtgctccatctgcctgagcatctaccaggacccggtgagcctgggctgcgagcattacttctgccgccgctgcatcacggagcactgggtgcggcaggaggcgcagggcgcccgcgactgccccgagtgccggcgcacgttcgccgagcccgcgctggcgcccagcctcaagctggccaacatcgtggagcgctacagctccttcccgctggacgccatcctcaacgcgcgccgcgccgcgcgaccctgccaggcgcacgacaaggtcaagctcttctgcctcacggaccgcgcgcttctctgcttcttctgcgacgagcctgcactgcacgagcagcatcaggtcaccggcatcgacgacgccttcgacgagctgcagagggagctgaaggaccaacttcaggcccttcaagacagcgagcgggaacacaccgaagcgctgcagctgctcaagcgacaactggcggagaccaagtcttccaccaagagcctgcggaccactatcggcgaggccttcgagcggctgcaccggctgctgcgtgaacgccagaaggccatgctagaggagctggaggcggacacggcccgcacgctgaccgacatcgagcagaaagtccagcgctacagccagcagctgcgcaaggtccaggagggagcccagatcctgcaggagcggctggctgaaaccgaccggcacaccttcctggctggggtggcctcactgtccgagcggctcaagggaaaaatccatgagaccaacctcacatatgaagacttcccgacctccaagtacacaggccccctgcagtacaccatctggaagtccctgttccaggacatccacccagtgccagccgccctaaccctggacccgggcacagcccaccagcgcctgatcctgtcggacgactgcaccattgtggcttacggcaacttgcacccacagccactgcaggactcgccaaagcgcttcgatgtggaggtgtcggtgctgggttctgaagccttcagtagtggcgtccactactgggaggtggtggtggcggagaagacccagtgggtgatcgggctggcacacgaagccgcaagccgcaagggcagcatccagatccagcccagccgcggcttctactgcatcgtgatgcacgatggcaaccagtacagcgcctgcacggagccctggacgcggcttaacgtccgggacaagcttgacaaggtgggtgtcttcctggactatgaccaaggcttgctcatcttctacaatgctgatgacatgtcctggctctacaccttccgcgagaagttccctggcaagctctgctcttacttcagccctggccagagccacgccaatggcaagaacgttcagccgctgcggatcaacaccgtccgcatctagtccaggcagaaggagaccacaacctcctgggaccactgccacctgcaagagccctgcccaggagatagaagacctggactccagcccaccgtggccactggagacctcaggccagttgtttaccctccagcctccagtctgtaaaatggaggttgcattccctacttcctaaactctcttccagcatcgatgttctgtagctctgaccttgatagggatacagctttgatccaaggatgtgacatggcttctcctcagggcaacccctgcccaaccctcatccccatcttctcaggggcaggggactaccttccagtgtctccctccagcccagccctgacctcaggaagtgtcagagcatggccagtagttggcagcccgaaagacacacagcaccctcttatgtcccatggcctaagacttacccctgaccaagctagtgatgggccatttacccttgaccccagtccacagtggtcacaggtagtacctggtcctagggttgcctgagagccaacctctcctgccacccccacaccaagaactatatggttcctacttctcccactgatctgctggtcagtgatgatgctgtggcctgtggaaggcacctggtagttgagtccacacattatagtcatgtgccaccaccttcctgcccacaggccgagggacagggtgagggtatacccaaagctgatgcagagcccattagcctaaaagcaactgcaggacaagcctccctggatgatcgaggtccccagtagctctgaacaagagtccagccaaccctcttcagccaggcctctgtgacctgctagggtgcaggaggcttccagaagcagttgttgtaattaggacccaagcactgggaggggctgttggctggaccccttgtcagacttggcatctatctcagttaggatcctgctgcagaaaacaagagccacttgtagctggtttaattagacaaggatttactacctggcccctggtggcttgcaaaattgttggaagagctggagaagcagactctgctgaatttccaggaactcccagcgccagattcatcatgtctgttgtgaccaggaaagctgcccccatctgcaggaagccactatgccagaaagctgctgactgcagaactaggctccctctgccacggtccgtgccagccaatagatgtcctgaggcctgcccctctcccacttcactcagttcccaaatctaaatttttacaagagattctgtttgggggaacttaagtcagatccagaaccttggctgcaagggagtctgggaaatgtcatttccctagaaggaagttagggtgggtggagcaagccccacctgcgtttttctgccacagcatccaatcgtgaagaactcgggagagggtggagtccacatctagggttgtcctgccccttggctctatccctgcccagaggtgggaactggaggagtgggctgcaagactgagcctaaatgtctccccggccttgacttttctttctagtcctggggcctagattctgcacttggggtctctgacacaacacaccatcccaaagtagccggaagagctaaacacagggggttcttaaaatggctgcccccgccacccgggcctcccttgggcaaaaggaattgtcagccctaccccaacccttcaactaccagaatctgggccaccccagcagtatttttatttaaaatgttgcccattttatgagttatgatcaatttgtattaaattaaagttacagatgtca

SEQ ID NO: 7888 - DNA, 1823 bp, Homo sapiens
accggcagctcggattcggctggttccgggttgagaggctgcgctggaccgaagcggtggctgctaagctcgcgggggtaaggggtcgcgctgggccagggtttggggccgggatccggcagctgagcgggccggcacccctcctcttctctgccggtcacagccaatgtacggctcggcctggctgccccctcccccaggattccccatccccagcttctcgccctccccgcaccgcccccaccccgggatttcgacccccttaagggctccaccccgctccgggatccccttctcccagctcctatcccttaggactgccccgccccctagaacctccccgtcaggatctccgtccctcagccgctcacagcctcctcccagcgcccatcgccttgagctgcccactacctctagactgccctcccgggctggcgtcccacggagtctcagccgcgcaccccttcctcgcgttaccctccttccggacagcaccccctcccttctccggtagctcctacccctgcctgtgcgggcctcgtccccgcgcccagccctcggtgctgcctccgacagcgccgcgctctctcagccgcccccctgcccctcgggcccccctctctgctgcccctggcgccatggcgtgcagcctcaaggacgagctgctgtgctccatctgcctgagcatctaccaggacccggtgagcctgggctgcgagcattacttctgccgccgctgcatcacggagcactgggtgcggcaggaggcgcagggcgcccgcgactgccccgagtgccggcgcacgttcgccgagcccgcgctggcgcccagcctcaagctggccaacatcgtggagcgctacagctccttcccgctggacgccatcctcaacgcgcgccgcgccgcgcgaccctgccaggcgcacgacaaggtcaagctcttctgcctcacggaccgcgcgcttctctgcttcttctgcgacgagcctgcactgcacgagcagcatcaggtcaccggcatcgacgacgccttcgacgagctgcagagggagctgaaggaccaacttcaggcccttcaagacagcgagcgggaacacaccgaagcgctgcagctgctcaagcgacaactggcggagaccaagtcttccaccaagagcctgcggaccactatcggcgaggccttcgagcggctgcaccggctgctgcgtgaacgccagaaggccatgctagaggagctggaggcggacacggcccgcacgctgaccgacatcgagcagaaagtccagcgctacagccagcagctgcgcaaggtccaggagggagcccagatcctgcaggagcggctggctgaaaccgaccggcacaccttcctggctggggtggcctcactgtccgagcggctcaagggaaaaatccatgagaccaacctcacatatgaagacttcccgacctccaagtacacaggccccctgcagtacaccatctggaagtccctgttccaggacatccacccagtgccagccgccctaaccctggacccgggcacagcccaccagcgcctgatcctgtcggacgactgcaccattgtggcttacggcaacttgcacccacagccactgcaggactcgccaaagcgcttcgatgtggaggtgtcggtgctgggttctgaagccttcagtagtggcgtccactactgggaggtggtggtggcggagaagacccagtgggtgatcgggctggcacacgaagccgcaagccgcaagggcagcatccagatccagaaccttggctgcaagggagtctgggaaatgtcatttccctag

SEQ ID NO: 7889 - DNA, 2246 bp, Homo sapiens
gttgagaggctgcgctggaccgaagcggtggctgctaagctcgcgggggtaaggggtcgcgctgggccagggtttggggccgggatccggcagctgagcgggccggcacccctcctcttctctgccggtcacagccaatgtacggctcggcctggctgccccctcccccaggattccccatccccagcttctcgccctccccgcaccgcccccaccccgggatttcgacccccttaagggctccaccccgctccgggatccccttctcccagctcctatcccttaggactgccccgccccctagaacctccccgtcaggatctccgtccctcagccgctcacagcctcctcccagcgcccatcgccttgagctgcccactacctctagactgccctcccgggctggcgtcccacggagtctcagccgcgcaccccttcctcgcgttaccctccttccggacagcaccccctcccttctccggtagctcctacccctgcctgtgcgggcctcgtccccgcgcccagccctcggtgctgcctccgacagcgccgcgctctctcagccgcccccctgcccctcgggcccccctctctgctgcccctggcgccatggcgtgcagcctcaaggacgagctgctgtgctccatctgcctgagcatctaccaggacccggtgagcctgggctgcgagcattacttctgccgccgctgcatcacggagcactgggtgcggcaggaggcgcagggcgcccgcgactgccccgagtgccggcgcacgttcgccgagcccgcgctggcgcccagcctcaagctggccaacatcgtggagcgctacagctccttcccgctggacgccatcctcaacgcgcgccgcgccgcgcgaccctgccaggcgcacgacaaggtcaagctcttctgcctcacggaccgcgcgcttctctgcttcttctgcgacgagcctgcactgcacgagcagcatcaggtcaccggcatcgacgacgccttcgacgagctgcagagggagctgaaggaccaacttcaggcccttcaagacagcgagcgggaacacaccgaagcgctgcagctgctcaagcgacaactggcggagaccaagtcttccaccaagagcctgcggaccactatcggcgaggccttcgagcggctgcaccggctgctgcgtgaacgccagaaggccatgctagaggagctggaggcggacacggcccgcacgctgaccgacatcgagcagaaagtccagcgctacagccagcagctgcgcaaggtccaggagggagcccagatcctgcaggagcggctggctgaaaccgaccggcacaccttcctggctggggtggcctcactgtccgagcggctcaagggaaaaatccatgagaccaacctcacatatgaagacttcccgacctccaagtacacaggccccctgcagtacaccatctggaagtccctgttccaggacatccacccagtgccagccgccctaaccctggacccgggcacagcccaccagcgcctgatcctgtcggacgactgcaccattgtggcttacggcaacttgcacccacagccactgcaggactcgccaaagcgcttcgatgtggaggtgtcggtgctgggttctgaagccttcagtagtggcgtccactactgggaggtggtggtggcggagaagacccagtgggtgatcgggctggcacacgaagccgcaagccgcaagggcagcatccagatccagaaccttggctgcaagggagtctgggaaatgtcatttccctagaaggaagttagggtgggtggagcaagccccacctgcgtttttctgccacagcatccaatcgtgaagaactcgggagagggtggagtccacatctagggttgtcctgccccttggctctatccctgcccagaggtgggaactggaggagtgggctgcaagactgagcctaaatgtctccccggccttgacttttctttctagtcctggggcctagattctgcacttggggtctctgacacaacacaccatcccaaagtagccggaagagctaaacacagggggttcttaaaatggctgcccccgccacccgggcctcccttgggcaaaaggaattgtcagccctaccccaacccttcaactaccagaatctgggccaccccagcagtatttttatttaaaatgttgcccattttatgagttatgatcaatttgtattaaattaaagttacaga

SEQ ID NO: 7890 - DNA, 3148 bp, Homo sapiens
tggttccgggttgagaggctgcgctggaccgaagcggtggctgctaagctcgcgggggtaaggggtcgcgctgggccagggtttggggccgggatccggcagctgagcgggccggcacccctcctcttctctgccggtcacagccaatgtacggctcggcctggctgccccctcccccaggattccccatccccagcttctcgccctccccgcaccgcccccaccccgggatttcgacccccttaagggctccaccccgctccgggatccccttctcccagctcctatcccttaggactgccccgccccctagaacctccccgtcaggatctccgtccctcagccgctcacagcctcctcccagcgcccatcgccttgagctgcccactacctctagactgccctcccgggctggcgtcccacggagtctcagccgcgcaccccttcctcgcgttaccctccttccggacagcaccccctcccttctccggtagctcctacccctgcctgtgcgggcctcgtccccgcgcccagccctcggtgctgcctccgacagcgccgcgctctctcagccgcccccctgcccctcgggcccccctctctgctgcccctggcgccatggcgtgcagcctcaaggacgagctgctgtgctccatctgcctgagcatctaccaggacccggtgagcctgggctgcgagcattacttctgccgccgctgcatcacggagcactgggtgcggcaggaggcgcagggcgcccgcgactgccccgagtgccggcgcacgttcgccgagcccgcgctggcgcccagcctcaagctggccaacatcgtggagcgctacagctccttcccgctggacgccatcctcaacgcgcgccgcgccgcgcgaccctgccaggcgcacgacaaggtcaagctcttctgcctcacggaccgcgcgcttctctgcttcttctgcgacgagcctgcactgcacgagcagcatcaggtcaccggcatcgacgacgccttcgacgagctgcagagggagctgaaggaccaacttcaggcccttcaagacagcgagcgggaacacaccgaagcgctgcagctgctcaagcgacaactggcggagaccaagtcttccaccaagagcctgcggaccactatcggcgaggccttcgagcggctgcaccggctgctgcgtgaacgccagaaggccatgctagaggagctggaggcggacacggcccgcacgctgaccgacatcgagcagaaagtccagcgctacagccagcagctgcgcaaggtccaggagggagcccagatcctgcaggagcggctggctgaaaccgaccggcacaccttcctggctggggtggcctcactgtccgagcggctcaagggaaaaatccatgagaccaacctcacatatgaagacttcccgacctccaagtacacaggccccctgcagtacaccatctggaagtccctgttccaggacatccacccagtgccagccgccctaaccctggacccgggcacagcccaccagcgcctgatcctgtcggacgactgcaccattgtggcttacggcaacttgcacccacagccactgcaggactcgccaaagcgcttcgatgtggaggtgtcggtgctgggttctgaagccttcagtagtggcgtccactactgggaggtggtggtggcggagaagacccagtgggtgatcgggctggcacacgaagccgcaagccgcaagggcagcatccagatccagcccagccgcggcttctactgcatcgtgatgcacgatggcaaccagtacagcgcctgcacggagccctggacgcggcttaacgtccgggacaagcttgacaaggtgggtgtcttcctggactatgaccaaggcttgctcatcttctacaatgctgatgacatgtcctggctctacaccttccgcgagaagttccctggcaagctctgctcttacttcagccctggccagagccacgccaatggcaagaacgttcagccgctgcggatcaacaccgtccgcatctagtccaggcagaaggagaccacaacctcctgggaccactgccacctgcaagagccctgcccaggagatagaagacctggactccagcccaccgtggccactggagacctcaggccagttgtttaccctccagcctccagtctgtaaaatggaggttgcattccctacttcctaaactctcttccagcatcgatgttctgtagctctgaccttgatagggatacagctttgatccaaggatgtgacatggcttctcctcagggcaacccctgcccaaccctcatccccatcttctcaggggcaggggactaccttccagtgtctccctccagcccagccctgacctcaggaagtgtcagagcatggccagtagttggcagcccgaaagacacacagcaccctcttatgtcccatggcctaagacttacccctgaccaagctagtgatgggccatttacccttgaccccagtccacagtggtcacaggtagtacctggtcctagggttgcctgagagccaacctctcctgccacccccacaccaagaactatatggttcctacttctcccactgatctgctggtcagtgatgatgctgtggcctgtggaaggcacctggtagttgagtccacacattatagtcatgtgccaccaccttcctgcccacaggccgagggacagggtgagggtatacccaaagctgatgcagagcccattagcctaaaagcaactgcaggacaagcctccctggatgatcgaggtccccagtagctctatccctgcccagaggtgggaactggaggagtgggctgcaagactgagcctaaatgtctccccggccttgacttttctttctagtcctggggcctagattctgcacttggggtctctgacacaacacaccatcccaaagtagccggaagagctaaacacagggggttcttaaaatggctgcccccgccacccgggcctcccttgggcaaaaggaattgtcagccctaccccaacccttcaactaccagaatctgggccaccccagcagtatttttatttaaaatgttgcccattttatgagttatgatcaatttgtattaaattaaagttac

SEQ ID NO: 7891 - DNA, 1638 bp, Homo sapiens
tctcaggttcctaacccccagagaggggatccgattcagtctcagccgccccctccaggcctcatgtgaccattggagcccttcccaaggcttccttcatgccagagaagacagcagtggatcagccttggacgcaagccctgagggagctgaaggaccaacttcaggcccttcaagacagcgagcgggaacacaccgaagcgctgcagctgctcaagcgacaactggcggagaccaagtcttccaccaagagcctgcggaccactatcggcgaggccttcgagcggctgcaccggctgctgcgtgaacgccagaaggccatgctagaggagctggaggcggacacggcccgcacgctgaccgacatcgagcagaaagtccagcgctacagccagcagctgcgcaaggtccaggagggagcccagatcctgcaggagcggctggctgaaaccgaccggcacaccttcctggctggggtggcctcactgtccgagcggctcaagggaaaaatccatgagaccaacctcacatatgaagacttcccgacctccaagtacacaggccccctgcagtacaccatctggaagtccctgttccaggacatccacccagtgccagccgccctaaccctggacccgggcacagcccaccagcgcctgatcctgtcggacgactgcaccattgtggcttacggcaacttgcacccacagccactgcaggactcgccaaagcgcttcgatgtggaggtgtcggtgctgggttctgaagccttcagtagtggcgtccactactgggaggtggtggtggcggagaagacccagtgggtgatcgggctggcacacgaagccgcaagccgcaagggcagcatccagatccagcccagccgcggcttctactgcatcgtgatgcacgatggcaaccagtacagcgcctgcacggagccctggacgcggcttaacgtccgggacaagcttgacaaggtgggtgtcttcctggactatgaccaaggcttgctcatcttctacaatgctgatgacatgtcctggctctacaccttccgcgagaagttccctggcaagctctgctcttacttcagccctggccagagccacgccaatggcaagaacgttcagccgctgcggatcaacaccgtccgcatctagtccaggcagaaggagaccacaacctcctgggaccactgccacctgcaagagccctgcccaggagatagaagacctggactccagcccaccgtggccactggagacctcaggccagttgtttaccctccagcctccagtctgtaaaatggaggttgcattccctacttcctaaactctcttccagcatcgatgttctgtagctctgaccttgatagggatacagctttgatccaaggatgtgacatggcttctcctcagggcaacccctgcccaaccctcatccccatcttctcaggggcaggggactaccttccagtgtctccctccagcccagccctgacctcaggaagtgtcagagcatggccagtagttggcagcccgaaagacacacagcaccctcttatgtcccatggcctaagacttacccctgaccaagctagtgatgggccatttacccttgaccccagtccacagt

SEQ ID NO: 7892 - DNA, 2689 bp, Homo sapiens
atggattcagacgacctgcaagtcttccagaatgagctcatttgctgcatttgcgtgaactacttcatagatccggtcaccattgactgtgggcacagcttttgcaggccctgcctctgcctctgctcagaagaaggcagagcaccaatgcgctgcccttcgtgcagaaaaacctcagagaagcccaacttcaacaccaatctggtactcaaaaagctgtcttccctagccagacagaccagacctcagaacatcaacagctcagacaatatctgtgtgctccatgaggagactaaggagctcttctgtgaggctgacaagagattgctctgtgggccctgctctgagtcaccagagcacatggctcacagccacagcccaataggatgggctgctgaggaatgcagggagaaacttataaaggaaatggactatttatgggaaatcaatcaagagacaagaaacaatctaaatcaggaaactagcacatttcattcgttaaaggactatgtgtcagtaaggaagaggataatcactattcaatatcaaaagatgcctatatttctcgatgaggaggagcaacggcatctgcaggcactggaaagagaagcagaagagcttttccaacaactacaagacagtcaagtgagaatgacccaacatttagaaaggatgaaagacatgtacagagagctgtgggagacatgccacatgcctgacgtggtgctgctccaggatgtgagaaatgtatcagcaaggactgatttggcacagatgcaaaagccccagccagtgaacccagagctcacttcatggtgcataactggagtcctagacatgctcaacaacttcagagtggatagtgctctgagcacggaaatgattccttgctatataagcctttctgaggatgtgagatatgtgatatttggagatgaccatctcagtgctcccacggatccccagggagtggacagctttgctgtgtggggagcgcaagcattcacctccggcaagcattactgggaggtggatgtgaccctctcctccaactggattctgggagtctgtcgagattccaggactgcagatgccaatttcgttattgattctgatgaaagattttttttaatttcctcaaagaggagcaatcactatagtctctccaccaactctccacctttaattcagtatgtgcaaaggcctctgggtcgagttggggtgtttctggattatgataatggatctgtgagtttttttgatgtttctaaaggttctcttatctatggttttcctccttcctccttctcttcccctctgaggcctttcttttgctttggttgtacatgaaaagttggtttcacgatgatttattgtgacctcccacatatgaggcaaatactgtcctaagacactatgtgcgagagcctgtgagctcattgtaacttcatggaatgtaattactatgtggttatgaatgggataaccaccttgaatgtgtacttttgttaattaaattattttaattaataagttattgtggaatctttactagaacatcaataatggtttttttgtactagttttgttgagattcattcatttactgtaaaagtcatgttctaatgtatttaattcagatattgttagtatatcacacttgagcagccatcagagctctctactacctgtgaacttttatcacttccagaagaatcccaatacacattaacattaattctccttttaccctcccccattccttgacagcacttaatctactttttatgtttttgcattcaggtaaataaaatcatacaatgtaagttctttttttaatctgatttctttttcagagagtatgttttcagtttgtacacactgtaaaccatttgtcttagtcgtatatttcaaccaggctggggtagaataatgaagtggtggatatctcatcttacaaagaataaaaagagtgctttttttctttttaagtctgagcaagttaggttgacctcacagactttattatgtctcaacaacctagttattaatcacatttcagctcatacaacagtttttcagtgctgggttgctctgctattacatcttctctgaatatattatatcaggttataatattaagaaaactcttatacttattactaccagattgaaaagtccaagggggcaatggcagtatttgtcttctttgctaatatattacaattattcaatgcaatttttagaatagattacacagtaaataagatgagtaaatggataagtagaggagttaacatgtataaatactattctaacattaagaaacttttccaaaatataagtaacaaaataggacagaacatactaatgaatatctatcaaaagataagaaataaattgattttcagattcatatcaaagataacactattatgttggggtttaaaataattgtagcataatttttacagggttgatttcaattgtcttaggttttttcatataaactatggaaagaggaaggttcctatataagatgatggggaacaggaacaggacttagaataatggaggctgtccttatttaaactgacatataattacttgctaagcataaagtggtataaaccttcttatgcagtagaaagaacaaactttggttacatttcaaataagaatccagatg

SEQ ID NO: 7893 - DNA, 1344 bp, Homo sapiens
atggattcagacaccctgcgagtcttccagaatgagctcatttgctgcatttgcgtgaactacttcatagacccggtcaccactgactgtgtgcacagcttttgcaggccctgcctctgcctctgctcagaagaaggcagagcaccaatgcgctgccctttgtgcagaaaaatctcagagaagcccaacttcaacaccaatgtggcactcaaaaagctggcttccctagccagacagaccagacctcagaacatcaacagctcagacaatatctgtgtgctccatgaggagactaaggagctcttctgtgaggctgacaagagattgctctgtgggccctgctctgagtcaccagagcacatggctcacagccacagcccaataggatgggctgctgaggaatgcagggtacagaaacttataaaggaaatggactatttatggaaaatcaatcaagagacacaaaacaatctaaatcaggaaactagcaaattttgttcattagtggaagacaaaagaaatagaatagtatatagatatcaaaagatgcatatatttctcgatgaggaggagcaacggcatctgcaggcactggaaagagaagcaaaagagcttttccaacaactacaagacagtcaagtgagaatgacccaacatttagaagggatgaaagacatgtacagagagctgtgggagacataccacatgcctgacgtggagctgctccaggatgtgggaaatatatcggcaagaactgatttggcacagatgccaaagccccagccagtgaacccagagctcacttcatggtgcataactggagtcctagacatgctcaacaacttcagagtggataatgctctgagtacagaaatgactccttgctatataagcctttctgaggatgtgagacgtgtgatatttggagatgaccatcgcagtgcacccatggatccccaaggagtggagagctttgctgtgtggtgtgcgcaagcattcacctccggcaagcattactgggaagtggatgtgacccactcctccaactggattctgggagtctgtcgagattctaggacagcagataccaatatagttattgattctgacaaaacatttttttcaatttcttcaaagacgagcaatcactatagtctctccaccaattctccacctttaatccagtatgtgcaaaggcctctgggttgggttggggtgtttctggattatgataatggatctgtgagtttttttgatgtttctaaaggttctcttatctatggttttcctccttcctccttctcttcccctctgaggcctttcttttgctttggttgtacatga

SEQ ID NO: 7894 - DNA, 3439 bp, Homo sapiens
agcgcgcgaggcccgcggtccctttaagacgcccggggcccgcctggctctcgccgccgccgggccatggccgcgcagctgctggaggagaagctgacctgcgccatctgcctggggctctaccaggacccagtgacgctgccctgcggccacaacttctgcggggcctgcatccgggactggtgggaccgctgcggaaaggcgtgccccgagtgccgggagccctttcccgacggcgccgagctgcgccgcaacgtggccctcagcggcgtgctggaggtggtgcgcgccgggcccgcccgggatcccggccccgatcccggccccggccccgaccctgccgcgcgctgcccccgccacgggcggccgctggagctcttctgccggaccgagggccgctgtgtgtgcagcgtgtgcaccgtgcgcgagtgtcgcctccacgagcgggcgctgctggatgccgagcgcctcaagcgcgaggcccagctgagagccagcctggaggttacccagcagcaggccacccaggccgaaggccagctactagagctgcgcaagcaaagcagccagatccagaactcggcctgcatcttggcctcctgggtctccggcaagttcagcagcctgctacaggccctggaaatacagcacacgacagcactgaggagcatcgaggtggccaagacgcaggcgctggcacaggctcgagacgaggagcagcggctgcgggtccatttggaggctgtggctcgccatggctgcaggatccgggagctcctggagcaggtggatgagcagaccttcctgcaggaatcgcagctcctccagcccccagggcctcttgggccactgacccctctgcagtgggatgaagaccaacagctgggtgacctgaagcagttgctaagccggctgtgtggcctcctcttggaagaggggagccaccctggggcaccagccaagcctgtggacttagcccccgtggaggccccaggtcccctggcaccggtcccaagcacagtttgtccactgaggaggaaactctggcagaattatcgcaatctgacctttgatccagtcagcgccaaccgtcacttctatctgtcgcgccaggaccagcaggtgaagcactgtcgtcagtcccggggcccaggcgggcccggcagctttgagctctggcaggtgcaatgtgcccagagcttccaggccgggcaccactactgggaggtgcgcgcgtcagaccactcggtgacactgggcgtctcctacccgcaactgccacggtgcaggctggggccccacacagacaacattggccggggaccctgctcctgggggctctgcgtccaggaggacagcctccaggcctggcacaacggggaagcccagcgcctcccaggggtgtcagggcggctcctgggcatggatttggacctggcctcaggctgcctcaccttctacagcctggagccccagacccagcccctgtacaccttccatgccctcttcaaccagcccctcacccccgtcttctggctcctcgagggtaggaccctgaccctgtgccatcagccaggggctgtgttccctctggggccccaggaagaggtgctcagctgaagaaggcatgggatggagccctggcatagctgccaccatgcctatgtgcccaagagctgcccagcttcagcttggggactggaggaccagctgttggcctctctgttaactcagaaagagatgggaggttgggggaggtgagcataaacgcagagttcactgttgcagcctttttgaaggggacacagtctaggagggggataaatgggatgcccttgccccagagagaacccagttctaggtactgtctgggcctgggaggcgagagcagtgcccaggggacttctgggcttacaggacagcgtgtgtgacaaaattcagatctacctgaacttgcctctggagatgataagggccaaaggagcagtcagggaggggcggtgagccagagtagtcccagggggagacagattcctccctcctccccgcctgcagctctctttaattttttgtaacatttggagagacgtccgtcctgtcttgtagtctttttattttgtgcatccttataattgtattctacaaacaattttgttttctgcatttaaacatttttgtgtttttaggagatggtcttgctctgtcactcaggctggagtacagtggcacaatcatggctcactgcagcctcgagctcctgagctcaaaggatcctcccacctcagcctccagagtagctcagattacagtgttttctgaagtttcctgacttaacataagcatttttcacatgattgaaaattttcactgattgctgtagtcattctaatgactatcaagtttatttatccattattggacatttaaatttctttctttttagctatacaaacattgatgtgttttttttgagacaggatctccatctgtcacccaggctggtgtgcaggggtgcggtcatgggctcatgggattctcctacctcagcctcctgagtagctgggattacaggtgtatgccaccacgcctggcttatgatgaatatttctgagtgggatgtttggccacatttatggtcatgtatgtaggctgttacctcaagtgagtcactcagggaacaatgagcacttgaagatttttttatacaaaaggccacagtgaggccaccttgagtcaagccgactaaggcccctcaaccctgtcactaagcagcacgtgacactggcaggaccttcatctccagcatcccacccctgggtgtgggactttggggcagccgtgtgtgcaggtgtcggcacaggctagctcctcctggtttggtgtggtgtttgccattgcagagcaagctgccacgaagacccctgggcatgattttgcttgtatttccggaagtggggttgctgggtcatagggcaggtgtaattttttttacttgaaatgttccacttcttgttctgggaggtggttccaagggtgtctgcttttggccaggcgcagtggctcacgcttgtaatcccagcactttgggaggccgaggcaggcggatcacaaggtcaggagttcgagaccagcctggccaacaaggcaaaaccccgtctctactaaaaatacaaaaattagccgggcatggtggtgtgcgcctgtaatcccagctactggggaggctgaggcagaagaatcgcttgaacccaggaggtgaggttgcagtgagctgagattgcaccactggactacagcctgggtgacagagcgagactctgtctcaaaaaaaaaaaaaaaaagggagggctgtctgctttttgtaacttgaaaaactggacatctatgttatatgtactcatggataaatatttcacaataaaactttttaaaaggataa

SEQ ID NO: 7895 - DNA, 1797 bp, Homo sapiens
acagaagagataagggtttcttgtcataacaacataggaacaggtcacccgcgtgttactcaaaactgtaggacggcagtgagggctttgctaatcccagaacagaggtgtaacctggctgcatatccagcctcgagaaaatgtctacagcagatctgatggagaacctcagggaggaactcacctgtttcatctgcttagactatttcagcagcccagtgaccaccgagtgtgggcacagcttttgtctggtgtgtctcctcaggagctgggaggaacataacacacctttatcttgtcctgagtgctggaggaccttggagggcccgcatttccagtcaaacgagcgtctggggaggctggccagcatcgccaggcagctccggtcccaggtgctgcagagcgaggatgagcagggcagctacgggaggatgcccaccactgccaaggcgctctccgatgacgagcagggtggaagcgccttcgtagcccagagccatggtgcaaacagagtgcatctctccagcgaggctgaggagcatcacagagagaaactccaggaaatcctgaatcttttgcgtgtaaggagaaaggaagctcaggctgtactaacccatgagaaggagagagtgaaactgtgccaggaagaaacaaagacttgtaaacaggttgttgtgtcagaatacatgaaaatgcaccagttcctgaaggaagaggagcagctgcaactccagctactagaacaggaagagaaagagaacatgaggaagctgaggaacaatgagatcaaactgacccagcaaatcagaagcctaagcaaaatgatcgcacagattgagtcctcaagtcaaagctcggctttcgaatctcttgaggaagtgagaggagccctggaaaggagcgagccactcttgcttcagtgtccagaggccaccaccacagagctgagtctgtgccgcatcacgggaatgaaggagatgctaagaaaattcagcacggagataacgctggacccagccacagctaatgcctatctcgtgttgtcggaggatctgaagagtgtgaaatatgggggaagcagacagcagctacccgacaacccggaaagatttgaccagtctgcgactgtgctgggtactcagatcttcaccagtgggagacactactgggaggtggaggtgggaaacaagaccgagtgggaagtgggcatctgcaaggactctgtgagcagaaaggggaatctccccaagccacctggggacctgttctcactaataggtttaaaaatcggagatgattacagcctctgggtctcgtcacctttgaaaggtcagcacgtcagagagcctgtgtgtaaggttggtgtcttcctggactatgaatctggacatatagcattctacaacgggacggatgaatccctcatctacagcttcccgcaggcttctttccaagaggccctcaggcctatcttttccccctgcctcccaaatgaggggacaaacacagaccctctcaccatctgctcactgaacagccacgtctgaggggcgtgccctgagccgtcacagcgggcgatgtctgagaccaagacacaactattaagacgatgaaggcatcgacagtattaatgtcaggtgatctgaaataaactcccgtaaccccaccccacccccaagagtttccattaacttgatcccattatgaacagccacattacacaatcaacttcaaccccaatagaagagagctgatcatattctgtgtctttaagtaaatgtattctctgggctaccc

SEQ ID NO: 7896 - DNA, 1639 bp, Homo sapiens
aagcaggcagctgccagaaatttgttggatttgaggagtccagagcgccgacccgctctgtctgcgtggacttatttccttggatcttcgtggactctgaagttgccaagtgtgtgtgcctgctccagaaaacaaaggaagccaccattttttctcattcacagtgcagggagatacctcagtagaagcatacagtccagtcttcaactagggacccctaccaggatgtccaaaaggctcagccctcagttacagcacaacatcacagaagatgcctattgtgaaacacacctggaaccaacacggctgttctgtgatgttgaccaaatcacactctgcagcaaatgcttccagtcccaggagcacaaacatcacatggtgtgtgggatacaagaggctgctgagaattacaggaagttattccaggaaatattgaacacatcgagggagaaacttgaagcagctaaaagcatattgactgatgagcaagaaagaatggcgatgattcaggaagaggaacaaaattttaaaaagatgattgagtctgagtatagtatgagactccggttgttgaatgaagagtgtgagcagaatctccagagacagcaggaatgcatatctgacttgaacctgagagaaacccttctgaatcaagcgatcaagcttgccaccgagctagaggagatgttccaggaaatgctacagagactgggccgtgtggggagagagaacatggagaaactgaaggagagtgaagccagggcttctgaacaggtccgcagcctcctaaagctcatcgtggagcttgagaaaaagtgtggggaaggcaccttggcattgctcaagaatgcaaaatactctttagaaaggagcaagtcactgctgcttgagcatctggagcccgctcatatcacagacctgagtttatgccacataagaggactcagcagcatgttcagagtactccagagacatttaacattggatcctgaaacagctcatccctgcctggcactatctgaggacctgagaactatgagattgagacatgggcagcaggatggggctggcaacccagaaagattggatttcagtgccatggtgctggctgcggagagcttcacctcagggaggcactactgggaggtggacgtggaaaaggcaaccaggtggcaagtgggcatataccacggctctgcagacgcgaagggcagcacggccagagcttccggagagaaagtcttgctcacggggtcggtgatggggaccgagtggactctctgggtcttcccccctctgaaaaggctcttcctggaaaagaagttggacacagttggcgttttccttgactgcgaacacgggcagatatcattctacaatgtgaccgagatgtccctcatttacaatttctcccattgcgccttccaaggagctctcaggcctgtgttttccctctgtatcccaaatggagacacaagtccagactccctcaccatcttacaacatggtccttcttgtgatgctactgttagcccttaatcttctgtgtgtaaaatccaagaccacgagacaccagaaagttggagaacaagactttgaaagaatttgtgtaaactaacccaataaaaagcgttccagg

SEQ ID NO: 7897 - DNA, 1275 bp, Homo sapiens
aaatacccaggattgctacaaagaaacaggcagctgccagaaatttgttggatttgaggagtccagagcgccgacccgctctgtctgcgtggacttatttccttggatcttcgtggactctgaagttgccaagtgtgtgtgcctgctccagaaaacaaaggaagccaccattttttctcattcacagtgcagggagatacctcagtagaagcatacagtccagtcttcaactagggacccctaccaggatgtccaaaaggctcagccctcagttacagcacaacatcacagaagatgcctattgtgaaacacacctggaaccaacacggctgttctgtgatgttgaccaaatcacactctgcagcaaatgcttccagtcccaggagcacaaacatcacatggtgtgtgggatacaagaggctgctgagaattacaggaagttattccaggaaatattgaacacatcgagggagaaacttgaagcagctaaaagcatattgactgatgagcaagaaagaatggcgatgattcaggaagaggaacaaaattttaaaaagatgattgagtctgagtatagtatgagactccggttgttgaatgaagagtgtgagcagaatctccagagacagcaggaatgcatatctgacttgaacctgagagaaacccttctgaatcaagcgatcaagcttgccaccgagctagaggagatgttccaggaaatgctacagagactgggccgtgtggggagagagaacatggagaaactgaaggagagtgaagccagggcttctgaacaggtccgcagcctcctaaagctcatcgtggagcttgagaaaaagtgtggggaaggcaccttggcattgctcaaggtaagatgctgggaaaaagaaaataaaattcattccagtatttgagaaatgagaagtggacagtactcattaggggttgctgtcagaacacaatatccaatgatcttcaaccacaaaagaaggctacatgactttctttcagctgccaaaagctttaggaatggtcatagctttgtgggatagtgtggagctgcttcatgagatgaattctcaccttaaaattatcagcagtaagttagggttgagatgtgacacaatgtggttaatacctccatgcaatgaaatattctgtgatcataaagaataaaacagctctataggcactaacagtatttcaagcactcattaagtgaaaaagaaagatgcagactgctttttgtttgatctttggataataagtatatat

SEQ ID NO: 7898 - DNA, 4470 bp, Homo sapiens
agtacgcttctgcgcagtttgtggtggcgtcgtaacgcctcggggaaagggaagcggacgggcatctggaatcgctgcctctggctttctgttttctactaacaggatttggtcactggttcttcatcttttgtctgttgcacgcatcccgccctccccacttgcttccccactccttggatccagccctgtgggcattcacgtcagttctctgaccccgccgtgagccccgctccgggtccccgggcgggcttggcacggaggcggtaactatggagaatatggcggaggaggagctgctgcccctggagaaggaggaggtggaggtggcccaggtccaggtcccgaccccggcccgggactcggctggggtcccagctccggccccggattcggctctggactcggctccgactccggcctcggctccagccccagcccctgccctggcccaggctccggccctgtccccgtccctagcctctgcccctgaggaggctaaaagcaagagacacatctcaattcaaaggcagcttgctgatctagagaatttagcttttgtaactgatggaaattttgactctgccagctcattgaactcagataatcttgatgcaggcaacagacaggcttgtccattgtgccctaaggaaaaattcagagcttgtaatagccataagcttcgtcgtcacctccagaatttacactggaaagtctcagttgaatttgaaggttacaggatgtgcatctgtcacttaccttgtcgaccagtgaaaccaaacattattggagaacagataaccagtaaaatgggagcccattatcattgtatcatttgttcagcaacaatcaccagaagaactgatatgctaggacatgttaggcgccacatgaataaaggagagactaaatctagttatattgcagcttccactgctaaaccacctaaggaaattttgaaagaggcagacacggatgtacaagtttgtcccaactattctatacctcagaaaacagattcctattttaaccccaaaatgaaactaaatcggcagctaatattctgtacattggctgctttggctgaggaacgaaaacctttggaatgtctagatgcttttggagccactgggataatgggattacagtgggcaaaacatcttggaaatgcagtcaaagttacaatcaatgacttgaatgaaaattctgtgacactgattcaggaaaactgccatttaaacaaattgaaagtggtggtggacagtaaggaaaaggaaaagagtgatgatattcttgaagaaggagagaaaaatcttggtaatattaaggtgaccaaaatggatgccaatgtactgatgcatttgagatcttttgatttcatacatctagacccttttggaacatcagtgaattatctagattctgcattcagaaatataagaaaccttggcatagtgtcagtgacttctacagatatcagttctttatatgccaaggcacagcatgttgcccggcgtcactacggatgtaacattgtccgaactgaatattacaaggaactagcagccagaattgttgtagctgcagtggcaagagctgcagcccgatgcaacaaaggcatagaagtactgtttgcagtggctctggaacattttgtgttggtagttgtgagagttttgaggggacctacttcagcagatgaaacagccaagaagattcaatacctgatccattgtcagtggtgtgaagagagaatttttcagaaggatggtaatatggtagaagattacagtgctaactttgttatttcctatactggatttcctttcgtcaacagacaagacattcgtaaaacccatatagacagctgccttgtaactgtcatggaagcatgcctggaaagacagcaatagaacttggacctctgtggtcaagttcccttttcaatactggattcctcaaaagaatgctatttgaatctcttcaccatggtttggatgacattcagaccctaataaagacattaatctttgaatcagagtgtacgcctcaaagtcagttttcaattcatgcatcttcaaatgtcaacaagcaagaagaaaatggtgtatttattaaaactacagatgacaccacaacagataattacattgcacaaggaaagagaaaaagtaatgaaatgatcacaaatttaggcaagaagcaaaagactgatgtcagtactgaacatcctcccttttattacaacattcacagacacagcattaaaggaatgaatatgccaaagttaaaaaagtttttgtgctatttatctcaagcaggctttcgagtaagccgaactcattttgacccaatgggtgtacgcacagatgcacctctgatgcagtttaaatctatccttttaaagtacagcacccccacctacactggaggacagtcagaaagccatgtccagtcagcatctgaagatacagtaactgaaagagttgaaatgtcagtgaatgacaaagcagaagcaagtggctgcagaagatggtaaacgtagagaagaattggttctcaggtgtctgtatagatggcctaatagttctctataccaactgtagttctttttctgttctttcaattcagtagagtaaaaataaaaaacagtgtcattttcattcagaaactgagcagtttctaacttagctggtttgggagctttgctttccaagtttttttttgttttaaggcaaacttaaaattttaatggaaacatttcatatgaagccaagtctcactgagatcaccctactgcttaataattcagaaaattttcacatgcaaagtgtttggaattttatgtatgttatgaaagccatcttttacaattcttaatcacatctctgcctaaactgattcatgatgtttatgttttcctgtttgtagtgtacaaaatgaagctgaaggctcacatgttaaaatgaccctgaatagaataggaagaacaatgttcttacaggtcataatgtatttcacaattaaaaaactaaaatatgtacccatttttaagaaatcatacttctctccacattgatcttttcatttcttactagcttttaagaaattaaatacttgcctgagatagaaatactttatttttgtaactttaaggtctaaatgactaaacttcaaagtaagattttgtcagaataaattgagaccattaatctaatataatacttgttcatgagcactgaaatcctgaagaggagagatttggttataaattaaaaaggttgggtgatcttaagtgcctcagttaatgcacgtacagtattcatttggttggttgtactacctctcagaagtaaaatttgtcaccttatggaatgagagtttttgggtttgggggttgtttttttgttgttgcttggtttggtatttttggttttgtgtgtatttgtataaattttctgtataattagcccaggctgatgtaactataaaaattagttgaaaaaaaaaatattgtttccttaatggaattctcacttcatttgaatataagattttggatgaaaggatttggtataaagtttgggtttttgtctcaaggatttgatccatatttatccctaaatatttcttaagggatgtaactttttataaccattaagtggggggaagggggtggagggggtggtaataattataactgaaaggtttaaatatactacctaagaaaaaagtacttctgtgacatatacaaaaaaatctagtggataggcattagatgaatagagaatattaattttgcagaaatgaaggaaaatctcttcgtgctagtacagcgtattcccaagagagtttattttcctttctccaattaatgtggtcataaatttcggtaaaatcaagaaataggtgaagtgcaagctagtttctataatgaccattaaaaaaattctgctgtgtaattcttgccagttaaaattataacttgcaaatgagcagaataaatgaggtttttttcaattaaaaattactataaatccaggaggcaaactattttagcactcagattatctgatttaatacatattattgaatatcagtctcaaattttgctaaatgcttatcagcatgaaatatgttgatcagtgatgagttgggcttaatgcaaagatcctaatttaataaagaaacctgtaaattactgttacctaaaatatatgtgtatattaatttcacatataaaggtagatttttcaaagaaaaatttggtaggcggtagtttagaactctgatcaggtactacatcaaccaaaagaggaaatactttaaaaattccttttagcaacctgagcaatcttattctcgtaacaatagtagtaatttgggacattgcaaatgtttatcatgttgtaaagtagcatcagttgtatcctttcattaaaacttgataaacaaaagaacgagttaagg

SEQ ID NO: 7899 - DNA, 4392 bp, Homo sapiens
acgcttctgcgcagtttgtggtggcgtcgtaacgcctcggggaaagggaagcggacgggcatctggaatcgctgcctctggctttctgttttctactaacaggatttggtcactggttcttcatcttttgtctgttgcacgcatcccgccctccccacttgcttccccactccttggatccagccctgtgggcattcacgtcagttctctgaccccgccgtgagccccgctccgggtccccgggcgggcttggcacggaggcggtaactatggagaatatggcggaggaggagctgctgcccctggagaaggaggaggtggaggtggcccaggtccaggtcccgaccccggcccgggactcggctggggtcccagctccggccccggattcggctctggactcggctccgactccggcctcggctccagccccagcccctgccctggcccaggctccggccctgtccccgtccctagcctctgcccctgaggaggctaaaagcaagagacacatctcaattcaaaggcagcttgctgatctagagaatttagcttttgtaactgatggaaattttgactctgccagctcattgaactcagataatcttgatgcaggcaacagacaggcttgtccattgtgccctaaggaaaaattcagagcttgtaatagccataagcttcgtcgtcacctccagaatttacactggaaagtctcagttgaatttgaaggttacaggatgtgcatctgtcacttaccttgtcgaccagtgaaaccaaacattattggagaacagataaccagtaaaatgggagcccattatcattgtatcatttgttcagcaacaatcaccagaagaactgatatgctaggacatgttaggcgccacatgaataaaggagagactaaatctagttatattgcagcttccactgctaaaccacctaaggaaattttgaaagaggcagacacggatgtacaagtttgtcccaactattctatacctcagaaaacagattcctattttaaccccaaaatgaaactaaatcggcagctaatattctgtacattggctgctttggctgaggaacgaaaacctttggaatgtctagatgcttttggagccactgggataatgggattacagtgggcaaaacatcttggaaatgcagtcaaagttacaatcaatgacttgaatgaaaattctgtgacactgattcaggaaaactgccatttaaacaaattgaaagtggtggtggacagtaaggaaaaggaaaagagtgatgatattcttgaagaaggagagaaaaatcttggtaatattaaggtgaccaaaatggatgccaatgtactgatgcatttgagatcttttgatttcatacatctagacccttttggaacatcagtgaattatctagattctgcattcagaaatataagaaaccttggcatagtgtcagtgacttctacagatatcagttctttatatgccaaggcacagcatgttgcccggcgtcactacggatgtaacattgtccgaactgaatattacaaggaactagcagccagaattgttgtagctgcagtggcaagagctgcagcccgatgcaacaaaggcatagaagtactgtttgcagtggctctggaacattttgtgttggtagttgtgagagttttgaggggacctacttcagcagatgaaacagccaagaagattcaatacctgatccattgtcagtggtgtgaagagagaatttttcagaaggatggtaatatggtagaagaaaacccatatagacagctgccttgtaactgtcatggaagcatgcctggaaagacagcaatagaacttggacctctgtggtcaagttcccttttcaatactggattcctcaaaagaatgctatttgaatctcttcaccatggtttggatgacattcagaccctaataaagacattaatctttgaatcagagtgtacgcctcaaagtcagttttcaattcatgcatcttcaaatgtcaacaagcaagaagaaaatggtgtatttattaaaactacagatgacaccacaacagataattacattgcacaaggaaagagaaaaagtaatgaaatgatcacaaatttaggcaagaagcaaaagactgatgtcagtactgaacatcctcccttttattacaacattcacagacacagcattaaaggaatgaatatgccaaagttaaaaaagtttttgtgctatttatctcaagcaggctttcgagtaagccgaactcattttgacccaatgggtgtacgcacagatgcacctctgatgcagtttaaatctatccttttaaagtacagcacccccacctacactggaggacagtcagaaagccatgtccagtcagcatctgaagatacagtaactgaaagagttgaaatgtcagtgaatgacaaagcagaagcaagtggctgcagaagatggtaaacgtagagaagaattggttctcaggtgtctgtatagatggcctaatagttctctataccaactgtagttctttttctgttctttcaattcagtagagtaaaaataaaaaacagtgtcattttcattcagaaactgagcagtttctaacttagctggtttgggagctttgctttccaagtttttttttgttttaaggcaaacttaaaattttaatggaaacatttcatatgaagccaagtctcactgagatcaccctactgcttaataattcagaaaattttcacatgcaaagtgtttggaattttatgtatgttatgaaagccatcttttacaattcttaatcacatctctgcctaaactgattcatgatgtttatgttttcctgtttgtagtgtacaaaatgaagctgaaggctcacatgttaaaatgaccctgaatagaataggaagaacaatgttcttacaggtcataatgtatttcacaattaaaaaactaaaatatgtacccatttttaagaaatcatacttctctccacattgatcttttcatttcttactagcttttaagaaattaaatacttgcctgagatagaaatactttatttttgtaactttaaggtctaaatgactaaacttcaaagtaagattttgtcagaataaattgagaccattaatctaatataatacttgttcatgagcactgaaatcctgaagaggagagatttggttataaattaaaaaggttgggtgatcttaagtgcctcagttaatgcacgtacagtattcatttggttggttgtactacctctcagaagtaaaatttgtcaccttatggaatgagagtttttgggtttgggggttgtttttttgttgttgcttggtttggtatttttggttttgtgtgtatttgtataaattttctgtataattagcccaggctgatgtaactataaaaattagttgaaaaaaaaaatattgtttccttaatggaattctcacttcatttgaatataagattttggatgaaaggatttggtataaagtttgggtttttgtctcaaggatttgatccatatttatccctaaatatttcttaagggatgtaactttttataaccattaagtggggggaagggggtggagggggtggtaataattataactgaaaggtttaaatatactacctaagaaaaaagtacttctgtgacatatacaaaaaaatctagtggataggcattagatgaatagagaatattaattttgcagaaatgaaggaaaatctcttcgtgctagtacagcgtattcccaagagagtttattttcctttctccaattaatgtggtcataaatttcggtaaaatcaagaaataggtgaagtgcaagctagtttctataatgaccattaaaaaaattctgctgtgtaattcttgccagttaaaattataacttgcaaatgagcagaataaatgaggtttttttcaattaaaaattactataaatccaggaggcaaactattttagcactcagattatctgatttaatacatattattgaatatcagtctcaaattttgctaaatgcttatcagcatgaaatatgttgatcagtgatgagttgggcttaatgcaaagatcctaatttaataaagaaacctgtaaattactgttacctaaaatatatgtgtatattaatttcacatataaaggtagatttttcaaagaaaaatttggtaggcggtagtttagaactctgatcaggtactacatcaaccaaaagaggaaatactttaaaaattccttttagcaacctgagcaatcttattctcgtaacaatagtagtaatttgggacattgcaaatgtttatcatgttgtaaagtagcatcagttgtatcctttcattaaaacttgataaacaaaagaa

SEQ ID NO: 7900 - DNA, 735 bp, Homo sapiens
acatcagtgaattatctagattctgcattcagaaatataagaaaccttggcatagtgtcagtgacttctacagatatcagttctttatatgccaaggcacagcatgttgcccggcgtcactacggatgtaacattgtccgaactgaatattacaaggaactagcagccagaattgttgtagctgcagtggcaagagctgcagcccgatgcaacaaaggcatagaagtactgtttgcagtggctctggaacattttgtgttggtagttgtgagagttttgaggggacctacttcagcagatgaaacagccaagaagattcaatacctgatccattgtcagtggtgtgaagagagaatttttcagaaggatggtaatatggtagaagaaaacccatatagacagctgccttgtaactgtcatggaagcatgcctggaaagacagcaatagaacttggacctctgtggtcaagttcccttttcaatactggattcctcaaaagaatgctatttgaatctcttcaccatggtttggatgacattcagaccctaataaagacattaatctttgaatcagagtgtacgcctcaaagtcagttttcaattcatgcatcttcaaatgtcaacaagcaaggtgactaactgaacgctagcttactagctttaaactgcttaccaaaaatactgtatctttttcaattgtatttgatgttataataaaaccaatataattataaa

SEQ ID NO: 7901 - DNA, 1949 bp, Homo sapiens
cgcctgcctcgcagagcttccgcttccggcccttcaggctctgtctctgtggagactgggctttgggagggagaaagagggacctagcgcgggccgcgcaggcgcacggtgggcagctgcaatggcgctgtcgtgtacccttaacaggtatctgctcctcatggcgcaggagcatctggagttccgcctgccggaaataaagtctttgcttttgctttttggaggtcagtttgccagcagtcaagaaacttatggaaagtcaccattttggattcttagcattccctctgaagatattgcaagaaatttgatgaaacggacagtgtgtgccaagtctatatttgaactatggggtcatggacaatctcctgaggagctgtacagttctcttaaaaactaccctgtggagaagatggttccatttctacattcggactctacatataaaataaagattcacacttttaataagacattgacacaagaagagaaaatcaagcgaatagatgcacttgaatttctgccatttgaaggaaaagtgaatttaaagaaaccgcaacatgtattttctgttttggaggattatggtttagacccaaactgcatccctgagaatccacataatatttattttggtagatggattgcagatggacagagagagcttattgagtcatacagtgtcaaaaagagacactttattggaaatacaagtatggatgctggtttgtcattcattatggctaaccatggaaaagtgaaagaaaatgatattgtctttgatccatttgttggaacaggtggcctgctgatagcatgtgctcattttggtgcatatgtgtatgggacagacatagactacaacacagttcatggcttgggaaaggctactaggaaaaaccagaagtggagaggaccagatgaaaacattagggccaatcttcgtcaatatggtttagagaagtattaccttgatgtcctggtttcagatgcatctaaaccttcctggaggaagggcacatattttgatgcaatcattactgatcctccatatggtatcagagaatctacaagaagaacaggttcacagaaggagataccaaaggggatagaaaaatgggaaaaatgtccagaaagccatgttcctgtttccttgagttatcatctgagtgatatgtttcttgacctgttaaacttcgcagctgagaccctcgttttaggtggaagactagtctattggttaccggtgtatacgccagaatacactgaagagatggtgccttggcacccttgcctggaactcgttagcaactgcgagcagaagctttccagtcacacatcaaggcgcttgatcacaatggaaaaggtgaagaaatttgagaatcgggaccagtattcacatctgctaagtgatcattttctgccataccaaggtcataattccttccgtgagaaatattttagtggggtaacaaaaagaattgccaaggaagaaaaatccacccaggaatgaaaattaagattttgacaatgaagaaagaataagaatttgatttaaaaagacatctggatgtgaactttcatgtatgatccagaaaataggtacggttttaaaatattttatatagaaaagctacaaagtaaattgagcaatgcttttaaagttatctttgttttatagacttttttgttgtatgtattacagtctttataatcttatttaatgtatatttgtactttcaagtactgatggagatagactcaaaacagttatttttttacaattaatctacaaagggaattaatattgttgacttttaaaacatctgctggatatattatatgcaattaatagtagttaagaatttattcatttggtagatatgtttatttggtttttggttgtcatcgatttacattgccactaataaaccatattgagaatttct

SEQ ID NO: 7902 - DNA, 1889 bp, Homo sapiens
tggagactgggctttgggagggagaaagagggacctagcgcgggccgcgcaggcgcacggtgggcagctgcaatggcgctgtcgtgtacccttaacaggtatctgctcctcatggcgcaggagcatctggagttccgcctgccggaaataaagtctttgcttttgctttttggaggtcagtttgccagcagtcaagaaacttatggaaagtcaccattttggattcttagcattccctctgaagatattgcaagaaatttgatgaaacggacagtgtgtgccaagtctatatttgaactatggggtcatggacaatctcctgaggagctgtacagttctcttaaaaactaccctgtggagaagatggttccatttctacattcggactctacatataaaataaagattcacacttttaataagacattgacacaagaagagaaaatcaagcgaatagatgcacttgaatttctgccatttgaaggaaaagtgaatttaaagaaaccgcaacatgtattttctgttttggaggattatggtttagacccaaactgcatccctgagaatccacataatatttattttggtagatggattgcagatggacagagagagcttattgagtcatacagtgtcaaaaagagacactttattggaaatacaagtatggatgctggtttgtcattcattatggctaaccatggaaaagtgaaagaaaatgatattgtctttgatccatttgttggaacaggtggcctgctgatagcatgtgctcattttggtgcatatgtgtatgggacagacatagactacaacacagttcatggcttgggaaaggctactaggaaaaaccagaagtggagaggaccagatgaaaacattagggccaatcttcgtcaatatggtttagagaagtattaccttgatgtcctggtttcagatgcatctaaaccttcctggaggaagggcacatattttgatgcaatcattactgatcctccatatggtatcagagaatctacaagaagaacaggttcacagaaggagataccaaaggggatagaaaaatgggaaaaatgtccagaaagccatgttcctgtttccttgagttatcatctgagtgatatgtttcttgacctgttaaacttcgcagctgagaccctcgttttaggtggaagactagtctattggttaccggtgtatacgccagaatacactgaagagatggtgccttggcacccttgcctggaactcgttagcaactgcgagcagaagctttccagtcacacatcaaggcgcttgatcacaatggaaaagaatcgggaccagtattcacatctgctaagtgatcattttctgccataccaaggtcataattccttccgtgagaaatattttagtggggtaacaaaaagaattgccaaggaagaaaaatccacccaggaatgaaaattaagattttgacaatgaagaaagaataagaatttgatttaaaaagacatctggatgtgaactttcatgtatgatccagaaaataggtacggttttaaaatattttatatagaaaagctacaaagtaaattgagcaatgcttttaaagttatctttgttttatagacttttttgttgtatgtattacagtctttataatcttatttaatgtatatttgtactttcaagtactgatggagatagactcaaaacagttatttttttacaattaatctacaaagggaattaatattgttgacttttaaaacatctgctggatatattatatgcaattaatagtagttaagaatttattcatttggtagatatgtttatttggtttttggttgtcatcgatttacattgccactaataaaccatattgagaatttctaaaa

SEQ ID NO: 7903 - DNA, 617 bp, Homo sapiens
ggcgctgtcgtgtacccttaacaggtatctgctcctcatggcgcaggagcatctggagttccgcctgccggtgagtccgtagcgccctccggaacttccgacggaagaggacgctggagtggagtggagtgggtggaggtgatctgcatagcccgaggaagctgggattcgggggtcttcgctggtctgcgcgggtcacgcgtccccagtcctcgggcggggaaataaagtctttgcttttgctttttggaggtcagtttgccagcagtcaagaaacttatggaaagtcaccattttggattcttagcattccctctgaagatattgcaagaaatttgatgaaacggacagtgtgtgccaagtctatatttgaactatggggtcatggacaatctcctgaggagctgtacagttctcttaaaaactaccctgtggagaagatggttccatttctacattcggactctacatataaaataaagattcacacttttaataagacattgacacaagaagagaaaatcaagcgaatagatgcacttgaatttctgccatttgaaggaaaagtgaatttaaagaaaccgcaacatgtattttctgttttggaggattatggt

SEQ ID NO: 7904 - DNA, 657 bp, Homo sapiens
ggcgctgtcgtgtacccttaacaggtatctgctcctcatggcgcaggagcatctggagttccgcctgccggtgagtccgtagcgccctccggaacttccgacggaagaggacgctggagtggagtggagtgggtggaggaaataaagtctttgcttttgctttttggaggtcagtttgccagcagtcaagaaacttatggaaagtcaccattttggattcttagcattccctctgaagatattgcaagaaatttgatgaaacggacagtgtgtgccaagtctatatttgaactatggggtcatggacaatctcctgaggagctgtacagttctcttaaaaactaccctgtggagaagatggttccatttctacattcggactctacatataaaataaagattcacacttttaataagacattgacacaagaagagaaaatcaagcgaatagatgcacttgaatttctgccatttgaaggaaaagtgaatttaaagaaaccgcaacatgtattttctgttttggaggattatggtttagacccaaactgcatccctgagaatccacataatatttattttggtagatggattgcagatggacagagagagcttattgagtcatacagtgtcaaaaagagacactttattggaaataca

SEQ ID NO: 7905 - DNA, 895 bp, Homo sapiens
cgcctgcctcgcagagcttccgcttccggcccttcaggctctgtctctgtggagactgggctttgggagggagaaagagggacctagcgcgggccgcgcaggcgcacggtgggcagctgcaatggcgctgtcgtgtacccttaacaggtatctgctcctcatggcgcaggagcatctggagttccgcctgccggaaataaagtctttgcttttgctttttggaggtcagtttgccagcagtcaagaaacttatggaaagtcaccattttggattcttagcattccctctgaagatattgcaagaaatttgatgaaacggacagtgtgtgccaagtctatatttgaactatggggtcatggacaatctcctgaggagctgtacagttctcttaaaaactaccctgtggagaagatggttccatttctacattcggactctacatataaaataaagattcacacttttaataagacattgacacaagaagagaaaatcaagcgaatagatgcacttgaatttctgccatttgaaggaaaagtgaatttaaagaaaccgcaacatgtattttctgttttggaggattatggtttagacccaaactgcatccctgagaatccacataatatttattttggtagatggattgcagatggacagagagagcttattgagtcatacagtgtcaaaaagagacactttattggaaatacaagtatggatgctggtttgtcattcattatggctaaccatggaaaagtgaaagaaaatgatattgtctttgatccatttgttggaacaggtggcctgctgatagcatgtgctcattttggtgcatatgtgtatgggacagacatagactacaacacagttcatggcttggcctgctcaacatga

SEQ ID NO: 7906 - DNA, 509 bp, Homo sapiens
tttgtcattcattatggctaaccatggaaaagtgaaagaaaatgatattgtctttgatccatttgttggaacaggtggcctgctgatagcatgtgctcattttggtgcatatgtgtatgggacagacatagactacaacacagttcatggcttgggaaaggctactaggaaaaaccagaagtggagaggaccagatgaaaacattagggccaatcttcgtcaatatggtttagagaagtattaccttgatgtcctggtttcagatgcatctaaaccttcctggaggaagggcacatattttgatgcaatcattactgatcctccatatggtatcagagaatctacaagaagaacaggttcacagaaggagataccaaaggggatagaaaaatgtccagaaagccatgttcctgtttccttgagttatcatctgagtgatatgtttcttgacctgttaaacttcgcagctgagaccctcgttttaggtggaagactagtctattggttac

SEQ ID NO: 7907 - DNA, 1106 bp, Homo sapiens
ggccacccgcagaacagagcttccgggacccacgcctcgtttgcactgggtgctggacagccgacgcaactacaaatggggcggagctttcggcactggagcagctaatttgcatataggaatgaggtgcggctcggcttccatgggcctaatttacagatagggcggtatttctgccccttaaccgaaagtgggatacagaggacgacggtgttaggcgcctgtgtaggagtaaaatgtgtttattttgcattcaacgagagctcctgcattgcagctattttgcatatgatttgcatcttacgaagaatttgtggcaaaaaaaagctgggcgtgcgccgtaggaacctcctgctgagacgcttccggtagcggcgcgtgacccgacaggtctttcacctacctacctcagctcccacaaacacgagaagttccagcaagttcgccacttccggttctcctggctatccaatagcatcgagaggagcatccccggaagtgaggcagcggaggacgacctttttccggttccggcctggcgagagtttgtgcggcgacatgaaactgcttacccacaatctgctgagctcgcatgtgcggggggtggggtcccgtggcttccccctgcgcctccaggccaccgaggtccgtatctgccctgtggaattcaaccccaacttcgtggcgcgtatgatacctaaagtggagtggtcggcgttcctggaggcggccgataacttgcgtctgatccaggtgccgaaagggccggttgagggatatgaggagaatgaggagtttctgaggaccatgcaccacctgctgctggaggtggaagtgatagagggcaccctgcagtgcccggaatctggacgtatgttccccatcagccgcgggatccccaacatgctgctgagtgaagaggaaactgagagttgattgtgccaggcgccagtttttcttgttatgactgtgtatttttgttgatctataccctgtttccgaattctgccgtgtgtatccccaacccttgacccaatgacaccaaacacagtgtttttgagctcggtattatatatttttttctcattaaaggtttaaaaccaaaa

SEQ ID NO: 7908 - DNA, 2215 bp, Homo sapiens
ctctttgcacgtcatttccggcaccggcatggccgggtgagctgcaggctaccttatttaagaccgggaatttagtcagcctggtgagccgactctgaggagatggagtatcgctgaggtgatgagagagaatgtggttgttagcaacatggagagagaaagtgggaagcccgtggctgttgtcgcagttgtgactgagccttggtttacccagcgatacagagaatatctccagaggcagaaactctttgatacacagcaccgtgtggaaaagatgccggatggctcggtggcgctaccggtgctgggagagacgcttccagagcagcacctgcaggagctgaggaatcgtgttgccccaggcagtccctgtatgctcacgcagctcccggatcctgttccttcgaagagggcccagggttgttcacctgcccaaaaattgtgtcttgaggtgagtcgctgggtggagggtcggggagtcaagtggtcagccgagttggaggctgatttgccccgatcatggcaacggcatggtaatctcttgttgctgagtgaagactgtttccaagccaagcagtggaaaaatctgggaccggaactctgggagaccgttgccttggcacttggcgtccagcgtttggcaaaacgagggcgggtatcaccggatggtactcgaactccagcagtgacactgctgctgggtgaccatggctgggtagagcatgtggataatggtatccgttataagtttgacgtgacccagtgtatgttctcctttggaaacatcactgagaagcttcgagtggcatcgttgtcctgtgctggagaagtgctggtggatctctatgcagggattggttattttacattgcctttcctagttcatgctggtgctgccttcgtccatgcttgtgagtggaatccccatgctgtagttgctctgagaaataaccttgagatcaatggagtagcagatcggtgccaaatacactttggagataacagaaaactgaagctctcaaatattgcagatagggtgatcctggggctgattcccagctctgaagaaggctggcccattgcctgccaagtgttaaggcaggatgctggaggcattttgcatatccaccaaaatgtggaatctttcccagggaagaatcttcaggctcttggagtcagcaaagtagagaaagagcattggctgtatcctcagcaaattaccaccaaccaatggaaaaatggagctaccagggattctaggggaaaaatgctgtcaccagccaccaagccagagtggcaaaggtgggcagaatctgcagaaactcgaatcgccactcttcttcagcaggtgcatgggaaaccatggaagacacaaattctgcacatccaaccagtgaaatcctatgctccccatgtggatcacatagtcctggatctggaatgctgcccctgtccttcagttggctagaggaggtagatcctgggacacatgggatccacgtgcgagtggcccttaaatgtatcagttcagtccaggttgtcatcccttttgtcccctggtgatcagtttttttcatattttatagccctgaaagcaggctctagatcaattcaaattatttcatttgtctttcattgataacagaaaatgaaatacctgtttgggagaagcagcatggcccattgaaatgaggctcatctgtgcaattatgaattccaaattctgacctcagttctggaattgaagtttcagtatgttttggcctcgggtttcgttatttgcaaaatgagagtttctttgaactgtctcacgtgactattaagcaactatacacaggacatcggttattttagagtgaaagacacagtgctttttccaaattgctctggctaccatatagaaaattgactgaaggagggccaagatggaaacagagagaccagtgaggaggcttctgtggttgtccaggtctgaggtgatggtaacttggactcggatggtggtaatgggaggtagattgatatgataaataaaattgacagaccaagcaatggaatcagaattaagtccttaacatgaagctgctttgttattatgactgactaaattagagagagaagggaacaaaaattattttagtgtatttccattcccttactgtggcattcctaaatgattgtgaggggttgtcttataaatttggtttgttgtggt

SEQ ID NO: 7909 - DNA, 1836 bp, Homo sapiens
gcgacggcgccttcgcgaaacactatgctaatggcatggtgccgcggtcctgtcttgctgtgcctgcggcaggggctcggaaccaattcattcctgcacggcctggggcaggagcccttcgagggagctcggtcactgtgttgcaggtcctcgcctagagacctgcgagatggagaaagagagcacgaggcggcacaaaggaaagccccaggagcagagtcttgcccatctctccctctgagcatctcggacattgggactggatgtctttcgtcactggaaaacctcagactgccgacgctgcgggaagagtcatcccctcgagagctcgaggactcgagcggagaccagggccggtgcggtcccacacaccagggatccgaggatccttcgatgctctcgcaggcccagtccgctaccgaggtcgaagagcgtcacgtctccccttcttgttcaacttccagagagagaccctttcaggctggggaactgattttagctgagactggggagggagaaacaaaatttaagaaattatttaggttgaacaacttcggactcttaaatagtaactggggggcagtcccgttcggcaagatcgtggggaagttccccggccagatactgaggagttccttcggtaagcagtacatgctgaggaggccagccttggaagactatgtagtattgatgaaaagagggactgccataacattcccaaaggatattaatatgattctctcaatgatggatatcaacccaggtgatactgttttggaagctggctcaggctctggtggaatgagcttatttttatccaaagcagttggatcacaaggacgagtcataagttttgaggtacgaaaagaccaccatgatctggctaagaagaattacaaacactggcgtgattcatggaaattaagtcatgtagaagagtggccagacaatgtggattttattcataaggacatttcaggagcaaccgaagacataaaatctttaacatttgacgcagtagctttggatatgttaaatcctcatgttactttgcctgttttttacccacatcttaagcatggtggtgtatgtgctgtatatgtagtaaacatcacacaggttattgaacttttagatggaattcgcacctgtgaacttgctctttcatgtgaaaagataagcgaggtcattgtcagagattggttggtttgccttgcaaaacagaaaaatggaattttagctcaaaaagtagaatctaaaatcaacacagatgtacaactagattctcaagagaaaattggagttaaaggtgagctgtttcaagaggatgaccatgaagaatcgcattctgattttccatatggatcatttccctatgttgctagaccagtacactggcaacctggtcatacagcttttcttgtcaagttgaggaaggtcaaaccacaacttaactgagtactccagatgacagtaactgacttgaagatggaaaaatatcaaaatagaactttatattgaaaatcactgcttccatagattggcatttttagctattactatgacttatataacttatacatataattttgaaaataacaactaaaagatgtataacatagcaaaactgcttaaacatcccattttgacacttgtcttgcagttagtttgacattttgtagttaatgattccaaattggtttagttgggccatctcattcttcacttcctgtaaaccactccatagatttgtctttcttcaagaaattagttttctttcctttatttgattgatggtcattgactactgaaataaaatatgcattttaagataaa

SEQ ID NO: 7910 - DNA, 1349 bp, Homo sapiens
gaggcctaggggcggggcttcgccgagaccccggaggctttgggtgcgctgcagcggtctgcggcgcgcagctgtttcggtaactgctttgcctcccggctcccgcaggaggatgctggtggtggaggtggcgaacggccgctccctggtgtggggagccgaggcggtgcaggccctccgggagcgcctgggtgtggggggccgcacggtaggcgccctgccccgcgggccccgccagaactcgcgcctgggcctcccgctgctgctgatgcccgaagaggcgcggctcttggccgagatcggcgccgtgactctggtcagcgccccgcgtccagactctcggcaccacagcctggccctgacatccttcaagcgccagcaagaggagagcttccaggagcagagcgccttggcagctgaggcccgggagacccgtcgtcaggagctcctggagaagattacggagggccaggctgctaagaagcagaaactagaacaggcttcaggggccagctcaagccaggaggccggctcgagccaggctgccaaagaggatgagaccagtgatggccaggcttcgggagagcaggaggaagctggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtgacttcctggtctatcctggtgaccccctccgcttccacgcccattatatcgctcagtgctgggcccccgaggacaccatcccactccaagacctggttgctgctgggcgccttggaaccagcgtcagaaagaccctgctcctctgttctccgcagcctgatggtaaggtggtctacacctccctgcaatgggccagcctgcagtgaactccagagacctaggggatgtggctgtgtcggcagcaagagcctttctggatgttccccagctcttctctgggagtctagaacatcctcctacctttctccgcggttagtttttgattccaggttttcgaacactacatcttttttatgttcttccttgtttcaaagcacttattggctgtgtttttgtagttacctattttcacactgtgagcttcccgagaatggggcctgggtttgattcatctgttttctacagggtttaagtctcaggaggtctcaataaacttggtatataaatgtt

SEQ ID NO: 7911 - DNA, 1424 bp, Homo sapiens
tgacgaagttgacgagggtgtcggcatgagggggtggagcaaggagcgcgtggcgcggtgcgcagtgggtggctccacctcgactgcgaattactgtttatgaggtgactcgctggttctatcggtggacagtgggacattctgaagggaggcaaggaggcggactgagcgctcccaattggggaggatgctggtggtggaggtggcgaacggccgctccctggtgtggggagccgaggcggtgcaggccctccgggagcgcctgggtgtggggggccgcacggtaggcgccctgccccgcgggccccgccagaactcgcgcctgggcctcccgctgctgctgatgcccgaagaggcgcggctcttggccgagatcggcgccgtgactctggtcagcgccccgcgtccagactctcggcaccacagcctggccctgacatccttcaagcgccagcaagaggagagcttccaggagcagagcgccttggcagctgaggcccgggagacccgtcgtcaggagctcctggagaagattacggagggccaggctgctaagaagcagaaactagaacaggcttcaggggccagctcaagccaggaggccggctcgagccaggctgccaaagaggatgagaccagtgatggccaggcttcgggagagcaggaggaagctggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtgacttcctggtctatcctggtgaccccctccgcttccacgcccattatatcgctcagtgctgggcccccgaggacaccatcccactccaagacctggttgctgctgggcgccttggaaccagcgtcagaaagaccctgctcctctgttctccgcagcctgatggtaaggtggtctacacctccctgcaatgggccagcctgcagtgaactccagagacctaggggatgtggctgtgtcggcagcaagagcctttctggatgttccccagctcttctctgggagtctagaacatcctcctacctttctccgcggttagtttttgattccaggttttcgaacactacatcttttttatgttcttccttgtttcaaagcacttattggctgtgtttttgtagttacctattttcacactgtgagcttcccgagaatggggcctgggtttgattcatctgttttctacagggtttaagtctcaggaggtctcaataaacttggtatataaatgtt

SEQ ID NO: 7912 - DNA, 1349 bp, Homo sapiens; identical to SEQ ID NO: 7910

SEQ ID NO: 7913 - DNA, 1349 bp, Homo sapiens; identical to SEQ ID NO: 7910

SEQ ID NO: 7914 - DNA, 1424 bp, Homo sapiens; identical to SEQ ID NO: 7911

SEQ ID NO: 7915 - DNA, 1424 bp, Homo sapiens; identical to SEQ ID NO: 7911

SEQ ID NO: 7916 - DNA, 1424 bp, Homo sapiens; identical to SEQ ID NO: 7911

SEQ ID NO: 7917 - DNA, 1424 bp, Homo sapiens; identical to SEQ ID NO: 7911

SEQ ID NO: 7918 - DNA, 1349 bp, Homo sapiens; identical to SEQ ID NO: 7910

SEQ ID NO: 7919 - DNA, 1349 bp, Homo sapiens; identical to SEQ ID NO: 7910

SEQ ID NO: 7920 - DNA, 1424 bp, Homo sapiens; identical to SEQ ID NO: 7911

SEQ ID NO: 7921 - DNA, 1349 bp, Homo sapiens; identical to SEQ ID NO: 7910

SEQ ID NO: 7922 - DNA, 3348 bp, Homo sapiens
gaaccaatcaggaccggcctggcagtgtcatggctgcccacaggtctgcaggcactcggtacgccgctaacgcggcgaggtagctcggtgcgtctcgcggtaccagtgcgaatcatcgggctatccaggtccgagatcctagtctcctgtcggctctgaggaggatggatccttctgcggatacatgggacctcttctcacctttaatatcattatggataaacaggttttacatttatttgggctttgctgttagcattagcctttggatttgtgtccagattgtcatcaagacgcagggcaagaacttacaggaaaaatctgttccaaaagcagctcaggatttgatgacaaatggttatgtctcccttcaagagaaagacatctttgtgtctggagtgaagattttttatggttctcagactggaacagcgaagggattcgcaacagttcttgctgaagcagttacatccctggatctgcctgtggccattattaatctaaaagaatatgatccagatgatcatctgatagaagaggtgactagtaaaaatgtctgtgtcttcctggttgcgacatacactgacggcctaccaactgaaagtgcagagtggttctgcaaatggttagaggaagcatccattgattttcgatttggcaaaacttacctgaagggtatgagatatgcggtatttggcctgggaaattctgcctatgctagccacttcaacaaggttggcaaaaatgttgacaagtggctctggatgcttggcgcgcatcgtgtgatgagtcgaggggagggcgactgcgacgtggttaaaagcaagcacggcagcattgaggccgacttcagagcatggaagaccaagttcatctcccagctgcaggcacttcagaaaggggagagaaagaagtcctgtggcggccactgcaagaaaggcaaatgtgaatctcaccaacatggctcagaggagagggaggaaggatctcatgagcaggatgaattgcatcatagagacaccgaggaggaagaaccctttgagagctccagtgaagaagagtttggtggtgaggaccatcagagcctaaattccattgttgatgttgaagatttgggcaaaattatggatcatgtgaagaaagaaaagagagaaaaggaacagcaggaagagaagtctggtttgttcaggaacatggggaggaatgaagatggtgaaagaagagctatgataactcctgctctccgagaagcccttactaaacaaggttatcagttgattgggagccactcgggggtgaagctttgcaggtggacaaagtccatgctccgagggagaggaggttgttacaaacacacattctatggaattgagagccatcgctgcatggaaaccaccccgagcttggcgtgtgctaataaatgtgtcttctgttggcggcaccacaccaaccccgtgggcactgagtggcggtggaagatggaccagcctgaaatgatcttgaaggaagccattgaaaaccatcagaacatgattaagcagtttaaaggagtaccgggcgtcaaagcagaacgctttgaagaaggaatgacggtaaagcactgtgcattgtccctcgtgggagaaccaataatgtacccagagatcaacaggtttttgaagctactccaccagtgtaaaatttccagcttcctggtcacaaacgcacaatttcctgcggaaatcaggaacctcgagccggttactcagctgtatgtcagtgtggatgccagtaccaaagacagcctgaagaaaatcgaccgcccactcttcaaggatttctggcagagattccttgacagtttaaaagccttggcagtcaagcaacaacgaactgtctacagactgacgctcgtgaaagcatggaacgtggacgagctccaggcctacgcgcagctcgtgtccctggggaatcctgacttcatcgaagtgaagggcgttacctactgcggagaaagttcagcaagcagtcttaccatggcccacgtgccctggcatgaggaagtggtacagtttgtccacgagttggtggatctgatccccgaatatgaaattgcatgtgaacacgaacactctaattgcctcctgatagcacacagaaagtttaaaattggtggtgaatggtggacatggatcgattataaccgcttccaggagctcatccaggaatatgaagatagtggtggatcaaaaacgttcagcgcaaaggattatatggccagaactcctcactgggcattatttggtgccagtgaaagaggctttgatcccaaggacacaagacatcagagaaagaacaaatcaaaggctatttctggatgttgagattatctgatttcaaggtactgaaggacaaaaacttggatggcctcaaaaggttcttgaacaccactgtgattctccaaggacgaattacgtaaattatactttcatacaaaggagacgataaggcagtaaacatggagacacgggggacagcgtccacactcagagggcctgggccacagccccgatgtttcttttcagaactcagcccctttcctgattttacttctaagaggaaaattattttggggaggaactacacagtcgtgattagaatttatctgatggttttgtattataacttgtaagacctgccagaatgctagtcccgagagtgtcagacaaggaagaagtccctgggcctcttccccttacccggcccttagatttcatggagcagccacttagcattgaattgcactaccctgagctaaacgtgtctgtgctttctaagataagagcttgatccctttcttctatcttaagacagcacctcctgaaaagaatcgaagttgtcacaactctcaattattttttaaatactgcatagattgagttttggtttattaccaacccttcccagaattgcgttggatctaaaactactagatctcatcccattcccatgtaaattaccacagaccgcagtaccggggctggagcggagtgaagctgtctgctgtaagaggagtggccatgtgagggcatggagtcattagtctcacaaacacactttggactgaagaggatcatttctttttgttcgtgaggtcactgtccaggcctctcatatcatgaccagacggcgggtctccatcttctttcactcctgtggccctggctgctttacacaatctgttctataaggttcaggtgttttcaagttggaaagatcataaatactcaaaattgttttcaagttagcaagttcttttaacagtcttttatgcaaaaattgaattaataaaataatcttttgtaaaga

SEQ ID NO: 7923 - DNA, 3114 bp, Homo sapiens
aggtctgcaggcactcggtacgccgctaacgcggcgaggtagctcggtgcgtctcgcggtaccagtgcgaatcatcgggctatccaggtccgagatcctagtctcctgtcggctctgaggaggatggatccttctgcggatacatgggacctcttctcacctttaatatcattatggataaacaggttttacatttatttgggctttgctgttagcattagcctttggatttgtgtccagattgtcatcaagacgcagggattcgcaacagttcttgctgaagcagttacatccctggatctgcctgtggccattattaatctaaaagaatatgatccagatgatcatctgatagaagaggtgactagtaaaaatgtctgtgtcttcctggttgcgacatacactgacggcctaccaactgaaagtgcagagtggttctgcaaatggttagaggaagcatccattgattttcgatttggcaaaacttacctgaagggtatgagatatgcggtatttggcctgggaaattctgcctatgctagccacttcaacaaggttggcaaaaatgttgacaagtggctctggatgcttggcgcgcatcgtgtgatgagtcgaggggagggcgactgcgacgtggttaaaagcaagcacggcagcattgaggccgacttcagagcatggaagaccaagttcatctcccagctgcaggcacttcagaaaggggagagaaagaagtcctgtggcggccactgcaagaaaggcaaatgtgaatctcaccaacatggctcagaggagagggaggaaggatctcatgagcaggatgaattgcatcatagagacaccgaggaggaagaaccctttgagagctccagtgaagaagagtttggtggtgaggaccatcagagcctaaattccattgttgatgttgaagatttgggcaaaattatggatcatgtgaagaaagaaaagagagaaaaggaacagcaggaagagaagtctggtttgttcaggaacatggggaggaatgaagatggtgaaagaagagctatgataactcctgctctccgagaagcccttactaaacaagtccatgctccgagggagaggaggttgttacaaacacacattctatggaattgagagccatcgctgcatggaaaccaccccgagcttggcgtgtgctaataaatgtgtcttctgttggcggcaccacaccaaccccgtgggcactgagtggcggtggaagatggaccagcctgaaatgatcttgaaggaagccattgaaaaccatcagaacatgattaagcagtttaaaggagtaccgggcgtcaaagcagaacgctttgaagaaggaatgacggtaaagcactgtgcattgtccctcgtgggagaaccaataatgtacccagagatcaacaggtttttgaagctactccaccagtgtaaaatttccagcttcctggtcacaaacgcacaatttcctgcggaaatcaggaacctcgagccggttactcagctgtatgtcagtgtggatgccagtaccaaagacagcctgaagaaaatcgaccgcccactcttcaaggatttctggcagagattccttgacagtttaaaagccttggcagtcaagcaacaacgaactgtctacagactgacgctcgtgaaagcatggaacgtggacgagctccaggcctacgcgcagctcgtgtccctggggaatcctgacttcatcgaagtgaagggcgttacctactgcggagaaagttcagcaagcagtcttaccatggcccacgtgccctggcatgaggaagtggtacagtttgtccacgagttggtggatctgatccccgaatatgaaattgcatgtgaacacgaacactctaattgcctcctgatagcacacagaaagtttaaaattggtggtgaatggtggacatggatcgattataaccgcttccaggagctcatccaggaatatgaagatagtggtggatcaaaaacgttcagcgcaaaggattatatggccagaactcctcactgggcattatttggtgccagtgaaagaggctttgatcccaaggacacaagacatcagagaaagaacaaatcaaaggctatttctggatgttgagattatctgatttcaaggtactgaaggacaaaaacttggatggcctcaaaaggttcttgaacaccactgtgattctccaaggacgaattacgtaaattatactttcatacaaaggagacgataaggcagtaaacatggagacacgggggacagcgtccacactcagagggcctgggccacagccccgatgtttcttttcagaactcagcccctttcctgattttacttctaagaggaaaattattttggggaggaactacacagtcgtgattagaatttatctgatggttttgtattataacttgtaagacctgccagaatgctagtcccgagagtgtcagacaaggaagaagtccctgggcctcttccccttacccggcccttagatttcatggagcagccacttagcattgaattgcactaccctgagctaaacgtgtctgtgctttctaagataagagcttgatccctttcttctatcttaagacagcacctcctgaaaagaatcgaagttgtcacaactctcaattattttttaaatactgcatagattgagttttggtttattaccaacccttcccagaattgcgttggatctaaaactactagatctcatcccattcccatgtaaattaccacagaccgcagtaccggggctggagcggagtgaagctgtctgctgtaagaggagtggccatgtgagggcatggagtcattagtctcacaaacacactttggactgaagaggatcatttctttttgttcgtgaggtcactgtccaggcctctcatatcatgaccagacggcgggtctccatcttctttcactcctgtggccctggctgctttacacaatctgttctataaggttcaggtgttttcaagttggaaagatcataaatactcaaaattgttttcaagttagcaagttcttttaacagtcttttatgcaaaaattgaattaataaaataatcttttgtaaa

SEQ ID NO: 7924 - DNA, 1399 bp, Homo sapiens
gctaacgcggcgaggtagctcggtgcgtctcgcggtaccagtgcgaatcatcgggctatccaggtccgagatcctagtctcctgtcggctctgaggaggatggatccttctgcggatacatgggacctcttctcacctttaatatcattatggataaacaggttttacatttatttgggctttgctgttagcattagcctttggatttgtgtccagattgtcatcaagacgcagggattcgcaacagttcttgctgaagcagttacatccctggatctgcctgtggccattattaatctaaaagaatatgatccagatgatcatctgatagaagaggaggaagaaccctttgagagctccagtgaagaagagtttggtggtgaggaccatcagagcctaaattccattgttgatgttgaagatttgggcaaaattatggatcatgtgaagaaagaaaagagagaaaaggaacagcaggaagagaagtctggtttgttcaggaacatggggaggaatgaagatggtgaaagaagagctatgataactcctgctctccgagaagcccttactaaacaagtccatgctccgagggagaggaggttgttacaaacacacattctatggaattgagagccatcgctgcatggaaaccaccccgagcttggcgtgtgctaataaatgtgtcttctgttggcggcaccacaccaaccccgtgggcactgagtggcggtggaagatggaccagcctgaaatgatcttgaaggaagccattgaaaaccatcagaacatgattaagcagtttaaaggagtaccgggcgtcaaagcagaacgctttgaagaaggaatgacggtaaagcactgtgcattgtccctcgtgggagaaccaataatgtacccagagatcaacaggtttttgaagctactccaccagtgtaaaatttccagcttcctggtcacaaacgcacaatttcctgcggaaatcaggaacctcgagccggttactcagctgtatgtcagtgtggatgccagtaccaaagacagcctgaagaaaatcgaccgcccactcttcaaggatttctggcagagattccttgacagtttaaaagccttggcagtcaagcaacaacgaactgtctacagactgacgctcgtgaaagcatggaacgtggacgagctccaggcctacgcgcagctcgtgtccctggggaatcctgacttcatcgaagtgaagggcgttacctactgcggagaaagttcagcaagcagtcttaccatggcccacgtgccctggcatgaggaagtggtacagtttgtccacgagttggtggatctgatccccgaatatgaaattgcatgtgaacacgaacactctaattgcctcctgatagcacacagaaag

SEQ ID NO: 7925 - DNA, 3430 bp, Homo sapiens
tcggccaccgctcgcttcaatatggctgcccccagggagagacgaggctaccatgaaggagccgagcgcagaccctgagtccgtcacccatggatcgcagcgcggagttcaggaaatggaaggcgcaatgtttgagcaaagcggacctcagccggaagggcagtgttgacgaggatgtggtagagcttgtgcagtttctgaacatgcgagatcagtttttcaccaccagctcctgcgctggccgcatcctactccttgaccggggtataaatggttttgaggttcagaaacaaaactgttgctggctactggttacacacaaactttgtgtaaaagatgatgtgattgtagctctgaagaaagcaaatggtgatgccactttgaaatttgaaccatttgttcttcatgtgcagtgtcgacaattgcaggatgcacagattctgcattccatggcaatagattctggtttcaggaactctggcataacggtgggaaagagaggaaaaactatgttggctgtccggagtacacatggcttagaagttccattaagccataagggaaaactgatggtgacagaggaatatattgacttcctgttaaatgtggcaaatcaaaaaatggaggaaaacaagaaaagaattgagaggttttacaactgcctacagcatgctttggaaagggaaacgatgactaacttacatcccaagatcaaagagaaaaataactcatcatatattcataagaaaaaaagaaacccagaaaaaacacgtgcccagtgtattactaaagaaagtgatgaagaacttgaaaatgatgatgatgatgatctaggaatcaatgttaccatcttccctgaagattactaagctttggttctgatgtgtcttggccgtaatgtttctagtaggttttataaagctgctcttcataagagtattttagtttgttgagtgtatcagccattcataagccagtaatgacaagtgcagagcttcaaactataactttgttgcccagaggatgtgcagttgtcatctaagctctcagcagtacccggcttatcctacgacttcacctgaaatgctatagttatccctacttttttaccagtttctcccagaagcacctgcttaataaatcaaagatgtttgaatggtgtcttattctgaaataacctgacctaagacaggtatttagattattttggatacattttgaaaagggatagcataaatattttaagtaaaaagacctttattttaaataatagtggatattttaatgctggaaattagcattatagttgatatgccagaaattatatctttggttgtgatttaaacttatgctataaactaaattaatgatgtaaatacatagttttaaacattcttttagggacatgtaacttttaagtatcacttcaataatacgtattattataggaacaaagatttgggaataattgattacaggtgaggaagtactggaattccagttcaaggagataccatttcatttaggactaaaaggacaagatacaagttcacatgatgggaaaaatcagaaaacctctcgcagacaaagggtatataatggatatgaggcatcaaaaagcatggtatagtcagtgatggggaatagtccagaaaggctgaaacacagcatgtgatgcgagtcaaggtagttgatgcccaactgtgaagggccgttctaatctagcatggaggtagacagtgtttccttaatatggctgcatatcagaattacctaggtcaggacgaggcatggagatgctactttaataggccctgccgcagatcttccaaaccagaatcttaatcctggagtctaggaatctttatttttcacacaactcatccaagtggttctgataaaatcagtccagcacttttagaacccactgataacagacttattcctggagacagcatttgaggaggaattgaagatttttctaatgaaaagaaaaagggtcacatgaacagatgttgcagtgtacctgtgccagggatttcatgtgtacactttataggagaataagcaagagcttaggtaagttatagtccttaccattgggtctaaggcagtttccaggaaagcatggcaactcgttcagctatgtaagttgaactctgtaccacttgggagggaacattcccctagatgacaatgtcagtggcactcgaagttgtgcagtgcacattcttatctaccaacatatacagcagtccttctgggaaggaaatttgggcaggaaagggaactcacagtgtcggaatgcctggagcatttcttctagtctggtggacagaatatgaaagtatctgcctggcagtgcagtaaatgaaaagagaagataaatgaataaaaaaaaaagttataaataacagtaggaaagagagagtgcaggtggaacgagcctatcctgtggtgaaatgacaacacattctgcagttttaaaatctaagaggctcattgacttttcttcattcatttaaattgatctccaagaaaactatgtattttaaagattccataaactgaatatatgaatgagaattaagaagagaggggctgcttcctaatctgtttatataaggtatagtatagtataatctgtttatataaggttagtagagaggagacaccaggtgctggccataaacctaagaagacattgaatcccattcactccttaacattccttaatatacattcatgagctacataacattttaatcatcaatgatggaccatataccatatacgatatggtggccccataagattataatggacctgaaaaattcctattgctagtgatgtggtcattgtaaagctgtagcacaacacattacccacgtttgtggtgacagtcatataaaagtatggtacatataattatgtacagtgcatacataatacttgataatatgttactggtttgtgtctttgctatgctttttatcattattttagggtatactacttaaaatgttaactgtaaaacagcttctgacaggtccttcaggaagtactccagaagaaggcattgttatcatagaaggtgacagcttcatgtgtgttattgcccctgaagaccttccagtggtacaagatgtggaggaggaagacagtgatactgaggattctgaccctgtgtaggcttaggctaatgtgtgtgtttatatcttagtttttcacaaaaaggtttttccaatgttaaaaaaaatatataaaaaagcttatagaataaggatataaagaaatattttgtacagctgtacaataagctaagcattattaccaaagagtcaaaaagttttaagaaattaaagtttataaaccaaatgttcattgtgagccaaggttaatttattgaagaaataaaacatttttaatg

SEQ ID NO: 7926 - DNA, 943 bp, Homo sapiens
aatatggctgcccccagggagagacgaggctaccatgaaggagccgagcgcagaccctgagtccgtcacccatggatcgcagcgcggagttcaggaaatggaaggcgcaatgtttgagcaaagcggacctcagccggaagggcagtgttgacgaggatgtggtagagcttgtgcagtttctgaacatgcgagatcagtttttcaccaccagctcctgcgctggccgcatcctactccttgaccgggctgtccggagtacacatggcttagaagttccattaagccataagggaaaactgatggtgacagaggaatatattgacttcctgttaaatgtggcaaatcaaaaaatggaggaaaacaagaaaagaattgagaggttttacaactgcctacagcatgctttggaaagggaaacgatgactaacttacatcccaagatcaaagagaaaaataactcatcatatattcataagaaaaaaagaaacccagaaaaaacacgtgcccagtgtattactaaagaaagtgatgaagaacttgaaaatgatgatgatgatgatctaggaatcaatgttaccatcttccctgaagattactaagctttggttctgatgtgtcttggccgtaatgtttctagtaggttttataaagctgctcttcataagagtattttagtttgttgagtgtatcagccattcataagccagtaatgacaagtgcagagcttcaaactataactttgttgcccagaggatgtgcagttgtcatctaagctctcagcagtacccggcttatcctacgacttcacctgaaatgctatagttatccctacttttttaccagtttctcccagaagcacctgcttaataaatcaaagatgtttgaatggtgtcttattctgaaataacctgacctaagacaggtatttagattattttggata

SEQ ID NO: 7927 - DNA, 3335 bp, Homo sapiens
cttttcggccaccgctcgcttcaatatggctgcccccagggagagacgaggctaccatgaaggagccgagcgcagaccctgagtccgtcacccatggatcgcagcgcggagttcaggaaatggaaggcgcaatgtttgagcaaagcggacctcagccggaagggcagtgttgacgaggatgtggtagagcttgtgcagtttctgaacatgcgagatcagtttttcaccaccagctcctgcgctggccgcatcctactccttgaccggggtataaatggttttgaggttcagaaacaaaactgttgctggctactggttacacacaaactttgtgtaaaagatgatgtgcattccatggcaatagattctggtttcaggaactctggcataacggtgggaaagagaggaaaaactatgttggctgtccggagtacacatggcttagaagttccattaagccataagggaaaactgatggtgacagaggaatatattgacttcctgttaaatgtggcaaatcaaaaaatggaggaaaacaagaaaagaattgagaggttttacaactgcctacagcatgctttggaaagggaaacgatgactaacttacatcccaagatcaaagagaaaaataactcatcatatattcataagaaaaaaagaaacccagaaaaaacacgtgcccagtgtattactaaagaaagtgatgaagaacttgaaaatgatgatgatgatgatctaggaatcaatgttaccatcttccctgaagattactaagctttggttctgatgtgtcttggccgtaatgtttctagtaggttttataaagctgctcttcataagagtattttagtttgttgagtgtatcagccattcataagccagtaatgacaagtgcagagcttcaaactataactttgttgcccagaggatgtgcagttgtcatctaagctctcagcagtacccggcttatcctacgacttcacctgaaatgctatagttatccctacttttttaccagtttctcccagaagcacctgcttaataaatcaaagatgtttgaatggtgtcttattctgaaataacctgacctaagacaggtatttagattattttggatacattttgaaaagggatagcataaatattttaagtaaaaagacctttattttaaataatagtggatattttaatgctggaaattagcattatagttgatatgccagaaattatatctttggttgtgatttaaacttatgctataaactaaattaatgatgtaaatacatagttttaaacattcttttagggacatgtaacttttaagtatcacttcaataatacgtattattataggaacaaagatttgggaataattgattacaggtgaggaagtactggaattccagttcaaggagataccatttcatttaggactaaaaggacaagatacaagttcacatgatgggaaaaatcagaaaacctctcgcagacaaagggtatataatggatatgaggcatcaaaaagcatggtatagtcagtgatggggaatagtccagaaaggctgaaacacagcatgtgatgcgagtcaaggtagttgatgcccaactgtgaagggccgttctaatctagcatggaggtagacagtgtttccttaatatggctgcatatcagaattacctaggtcaggacgaggcatggagatgctactttaataggccctgccgcagatcttccaaaccagaatcttaatcctggagtctaggaatctttatttttcacacaactcatccaagtggttctgataaaatcagtccagcacttttagaacccactgataacagacttattcctggagacagcatttgaggaggaattgaagatttttctaatgaaaagaaaaagggtcacatgaacagatgttgcagtgtacctgtgccagggatttcatgtgtacactttataggagaataagcaagagcttaggtaagttatagtccttaccattgggtctaaggcagtttccaggaaagcatggcaactcgttcagctatgtaagttgaactctgtaccacttgggagggaacattcccctagatgacaatgtcagtggcactcgaagttgtgcagtgcacattcttatctaccaacatatacagcagtccttctgggaaggaaatttgggcaggaaagggaactcacagtgtcggaatgcctggagcatttcttctagtctggtggacagaatatgaaagtatctgcctggcagtgcagtaaatgaaaagagaagataaatgaataaaaaaaaaagttataaataacagtaggaaagagagagtgcaggtggaacgagcctatcctgtggtgaaatgacaacacattctgcagttttaaaatctaagaggctcattgacttttcttcattcatttaaattgatctccaagaaaactatgtattttaaagattccataaactgaatatatgaatgagaattaagaagagaggggctgcttcctaatctgtttatataaggtatagtatagtataatctgtttatataaggttagtagagaggagacaccaggtgctggccataaacctaagaagacattgaatcccattcactccttaacattccttaatatacattcatgagctacataacattttaatcatcaatgatggaccatataccatatacgatatggtggccccataagattataatggacctgaaaaattcctattgctagtgatgtggtcattgtaaagctgtagcacaacacattacccacgtttgtggtgacagtcatataaaagtatggtacatataattatgtacagtgcatacataatacttgataatatgttactggtttgtgtctttgctatgctttttatcattattttagggtatactacttaaaatgttaactgtaaaacagcttctgacaggtccttcaggaagtactccagaagaaggcattgttatcatagaaggtgacagcttcatgtgtgttattgcccctgaagaccttccagtggtacaagatgtggaggaggaagacagtgatactgaggattctgaccctgtgtaggcttaggctaatgtgtgtgtttatatcttagtttttcacaaaaaggtttttccaatgttaaaaaaaatatataaaaaagcttatagaataaggatataaagaaatattttgtacagctgtacaataagctaagcattattaccaaagagtcaaaaagttttaagaaattaaagtttataaaccaaatgttcattgtgagccaaggttaatttattgaagaaataaaacatttttaatg

SEQ ID NO: 7928 - DNA, 4306 bp, Homo sapiens
gcctcagcggtgtcggagaaagagactggagagcaaagtggacctgttgctgcagcctctggtgagtcggccccgtccccgctctccagcacgcagcccaggccgaggcccttcggcaacccgccccgcgctcggacccagccactctggagtctgccggcctcgcggaccttttctctgtcgctcgtgtttccgggcggatggcgctgaggaacgctttagagccgaagttccgaagacctggaagagggcaggcgtgagcaaccatggccgggcagcacctcccggtaccccggctggagggcgtttctcgggagcagttcatgcagcacctctacccacagagaaaacctcttgtgttggaagggattgatttggggccatgtacaagcaaatggacagtggattacctaagccaagttggagggaagaaagaagtaaagattcatgttgctgcagttgcacagatggacttcattagtaagaactttgtatatagaactttaccttttgaccagttggtccagagggcagctgaagagaaacataaagaattctttgtttcagaggatgagaaatactacttacggtcacttggagaagaccctagaaaggatgttgcagatatcagaaagcagtttcctttgttgaaaggagatattaagtttccagaattcttcaaagaggaacagttcttttccagtgtttttcgaattagttcaccaggattacaactatggactcattatgatgtaatggataatttgttaatacaagtgacaggaaaaaagcgtgttgtactcttcagtcctcgagatgcccagtatttatatttaaaaggtactaaatcagaagtactgaatatagataacccagacttggctaaatatccacttttttccaaggctagaagatatgaatgttcccttgaagctggtgatgtattattcattcctgctttatggttccataatgtaatttctgaagagtttggagtgggagtgaatatcttttggaagcaccttccatctgaatgctatgataaaacagatacctatggaaacaaagatcctacagcagcatcaagagctgcacaaattctggacagagccttgaaaacactggccgagttaccagaggaatatagggacttctatgcacgacgaatggtcctacacattcaagacaaagcctacagcaagaactctgagtaaataatgaagtgaatgcaatgcacattaacactttagtaaggtataacgatataaattaaagattttgttaaaataggaaagatacatcagatttacagattatgtaagtacgaaggggtgtttgtgtggattctacttgatacagattgttataattaaagaatgctgtgctgggaccactctttaacattcagatgctgaccactaaaagtccaacttaaaatgacttaaaaacagtaagaaaatatattgattcacaatacatgaaatctattgacagaatgtgctgcagtgtttctgatccaatgattcagtaatgtcatcaagaaccttgggaacccgcctccacaccccacccccttttcaaccacaacattggcatcatcctaaggctggctaccctcgtggtcatgggatgattgccagtagcagttggagccttgtgcatcttcatttacatgcagcggaagagtcaggctggattctaggggccctgtcctagtatgagaaagctttcccagaattcactttccatatccttaggtctcattgctctaaagtaacttagacctgtccatccctgagccagtcactggcaaagggtctagaataacctttagggcagtcaggtccactggagctgagagtagaagtggaggccacatgagggatatatggggacagaaaggatagtttttttaaaatcatggttctgataggaaaaacatgagcaacgcacaatatctattacatttgcctagaagcagaattttttgaggaactttaaaaaatgtacagatacctaggtcccaactttgtagactgattcaagagtgtttgggatttggtataggaacttaatagacctcacagggtgttctgatgcataatcagagctgagatcaactggagttgatgatagtgacttggattattagttttgtgattagtgcaaaacaaatgtttaatctgatcttgacttttcttgccacccagtatgtcagggtggtttttggtttttgaatgttacaaaataaataatttatacctatgtctaaaccttagcctagttaaagatttcccaactattttttccacctatcccttttttaaaagaaaaattacttaaagaatgaataaatgagatcctaaaagtgttgtcatcgaagacagtgagccattgtgtgtggatctctgcttttgttttgtacctagtaattatattgcagtgtcattgaagaccacataatcttcactgaacataaatgtgttcatctaaagcaatctcttagtacatcaatttggtgcattttaattagagaaaatcattttctctattgaagagaatccatccactcatgtcctataaattatagtaaataaggaaaagcatatataacattctgaatttcctaggtgtctttggaaacaggtaagttactcaggtgaataaaggtgaaaaaagtcttgtcagaaaaggaatgattatattagccaaatttaattaccaggttttgatcttcattaagcaaagcaaagaacttctttactgattccttgtccttcagtaaggaaaaagacaaaactctccttagtttacacattatttatggtcagtttttaataaatcttgttttttttcttaaccagcaagagaattgatacaaagtataaatccagagtcatgtagaaaacttggaagtattaataaaacagattacagtttgtgcactgaatagtcatcttaattgattgtttaatggagaagcaaactggatgaccttagacaaaataacatttatctatgaagcttattttcctcatctttaaaacagaactacaaaaatgcagagagttcaagggcaggcacatagttgataactggtgctagttcttctatttaattatattccatctttgttgagagatttgaggtagctcctgttgcagtattaatttataatattttaaaagttagagaactttcctttgggatgttttaaaattatttccctggtcataattaatattagggtctgtttatttcaaatacaaaatattttaatcttttcttcctactgggttaagaccaaatgagatgtttgtttttaatgtataaaatcttatacagtgtatgttagctgcaacttctcaggaattctgaatcttagaacttttttattgaaagagatcttagaagccatctaaccaacccagattgcttaatgattgtctgggttcacatagctatgggtgatagaaaccgggattcgttgtgaccagtaattctccattctccctaatgtgcagcacatctccagtacttctgaatagattacacagcttttctttggctagtttgggggcttgacctgatgcaaaaaggaatttttttcctctgccaacaaaatttctcactgcactgcttgctacacagacaagattcaaaataaaagtaatggtgggtcaggtgccatggctcatgcctgtaatcccagcactttgggaggccgaggtgggcagatcacgaggtcagatcaagaccattctggccaacatggtaaaaccccgtctctactaaaaatagaaaaattaaatgttacatgaaaaacatatttgaaactgtactgccatttgtgtaaaacaaggtatgtggtgtgtgaacatcttatttgcatatgcatataattatctctaaggatgcacgagaaaccagtgataattatgcctccaagaagaggttcaactaggtgggctgcttagaatctagttttgtattatttggacttttgttcacattatcctttcaaaatacattttaaaaatactatatgcaccgaggtgggtggatcatctgaactcaggagttcgagaccagcctgggcaacatggcgaaaccttgtctctaccaaaaatacagagaattagctggctgtggtggtgtgcgcctgtagtcccagctactcaggaggctaagataggaggatcacttgagcctgggaggtgcaggttgcagtgagctggaattgtgcaactgcactccagcctgggtgacagagtgagaccctgtctcaaaaaaaaaaaaaaaaaaa

SEQ ID NO: 7929 - DNA, 1191 bp, Homo sapiens
ataaatggggaggggagagcccactgggtagaaggaacagggagcggccaggatgctgaatctgctgctgctggcgctgcccgtcctggcgagccgcgcctacgcggcccctgccccaggccaggccctgcagcgagtgggcatcgttgggggtcaggaggcccccaggagcaagtggccctggcaggtgagcctgagagtccgcgaccgatactggatgcacttctgcgggggctccctcatccacccccagtgggtgctgaccgcagcgcactgcgtgggaccggacgtcaaggatctggccgccctcagggtgcaactgcgggagcagcacctctactaccaggaccagctgctgccggtcagcaggatcatcgtgcacccacagttctacaccgcccagatcggagcggacatcgccctgctggagctggaggagccggtgaacgtctccagccacgtccacacggtcaccctgccccctgcctcagagaccttcccccccatgccgtgctgggtcactggctggggcgatgtggacaatgatgagcgcctcccaccgccatttcctctgaagcaggtgaaggtccccataatggaaaaccacatttgtgacgcaaaataccaccttggcgcctacacgggagacgacgtccgcatcgtccgtgacgacatgctgtgtgccgggaacacccggagggactcatgccagggcgactccggagggcccctggtgtgcaaggtgaatggcacctggctgcaggcgggcgtggtcagctggggcgagggctgtgcccagcccaaccggcctggcatctacacccgtgtcacctactacttggactggatccaccactatgtccccaaaaagccgtgagtcaggcctggggtgtccacctgggtcactggagagccagcccctcctgttcaaaacaccactgcttcctacccaggtggcgactgccccccacaccttccctgccccgtcctgagtgccccttcctgtcctaagccccctgctctcttctgagccccttcccctgtcctgaggacccttccccatcctgagcccccttccctgtcctaagcctgacgcctgcaccgggccctccggccctcccctgcccaggcagctggtggtgggcgctaatcctcctgagtgctggacctcattaaagtgcatggaaatca

SEQ ID NO: 7930 - DNA, 4477 bp, Homo sapiens
cccagcatccctggcgcggccatttcagccccatcttggcccagcggagggagctgcagccgccgcttcagcagtttgaatttcagtttcttcggggtttaggaattgggcgcaccgaggaggagccggagaagccaccaccgctacctcacacagccggggcgcctccggtcccgtgccagcggtctgccgccgccgcccctctctgagagaagccgcgaggggaggccgagaccgccgtcgccgcccgcccgcaggggtggttccccctgtaaggggaggaccgagccggctttcccctcccccagagcgggtttccgcctgaggcagtcgacatgtccctggggctgagctccggctagagccggggagggagggccgcctgcccgcgccacagccccaccgcccgcccgcggaccttcagccagctccggcccgcggctcccggctgaattaggcatctccgactccggactcgccgctccttccctcagtcagagagcccagcgctgacgccggcaccggcctgaggagcccgagcggggcagcaccgcccctcacgccgccgccaccgcctcctcctcctcctcttcgccctcccactcccacccccagccaaggcctgctgaccgcgccgagcgccgagctggactgaccacggctgcccggagacgagagaggaagcagccggcccgcccctgggttcgcgctctcgccgcctctgagggaattgaattgaggcgccgcggctgcgagagctaaaaaggaaggaggagccgccgcgggactgagacgggggcagagccgaagagaccgacacagagaaggaaacgaggaggaggatgtctcaccgggcggccagcgcctggatcagcccgtgactcttaacagcggcgggcctcagaccccagcgcagactcggactttgtctttgggggcccgtgctctgccctccccggtttccgacaggacccagaggagccggcgtgcctctctgccctccagccttcttcaccatgtccaagatgccggccaagaagaagagctgcttccagatcaccagtgtcaccacggcccaggtggccactagcatcaccgaggacaccgagagcttggacgacccggacgagtcacgcacagaggacgtctcctccgagattttcgacgtctctcgggccacggattatggccctgaggaggtctgcgagcgcagctcttccgaagagacgcttaacaatgttggggatgcggagactcccgggaccgtctccccaaacctcctcctagatgggcagctggcagcggcggctgctgctcccgccaacggaggaggagtcgtttcggcccggagcgtgtctggggcgctcgccagtaccctggcggcggctgccacttcggcccccgcccccggagcacccggcggcccccagctcgcgggctcatccgccgggccagtgactgcagccccatctcagcctcccaccacatgtagttcccgttttcgcgtgatcaagctggaccacgggagcggagagccctatagacgcggccgatggacgtgtatggaatactatgagagggattcagacagcagcgtcctgactagatccggggattgcattagacacagcagtacttttgaccagactgcggagcgggacagcggcctgggcgccaccggagggtcggtggtggtagtagtggcctccatgcagggggcgcacgggcccgagtcgggaactgacagctccttgactgctgtgtcacagctacccccgtcggagaaaatgagccagcccactccggcccagccgcagagttttagcgttgggcagccacagccgccgccgccacccgtaggtggggctgtggctcaaagctcggctccgctgccgccgttcccgggagccgcgaccgggccgcagccaatgatggcagccgcgcagcccagccagccccagggagcggggcccgggggacagactctgccgccgacgaatgtaaccctggcgcagccggctatgtccctgcctccgcagccgggccctgcagtgggcgcccccgcggcgcagcagccccagcagttcgcgtatcctcagcctcagataccgcccggacatttgctgcccgtccagccctccggccagagtgagtacctgcagcagcacgtggccggcctgcagccgccaagccccgcgcagccctcgtccaccggcgccgcagcgagccccgccacggcggccacccttcccgtgggcaccggccagaatgcttcctcggtgggcgcgcagctcatgggcgcgtcttcccagcccagcgaagccatggccccccggacgggaccagcgcaaggcgggcaggtcgcgccttgtcagccgactggagtgcccccggctactgtgggaggcgtggtgcagccgtgcctcggtcctgccggggctgggcagccccagtccgtgcctccgccgcagatgggtggcagtggtccgctgtcagccgtacctggtggccctcacgccgtggtgcccggagttccaaacgtgcctgcagccgtgcccgctccaagcgtgcctagtgtgtctaccacttctgttactatgccaaatgtacccgcgcctctggcccagtcgcaacagctgagcagccatacgccagtcagcaggagcagcagcataatccagcatgttgggctgcccttagcgccaggcacacacagcgcaccaacaagtctaccacagtctgacctaagccagtttcaaactcagacccagcctttagtcgggcaagtcgacgatactagaagaaaatcagaacccctacctcaaccaccactttctctcattgctgaaaataagcctgttgtgaagccgcctgttgcagattccctggcaaacccccttcagttaacacctatgaacagtctggccacctctgtattcagcatagctattcctgttgatggtgatgaagacagtgcatctgggggaggtgttgtagccattgacaacaaaatagaacaagcaatggatctggtgaaaagccatttgatgtatgcagtaagagaagaagtggaagttttaaaggaacaaataaaagaattagttgaaagaaactctttacttgaacgagaaaatgcactgttaaaatctctttcaagcaatgatcaattatcccaactcccaacccaacaggccaatcctggtagcacttctcaacagcaagcagtgatagcacagcctccgcagccaacgcaacctccacagcagccgaatgtctcctcagcataaagctttcttaagcctcattaagaaaaaaactgaaagcaatctatccttgtgtgccactggtgttctttccactttatacgaaagcaagtagccatgctttggttgtgtgtttggccttttcagtattagacaatcattctacaagagcttttcctctctctgagatgtcatgcagcgctgttgatgtccagttctatgtcatcagtacacaaggagaataatagatggggtttattaaagcgagcaaagtctgcattttacctggtgcgcatgagtggggtctttaagagttttggtggctctcccatgtttcctattacccatggatttaccctgagccttcctatcacattataaataacagttcatctaaagagccacttttctttctgattcagtaacatttgcctacataagttttcatttatttgtgttttatttattacagggctgctattttcataatgtacatgaacaatgtcacagaacttttttaatttttttgaataattataagtatcagtaaaggaagtgaaagacaggattgcatttaatagataaaacgtttaggcaataattgaacaaaagaatcctggcatatttctaacactaatggcaatttacttatggtatttattttcagtagtaaagacccagcttgaatgtaaattttgtatagtgtaagtatgaagaacatagtgcaactgtacaggtagtcaccagttattgtgatatgataaataattgggctattttgatgaagaaaactttgttcatttgtttctactttctaagagaaattgccacgattcctctgcttttcaacatttcgtatgacttttttttcgggtgggaataaaaagctgtgaaattgttcaacctactttgtaaccaaagaagcaaagctgtgtaatggagtttggtttttttttgttgtttttttttttttgtctttttttttttttataatgcacattctttatgtatttttatttagtgttttctcagtcacaattttctttactgtctagcatgatctgcatgacctataatctttgaaccactttcgtacctcatgtttttatccagcactcttattgtaatatgtactagtctgtgaacaatgtcaaataaaagagaacgaacaggtagtttggtggagctgagctagtgtacaatacactagttgt

SEQ ID NO: 7931 - DNA, 4839 bp, Homo sapiens
cccagcatccctggcgcggccatttcagccccatcttggcccagcggagggagctgcagccgccgcttcagcagtttgaatttcagtttcttcggggtttaggaattgggcgcaccgaggaggagccggagaagccaccaccgctacctcacacagccggggcgcctccggtcccgtgccagcggtctgccgccgccgcccctctctgagagaagccgcgaggggaggccgagaccgccgtcgccgcccgcccgcaggggtggttccccctgtaaggggaggaccgagccggctttcccctcccccagagcgggtttccgcctgaggcagtcgacatgtccctggggctgagctccggctagagccggggagggagggccgcctgcccgcgccacagccccaccgcccgcccgcggaccttcagccagctccggcccgcggctcccggctgaattaggcatctccgactccggactcgccgctccttccctcagtcagagagcccagcgctgacgccggcaccggcctgaggagcccgagcggggcagcaccgcccctcacgccgccgccaccgcctcctcctcctcctcttcgccctcccactcccacccccagccaaggcctgctgaccgcgccgagcgccgagctggactgaccacggctgcccggagacgagagaggaagcagccggcccgcccctgggttcgcgctctcgccgcctctgagggaattgaattgaggcgccgcggctgcgagagctaaaaaggaaggaggagccgccgcgggactgagacgggggcagagccgaagagaccgacacagagaaggaaacgaggaggaggatgtctcaccgggcggccagcgcctggatcagcccgtgactcttaacagcggcgggcctcagaccccagcgcagactcggactttgtctttgggggcccgtgctctgccctccccggtttccgacaggacccagaggagccggcgtgcctctctgccctccagccttcttcaccatgtccaagatgccggccaagaagaagagctgcttccagatcaccagtgtcaccacggcccaggtggccactagcatcaccgaggacaccgagagcttggacgacccggacgagtcacgcacagaggacgtctcctccgagattttcgacgtctctcgggccacggattatggccctgaggaggtctgcgagcgcagctcttccgaagagacgcttaacaatgttggggatgcggagactcccgggaccgtctccccaaacctcctcctagatgggcagctggcagcggcggctgctgctcccgccaacggaggaggagtcgtttcggcccggagcgtgtctggggcgctcgccagtaccctggcggcggctgccacttcggcccccgcccccggagcacccggcggcccccagctcgcgggctcatccgccgggccagtgactgcagccccatctcagcctcccaccacatgtagttcccgttttcgcgtgatcaagctggaccacgggagcggagagccctatagacgcggccgatggacgtgtatggaatactatgagagggattcagacagcagcgtcctgactagatccggggattgcattagacacagcagtacttttgaccagactgcggagcgggacagcggcctgggcgccaccggagggtcggtggtggtagtagtggcctccatgcagggggcgcacgggcccgagtcgggaactgacagctccttgactgctgtgtcacagctacccccgtcggagaaaatgagccagcccactccggcccagccgcagagttttagcgttgggcagccacagccgccgccgccacccgtaggtggggctgtggctcaaagctcggctccgctgccgccgttcccgggagccgcgaccgggccgcagccaatgatggcagccgcgcagcccagccagccccagggagcggggcccgggggacagactctgccgccgacgaatgtaaccctggcgcagccggctatgtccctgcctccgcagccgggccctgcagtgggcgcccccgcggcgcagcagccccagcagttcgcgtatcctcagcctcagataccgcccggacatttgctgcccgtccagccctccggccagagtgagtacctgcagcagcacgtggccggcctgcagccgccaagccccgcgcagccctcgtccaccggcgccgcagcgagccccgccacggcggccacccttcccgtgggcaccggccagaatgcttcctcggtgggcgcgcagctcatgggcgcgtcttcccagcccagcgaagccatggccccccggacgggaccagcgcaaggcgggcaggtcgcgccttgtcagccgactggagtgcccccggctactgtgggaggcgtggtgcagccgtgcctcggtcctgccggggctgggcagccccagtccgtgcctccgccgcagatgggtggcagtggtccgctgtcagccgtacctggtggccctcacgccgtggtgcccggagttccaaacgtgcctgcagccgtgcccgctccaagcgtgcctagtgtgtctaccacttctgttactatgccaaatgtacccgcgcctctggcccagtcgcaacagctgagcagccatacgccagtcagcaggagcagcagcataatccagcatgttgggctgcccttagcgccaggcacacacagcgcaccaacaagtctaccacagtctgacctaagccagtttcaaactcagacccagcctttagtcgggcaagtcgacgatactagaagaaaatcagaacccctacctcaaccaccactttctctcattgctgaaaataagcctgttgtgaagccgcctgttgcagattccctggcaaacccccttcagttaacacctatgaacagtctggccacctctgtattcagcatagctattcctgttgatggtgatgaagacaggaatccttcaactgctttctaccaagcgttccatttgaacacgttaaaggaatcaaagagcctctgggatagtgcatctgggggaggtgttgtagccattgacaacaaaatagaacaagcaatggatctggtgaaaagccatttgatgtatgcagtaagagaagaagtggaagttttaaaggaacaaataaaagaattagttgaaagaaactctttacttgaacgagaaaatgcactgttaaaatctctttcaagcaatgatcaattatcccaactcccaacccaacaggccaatcctggtagcacttctcaacagcaagcagtgatagcacagcctccgcagccaacgcaacctccacagcagccgaatgtctcctcagcataaagctttcttaagcctcattaagaaaaaaactgaaagcaatctatccttgtgtgccactggtgttctttccactttatacgaaagcaagtagccatgctttggttgtgtgtttggccttttcagtattagacaatcattctacaagagcttttcctctctctgagatgtcatgcagcgctgttgatgtccagttctatgtcatcagtacacaaggagaataatagatggggtttattaaagcgagcaaagtctgcattttacctggtgcgcatgagtggggtctttaagagttttggtggctctcccatgtttcctattacccatggatttaccctgagccttcctatcacattataaataacagttcatctaaagagccacttttctttctgattcagtaacatttgcctacataagttttcatttatttgtgttttatttattacagggctgctattttcataatgtacatgaacaatgtcacagaacttttttaatttttttgaataattataagtatcagtaaaggaagtgaaagacaggattgcatttaatagataaaacgtttaggcaataattgaacaaaagaatcctggcatatttctaacactaatggcaatttacttatggtatttattttcagtagtaaagacccagcttgaatgtaaattttgtatagtgtaagtatgaagaacatagtgcaactgtacaggtagtcaccagttattgtgatatgataaataattgggctattttgatgaagaaaactttgttcatttgtttctactttctaagagaaattgccacgattcctctgcttttcaacatttcgtatgacttttttttcgggtgggaataaaaagctgtgaaattgttcaacctactttgtaaccaaagaagcaaagctgtgtaatggagtttggtttttttttgttgtttttttttttttgtctttttttttttttataatgcacattctttatgtatttttatttagtgttttctcagtcacaattttctttactgtctagcatgatctgcatgacctataatctttgaaccactttcgtacctcatgtttttatccagcactcttattgtaatatgtactagtctgtgaacaatgtcaaataaaagagaacgaacaggtagtttggtggagctgagctagtgtacaatacactagttgtaaaaaaaaaaaaaaaaaaaagtgagccatcttttgttcatttaaaatggtgttttgaatttcgtatgcagaaaacgttttgttacattgcagattttaatgtatttaataaatgcaacatgcagattaagtgcagtgtatactgagtatttaaattaaaatgtacatttcataaatacagtttcaaaagaaagcatcattttgtgtatactaacacattaagtgtatgtcagaaattgatgtataaatatatattttaacattttctgaaattaaactgcagttttgttg

SEQ ID NO: 7932 - DNA, 1257 bp, Homo sapiens
attttagtcggcagcggcggcggcagcggggctgctgctcctcccagcatccctggcgcggccatttcagccccatcttggcccagcggagggagctgcagccgccgcttcagcagtttgaatttcagtttcttcggggtttaggaattgggcgcaccgaggaggagccggagaagccaccaccgctacctcacacagccggggcgcctccggtcccgtgccagcggtctgccgccgccgcccctctctgagagaagccgcgaggggaggccgagaccgccgtcgccgcccgcccgcaggggtggttccccctgtaaggggaggaccgagccggctttcccctcccccagagcgggtttccgcctgaggcagtggtccgctgtcagccgtacctggtggccctcacgccgtggtgcccggagttccaaacgtgcctgcagccgtgcccgctccaagcgtgcctagtgtgtctaccacttctgttactatgccaaatgtacccgcgcctctggcccagtcgcaacagctgagcagccatacgccagtcagcaggagcagcagcataatccagcatgttgggctgcccttagcgccaggcacacacagcgcaccaacaagtctaccacagtctgacctaagccagtttcaaactcagacccagcctttagtcgggcaagtcgacgatactagaagaaaatcagaacccctacctcaaccaccactttctctcattgctgaaaataagcctgttgtgaagccgcctgttgcagattccctggcaaacccccttcagttaacacctatgaacagtctggccacctctgtattcagcatagctattcctgttgatggtgatgaagacagtgcatctgggggaggtgttgtagccattgacaacaaaatagaacaagcaatggatctggtgaaaagccatttgatgtatgcagtaagagaagaagtggaagttttaaaggaacaaataaaagaattagttgaaagaaactctttacttgaacgagaaaatgcactgttaaaatctctttcaagcaatgatcaattatcccaactcccaacccaacaggccaatcctggtagcacttctcaacagcaagcagtgatagcacagcctccgcagccaacgcaacctccacagcagccgaatgtctcctcagcataaagctttcttaagcctcattaagaaaaaaactgaaagcaatctatccttgtgtgccactggtgttctttccactttatacg

SEQ ID NO: 7933 - DNA, 1534 bp, Homo sapiens
cacgtggactggggccggataatggcgggcgctgcagaagatgcgcgagctcttttccgggctggggtctgcgcggccctggaggcctggccggccttgcagatcgctgtggagaatggcttcgggggtgtgcacagccaggagaaggccaagtggctggggggtgcagtggaggattacttcatgcgcaatgctgacttggagctagatgaggtggaagacttccttggagagctgttgaccaacgagtttgatacagttgtggaagacgggagtctgccccaggtgagccagcaactgcagaccatgttccaccacttccagaggggtgatggggctgctctgagggagatggcctcctgcatcactcagagaaaatgcaaggtcacagccactgcacttaagacagctagagagactgatgaggatgaagatgatgtggacagtgtggaagagatggaggtcacagctacgaatgatggggctgctacagatggggtctgcccccagcctgaaccctctgatccagacgctcagactattaaggaagaggatatagtggaagatggctggaccattgtccggagaaaaaaatgagtggggatgattggaaatggctttgggcccttatttgctgttctaagagttgtctgtaggggttttttttttgaggattgcagacctgtggactggttaccccatctccaccctctcccctgttcctctgtctggctccctccagggcaaggaaaacctagggtccttggtcttgggggtggggggaccttttccagcatattcccctgggcctttagttaacatccgagtgacgaagccgggttccccagtacagtgtcttttgggtgcggtcattgtgaggaaggggatgagtgagtgtgggtgtggctggaggaggagctagatgccggtggacagtgggcaggtggatttggggaggagaggatcagcagcagcagcagtactcagtgatagggggctggctgggtcaggaatggtgagatgaacatgcaagtggaagagagaatagttgaaaatgtgaatgaaagtagctctggagcctctcccttaccccaccccacacacacgcaacagctctgtacccctgcccagaacttggaacctcccaggaatgctgccttccttcagcccagcctccagtcctgggttccctcaggaattcgaagaccttggctaggtggtgagcttggaagagctgggctttgttttctgtctcctctaacctctttccttactccttatcccatcccatttgagttcaggggtgaggcttaagatcttaataaataataccttactgcttaatctgtggcttgacctgtgagtagtagccttagaatcagccttctgggagctcagcttcagagtttacaagggagcagtttctgggcccaccctagcagcctggtactttggacaaccaaacagatgaacgaacggagcacagcagtgctatgaaagttactgtaagcctgaaataaactgtatttttctt

SEQ ID NO: 7934 - DNA, 3385 bp, Homo sapiens
gggccgacggacggcgggcggcggcggcggtggcggcgctggagtcggcgcgggtgctggcgccatggaggccgagcggggtcccgagcgccggcctgcggagcgtagcagcccgggccagacgccggaggagggcgcgcaggccttggccgagttcgcggcgctgcacggcccggcgctgcgcgcttcgggggtccccgaacgttactggggccgcctcctgcacaagctggagcacgaggttttcgacgctggggaagtgtttgggatcatgcaagtggaggaggtagaagaggaggaggacgaggcagcccgggaggtgcggaagcagcagcccaacccggggaacgagctgtgctacaaggtcatcgtgaccagggagagcgggctccaggcagcccaccccaacagcatcttcctcatcgaccacgcctggacgtgccgtgtggagcacgcgcgccagcagctgcagcaggtgcccgggctgctgcaccgcatggccaacctgatgggcattgagttccacggtgagctgcccagtacagaggctgtggccctggtgctggaggagatgtggaagttcaaccagacctaccagctggcccatgggacagctgaggagaagatgccggtgtggtatatcatggacgagttcggttcgcggatccagcacgcggacgtgcccagcttcgccacggcacccttcttctacatgccgcagcaggtggcctacacgctgctgtggcccctgagggacctggacactggcgaggaggtgacccgagactttgcctacggagagacggaccccctgatccggaagtgcatgctgctgccctgggcccccaccgacatgctggacctcagctcttgcacacccgagccgcccgccgagcactaccaggccattctggaggaaaacaaggagaagctgccacttgacatcaaccccgtggtgcacccccacggccacatcttcaaggtctacacggacgtgcagcaggtggccagcagcctcacccacccgcgcttcaccctcacccagagtgaggcggacgccgacatcctcttcaacttctcacacttcaaggactacaggaaactcagccaggagaggccaggcgtgctgctgaaccagttcccctgcgagaacctgctgactgtcaaggactgcctggcctccatcgcgcgccgggcaggtggccccgagggcccaccctggctgccccgaaccttcaacctgcgcactgagctgccccagtttgtcagctacttccagcagcgggaaaggtggggcgaggacaaccactggatctgcaagccctggaacctggcgcgcagcctggacacccacgtcaccaagagcctgcacagcatcatccggcaccgagagagcacccccaaggttgtgtccaagtacatcgaaagtcccgtgttgttccttcgagaagacgtgggaaaggtcaagttcgacatccgctacatcgtgctgctgcggtcagtgaggcccctacggttgttcgtgtatgatgtgttctggctgcggttctccaaccgggcctttgcactcaacgacctggatgactacgagaagcacttcacggtcatgaactatgacccggatgtggtgctgaagcaggtgcactgtgaagagttcatccccgagtttgagaagcaatacccagaatttccctggacggacgtccaggctgagatcttccgggccttcacggagctgttccaggtggcctgtgccaagccaccacccctgggcctctgcgactacccctcatcccgggccatgtatgccgtcgacctcatgctgaagtgggacaacggcccagatggaaggcgggtgatgcagccgcagatcctggaggtgaacttcaaccccgactgtgagcgagcctgcaggtaccaccccaccttcttcaacgacgtcttcagcaccttgtttctggaccagcccggtggctgccacgttacctgccttgtctaggcactcgctgtccccaaaacctgtgcttggggcaggattccaacctcagttctctgagctgcttctgcaaaggcccccatgtccctccccacaccggccctgggcatagcctcagccccaggcctctgtcctgccgagccatcctcccggcgccacactccgggagcacagcatcctcctctcacctgtgggtcagagcaggacagtgatggtgtccccagggctgagcaccaccccacgccctgccctcacccctcaccaccatctgtgcactgatgagtctccagtttagccaagggctttgttcctggcatggagaatttgttcctggctgctgtgtttccagggggtgctgggggaagggttccgtggagcgagacaaggtgtcctcgggagcagggttccaccgggaagcgtttgggagccctgtatcacacggggcaggcgggtttctcttccggggtctctgctcttatgcatcaggacgaccccgggacggctgtggggccccacactgcacccacagggctctatgcgacaggggcccaggaacagcctgaggccaccacccagcaagcccgccttatcacccattccagctcacccagaaccttcaccagcaaacctcctgctgaggtcctggcaggaggccaccgtcttgttaccgtttccttttcgtttgctgagggtcacagaccccaacagggaaatcagtatctgtcttcccagtggttgccctgctcgccgggcactccacggggtcccgcccttgtgtgagatgggccaggatccttcggcaaggggcgcctggggctggggctgattgtgggcggtggagcgccagacagaaaaggattccaatgagaacttcaggttaaagtcagatgccacctaccagggtctacagtcaaaatgttggctttttcttattttttaatgtatgggagaaaaatgtaaaattccagttcttttctaattgtgtttctgaaattaggagtcagctgccagcgtttttgtgtggctgcagtgtgcctgggcccagctcacgggcagtgggtggacctaactgcccaggcaggcgagagctacttccagagccttccagtgcatgggagggcagggctaggtgtagcggtgtctcctctttgaaattaagaactatctttcttgtagcaaagctgcacctgatgatgctgcctctcctctctgtgttgtctgggcccttgtttacaagcacgcgttacccttcctgaggggagccatgctctagcccctggagggcctgttgcaggggcagggcgggcccgtcgcctttggcagctcctggagagctgtggacatgcagtccccctcagttcgtgctgcaataaaggccatcttctctta

SEQ ID NO: 7935 - DNA, 2180 bp, Homo sapiens
gccgacggacggcgggcggcggcggcggtggcggcgctggagtcggcgcgggtgctggcgccatggaggccgagcggggtcccgagcgccggcctgcggagcgtagcagcccgggccagacgccggaggagggcgcgcaggccttggccgagttcgcggcgctgcacggcccggcgctgcgcgcttcgggggtccccgaacgttactggggccgcctcctgcacaagctggagcacgaggttttcgacgctggggaagtgtttgggatcatgcaagtggaggaggtagaagaggaggaggacgaggcagcccgggaggtgcggaagcagcagcccaacccggggaacgagctgtgctacaaggtcatcgtgaccagggagagcgggctccaggcagcccaccccaacagcatcttcctcatcgaccacgcctggacgtgccgtgtggagcacgcgcgccagcagctgcagcaggtgcccgggctgctgcaccgcatggccaacctgatgggcattgagttccacggtgagctgcccagtacagaggctgtggccctggtgctggaggagatgtggaagttcaaccagacctaccgccatgtatgccgtcgacctcatgctgaagtgggacaacggcccagatggaaggcgggtgatgcagccgcagatcctggaggtgaacttcaaccccgactgtgagcgagcctgcaggtaccaccccaccttcttcaacgacgtcttcagcaccttgtttctggaccagcccggtggctgccacgttacctgccttgtctaggcactcgctgtccccaaaacctgtgcttggggcaggattccaacctcagttctctgagctgcttctgcaaaggcccccatgtccctccccacaccggccctgggcatagcctcagccccaggcctctgtcctgccgagccatcctcccggcgccacactccgggagcacagcatcctcctctcacctgtgggtcagagcaggacagtgatggtgtccccagggctgagcaccaccccacgccctgccctcacccctcaccaccatctgtgcactgatgagtctccagtttagccaagggctttgttcctggcatggagaatttgttcctggctgctgtgtttccagggggtgctgggggaagggttccgtggagcgagacaaggtgtcctcgggagcagggttccaccgggaagcgtttgggagccctgtatcacacggggcaggcgggtttctcttccggggtctctgctcttatgcatcaggacgaccccgggacggctgtggggccccacactgcacccacagggctctatgcgacaggggcccaggaacagcctgaggccaccacccagcaagcccgccttatcacccattccagctcacccagaaccttcaccagcaaacctcctgctgaggtcctggcaggaggccaccgtcttgttaccgtttccttttcgtttgctgagggtcacagaccccaacagggaaatcagtatctgtcttcccagtggttgccctgctcgccgggcactccacggggtcccgcccttgtgtgagatgggccaggatccttcggcaaggggcgcctggggctggggctgattgtgggcggtggagcgccagacagaaaaggattccaatgagaacttcaggttaaagtcagatgccacctaccagggtctacagtcaaaatgttggctttttcttattttttaatgtatgggagaaaaatgtaaaattccagttcttttctaattgtgtttctgaaattaggagtcagctgccagcgtttttgtgtggctgcagtgtgcctgggcccagctcacgggcagtgggtggacctaactgcccaggcaggcgagagctacttccagagccttccagtgcatgggagggcagggctaggtgtagcggtgtctcctctttgaaattaagaactatctttcttgtagcaaagctgcacctgatgatgctgcctctcctctctgtgttgtctgggcccttgtttacaagcacgcgttacccttcctgaggggagccatgctctagcccctggagggcctgttgcaggggcagggcgggcccgtcgcctttggcagctcctggagagctgtggacatgcagtccccctcagttcgtgctgcaataaaggccatcttctctt

SEQ ID NO: 7936 - DNA, 1780 bp, Homo sapiens
aacggcggcggccacgggcttgctagaggaagcgctgccccggcagccgcagccacggccaccgggagctaggagtgaacccctgcgggggagcagcttccccctcgcgatcgtggggacagccagtcctgtgaaacgaggaggcggttccggacgcccagaaacgcccagggagacctggagccgggggaagaggggacatgagcggccagctgagtccatccccaggcggctaggggcggacccagcagcccctcagctctcctcgtaaccacggaatctgagagaatggagccgagtacctgtaggaccatggaatcagaggaagactatgttgaggaaaaggaatctgagaagtgtgttaaagagggagttaccaacccctctaactcttcacagcaggctctcttaaaagctgactataaggcattaaaaaatggggttccctcacccattatggccacaaaaattccgaagaaagtcatagccccagttgacacaggcgacttagaagctgggaggaggaagagaaggcggaaacgcagatcactggccatcaacctgaccaactgcaagtatgagagtgtgcgtcgggcagcccaaatgtgtggcctgaaggaggtgggggaggatgaagagtggactctgtactggacagactgcgctgtctcactggaacgagtcatggacatgaagaggtttcagaaaatcaaccacttccctggcatgacagaaatctgccgcaaagatctgctggctcggaacctcaaccgcatgtacaaactctatccctctgagtacaacatcttcccccgcacctggtgcctccccgcagactatggggacttccagtcctacggtcgtcagcgaaaagcccgcacatatatctgcaagccagacagtggctgtcagggacgtggcatcttcattacccgaaatccccgggagatcaagccaggagagcatatgatctgccagcaatacatctccaagcccctcctcattgatggcttcaagtttgatatgcgagtctacgtcctgatcacatcctgtgaccctctccggatcttcacatatgaggagggcctagcccgttttgccaccacgccctatatggagcccagccataacaacctggacaatgtctgcatgcacctgaccaactatgctatcaacaaacacaatgagaattttgtccgggatggcgctgtgggcagtaagaggaagctgtcgacactcaacatctggctgcaagagcacagctacaaccctggagagctgtggggggacatcgaggacatcatcatcaaaaccatcatctcagcccattctgttctacgccacaactaccgaacctgttttccccagtatctgaatggaggtacatgtgcctgttttgaaatccttggttttgacatcttgctggaccacaagttgaagccctggctgctagaggtaaaccactctccaagctttaccacggactcatgccttgatcaagaagtaaaggatgcacttctctgtgatgctatgacccttgtcaacctccggggctgtgacaaaaggaaggtgatggaggaggataagcggcgagtcaaggaacggcttttccagtgctaccgacagccacgagaatctaggtgtgctaggtgtctggcatgtgtttagttcttcattattcctgagagtaaaagtcctcctttagatgaagaatgtggcctggggctgatttgctatcaaaaacaactttttgcatagataatatgttcatatttgcatt

SEQ ID NO: 7937 - DNA, 2738 bp, Homo sapiens
gcaacggcggcggccacgggcttgctagaggaagcgctgccccggcagccgcagccacggccaccgggagctaggagtgaacccctgcgggggagcagcttccccctcgcgatcgtggggacagccagtcctgtgaaacgaggaggcggttccggacgcccagaaacgcccagggagacctggagccgggggaagaggggacatgagcggccagctgagtccatccccaggcggctaggggcggacccagcagcccctcagctctcctcgtaaccacggaatctgagagaatggagccgagtacctgtaggaccatggaatcagaggaagactatgttgaggaaaaggaatctgagaagtgtgttaaagagggagttaccaacccctctaactcttcacagcaggctctcttaaaagctgactataaggcattaaaaaatggggttccctcacccattatggccacaaaaattccgaagaaagtcatagccccagttgacacaggcgacttagaagctgggaggaggaagagaaggcggaaacgcagatcactggccatcaacctgaccaactgcaagtatgagagtgtgcgtcgggcagcccaaatgtgtggcctgaaggaggtgggggaggatgaagagtggactctgtactggacagactgcgctgtctcactggaacgagtcatggacatgaagaggtttcagaaaatcaaccacttccctggcatgacagaaatctgccgcaaagatctgctggctcggaacctcaaccgcatgtacaaactctatccctctgagtacaacatcttcccccgcacctggtgcctccccgcagactatggggacttccagtcctacggtcgtcagcgaaaagcccgcacatatatctgcaagccagacagtggctgtcagggacgtggcatcttcattacccgaaatccccgggagatcaagccaggagagcatatgatctgccagcaatacatctccaagcccctcctcattgatggcttcaagtttgatatgcgagtctacgtcctgatcacatcctgtgaccctctccggatcttcacatatgaggagggcctagcccgttttgccaccacgccctatatggagcccagccataacaacctggacaatgtctgcatgcacctgaccaactatgctatcaacaaacacaatgagaattttgtccgggatggcgctgtgggcagtaagaggaagctgtcgacactcaacatctggctgcaagagcacagctacaaccctggagagctgtggggggacatcgaggacatcatcatcaaaaccatcatctcagcccattctgttctacgccacaactaccgaacctgttttccccagtatctgaatggaggtacatgtgcctgttttgaaatccttggttttgacatcttgctggaccacaagttgaagccctggctgctagaggtaaaccactctccaagctttaccacggactcatgccttgatcaagaagtaaaggatgcacttctctgtgatgctatgacccttgtcaacctccggggctgtgacaaaaggaaggtgatggaggaggataagcggcgagtcaaggaacggcttttccagtgctaccgacagccacgagaatctaggaaagaaaaaactgagtcatcccatgtggcaatgctggaccaggaacgatatgaggattctcacctgggaaaataccggcggatctaccctgggcctgacacagagaagtatgcccgcttcttcaagcacaatggctccctcttccaagagactgctgcttccaaggccagagaggagtgtgccaggcagcaactagaggagatccgccttaagcaggaacagcaggagacctcgggcactaagaggcaaaaggccagggaccagaaccagggtgaatcagctggggagaaaagccgacccagggcagggctccagagcctttccacccacttggcttacaggaaccgcaactgggagaaagagctgctgccgggacagctggacaccatgaggcctcaagaaattgtggaagaggaggagctggagcggatgaaggccctgctacaaagggagactctcatccgaagcctgggtattgtagagcagctcacccgtctgcagcaccctggcccccagggccagaaaaaacttcatgagagtcgggacaggctgggcagtcaagaactgaaatctatgagtctggtcctactggtgctcctaagaggggctgccacagagcagggcgctcctcatttcctgcatccagttctgccccatgaatcaatccccaggatcttaggggcactgccaagcatgaatgctgcaatcccacatgttccccggtaccatctgcagcccaagaacttcaactggacaggagagccggcagccatcaactcctgttcattgtcaatgaagaaggctgggaggtgctatttttccagtgccagaatcaggctcactagccaaggacaagccagcagaaggctagaagccataaaccgagtcctggcaggatcagtgccacccactttaaccccaaagcagggctattttctgcaaccggaaagagtggcatctgactcatggactgaatgcaccttgccctccatggtaaactctgaacacagagcagccaaggttcccctctgccctgcgtctgcacccatgctgcagcgttccagagcactcctcaacatcaatcagttcaggtaa

SEQ ID NO: 7938 - DNA, 2075 bp, Homo sapiens
agtgctccctccagcctccgcgcatttcagctggcgctgcagctgctgcacagagacccacagaggccaccctcggaaccagcgcccaatgagagggcgggacctgtgttcctccacacaaagccaggcgctgggatctttgagaaccaccaccccagcctttacccttaacattccatccgaggcaaaccacactgagcagccgcctgcaggcctgggagcaaggctacaggaagcaggtgtttccatccctcccaggcgaggccgcccaacaccaacactggagaagaagaaaaaacctcatttgatggcggaagatgaaccttcaggggccctcttgaagccgctggtttttcgcgttgacgagaccaccccggctgtggtgcaaagcgtcctcctggagagggggtggaataagtttgataagcaggagcagaacgcggaggactggaacctgtactggaggacatcctctttccgaatgaccgaacacaacagtgttaaaccgtggcagcagctaaaccaccaccctggaaccaccaagcttaccaggaaagactgtttggccaaacacctgaagcacatgaggaggatgtatggcacttccctgtaccagttcatccccctgacgttcgtcatgcccaatgactataccaagttcgtggctgaatactttcaggagaggcagatgctgggcaccaagcatagctattggatttgcaagcctgctgagttatctcgtgggagggggatactaattttcagtgactttaaagacttcatctttgatgatatgtacatagtgcagaaatatatctccaatcctttacttattggcagatataaatgtgatctccgcatctatgtttgtgttactggctttaagcctttgaccatttatgtttatcaggaagggttggttcggtttgccacggaaaagtttgacctcagtaatttgcaaaacaattatgcccatttgaccaacagcagcatcaataaatccggggcctcttatgagaagatcaaagaagtgattggtcatggttgtaaatggacgctcagcagatttttttcctaccttcgtagctgggatgtggacgatctgcttttgtggaagaaaatccaccgcatggttattctcaccattctcgccattgcaccatctgtcccctttgctgccaattgctttgagctctttgggtttgatattttgattgatgacaacttgaaaccatggcttttagaggtcaactacagcccagccttgaccttggattgttcaacagatgtgttggtgaagagaaaacttgtccatgatattattgacctgatttacttaaatggtctaagaaatgaggggagagaagccagtaatgccacacatggaaattccaacatcgacgctgcaaaaagtgacagaggtgggcttgatgctcctgactgtcttccttatgattctctttcgttcacaagcagaatgtacaacgaggatgactctgtggtggagaaagctgtgagtgtgcgtcctgaagctgcacctgcctcccagctggaaggagagatgagtgggcaggattttcatctgtcaacaagggagatgccacaaagcaagcccaagttacggagcaggcacacgcctcacaagacactcatgccctacgcgtccctcttccagtcgcactcctgcaagaccaagacctccccgtgtgtcctgtcagaccgtggcaaagctccagatccccaagcaggcaactttgttcttgtttttcctttcaatgaagcaactctcggagcttccaggaatggattaaatgtcaaaagaataatccaagagctccagaaactaatgaataagcaacattcctaagtggtaaaaaatcaaatcaagaaaaagtgacatggatttttaaaaaccaaggatcctgtcctagagaaagcaatagttcaagtccctacctgtgccaccagcatgttaactatgacattgggactgaagatgtggccatatgtataaatataacagctctgacaaagcacaatatgttcaagtggtgattaaactacattacatccca

SEQ ID NO: 7939 - DNA, 1822 bp, Homo sapiens
catttcagctggcgctgcagctgctgcacagagacccacagaggccaccctcggaaccagcgcccaatgagagggcgggacctgtgttcctccacacaaagccaggcgctgggatctttgagaaccaccaccaacactggagaagaagaaaaaacctcatttgatggcggaagatgaaccttcaggggccctcttgaagccgctggtttttcgcgttgacgagaccaccccggctgtggtgcaaagcgtcctcctggagagggggtggaataagtttgataagcaggagcagaacgcggaggactggaacctgtactggaggacatcctctttccgaatgaccgaacacaacagtgttaaaccgtggcagcagctaaaccaccaccctggaaccaccaagcttaccaggaaagactgtttggccaaacacctgaagcacatgaggaggatgtatggcacttccctgtaccagttcatccccctgacgttcgtcatgcccaatgactataccaagttcgtggctgaatactttcaggagaggcagatgctgggcaccaagcatagctattggatttgcaagcctgctgagttatctcgtgggagggggatactaattttcagtgactttaaagacttcatctttgatgatatgtacatagtgcagaaatatatctccaatcctttacttattggcagatataaatgtgatctccgcatctatgtttgtgttactggctttaagcctttgaccatttatgtttatcaggaagggttggttcggtttgccacggaaaagtttgacctcagtaatttgcaaaacaattatgcccatttgaccaacagcagcatcaataaatccggggcctcttatgagaagatcaaagaagtgattggtcatggttgtaaatggacgctcagcagatttttttcctaccttcgtagctgggatgtggacgatctgcttttgtggaagaaaatccaccgcatggttattctcaccattctcgccattgcaccatctgtcccctttgctgccaattgctttgagctctttgggtttgatattttgattgatgacaacttgaaaccatggcttttagaggtcaactacagcccagccttgaccttggattgttcaacagatgtgttggtgaagagaaaacttgtccatgatattattgacctgatttacttaaatggtctaagaaatgaggggagagaagccagtaatgccacacatggaaattccaacatcgacgctgcaaaaagtgacagaggtgggcttgatgctcctgactgtcttccttatgattctctttcgttcacaagcagaatgtacaacgaggatgactctgtggtggagaaagctgtgagtgtgcgtcctgaagctgcacctgcctcccagctggaaggagagatgagtgggcaggattttcatctgtcaacaagggagatgccacaaagcaagcccaagttacggagcaggcacacgcctcacaagacactcatgccctacgcgtccctcttccagtcgcactcctgcaagaccaagacctccccgtgtgtcctgtcagaccgtggcaaagctccagatccccaagcaggcaactttgttcttgtttttcctttcaatgaagcaactctcggagcttccaggaatggattaaatgtcaaaagaataatccaagagctccagaaactaatgaataagcaacattcctaagtggtaaaaaatcaaatcaagaaaaagtgacatggatttttaaaaaccaaggatcctgtcctagagaaagcaatagttcaagtccctacctgtgccacc

SEQ ID NO: 7940 - DNA, 2406 bp, Homo sapiens
gcttgggcagcgacagctgttccaggcactccgcgtcgagcaccggagtcccgagccgtggctgccacgggcggtgggcgggcggaggagagcaccggaccaccagtgcaggctgccgagtcggggcggccgcccacggggaagctgcgaggcgcgggagcacctgggggaccgcttgcagcggggacgcgaggacccgggctgggctttcctcacccgggtaccttgttatcccataactttggtatcctgaaatctgaggattccaccaagataatatgataagaactttcagtgatttggggccatatcctacttagactaatgtggaatttccagatttcctgagagcttggtacagcagcacacactgcttgctaatcagcacaggcaataatgccatctctgcctcaagaaggagttattcagggaccctctcccctggatttgaatacagaattaccttatcaaagcacaatgaaaaggaaagtcagaaagaagaaaaagaagggaaccattacagcaaatgttgccgggacaaagtttgaaattgttcgtttagtaatagatgaaatgggatttatgaaaactccagatgaggatgaaacaagtaatcttatatggtgtgattctgctgttcagcaggagaaaatttcagagctgcaaaattatcagaggatcaaccattttccaggaatgggggagatctgtaggaaggatttcttagcaagaaatatgaccaaaatgatcaagtctcggcctctggattatacctttgttcctcgaacttggatctttcctgctgaatatactcaattccaaaattatgtgaaagaattgaagaaaaaacggaagcagaaaacttttatagtgaaaccagctaatggtgcaatgggtcatgggatttctttgataagaaatggtgacaaacttccatctcaggatcatttgattgttcaagaatacattgaaaagcctttcctaatggaaggttacaagtttgacttacgaatttatattctggttacatcgtgtgatccactaaaaatatttctctaccatgatgggcttgtgcgaatgggtacagagaagtacattccacctaatgagtccaatttgacccagttatacatgcatctgacaaactactccgtgaacaagcataatgagcattttgaacgggatgaaactgagaacaaaggcagcaaacgttccatcaaatggtttacagaattccttcaagcaaatcaacatgatgttgctaagttttggagtgatatttcagaattggtggtaaagaccctgattgtagcagaacctcatgtcctgcatgcctatcgaatgtgtagacctggtcaacctccaggaagcgaaagtgtctgctttgaagtcctgggatttgatattttgttggatagaaaactaaagccatggcttctggagattaaccgagccccaagctttggaactgatcagaaaatagactatgatgtaaaaaggggagtgctgctaaatgcgttgaagctactaaacataaggaccagtgacaaaagaagaaacttggccaaacaaaaagctgaggctcaaaggaggctctatggtcaaaattcaattaaaaggctcttaccaggctcctcagactgggaacagcagagacaccagttggagaggcggaaagaagagttgaaagagagactcgctcaagtacgaaagcagatctcacgagaagaacatgaaaatcgacatatggggaattatagacgaatttatcctcctgaagataaagcattacttgaaaagtatgaaaatttgttagctgttgcctttcagaccttcctttcaggaagagcagcttcattccagcgagagttgaataatcctttgaaaaggatgaaggaagaagatattttggatcttctggagcaatgtgaaattgatgatgaaaagttgatgggaaaaactaccaagactcgaggaccaaagcctctgtgttctatgcctgagagtactgagataatgaaaagaccaaagtactgcagcagtgacagcagttatgatagtagcagcagctcttcagaatctgacgaaaatgaaaaagaagagtaccaaaataagaaaagagaaaagcaagttacatataatcttaaaccctccaaccactacaaattaattcaacaacccagctccataagacgttcagtcagctgccctcggtccatctctgctcaatcaccttccagtggggacacccgcccattttctgctcaacaaatgatatctgtgtcacggccaacttctgcatctcggtcacattccttaaaccgtgcttcctcctacatgaggcatctgcctcacagtaatgatgcctgctctaccaactctcaagtggtagcaataataagacag

SEQ ID NO: 7941 - DNA, 1708 bp, Homo sapiens
gcttgggcagcgacagctgttccaggcactccgcgtcgagcaccggagtcccgagccgtggctgccacgggcggtgggcgggcggaggagagcaccggaccaccagtgcaggctgccgagtcggggcggccgcccacggggaagctgcgaggcgcgggagcacctgggggaccgcttgcagcggggacgcgaggacccgggctgggctttcctcacccgggaattggtggtaaagaccctgattgtagcagaacctcatgtcctgcatgcctatcgaatgtgtagacctggtcaacctccaggaagcgaaagtgtctgctttgaagtcctgggatttgatattttgttggatagaaaactaaagccatggcttctggagattaaccgagccccaagctttggaactgatcagaaaatagactatgatgtaaaaaggggagtgctgctaaatgcgttgaagctactaaacataaggaccagtgacaaaagaagaaacttggccaaacaaaaagctgaggctcaaaggaggctctatggtcaaaattcaattaaaaggctcttaccaggctcctcagactgggaacagcagagacaccagttggagaggcggaaagaagagttgaaagagagactcgctcaagtacgaaagcagatctcacgagaagaacatgaaaatcgacatatggggaattatagacgaatttatcctcctgaagataaagcattacttgaaaagtatgaaaatttgttagctgttgcctttcagaccttcctttcaggaagagcagcttcattccagcgagagttgaataatcctttgaaaaggatgaaggaagaagatattttggatcttctggagcaatgtgaaattgatgatgaaaagttgatgggaaaaactaccaagactcgaggaccaaagcctctgtgttctatgcctgagagtactgagataatgaaaagaccaaagtactgcagcagtgacagcagttatgatagtagcagcagctcttcagaatctgacgaaaatgaaaaagaagagtaccaaaataagaaaagagaaaagcaagttacatataatcttaaaccctccaaccactacaaattaattcaacaacccagctccataagacgttcagtcagctgccctcggtccatctctgctcaatcaccttccagtggggacacccgcccattttctgctcaacaaatgatatctgtgtcacggccaacttctgcatctcggtcacattccttaaaccgtgcttcctcctacatgaggcatctgcctcacagtaatgatgcctgctctaccaactctcaagtgagtgagtctttgcggcaactgaaaacaaaagaacaagaagatgatctaacaagtcagaccttatttgttctcaaagacatgaagatccggtttccaggaaagtcagatgcagaatcagaacttctgatagaagatatcattgataactggaagtatcataaaaccaaagtggcttcatattggctcataaaattggactctgtaaaacaacgaaaagttttggacatagtgaaaacaagtattcgtacagttcttccacgcatctggaaggtgcctgatgttgaagaagtaaatttatatcggattttcaaccgggtttttaatcgcttactctggagtcgtggccaagggctgtggaactgtttctgtgattcaggatatcta

SEQ ID NO: 7942 - DNA, 1776 bp, Homo sapiens
aaggcgcgaaggctgggcgtcgcgatcgcaggtgcacgcgcgtggcccgcgagacgaggagatcctgttggaaagcaactgcagcatgtcctggaacattagtcacccccaactctctgataaactgtttgggaagaatggagtgttggaggagcagaaatctccaggattcaagaaaagagagacagaggtgtatgttggcaatcttccactggatatttctaaggaggaaattctgtaccttctaaaggacttcaaccctcttgatgtccacaaaatccagaatggctgcaaatgctttgcatttgtagatctgggctccatgcagaaagtgacacttgcaatccaggagctgaatggtaaactcttccacaagcgaaaactgttcgtgaatacaagcaaaaggccccccaagaggacccctgatatgatccagcagcctcgggccccgctggtgttggagaaggcttctggtgaaggatttggcaaaaccgccgctattatacagctcgctcctaaagctcctgttgacctgtgtgagacagagaaactgagggcagccttctttgcagtcccgttggaaatgagagggtccttcctggtgctgctcctgagggaatgcttccgagacctgagctggctggcactcatccatagcgtccgtggggaggcggggctgctggtgacgagtatcgtcccgaagaccccgtttttctgggctatgcacgtcactgaggctctgcaccagaacatgcaggctctgtttagcaccctggctcaggcggaggagcagcagccctacctggagggctccaccgttatgcgcgggactcgctgtctggcagagtaccacctgggggattatggacacgcctggaacaggtgttgggtgctggacagggtggacacctgggctgtggtcatgttcattgattttggacagttggccaccatccctgtgcagtctctgcgcagcctagacagcgacgacttctggaccatcccacccctgactcagccattcatgctggagaaagacattttgagttcgtatgaggttgtccatcgaatcctcaaagggaaaatcactggtgctttgaactcggcggtaactgctcctgcatctaacttggctgttgtccctccactcctgcccttggggtgtctgcagcaggctgctgcctaggcctggacacagtatttacctggcattcttttagatcaaacgaactggttatctgaggggttgggtgaactggctcgggtgggccttccttcccaccaaggctttgtctttctcttccagttgcacatcctaaagtttgaagagtctaaataacggggcttccctcagcatgttccctctcctgtttgccacggatccagaggccacctgccctgtcttctcgtacccctttcactcttgaggcctgggaggtgaaaaaggccagactgtgcccaggattgattcaattttgcttttactcccagcttccctctcaaaagagagtgaagtctcatttgtcatgtgtcttcagttccccaacttggcatgaacatttgaaccaaacataggaaactaccattaggttgaaagcctgaggcagctgggatggtctttcttgtgtctcttctttgcaccccagagcatgatataagtggtcctaacagattctggataatggagaagccctctgctggttttcctggcattccatgtagaataggtagagaatatttaaccaatgagcaaataaatgttggcatgtttcatga

SEQ ID NO: 7943 - DNA, 2331 bp, Homo sapiens
gtcttcaacgcctgcccggcccgaggacaccgtggctctcggaggcggcgggcgccgggggcttccccctgctctttcctcctgcggtgggagaggccaggcccacggaagccccctgcggcccagcccacgctcccagggaccagagaggaccgagcggaggcggcgggagtatccccggcgcagcgacagacggtggacggacggcgagcggcccatcaactccgcgcgcccctcccctccgcggctggcgcctcccagccccgccacctcctgcccagagctgggggcggcggggtgagcgccatggcagaggcgggtcgggctgcgagctctggagaaaggggcggcggccgcacgtgcggatcggccgcgccccactgagcagagagcccccttctgccgccgacagcccgcgtctgcaccgagccggtctcggccgggcgctgccttcacacgcgcccaggagtgtcacgtgcgccgctcacccccgggaaggaagcccctcgcccacccactccgctctactccactctttctgcagacgttatttttggcggtagggcagaggttgcggcccgaggtccgggcgcagggacaacggtcgccagctcctgcgctagttccgttactcttcggtggcacacggtcctgggcagcgcgaggctcttcccgccgtggccgccggggattggctgccggcaagccccgccccgtgcccccgggctcagagggggcggagcgcggagggagaaggcgcgaaggctgggcgtcgcgatcgcaggtgcacgcgcgtggcccgcgagacgaggagatcctgttggaaagcaactgcagcatgtcctggaacattagtcacccccaactctctgataaactgtttgggaagaatggagtgttggaggagcagaaatctccaggattcaagaaaagagagacagaggtgtatgttggcaatcttccactggatatttctaaggaggaaattctgtaccttctaaaggacttcaaccctcttgatgtccacaaaatccagaatggctgcaaatgctttgcatttgtagatctgggctccatgcagaaagtgacacttgcaatccaggagctgaatggtaaactcttccacaagcgaaaactgttcgtgaatacaagcaaaaggccccccaagaggacccctgatatgatccagcagcctcgggccccgctggtgttggagaaggcttctggtgaaggatttggcaaaaccgccgctattatacagctcgctcctaaagctcctgttgacctgtgtgagacagagaaactgagggcagccttctttgcagtcccgttggaaatgagagggtccttcctggtgctgctcctgagggaatgcttccgagacctgagctggctggcactcatccatagcgtccgtggggaggcggggctgctggtgacgagtatcgtcccgaagaccccgtttttctgggctatgcacgtcactgaggctctgcaccagaacatgcaggctctgtttagcaccctggctcaggcggaggagcagcagccctacctggagggctccaccgttatgcgcgggactcgctgtctggcagagtaccacctgggggattatggacacgcctggaacaggtgttgggtgctggacagggtggacacctgggctgtggtcatgttcattgattttggacagttggccaccatccctgtgcagtctctgcgcagcctagacagcgacgacttctggaccatcccacccctgactcagccattcatgctggagaaagacattttgagttcgtatgaggttgtccatcgaatcctcaaagggaaaatcactggtgctttgaactcggcgttgcacatcctaaagtttgaagagtctaaataacggggcttccctcagcatgttccctctcctgtttgccacggatccagaggccacctgccctgtcttctcgtacccctttcactcttgaggcctgggaggtgaaaaaggccagactgtgcccaggattgattcaattttgcttttactcccagcttccctctcaaaagagagtgaagtctcatttgtcatgtgtcttcagttccccaacttggcatgaacatttgaaccaaacataggaaactaccattaggttgaaagcctgaggcagctgggatggtctttcttgtgtctcttctttgcaccccagagcatgatataagtggtcctaacagattctggataatggagaagccctctgctggttttcctggcattccatgtagaataggtagagaatatttaaccaatgagcaaataaatgttggcatgtttcatga

SEQ ID NO: 7944 - DNA, 1617 bp, Homo sapiens
agcgtgcgcgggcatccggtgggtgcgggaggcccgaggccaggcaggcagggatcccgcagcgaggggctggttactgccaggacggagcgcattgcctcgagccgaccccggggtccgcgagggctcctggggacgaggagtgtggggcacctgccgcggggggcccaggcgctaaaggtggagggaaggaacgcactcgcggcgggggcctggccggggcggacgcagccagcctcacccgcgacggtaggggacttccagggcgagggggcccatctgccctcgggcgccaggaggatgctccagctcctggtgctgaagattgaagatccaggttgcttctgggttattataaaagggtgtagtccctttttagatcatgatgtcgattatcaaaaattaaatagtgccatgaatgacttctacaacagcacgtgtcaagatatagaaataaaacccttaacattggaagaaggacaggtgtgtgtggtctattgtgaggagctaaagtgctggtgcagggccattgtcaaatcaattacgtcttccgcagaccagtacctggcagaatgtttccttgtggactttgccaagaacattccagtcaaatctaaaaacatccgagttgtagtagaatcgtttatgcagcttccctatagagcaaaaaaattcagcctgtactgcacaaagcctgtcacattacacattgacttctgccgagacagtactgacattgtacctgccaagaagtgggacaatgcagctattcagtactttcagaaccttctgaaagcaactacccaggtggaagccagattatgtgctgtggaagaagatacatttgaggtttacctttatgtaactataaaagatgaaaaagtttgtgttaatgatgatcttgttgcaaagaactatgcttgttatatgtcacctacaaagaataaaaaccttgattatttagaaaaaccaagattgaatataaaatcagcaccctccttcaataaactcaatccagcacttacactctggccaatgtttttgcaaggaaaagatgttcaaggaatggaagattcacatggtgtaaattttccggcacaatctctgcaacatacatggtgcaagggtattgtcggtgacctcaggccaacagccacagcacaggacaaagctgtaaaatgtaatatggattcattgagagattcacctaaagacaaatctgaaaagaaacaccattgcatctctttaaaagatacaaataagcgtgttgaatcctcagtgtactggccagcaaaaagaggcataaccatatatgctgatccagatgtaccagaagcaagtgctttaagtcagaagtcaaatgagaaacctcttagattgactgagaagaaagaatatgatgagaagaatagctgtgtgaaattactgcagtttttaaatcctgatcctttgagagctgacggaatctctgatctccagcagacttgagattagaagagaaactccttagatgggggacttaacctgaagacatccttttagaaacgatcgaatggattgttgcttctgagaaattgttccttgttttttggataataaacgatcttccttttggta

SEQ ID NO: 7945 - DNA, 3834 bp, Homo sapiens
agcgtgcgcgggcatccggtgggtgcgggaggcccgaggccaggcaggcagggatcccgcagcgaggggctggttactgccaggacggagcgcattgcctcgagccgaccccggggtccgcgagggctcctggggacgaggagtgtggggcacctgccgcggggggcccaggcgctaaaggtggagggaaggaacgcactcgcggcgggggcctggccggggcggacgcagccagcctcacccgcgacggtaggggacttccagggcgagggggcccatctgccctcgggcgccaggaggatgctccagctcctggtgctgaagattgaagatccaggttgcttctgggttattataaaagggtgtagtccctttttagatcatgatgtcgattatcaaaaattaaatagtgccatgaatgacttctacaacagcacgtgtcaagatatagaaataaaacccttaacattggaagaaggacaggtgtgtgtggtctattgtgaggagctaaagtgctggtgcagggccattgtcaaatcaattacgtcttccgcagaccagtacctggcagaatgtttccttgtggactttgccaagaacattccagtcaaatctaaaaacatccgagttgtagtagaatcgtttatgcagcttccctatagagcaaaaaaattcagcctgtactgcacaaagcctgtcacattacacattgacttctgccgagacagtactgacattgtacctgccaagaagtgggacaatgcagctattcagtactttcagaaccttctgaaagcaactacccaggtggaagccagattatgtgctgtggaagaagatacatttgaggtttacctttatgtaactataaaagatgaaaaagtttgtgttaatgatgatcttgttgcaaagaactatgcttgttatatgtcacctacaaagaataaaaaccttgattatttagaaaaaccaagattgaatataaaatcagcaccctccttcaataaactcaatccagcacttacactctggccaatgtttttgcaaggaaaagatgttcaaggaatggaagattcacatggtgtaaattttccggcacaatctctgcaacatacatggtgcaagggtattgtcggtgacctcaggccaacagccacagcacaggacaaagctgtaaaatgtaatatggattcattgagagattcacctaaagacaaatctgaaaagaaacaccattgcatctctttaaaagatacaaataagcgtgttgaatcctcagtgtactggccagcaaaaagaggcataaccatatatgctgatccagatgtaccagaagcaagtgctttaagtcagaagtcaaatgagaaacctcttagattgactgagaagaaagaatatgatgagaagaatagctgtgtgaaattactgcagtttttaaatcctgatcctttgagagctgacggaatctctgatctccagcagttgcagaagctgaagggcctgcagccgcccgtggtagtgctccggaacaagatcaagccctgcttaaccattgactcgtcgccgctgtcagcagacctgaagaaggctcttcaaagaaataagtttccgggccccagccacactgaatcttactcttggcctcccatagcgcgtggctgtgatgtggttgtcatttctcactgtgaaagcaaccctttgctctacctcctaccagtgttgacagttttgcaaacaggagcctgctacaagtcattaccaagtagaaatggacctctcgcagtcatcgtgtgccctgggtggaagaaggcccaatttatttttgaattattgggagaatatagcatgtcctccaggcctcttcatcctgtgctattaacaattgggctccataaagaggaagccaaaaatacaaagcttccaaggggctgtgatgtgattgttacgaccccatacagcctgctgaggcttctcgcctgtcagagcctgctgttcctcaggctctgccacctgatcctggatgaggtagaggtgctattcttggaagccaatgaacagatgtttgctatattagataactttaaaaaaaatattgaagttgaagaaagggaatctgcaccacatcagattgttgcagttggagttcattggaacaaacatatagaacatctcatcaaagagttcatgaatgatccctacattgtgatcacagccatggaagaggctgctctctatggcaatgtccaacaggtagtacatctttgcctagaatgtgaaaaaacttcttctttactccaagctcttgattttattccaagtcaggcacaaaagaccttgatcttcacctgctctgtagctgaaacagaaatagtgtgtaaggtagtagaaagcagttcaatattttgcttgaagatgcataaagaaatgatttttaacttacaaaatgttttagaacagtggaagaagaagttaagttctggctctcaaattatattagccctcacagacgactgcgtcccactcttggccatcaccgatgccacgtgtgtgattcacttcagtttccctgcctcaccaaaagtttttggtggacgcctgtattgcatgtctgatcattttcacgctgaacagggttctcctgcagaacagggagataagaaagccaaatctgtcttgctgctgacggagaaagatgcgagccatgcggtgggcgtcctgcgctacttggagcgagcggacgccaaggtccccgcagagctgtacgagttcaccgcaggagttctggaagccaaagaagataagaaagccggaaggcctctttgtccatatctgaaggcttttggtttttgcaaagacaaaaggatctgtcctgaccgacaccgtattaatccagaaacggacttgcccaggaaactgtccagccaagccctaccttcatttggatacattaaaataatacctttttatattttgaatgcaacaaattactttggccgtatagttgataaacacatggatctttatgcaactctcaatgctgaaatgaatgagtattttaaggattctaataaaacaactgtggaaaaggtggagaagtttggattgtatggattagcagaaaaaacgctttttcacagggttcaggtgttggaagtgaaccaaaaagaagacgcctgggccctggatgacatccttgtagagttcatcgatgaaggcaggacggggctcgtcacaagggaccagctgctgcatctcccagaacatttccacacacttcccccgcaggctgtggagtttattgtctgtagggtgaaacctgctgacaacgaaatagaatggaatccgaaggttactaggtacattcatcataaaattgttggaaaattgcatgatgcaaaagtgatcctggctttgggaaatacagtttggattgatccaatggtgcacattacaaacctttccagtttaaaaacctctgtcattgattataatgttcgagctgaaattttgtccatgggcatgggcattgataatccagaacacatagaacaactgaaaaaattacgcgaagatgctaagataccagcttgtgaagaaagcctaagccagaccccgccgagggtgacagggaccagtcctgctcaagaccaggatcatccatccgaggagcagggggggcaggggacgcctccagcagaagatgctgcttgcctgcagagcccccagcctgaggacacgggtgcagaaggaggggctgagtccaagacgagctcagaaaaccagaagcctggtgggtacttggtattcaaaagatggttaagttcaaatcgttaa

SEQ ID NO: 7946 - DNA, 3817 bp, Homo sapiens
cggccccggccccggctccggcgctgctcccaccgccgcggcaacggccccggcccacggaggcggctggacggacccccgacggttggacgtacggactctgcttcgagagtaggccatggacaccttcagcaccaagagcctggctctgcaggcgcagaagaagctcctgagtaagatggcgtccaaggcagtggtggccgtgctggtggatgacaccagcagtgaggtgctggatgagctgtaccgcgccaccagggagttcacgcgcagccgcaaggaggcccagaagatgctcaagaacctggtcaaggtggccctgaagctgggactgctgctgcgtggggaccagctgggcggtgaggagctggcgctgctgcggcgcttccgccaccgggcgcgctgcctggccatgacggccgtcagcttccaccaggtggacttcaccttcgaccggcgcgtgctggccgccgggctgctcgagtgccgcgacctgctgcaccaggccgtgggtccccacctgaccgccaagtcccacggccgcatcaaccacgtgttcggccacctagccgactgcgacttcctggctgcgctctacggccccgccgagccctaccgctcccacctgcgcaggatctgcgagggcctgggccggatgctggacgagggcagcctctgaaccccggcgccgcccaaccgcgcccctcgcgccttttggggctctcctgctgggcgcgggtggggtttgtgggtttttttccacctcttttctcccaatcggactccggccaaactcccctagacagatgggtgacctgtctcctttgagaggatgctgaggcatctgtagcagctgtttcaaacaccaatgtcacctctcctcctggcccccgcccaatggggagaggaatttggggccctactctggggaccacctttcacccgtttgtactttctgggccacgccgacccctgggtcgcttgatgtaaaagccaaaagctgctgcctcccacttggatcatgtcgcctgggattttcatccctcgcacaaggactacgggttcacacggtgaactgggggaagggaagtgttagggggcaagtcgcggcacccccccttccataaactcacgtcctaacccccaggacctcagaagatgatctgatttggaaataggatcattacagatggaattagttcagatgatctcatcttggagtagggtgggccccaattcaaggactggggtccttaaaaaaagggggcctggggcagggcgcggtggctcacgcctgtaatcccagcactttgagaggctgaggcgggcggatcacgaggtcaggagatcgagaccatcctggctaacacggtgaaaccccatctctactgaaaatacaaaaaattagctgggcatggtggcacatgcctgtagtcccagctactcgggaggctgaggcaggataatcacttgaaccaggaggaggaggttgcagtgagccgagattgtgccactgcactccagcctgggtgacagagcaagactctgtctcaaaaaaagaagcgggggagtgggggattgaggccacgtgcagtggctcactactctaattccagcactttgggaggccgaggcaggaagattgcttgaactcagaagttcaagaccagtctgggcaacatggtgagaccctcgtctctacaaaaaaaaaattatcgtggtgggccgggcgtggtggctcacacctgtaatcccagcactttgggaggctgaggcgggcagatcacaaggtcaagagatcgagaccatcctggccaacatggtgaaaccccgtctctactaaaaatacaaaaattagccgggcatggtgttgcgtgcctgtagtcccagctacttgggaggctgaggcaggagaatcgcttgaacctgggaggcgcaggttgcagggaggcggaggttgcagtgagccgagattgcaccactgcacttcagcctggtgacagagcgagactcgtctcaaaaaaaaaaaaaaaaaaaaaaaaaaaagtgactgtggtggtgcacacgtataatcccagctacttgagagatgacgagggaagatcacttgagcccaggagttaagaggctgcagtgaccgatgatcatgccactgcactccagcttgggtgagagtgggactctgtcttagaaagaaaaaaaaaagtatttggacacagacatgcatgcaaggaaggccaatgatgccggccaccaccaggagctgggagaggcccagggcagatccccttcagccttggagggacctagccctggccacaccttcatctcagacttgcggcccagagaactgaatgagaataaatgtgcgtgaagcccctcagtccacaggatgtggtactggaagcccccactcaagaaggctccagtgaatgctggcacgttcagccaggatgcctccgtgaagctggagacctctgccctgggtcgggaggggaaactgctccaatccagggactgccacatgggaggggacggagcgtgcccacctcccaggggtgaggggggacccacctgagatgtgtgcacattttatttatttattgttttgagacaaagtctcgctgtgtcacccaggctggagtgcagtggtgaaatctcggctcattgcagccccttccttccaggctcaagtgatcctcccacctcagccccgggtagctgggactacaggtgtgcacgagcacacccggctaatctttgtattttttgtagacagaaggtctcaccatgttgcccaggatggtctcgaactcctgggctcaagcgacctacctacctcggcctcacaaagtgtgcacattgtaatatcgtgatttcatatttggagaatcagcaaccaaccagccaaccatgttgcttttataagacagagctgagaaagcaaagcttggctgtcgtcttggctctggtaccacccacgagatgcgggcgattctcagctcagggcgtggaggcgtggtgtgggggagtctatttgccatttttgtttgtcagcagggggcaggggttctcaaagattgcaaaatgctgctgcaggtcaggaaggttattttgggtgcctgtgggggaggtgaaacaaggtcccatgactgttttgcagaaccttgtctgtggagggtagaggttgcggcaggggcctgtgggccttacttggtgagaaggtaggtctagctggctccattcagtatttgagacatttggaatttgtctgcatttaaaaccaagagatcacacacacctgtctggatttggagtttctcttgaaaactcgccagtccggccgtctgagcctgcactgacgcctggtgaagctgtgcaggggccgcccctctccctttcaccacagtcctctccactccctttcgcctctccctggcctgctgcactcactgataggaaattctgaccccagactcggagcagccttcccgtggttcggtttttgcttccgcgaaaaagccaaaggccttggccagagagccagctgttcctacctctaccccacgcttccaaggcaaccttctccacttatcttaggccgagagacagctcttcaagaacgtacatggatcctgattttctcacgaagtcccgatggaaccctgtgctgttgagacatcagtgtgtaaaactctctgtgtccctgttgggctgtccagacagtctggactcttgtaaatttgagatttaattaaaggaaacaaaccaaataggactgcggaacaatttaaataaaagcacacaccagcctggg

SEQ ID NO: 7947 - DNA, 3845 bp, Homo sapiens
gcatcggtccaggcatcggtggcggggagccaggcctaggccagcccgggcccacccagactggcccctaatgagctcccaagtggcctgtggggacttggcctcagttttgccagctgtgaactgggaccgtcgctgctaaggccatggacaccttcagcaccaagagcctggctctgcaggcgcagaagaagctcctgagtaagatggcgtccaaggcagtggtggccgtgctggtggatgacaccagcagtgaggtgctggatgagctgtaccgcgccaccagggagttcacgcgcagccgcaaggaggcccagaagatgctcaagaacctggtcaaggtggccctgaagctgggactgctgctgcgtggggaccagctgggcggtgaggagctggcgctgctgcggcgcttccgccaccgggcgcgctgcctggccatgacggccgtcagcttccaccaggtggacttcaccttcgaccggcgcgtgctggccgccgggctgctcgagtgccgcgacctgctgcaccaggccgtgggtccccacctgaccgccaagtcccacggccgcatcaaccacgtgttcggccacctagccgactgcgacttcctggctgcgctctacggccccgccgagccctaccgctcccacctgcgcaggatctgcgagggcctgggccggatgctggacgagggcagcctctgaaccccggcgccgcccaaccgcgcccctcgcgccttttggggctctcctgctgggcgcgggtggggtttgtgggtttttttccacctcttttctcccaatcggactccggccaaactcccctagacagatgggtgacctgtctcctttgagaggatgctgaggcatctgtagcagctgtttcaaacaccaatgtcacctctcctcctggcccccgcccaatggggagaggaatttggggccctactctggggaccacctttcacccgtttgtactttctgggccacgccgacccctgggtcgcttgatgtaaaagccaaaagctgctgcctcccacttggatcatgtcgcctgggattttcatccctcgcacaaggactacgggttcacacggtgaactgggggaagggaagtgttagggggcaagtcgcggcacccccccttccataaactcacgtcctaacccccaggacctcagaagatgatctgatttggaaataggatcattacagatggaattagttcagatgatctcatcttggagtagggtgggccccaattcaaggactggggtccttaaaaaaagggggcctggggcagggcgcggtggctcacgcctgtaatcccagcactttgagaggctgaggcgggcggatcacgaggtcaggagatcgagaccatcctggctaacacggtgaaaccccatctctactgaaaatacaaaaaattagctgggcatggtggcacatgcctgtagtcccagctactcgggaggctgaggcaggataatcacttgaaccaggaggaggaggttgcagtgagccgagattgtgccactgcactccagcctgggtgacagagcaagactctgtctcaaaaaaagaagcgggggagtgggggattgaggccacgtgcagtggctcactactctaattccagcactttgggaggccgaggcaggaagattgcttgaactcagaagttcaagaccagtctgggcaacatggtgagaccctcgtctctacaaaaaaaaaattatcgtggtgggccgggcgtggtggctcacacctgtaatcccagcactttgggaggctgaggcgggcagatcacaaggtcaagagatcgagaccatcctggccaacatggtgaaaccccgtctctactaaaaatacaaaaattagccgggcatggtgttgcgtgcctgtagtcccagctacttgggaggctgaggcaggagaatcgcttgaacctgggaggcgcaggttgcagggaggcggaggttgcagtgagccgagattgcaccactgcacttcagcctggtgacagagcgagactcgtctcaaaaaaaaaaaaaaaaaaaaaaaaaaaagtgactgtggtggtgcacacgtataatcccagctacttgagagatgacgagggaagatcacttgagcccaggagttaagaggctgcagtgaccgatgatcatgccactgcactccagcttgggtgagagtgggactctgtcttagaaagaaaaaaaaaagtatttggacacagacatgcatgcaaggaaggccaatgatgccggccaccaccaggagctgggagaggcccagggcagatccccttcagccttggagggacctagccctggccacaccttcatctcagacttgcggcccagagaactgaatgagaataaatgtgcgtgaagcccctcagtccacaggatgtggtactggaagcccccactcaagaaggctccagtgaatgctggcacgttcagccaggatgcctccgtgaagctggagacctctgccctgggtcgggaggggaaactgctccaatccagggactgccacatgggaggggacggagcgtgcccacctcccaggggtgaggggggacccacctgagatgtgtgcacattttatttatttattgttttgagacaaagtctcgctgtgtcacccaggctggagtgcagtggtgaaatctcggctcattgcagccccttccttccaggctcaagtgatcctcccacctcagccccgggtagctgggactacaggtgtgcacgagcacacccggctaatctttgtattttttgtagacagaaggtctcaccatgttgcccaggatggtctcgaactcctgggctcaagcgacctacctacctcggcctcacaaagtgtgcacattgtaatatcgtgatttcatatttggagaatcagcaaccaaccagccaaccatgttgcttttataagacagagctgagaaagcaaagcttggctgtcgtcttggctctggtaccacccacgagatgcgggcgattctcagctcagggcgtggaggcgtggtgtgggggagtctatttgccatttttgtttgtcagcagggggcaggggttctcaaagattgcaaaatgctgctgcaggtcaggaaggttattttgggtgcctgtgggggaggtgaaacaaggtcccatgactgttttgcagaaccttgtctgtggagggtagaggttgcggcaggggcctgtgggccttacttggtgagaaggtaggtctagctggctccattcagtatttgagacatttggaatttgtctgcatttaaaaccaagagatcacacacacctgtctggatttggagtttctcttgaaaactcgccagtccggccgtctgagcctgcactgacgcctggtgaagctgtgcaggggccgcccctctccctttcaccacagtcctctccactccctttcgcctctccctggcctgctgcactcactgataggaaattctgaccccagactcggagcagccttcccgtggttcggtttttgcttccgcgaaaaagccaaaggccttggccagagagccagctgttcctacctctaccccacgcttccaaggcaaccttctccacttatcttaggccgagagacagctcttcaagaacgtacatggatcctgattttctcacgaagtcccgatggaaccctgtgctgttgagacatcagtgtgtaaaactctctgtgtccctgttgggctgtccagacagtctggactcttgtaaatttgagatttaattaaaggaaacaaaccaaataggactgcggaacaatttaaataaaagcacacaccagcctggg

SEQ ID NO: 7948 - DNA, 2262 bp, Homo sapiens
acttgctagtcttacctcaagtaatgggaaacgaccagacctcctaaagagtcagtgtgcaagttagggctactgtcccaagaaggacacctgagtccaaatggggaaaccacggcaaaacccaagcacactggtttccacactctgtgaggcagagccaaaggggaaactgtgggtcaacggatatgcagggacccaaggcacaagggatgccacgttacaaacaagactcatccccttatcttttcatcttcagaggggaaagggacttgccgccccgctgtccgccctgagtgcgccgcggctgcccgagcgccccgcagacgggcgggtggccgtggacgcccagccagcagcccgcagcatggattcggattccggggagcagagcgagggcgagcccgtgaccgccgcaggtcctgatgtttttagttcaaagagtcttgcgcttcaagcccagaagaagattctgagcaaaatagccagcaaaactgtggccaacatgttgattgatgacaccagcagcgagatctttgatgagctctacaaagtcaccaaagagcacacacacaacaagaaggaagcccacaagatcatgaaagacttaatcaaggtggcgatcaaaatcgggatcctctaccggaacaaccagtttagccaagaggagctggttattgtggagaagttccggaagaagctgaaccagaccgccatgaccattgtcagcttctatgaggtggaatacaccttcgataggaacgtgctctccaatctcctgcatgagtgcaaggacctggtgcatgaactggtgcagcggcacctgacgcccaggacccacgggcgcatcaaccacgtctttaaccactttgccgatgtggagttcctctccaccctctatagtctggatggagactgtaggcccaacctcaagaggatttgtgaaggaatcaataagttgctagatgagaaagtcctttaaatgccttccctcctactggactttgctgctttaaagttacagcactcaaccatgatctgggtgagaatcaagaacataagcagaaacccttgtcaaagatgtccatgttctttcctgttcatccctctgatgctgattctgatgctgaactgagctcaggtgtgtttttcttccaagctttctagcaaggtttctacttaaaatcacctgtgtgcaagcccaaaggacatttcatctattctaagcagaaaggctgttttgttcattacagtgagtgctgttcatctcatggagtgggaggagcactaaaccaggagacagaggacatggatttggtttccagcttaaccagttaggactctgtcctctgcattctggaaccatgatgcctgcctgcctgcctcacagggctgttgtgaggaccagatgagatgatgtatgttcatacttttggaatctctaatttaaagtcttaatattttgtcttctgagtgtgaggggataaacctggatgtagactattaagcagcataggagaaaagaacaatagaatctaatggactgggtttgcaatctctctctaaatgcactgcttcagacaaagtgaaatccaaaggtgtgaaaaagtatagctgcaaattggaaaaatgtgtttcaagagtcgtctttttggccaggcatggtggctcacacctgtaatcccagcactttgggaggccgaggtgggcagattgcctgaggtccggagttcaagatcagcctggccaacatgatgaaaccctatctctactaaaattacaaaaattagccaggcgtggtggtacacgcctgtaatcccagctactcaggaggctgaggcaggagaattgtttgaacctgggagatggaggctgcagtgagctgagatcacgccactgtactccagcctgggcaacagagcaagactctgtctctaaaaaataataataataataataatttttttaaaaagaggtgtttttgaggtcttagatgttcaggttgatgatcctgcagagggaaactttccatgggggggtggggagagagagttttccatccacaatatagaaacagagaagcactgtgctccctctgcaggaccagccttcccttatctaaggggcatggagctcagggaggctttattccatatgcacgggagaatcaggcagaatgaacccctacccatctttcttggcttttcagtcattttgtgctgttttctctggttcattaataaattgaaactgccctccaaacaa

SEQ ID NO: 7949 - DNA, 1484 bp, Homo sapiens
ggtgtccattgtaccagctgggccatggatccctcccgcctgaaatctgactccacctgccaagagtctgagcctgcaggcctagatttcgactctgctggccaagattatttctctgcagcccaataattcgactctttctaccaagaattggacctggactctcttaacgaagatcttctttcccagtccatgccacatgccaggacagagacctctgtgggcacatatgaatcccactcgacttctgaactggaggatctgacagagcccgagcaaagagagctcaaaaccaaactcactaaattggaggctgaaattgtaaccctacgccacgtactagcagccaaagagagacgctgtggggaactcaagaggaagttaggcctcaccgccttggtagggctgagacagaatctgtccaagagctggcttgatgttcaggtctccaacacctatgtgaaacagaagacatcagctgctctgtccaccatgggcactctcatctgcaggaagcttggaggcgtgaagaagtcggccacattcagatcttttgaaggattgatcttcaataaatacacgttaaatcaaggaaggaattaacatcatatacttcagacatcaaatatggaatccaagagactatcaacaacatgaacttgttcacaagttccttctgcttttaaacaaaaatatcgtgtttattcaaagccaatctgagaccctactctgtatcaagaactgtcccaggttctgaaagcatagaattagacatcgtatgtgccctctagaaacacttagactttcaaatcattataattcaatgagtcctaaaatagagctgtgtgccagagataaaagaagtcctgaggaaggggtgttcaactctgtcttggtaggtcagtaaagactttagagagacagaaagtcttagaggactaggagaagtttgccagacagacaagaatagaacattccagacaacatgcagaggaactgagtcacaaaggaatgtataagaatggcatattctaggaactaacactgtggctagagaggaaggggaaatggtgttacatgagtgagggaggggaaatggtgttacgtgagtaagaaaaaataagcagggggcaaaatcataagtagtcttacatactacattagatatcaatatttaagcctgtaggaaatgggaggcattgaagcacttaagtaaaaaagtaactatcaaatttttgttttagattactctggtcatcagagaaatagattaagtatttaagaggtagaatctctcagacttaggaaccaactgcatgaggcggggcttggggggataaatttgcaagataataaggatgtagaattgaaaaggcctgatattattgaagctggagttgcacattcattttgctttggcttttttgtatcagtggtcatgggcaccaaataaaatgcttccatgaacatttggattctggctc

SEQ ID NO: 7950 - DNA, 2572 bp, Homo sapiens
acaccacgagctagcgtgtctacttcacaggccaggtcgtcaactcaactgtcaaggtgtccattgtaccagctgggccatggatccctcccgcctgaaatctgactccacctgccaagagtctgagcctgcaggcctagatttcgactctgctggccaagattatttctctgcagcccaataattcgactctttctaccaagaattggacctggactctcttaacgaagatcttctttcccagtccatgccacatgccaggacagagacctctgtgggcacatatgaatcccactcgacttctgaactggaggatctgacagagcccgagcaaagagagctcaaaaccaaactcactaaattggaggctgaaattgtaaccctacgccacgtactagcagccaaagagagacgctgtggggaactcaagaggaagttaggcctcaccgccttggtagggctgagacagaatctgtccaagagctggcttgatgttcaggtctccaacacctatgtgaaacagaagacatcagctgctctgtccaccatgggcactctcatctgcaggaagcttggaggcgtgaagaagtcggccacattcagatcttttgaaggtctgatggggacaatcaagtccaaagtctcagggggcaaaagagcttggccctgactgtctttcttctgcggagggtggggttgatctgctctcagttttggggtgtggggaagacccactccagattccggggagtgggaatgagccactcccagttctggagagtgaggatgaccatctccactttctggaaccagaatgagcccccttggtaaccttgcctggtactaaaccagtgcaaggacccccttcccttattacatttgcaactctgcccaacaaaaacaagcaagcaaaccacaatggtaaagtggttaattcaggaaattgacagaatccagttttgagaaaagaacacagatatttgctgcttttaagatagagaacccaaagttttgtacctggttatttttcacttaagtttgtagacgaaatgtgccattatattagctttcctgagactgtatctaatgggcaagtcagtggctccagaggggtcttaggccaaagcccaaactctcttttggaaaactagcttattagaaagccaaagtagagttctgtttaagcttgaaagaggtatgaagtaatctgtagtgtttttttggtttgtttgtttgttttcccttccccatttccttccttccctcagtctcaaagtcaccttgaaagcttcacctggcctacaacttttattttaaaaagatgatcaagaaaacttcatcttctctgagactcagaaaaagaggggaaaatagtggtagtgcactaattgttacattactaatatagcttttgtaaaactcgtttgttttcaaaggtctggactaagcaaaacaacagtgtcagtttaggaaattattactactttgaacacaaactgaaattgcaactttgccttgtgctttgtttataatttctttatatatcaaaatgagtgttttaaagtttaacccttgaagcagcatgtctttgccatagcagcacttcacttaaaaggaagaaattgcctctctggcagcaattcctagttagttaccacctccagctgaggggctggaggaaaacaggtatagccaaattcaagaaagataaacccctgtctcaaggaacattttaaaaagaacgtctgtcccctgtgatgctggctgttatgcctttgaatggacctaactatacatctttgctcttaactccaagtctgcccttctttttaggaaaccctaaaggagaaggaagcagaatataaccctctggagagctcaagacagtaggaacctggacggtgcttgtttgaattttctgatatctgattttcacacgaatatactttttgtttgttttccttttccattttcaaaatgccaagatctgggagcctctttcactcctctagacacactgcctgagatagaagtttgcatcttattggctgtgggcagagactaggacccttatgggtacatttcagtaatctctcactgcctaaaatggtaatccctccagcctaagaggatgattctgttttgttgactcttgaatgctcccccaacattcctttggttttcctataagcaaaaccaaataccactataaatacaaaagcatctggtaaactgtaaagttactcatgtatcccaaccctccacagatttctgaagacaaagttttgcttggattaaaacaagatgttttactattttgcatgttcgatttttaatttgttgtgtttatcaaccaaaatggctttgtatgctggagaacaagaggtgagcctgcagcatacaagaaatgaaagtagtccaacaggcaaaggctttgacatatttcaggaaggcttgtgttagggacaatctcagactattatcatgggccaaacctgagagatgttatattttatttaataatttctacaacagtagtaagtttccccaataaattctcaactccgtaaaa

SEQ ID NO: 7951 - DNA, 1321 bp, Homo sapiens
acaggccaggtcgtcaactcaactgtcaaggtgtccattgtaccagctgggccatggatccctcccgcctgaaatctgactccacctgccaagagtctgagcctgcaggcctagatttcgactctgctggccaagattatttctctgcagcccaataattcgactctttctaccaagaattggacctggactctcttaacgaagatcttctttcccagtccatgccacatgccaggacagagacctctgtgggcacatatgaatcccactcgacttctgaactggaggatctgacagagcccgagcaaagagagctcaaaaccaaactcactaaattggaggctgaaattgtaaccctacgccacgtactagcagccaaagagagacgctgtggggaactcaagaggaagttaggcctcaccgccttggtagggctgagacagaatctgtccaagagctggcttgatgttcaggtctccaacacctatgtgaaacagaagacatcagctgctctgtccaccatgggcactctcatctgcaggaagcttggaggcgtgaagaagtcggccacattcagatcttttgaaggaaaccctaaaggagaaggaagcagaatataaccctctggagagctcaagacagtaggaacctggacggtgcttgtttgaattttctgatatctgattttcacacgaatatactttttgtttgttttccttttccattttcaaaatgccaagatctgggagcctctttcactcctctagacacactgcctgagatagaagtttgcatcttattggctgtgggcagagactaggacccttatgggtacatttcagtaatctctcactgcctaaaatggtaatccctccagcctaagaggatgattctgttttgttgactcttgaatgctcccccaacattcctttggttttcctataagcaaaaccaaataccactataaatacaaaagcatctggtaaactgtaaagttactcatgtatcccaaccctccacagatttctgaagacaaagttttgcttggattaaaacaagatgttttactattttgcatgttcgatttttaatttgttgtgtttatcaaccaaaatggctttgtatgctggagaacaagaggtgagcctgcagcatacaagaaatgaaagtagtccaacaggcaaaggctttgacatatttcaggaaggcttgtgttagggacaatctcagactattatcatgggccaaacctgagagatgttatattttatttaataatttctacaacagtagtaagtttccccaataaattctcaactcc

SEQ ID NO: 7952 - DNA, 1998 bp, Homo sapiens
cttgcccacccatgctcaagatgggcgggatgccagcctgttacataaatgtgccaaaagcctggccatgcctggaaaatggaccaatccgcccgccaagaggttgggtctcgttccctagagagaaggaagtttcctctccttgaagtgagagctagaatcgcactttctgtcaagctgagagaaagactcttttccagaggctaaaaggacaagaaaatctgatttgcttgcttctaactttgcgttttaaagggggaaggaggaaaggaaagagggggagggtggttctgcttagccccacccctccggctaccccaggtccagccgtccattccggtggaggcagaggcagtcctggggctctggggctcgggctttgtcaccgggacccgcaggagccagaaccactcggcgccgcctggtgcatgggaggggagccgggccaggagtaagtaactcatacgggcgccggggacccgggtcgggctgggggcttccaactcagagggagtgtgatttgcctgatcctcttcggcgttgtcctgctctgccgcatccagccctgtaccgccatcccacttcccgccgttcccatctgtgttccgggtgggatcggtctggaggcggccgaggacttcccaggcaggagctcggggcggaggccgggtccgcggcagaccagggcagcgaggcgctggccggcagggggcgctgcggtgccagcctgaggctgggctgctccgcgaggatacagcggcccctgccctgtcctgtcctgccctgccctgtcctgtcctgccctgccctgccctgtcctgtcctgccctgccctgccctgtgtcctcagacaatatgttagccgtgcactttgacaagccgggaggaccggaaaacctctacgtgaaggaggtggccaagccgagcccgggggagggtgaagtcctcctgaaggtggcggccagcgccctgaaccgggcggacttaatgcagagacaaggccagtatgacccacctccaggagccagcaacattttgggacttgaggcatctggacatgtggcagagctggggcctggctgccagggacactggaagatcggggacacagccatggctctgctccccggtgggggccaggctcagtacgtcactgtccccgaagggctcctcatgcctatcccagagggattgaccctgacccaggctgcagccatcccagaggcctggctcaccgccttccagctgttacatcttgtgggaaatgttcaggctggagactatgtgctaatccatgcaggactgagtggtgtgggcacagctgctatccaactcacccggatggctggagctattcctctggtcacagctggctcccagaagaagcttcaaatggcagaaaagcttggagcagctgctggattcaattacaaaaaagaggatttctctgaagcaacgctgaaattcaccaaaggtgctggagttaatcttattctagactgcataggcggatcctactgggagaagaacgtcaactgcctggctcttgatggtcgatgggttctctatggtctgatgggaggaggtgacatcaatgggcccctgttttcaaagctactttttaagcgaggaagtctgatcaccagtttgctgaggtctagggacaataagtacaagcaaatgctggtgaatgctttcacggagcaaattctgcctcacttctccacggagggcccccaacgtctgctgccggttctggacagaatctacccagtgaccgaaatccaggaggcccataagtacatggaggccaacaagaacataggcaagatcgtcctggaactgccccagtgaaggaggatggggcaggacaggacgcggccaccccaggcctttccagagcaaacctggagaagattcacaatagacaggccaagaaacccggtgcttcctccagagccgtttaaagctgatatgaggaaataaagagtgaactgg

SEQ ID NO: 7953 - DNA, 1005 bp, Homo sapiens
aggagccagaaccactcggcgccgcctggtgcatgggaggggagccgggccaggaacaatatgttagccgtgcactttgacaagccgggaggaccggaaaacctctacgtgaaggaggtggccaagccgagcccgggggagggtgaagtcctcctgaaggtggcggccagcgccctgaaccgggcggacttaatgcagagacaaggccagtatgacccacctccaggagccagcaacattttgggacttgaggcatctggacatgtggcagagctggggcctggctgccagggacactggaagatcggggacacagccatggctctgctccccggtgggggccaggctcagtacgtcactgtccccgaagggctcctcatgcctatcccagagggattgaccctgacccaggctgcagccatcccagaggcctggctcaccgccttccagctgttacatcttgtgggaaatgttcaggctggagactatgtgctaatccatgcaggactgagtggtgtgggcacagctgctatccaactcacccggatggctggagctattcctctggtcacagctggctcccagaagaagcttcaaatggcagaaaagcttggagcagctgctggattcaattacaaaaaagaggatttctctgaagcaacgctgaaattcaccaaagtacaagcaaatgctggtgaatgctttcacggagcaaattctgcctcacttctccacggagggcccccaacgtctgctgccggttctggacagaatctacccagtgaccgaaatccaggaggcccataagtacatggaggccaacaagaacataggcaagatcgtcctggaactgccccagtgaaggaggatggggcaggacaggacgcggccaccccaggcctttccagagcaaacctggagaagattcacaatagacaggccaagaaacccggtgcttcctccagagccgtttaaagctgatatgaggaaataaagagtgaactg

SEQ ID NO: 7954 - DNA, 1635 bp, Homo sapiens
aacggctcctttctcttctcttagcagcacccagcttgcccacccatgctcaagatgggcgggatgccagcctgttacataaatgtgccaaaagcctggccatgcctggaaaatggaccaatccgcccgccaagaggttgggtctcgttccctagagagaaggaagtttcctctccttgaagtgagagctagaatcgcactttctgtcaagctgagagaaagactcttttccagaggctaaaaggacaagaaaatctgatttgcttgcttctaactttgcgttttaaagggggaaggaggaaaggaaagagggggagggtggttctgcttagccccacccctccggctaccccaggtccagccgtccattccggtggaggcagaggcagtcctggggctctggggctcgggctttgtcaccgggacccgcaggagccagaaccactcggcgccgcctggtgcatgggaggggagccgggccaggaacaatatgttagccgtgcactttgacaagccgggaggaccggaaaacctctacgtgaaggaggtggccaagccgagcccgggggagggtgaagtcctcctgaaggtggcggccagcgccctgaaccgggcggacttaatgcagagacaaggccagtatgacccacctccaggagccagcaacattttgggacttgaggcatctggacatgtggcagagctggggcctggctgccagggacactggaagatcggggacacagccatggctctgctccccggtgggggccaggctcagtacgtcactgtccccgaagggctcctcatgcctatcccagagggattgaccctgacccaggctgcagccatcccagaggcctggctcaccgccttccagctgttacatcttgtgggaaatgttcaggctggagactatgtgctaatccatgcaggactgagtggtgtgggcacagctgctatccaactcacccggatggctggagctattcctctggtcacagctggctcccagaagaagcttcaaatggcagaaaagcttggagcagctgctggattcaattacaaaaaagaggatttctctgaagcaacgctgaaattcaccaaaggtgctggagttaatcttattctagactgcataggcggatcctactgggagaagaacgtcaactgcctggctcttgatggtcgatgggttctctatggtctgatgggaggaggtgacatcaatgggcccctgttttcaaagctactttttaagcgaggaagtctgatcaccagtttgctgaggtctagggacaataagtacaagcaaatgctggtgaatgctttcacggagcaaattctgcctcacttctccacggagggcccccaacgtctgctgccggttctggacagaatctacccagtgaccgaaatccaggaggcccataagtacatggaggccaacaagaacataggcaagatcgtcctggaactgccccagtgaaggaggatggggcaggacaggacgcggccaccccaggcctttccagagcaaacctggagaagattcacaatagacaggccaagaaacccggtgcttcctccagagccgtttaaagctgatatgaggaaataaagagtgaactggaa

SEQ ID NO: 7955 - DNA, 677 bp, Homo sapiens
tttgacaagccgggaggaccggaaaacctctacgtgaaggaggtggccaagccgagcccgggggagggtgaagtcctcctgaaggtggcggccagcgccctgaaccgggcggacttaatgcagagacaaggccagtatgacccacctccaggagccagcaacattttgggacttgaggcatctggacatgtggcagagctggggcctggctgccagggacactggaagatcggggacacagccatggctctgctccccggtgggggccaggctcagtacgtcactgtccccgaagggctcctcatgcctatcccagagggattgaccctgacccaggctgcagccatcccagaggcctggctcaccgccttccagctgttacatcttgtgggaaatgttcaggctggagactatgtgctaatccatgcaggactgagtggtgtgggcacagctgctatccaactcacccggatggctggagctattcctctggtcacagctggctcccagaagaagcttcaaatggcagaaaagcttggagcagctgctggattcaattacaaaaaagaggatttctctgaagcaacgctgaaattcaccaaaggtaaacaactgcttctacagttcagcaggaatttaagagatgattaaataaaagccccaccagtctcaaagtt

SEQ ID NO: 7956 - DNA, 777 bp, Homo sapiens
ccctgagaggccgtgctcgggctcgcctgctcagctcactccgaaagcctctgctcagacctgcacccagtcacagcagcacagatgtgcaggaggagaccatttccacggaccctccgactcctaggaggcagtcccttagggactggccctaacaacaaatgaggagaagccaagttctctgctttctgcagacagggcctcccctggatgggatcttcctctgaggcgagcttcagatctgctcaagcttcctgcagtggggccaggaggcagggcctgggcaggggagaccagaacctctcggtgatgcctccgaatggcagggctcagacacacacacctggctgggtttcagatcccttagttttgggtgcccaagttcacggagggtgccggggaatagaagctctgtcagtctcgtctggatcttggtcctcagcaactgtctggatcctgacagtgcagtaagagcttgcctggcctgtgtgcagagctgcctcatcctgaaattctgggagttgaaagccccagggcaacccttaaccaatgggggaaaagcattggtgtgtaaatcccccagcttccctgggtgggctgcagctgagccatagtctacatgacacttccgaggatccccagtgggcatgacctcaatcgcccacattggatgccacaacctgcactggcttttctcccttccctgtgggtctctctctgcacttcctcccttgtgcattctaggttcaccttccaaataaatgatgtgcactcagg

SEQ ID NO: 7957 - DNA, 363 bp, Homo sapiens
atgggatcttcctctgaggcgagcttcagatctgctcaagcttcctgcagtggggccaggaggcagggcctgggcaggggagaccagaacctctcggtgatgcctccgaatggcagggctcagacacacacacctggctgggtttcagatcccttagttttgggtgcccaagttcacggagggtgccggggaatagaagctctgtcagtctcgtctggatcttggtcctcagcaactgtctggatcctgacaggtctctccaggcctttccttcctggagccacagtgcttagagacaggccactggggtcagcatttgagctcagctatgatcagaaaaaagcaccgttgaggttgcagtga

SEQ ID NO: 7958 - DNA, 2102 bp, Homo sapiens
agcccaagatttctagggcattggccgcgctgctgggtgatccctccgggctcaagttgcaagggggcgggccgggccggaggtggagtctcccgccaattgaagcctccgctataaattgaactccctgcactgctgaagcccagatgcctcgccaggccacgtcgcggttggtggtcggagagggcgaggggtcccagggggcttcggggcctgcagccaccatgctccgctccctgctgcttcactccttgaggctctgcgcccagaccgcctcgtgcctcgtgctcttcccgcgcttcctcggcacggccttcatgctctggcttctcgatttcttgtgtatccgcaagcatttcctgggccgccgccgccgggggcagcccgagcccgaagtggagctcaacagtgaaggcgaggaggtgcctcccgatgacccgcccatctgcgtgtccgacgacaaccgcctgtgcaccctggcgtcgctcaaggcggtgtggcatggccagaagttggatttcttcaagcaggcgcacgagggcggtccggcgcccaactccgaggtggttctgcccgacggcttccagagccagcacatcctcgactacgcgcaagggaaccgcccgctggttctcaatttcggcagctgcacctgaccaccgttcatggcgcgcatgagcgccttccagcgcctggtcactaagtaccagcgcgacgtcgacttcctcatcatctacatcgaggaagcgcacccctccgacggctgggtcaccacggactctccctacatcatcccacagcaccggagcctggaggaccgggtcagcgcagcgagggtactgcagcaaggtgcacccggctgcgctctggtcctcgacaccatggccaactccagcagctcggcctatggcgcctacttcgagcgtctctatgtcatccagagtggcactattatgtaccagggcggccgtggccccgacggctaccaggtctctgagctgcgcacttggttggaacgctatgatgagcaactgcacggcgctcggccccggagggtgtaaacatccaacggacaattgactgaacttggtgggctgggccttcgagccttcgaagcccacgtgcaagcgcctcaaaccaagtcacgcttggcgaggccccagtgacactgatgtgctgagccaccatttcagactgagtctgcaccctcagccacatgaacaatctcccctacctccctgggactctgcttctgtaactgtctcattcacacctgcctggctcactggaaatcctcttttgagcgcgggatatggcttgcccttgtccgtgtgcccccaggactttgcctctacagcattttcttacaccccctccccagcgtgccctcagccaagtgctttggcccggtgcttcccgcagctgcacagagaccttggccacgcccgcgcgccctgagcgcagctgggttccaggagactctcagctcagctgagctagttgcctggcacccacctgtcgcgcgcggagagggggttccctgttgcttttgtgtctgtttcctgtccctggtaggggaagtgatgtcgtggatggggaggggtgggcagggtagtttcccccgcttgttttgggtgcacaggagccccactgctgatgacgaactatctctaactggtcttgaccacgagctagttctgaattgcaggggcctcaaagcagcacctaaaccttgagggggagggtgctctgggtttccgtgaggtaaccaccttaaatgggagggaagttggggtgtctgctttgggaccagaggaagatagcttgagaggcattggcgaggttcgcagcgccccagggagagagaaaaagctgagactcctggggaatgacgttggggtgatggagtccggggaaagagaggtggggggagagcctgaggtccccaagtgaggggagtcctaggcagagctgctgattgtggggctgggaggtggagggcccctgattcgaaggccatttggtgagtgttttgctggaaatatttcctgtatataaacttctttcaatctacaataataaaggcttgaggtaaactgctt

SEQ ID NO: 7959 - DNA, 4627 bp, Homo sapiens
atgcaccagaccctctgcctgaaccccgagagcctgaaaatgtctgcgtgcagtgactttgtggagcacatctggaaacccgggtcctgcaagaactgcttctgcctgcggagcgaccaccagctggtggccggccctccccagcccagagcgggcagcctgccccctccaccgcgcctgcctcccaggcctgagaactgccgcctggaagatgaaggtgtgaacagctcaccttactccaagcccacaattgccgtgaagcccaccatgatgagctccgaggcctctgatgtgtggacagaggccaacctgagtgccgaagtctcgcaggtcatctggagacgagcccctggcaagctccccctcccgaagcaggaggatgcccccgtcgtctacctgggcagcttccgaggtgtacagaagcctgctggtccctctacctcccctgatggcaattctcgctgtcccccagcttacaccatggtcggcctgcacaaccttgagccccgcggcgagaggaacattgccttccacccggtgagcttcccggaggagaaggctgtgcacaaagaaaaaccctcatttccttaccaagaccggccctccacccaggagagcttccgccagaaactggctgcctttgctgggaccacatctggctgtcaccagggccctgggcccctgcgggaatccctgccctcggaggatgacagtgatcaaaggtgctcgccctccggggacagcgagggtggagagtactgctccatcctggactgctgccctgggagccctgttgccaaggctgcctcccagactgcaggttcccggggcaggcatggtggcagggactgctcacccacgtgctgggagcaggggaagtgttccgggcccgcagagcaggagaagcggggcccgagcttccccaaggagtgctgtagccagggccccactgcccacccatcctgcctgggccccaagaaactgtccctcacctcggaggctgccatttcttccgacggcctctcttgtggcagcggcagcggcagcggcgccagtagccccttcgtcccccacctcgagagtgattactgctccctcatgaaggaacctgccccagagaagcagcaggaccctggctgcccaggggtgacccctagcagatgccttgggctgacgggggagccccagcccccggcccacccccgggaggctacacagcctgaacccatctatgctgagagcaccaagaggaagaaggcagctccggtgccttccaagtcacaggccaagatagaacatgcagctgctgcccagggccaaggccaggtatgcacaggtaatgcctgggcccagaaagcagcatctggctggggccgggacagcccagacccaactccccaggtgtcagccaccatcacagtcatggcggcccacccggaagaggaccatcggacgatctacctgagcagccctgactctgcagtgggggtgcagtggccacgagggcctgtgagccagaactccgaggtaggtgaagaggagacttcggctgggcaggggctgagctccagggaaagccatgctcacagtgccagcgagagcaagcccaaggagaggcccgccattccccccaagttgtccaagagtagccctgtagggtccccggtgtcaccgtctgctggagggcccccagtgtcaccgctggctgaccttagtgatgggagctctggcggcagcagcattgggccccagcctccatcccaaggtcctgctgaccccgctccttcctgccggaccaacggtgtcgctatcagtgacccatccaggtgtccccagcctgccgcctcgtcagcctcggaacagaggcggcccaggttccaggcaggcacctggagtcgtcagtgccggatagaggaagaagaggaggtggagcaggaattgctgagtcacagctggggaagagagaccaaaaatggccccacggaccattcaaactccacgacctggcaccgtctccaccccacagatggctcctctgggcagaacagcaaagttgggaccgggatgagcaaatccgcctcttttgcctttgagttccccaaggacagaagtgggattgagacattctcacctcctcctccgcctccaaagtcgcggcaccttctaaaaatgaacaagagcagctctgatttggaaaaagtgagccagggctctgcagaaagcctcagcccatccttcaggggtgtccacgtcagcttcaccaccggctccacggacagcctggcctcagactctaggacctgcagcgatggaggtccctcgtctgagctggctcactcgcccaccaacagcgggaagaagctctttgctcccgttccgtttccttcaggctccactgaggacgtgtcccccagtggcccccagcagccccctccactcccccagaaaaagatagtgagccgggcagcctcttcaccggatggcttcttctggacccaaggctcccccaagcccggaacagcaagccccaagctgaacctaagccactcggaaaccaacgtccacgacgaatctcactttagctattcgttgagccccgggaaccgccaccatcctgtcttctcctcttccgatcctctggagaaagctttcaaaggcagtggccactggcttccggcagcagggctggcgggcaacagaggcggctgcgggagccctggcctccagtgcaaaggggccccctccgcctcatcctcccagctgagcgtgtccagtcaagcctccaccgggagcacccagcttcagctgcacggtctcctgagcaacatcagcagcaaggagggcacctatgccaagctggggggactctacacccagtccctggcccgccttgtagccaaatgtgaggacctcttcatgggcggccagaaaaaggagctccacttcaatgagaataactggtcgctcttcaagctgacttgtaacaagccctgctgtgactcgggggatgccatttattactgtgccacctgctctgaggaccccggcagcacctatgctgtgaaaatctgcaaagcccctgagcccaaaacagtctcctactgcagcccgtccgtgcccgtgcactttaacatccagcaggactgcggccacttcgtcgcctcggtgccgtccagcatgctcagctcccccgacgcgcccaaggaccctgtgcctgccctgcccacacacccccctgcccaggagcaggactgcgtggtggtcatcacccgagaggtgccacatcagaccgcctccgacttcgtgcgggactcggcggccagccaccaggcggagcccgaggcgtacgagcggcgcgtgtgcttcctgcttctgcaactctgcaacgggctggagcacctgaaggagcacgggatcatccaccgggacctgtgcctggagaacctgctgctggtgcactgcaccctccaggccggccccgggcccgcccccgccccggctcccgcccccgccgccgccgcgcctccctgctcctctgccgccccgcctgctggtggcactctcagccccgcagccggccccgcctccccggaagggccccgggagaagcagctgccccggctcatcatcagcaactttttgaaggccaagcagaagccgggcggcaccccaaacctgcagcagaagaagagccaggcccggctggcccccgagatcgtgtctgcttcccagtaccgcaagttcgatgagttccagacaggcatcctcatctacgagctgctgcaccaacccaacccgttcgaggtgcgcgcccagctgcgggagagagactaccggcaggaggacctgccgccgctgcccgcgctgtccctctactcacccggcctgcagcagctggcacatctgctactggaggccgaccccatcaagcgtatccgcatcggcgaggccaagcgcgtgctgcagtgcctgctgtgggggcctcggcgcgagctggtgcagcagccgggcacctcggaggaggcgctgtgcggcacgctgcacaactggatcgacatgaagcgggccctgatgatgatgaagtttgcggagaaggcggtggatcgcaggcggggcgtggagctggaggactggctttgctgccagtacctggcgtctgcggagcccggggccctcttacagtcgctgaagctcctgcagcttctgtgagccaagccccagcctgcaccgtcgctgccccttccctgcctaaccctttcctgtctcgccttggaagcacccatgtctccctgggaaatggtacagatgactgggatacctggatgtaaaatatataaatatatatatagaaaatacatataccatatataaatatgaaagactaaggatgctgttgcccgtccacactcgtctcctctctgcactaagtcctccctgttttcttctgtaattatacacatttccagttccatgcaacgtcctgaggacagttctgtgaactgaatgcagcctggacactggcctcaataccttgtttaggatttcttcacccttttgtcaaattgttatttaaagaaaaaaaaaaaagaagaaaattccattaaaattttttttggttgagtcatga

SEQ ID NO: 7960 - DNA, 4891 bp, Homo sapiens
ccggaggcggagggggcggagccgcgctcacagctgccacccggccgccgggcccaggcagaagccacccgcccgcggccgggcacgcaccgcgcgcagaccttctgcgaacaatgctccggccgggcggctggcggctcggagaccgacggaggggccgggggagcgcagcccagaggaagccgctctgtgacccacctctgaatcccacaaaactgcaccagagagccgggcgcaagatgaaccagcaccctgtcggctcaagatgcaccagaccctctgcctgaaccccgagagcctgaaaatgtctgcgtgcagtgactttgtggagcacatctggaaacccgggtcctgcaagaactgcttctgcctgcggagcgaccaccagctggtggccggccctccccagcccagagcgggcagcctgccccctccaccgcgcctgcctcccaggcctgagaactgccgcctggaagatgaaggtgtgaacagctcaccttactccaagcccacaattgccgtgaagcccaccatgatgagctccgaggcctctgatgtgtggacagaggccaacctgagtgccgaagtctcgcaggtcatctggagacgagcccctggcaagctccccctcccgaagcaggaggatgcccccgtcgtctacctgggcagcttccgaggtgtacagaagcctgctggtccctctacctcccctgatggcaattctcgctgtcccccagcttacaccatggtcggcctgcacaaccttgagccccgcggcgagaggaacattgccttccacccggtgagcttcccggaggagaaggctgtgcacaaagaaaaaccctcatttccttaccaagaccggccctccacccaggagagcttccgccagaaactggctgcctttgctgggaccacatctggctgtcaccagggccctgggcccctgcgggaatccctgccctcggaggatgacagtgatcaaaggtgctcgccctccggggacagcgagggtggagagtactgctccatcctggactgctgccctgggagccctgttgccaaggctgcctcccagactgcaggttcccggggcaggcatggtggcagggactgctcacccacgtgctgggagcaggggaagtgttccgggcccgcagagcaggagaagcggggcccgagcttccccaaggagtgctgtagccagggccccactgcccacccatcctgcctgggccccaagaaactgtccctcacctcggaggctgccatttcttccgacggcctctcttgtggcagcggcagcggcagcggcgccagtagccccttcgtcccccacctcgagagtgattactgctccctcatgaaggaacctgccccagagaagcagcaggaccctggctgcccaggggtgacccctagcagatgccttgggctgacgggggagccccagcccccggcccacccccgggaggctacacagcctgaacccatctatgctgagagcaccaagaggaagaaggcagctccggtgccttccaagtcacaggccaagatagaacatgcagctgctgcccagggccaaggccaggtatgcacaggtaatgcctgggcccagaaagcagcatctggctggggccgggacagcccagacccaactccccaggtgtcagccaccatcacagtcatggcggcccacccggaagaggaccatcggacgatctacctgagcagccctgactctgcagtgggggtgcagtggccacgagggcctgtgagccagaactccgaggtaggtgaagaggagacttcggctgggcaggggctgagctccagggaaagccatgctcacagtgccagcgagagcaagcccaaggagaggcccgccattccccccaagttgtccaagagtagccctgtagggtccccggtgtcaccgtctgctggagggcccccagtgtcaccgctggctgaccttagtgatgggagctctggcggcagcagcattgggccccagcctccatcccaaggtcctgctgaccccgctccttcctgccggaccaacggtgtcgctatcagtgacccatccaggtgtccccagcctgccgcctcgtcagcctcggaacagaggcggcccaggttccaggcaggcacctggagtcgtcagtgccggatagaggaagaagaggaggtggagcaggaattgctgagtcacagctggggaagagagaccaaaaatggccccacggaccattcaaactccacgacctggcaccgtctccaccccacagatggctcctctgggcagaacagcaaagttgggaccgggatgagcaaatccgcctcttttgcctttgagttccccaaggacagaagtgggattgagacattctcacctcctcctccgcctccaaagtcgcggcaccttctaaaaatgaacaagagcagctctgatttggaaaaagtgagccagggctctgcagaaagcctcagcccatccttcaggggtgtccacgtcagcttcaccaccggctccacggacagcctggcctcagactctaggacctgcagcgatggaggtccctcgtctgagctggctcactcgcccaccaacagcgggaagaagctctttgctcccgttccgtttccttcaggctccactgaggacgtgtcccccagtggcccccagcagccccctccactcccccagaaaaagatagtgagccgggcagcctcttcaccggatggcttcttctggacccaaggctcccccaagcccggaacagcaagccccaagctgaacctaagccactcggaaaccaacgtccacgacgaatctcactttagctattcgttgagccccgggaaccgccaccatcctgtcttctcctcttccgatcctctggagaaagctttcaaaggcagtggccactggcttccggcagcagggctggcgggcaacagaggcggctgcgggagccctggcctccagtgcaaaggggccccctccgcctcatcctcccagctgagcgtgtccagtcaagcctccaccgggagcacccagcttcagctgcacggtctcctgagcaacatcagcagcaaggagggcacctatgccaagctggggggactctacacccagtccctggcccgccttgtagccaaatgtgaggacctcttcatgggcggccagaaaaaggagctccacttcaatgagaataactggtcgctcttcaagctgacttgtaacaagccctgctgtgactcgggggatgccatttattactgtgccacctgctctgaggaccccggcagcacctatgctgtgaaaatctgcaaagcccctgagcccaaaacagtctcctactgcagcccgtccgtgcccgtgcactttaacatccagcaggactgcggccacttcgtcgcctcggtgccgtccagcatgctcagctcccccgacgcgcccaaggaccctgtgcctgccctgcccacacacccccctgcccaggagcaggactgcgtggtggtcatcacccgagaggtgccacatcagaccgcctccgacttcgtgcgggactcggcggccagccaccaggcggagcccgaggcgtacgagcggcgcgtgtgcttcctgcttctgcaactctgcaacgggctggagcacctgaaggagcacgggatcatccaccgggacctgtgcctggagaacctgctgctggtgcactgcaccctccaggccggccccgggcccgcccccgccccggctcccgcccccgccgccgccgcgcctccctgctcctctgccgccccgcctgctggtggcactctcagccccgcagccggccccgcctccccggaagggccccgggagaagcagctgccccggctcatcatcagcaactttttgaaggccaagcagaagccgggcggcaccccaaacctgcagcagaagaagagccaggcccggctggcccccgagatcgtgtctgcttcccagtaccgcaagttcgatgagttccagacaggcatcctcatctacgagctgctgcaccaacccaacccgttcgaggtgcgcgcccagctgcgggagagagactaccggcaggaggacctgccgccgctgcccgcgctgtccctctactcacccggcctgcagcagctggcacatctgctactggaggccgaccccatcaagcgtatccgcatcggcgaggccaagcgcgtgctgcagtgcctgctgtgggggcctcggcgcgagctggtgcagcagccgggcacctcggaggaggcgctgtgcggcacgctgcacaactggatcgacatgaagcgggccctgatgatgatgaagtttgcggagaaggcggtggatcgcaggcggggcgtggagctggaggactggctttgctgccagtacctggcgtctgcggagcccggggccctcttacagtcgctgaagctcctgcagcttctgtgagccaagccccagcctgcaccgtcgctgccccttccctgcctaaccctttcctgtctcgccttggaagcacccatgtctccctgggaaatggtacagatgactgggatacctggatgtaaaatatataaatatatatatagaaaatacatataccatatataaatatgaaagactaaggatgctgttgcccgtccacactcgtctcctctctgcactaagtcctccctgttttcttctgtaattatacacatttccagttccatgcaacgtcctgaggacagttctgtgaactgaatgcagcctggacactggcctcaataccttgtttaggatttcttcacccttttgtcaaattgttatttaaagaaaaaaaaaaaagaagaaaattccattaaaattttttttggttgagtcatg

SEQ ID NO: 7961 - DNA, 3118 bp, Homo sapiens
ggagagcgcgccacagaacgacttttacgcaggcgcagaagcctgtttcccctcacccgcggcttccaccctgcgcaggcgcaaaaagccgcgctggcaacctccgcagcggtcgcgcgcacccttcatccctcttgctgcttttgtctggcacaaccttctcaggccctccgcgaggccggccctttttttctttcactttccccacccggagagccaggtgccgagaactaggacctcgtccccttctctatcccttcccctgatccatctcgtctctgttctccttcccttttccgttcccgaagccggaaggagccgaggtacccacggaaaaagtcgaagctgtccccggagagtgaggccttcacgaagcggtggcggaaggagccgaagttctctgatcggaggcgtgagcaagtggcatctccggaaagagccgaaacacggactcgagcttaatcccaggaggggcccgagggcgagatccggaaatctccggaaagagccgaaggccgggacggttaggattgtcggaagtggccgattgcttggacagggccggcggagaagatcggagcaagtccgtggaagaagccaaagactgggacggattgaattgttggaagaacccgaactcgcagaggggactgggcgcagtggcacacgaggacacacggaaacctccgaacgttgaggagataatctcggaaaagttacggaaacctgggaagtcggcgaaaccctacgttcgggtgttttcggaagcagccgaagcggccgcctgcttcgccttcgtccagtatccggagatagccgaggcgcttcggagccaggctcggggggaggggcaagctcgcgggcgggcgggcgggtgagggggcggagcccgggcggggcggggagggctgccggaggcttgattaggtaggaggtggcgaagcgccggcggcggccggaagtagccgaagccagcggcggaagtagccgaagcggctggagcgggcggcaaggcgaggcgaaagctgcacagggccctacgcggccgcctcagcatgtcggacttcgacgagttcgagcggcagctcaacgagaataaacaagagcgggacaaggagaaccggcatcggaagcgcagccacagccgctctcggagccgggaccgcaaacgccggagccggagccgcgaccggcgcaaccgggaccagcggagcgcctcccgggacaggcgacgacgcagcaaacctttgaccagaggcgctaaagaggagcacggtggactgattcgttccccccgccacgagaagaagaagaaggtccgtaaatactgggacgtgccacccccaggctttgagcacatcaccccaatgcagtacaaggccatgcaagctgcgggtcagattccagccactgctcttctccccaccatgacccctgacggtctggctgtgaccccaacgccggtgcccgtggtcgggagccagatgaccagacaagcccggcgcctctacgtgggcaacatcccctttggcatcactgaggaggccatgatggatttcttcaacgcccagatgcgcctgggggggctgacccaggcccctggcaacccagtgttggctgtgcagattaaccaggacaagaattttgcctttttggagttccgctcagtggacgagactacccaggctatggcctttgatggcatcatcttccagggccagtcactaaagatccgcaggcctcacgactaccagccgcttcctggcatgtcagagaacccctccgtctatgtgcctggggttgtgtccactgtggtccccgactctgcccacaagctgttcatcgggggcttacccaactacctgaacgatgaccaggtcaaagagctgctgacatcctttgggcccctcaaggccttcaacctggtcaaggacagtgccacggggctctccaagggctacgccttctgtgagtacgtggacatcaacgtcacggatcaggccattgcggggctgaacggcatgcagctgggggataagaagctgctggtccagagggcgagtgtgggagccaagaatgccacgctgagcaccatcaatcagacgcctgtgaccctgcaagtgccgggcttgatgagctcccaggtgcagatgggcggccacccgactgaggtcctgtgcctcatgaacatggtgctgcctgaggagctgctggacgacgaggagtatgaggagatcgtggaggacgtgcgggacgagtgcagcaagtacgggcttgtcaagtccatcgagatcccccggcctgtggacggcgtcgaggtgcccggctgcggaaagatctttgtggagttcacctctgtgtttgactgccagaaagccatgcagggcctgacgggccgcaagttcgccaacagagtggttgtcacaaaatactgtgaccccgactcttatcaccgccgggacttctggtagaggcggctgggggagggtgggggcagggctggctgggggcttctccccactcccgccccccccttatccccctctgaagacgatgggcagaggagtgacagccgcagacacacgacagccggcagcaactggaatggcagcaattaagggtggggggcgggggttggggggttggggggttagggcagggaggggactggggaagtgcgcacacagcccacacagacaacacgcacccacacagacacagagggaaggggttgggatggggacagggtgcacagcagggcggggtaggaccccagcccctcccaaaacagcctctccttctcccatagacccctttcttctccccttccccacggtaggaacatagcgtgtttatattttatggccaaactattttgaattttgttgtccggccctcagtgccctgccctctcccttaccaggaccacagctctgttccttcggcctctggtcctctctggtcccctcctgggtttcttacgtagttgatttttcctctttagtctcccccgacctgcgcccagccccgtggcccctgcccctctcctactctctgtggcagtttcatatttgctaagacgaatttgctcattaaacattttgttgtattttacttt

SEQ ID NO: 7962 - DNA, 783 bp, Homo sapiens
atgtggcatgccatctctcgaacatccaggatgtcccagagtggatgtccatcaggtctgctggcagacaaaaatatctcttcaagtgccactcgagtgatagtgaagactgcaggcaaccagaaagactttatggtagctgatgacatctcggtaaggcagttcaaggagatgctattggctcacttccaatgccagatggaccaactagtgctggtcttcatgggttgccttctcaaagaccatgacacactgagccagaggggcatcatggatggccacaccatctacttggtcatcaagtccaagcagggctccagatctctagcccattccttccgggacctgccaacgaatgatccctgccaccgggacagaaacaccaaagccaatgacacccttaacaaggtcaaccacacttccaaagccaacactgctatgatttccaccaagggccagagccatatctgtgccactcggcagccagcttggataccagccttacctagcatagagcttacccagcagcttcaagaagaatacaaggatgccactgtttctctaagtagctccagacagacattaaagggtgatctccagctgtcagatgagcagagcagctcccagatcacaggaggcatgatgcagttgcttatgaacaacccctacctggcagctcagattatgttgttcacaagtatgccccagctgagtgaacagtggaggcagcagctgcccacattcctgcagcagacacagatttctgatctgcttagtgcttag

SEQ ID NO: 7963 - DNA, 2313 bp, Homo sapiens
cactttgtccaccatgggtgaattatgaatcagtagctatgccaggcctcagctgggccacatctggagaactggggtgagggcacaacatcacaaaatatctggccccagtctggtcactcatcccttttagggcaacaaggaaactatcctgtggcctgagagcacaatacctgagacaaaggccagcagaaacatttgtctgccctcaccctttctgccccagcttccacctgctccccatctgcccacccactaaagcccatgtggcatgccatctctcgaacatccaggatgtcccagagtggatgtccatcaggtctgctggcagacaaaaatatctcttcaagtgccactcgagtgatagtgaagactgcaggcaaccagaaagactttatggtagctgatgacatctcggtaaggcagttcaaggagatgctattggctcacttccaatgccagatggaccaactagtgctggtcttcatgggttgccttctcaaagaccatgacacactgagccagaggggcatcatggatggccacaccatctacttggtcatcaagtccaagcagggctccagatctctagcccattccttccgggacctgccaacgaatgatccctgccaccgggacagaaacaccaaaggaaacagcagcagagtgcaccaaccaactggtatgaatcaagctccagtggaactggcccactttgtggggtctgatgcacccaaagtgcatacccaaaacttggaagtgagccacccagagtgcaaagcacagatgctggagaatcctagcatccagcggcttctgtccaacatggagttcatgtggcagttcatttcagaacatctagacacgcaacaattgatgcagcagaacccagaagtttcccgccttcttcttgataattctgagatcctattgcagactctggagctggccaggaaccttgctatgatccaagagataatgcagatccaacaaccttcacaaaaccttgagtatccactgaacccacagccatatctgggcttagagacaatgccaggtgggaataatgccctgggtcagaactatgctgatatcaatgatcaaatgctgaacagcatgcaagatccttttggaggaaaccctttcacagctctcctggcaggacaagtgctagaacaagtccagtcttcacccccacctccaccaccatcacaggaacaacaagaccagctcacacagcatcctgcaacccgagtcatctataatagctctggtggtttctcttcaaacacctcagccaatgacacccttaacaaggtcaaccacacttccaaagccaacactgctatgatttccaccaagggccagagccatatctgtgccactcggcagccagcttggataccagccttacctagcatagagcttacccagcagcttcaagaagaatacaaggatgccactgtttctctaagtagctccagacagacattaaagggtgatctccagctgtcagatgagcagagcagctcccagatcacaggaggcatgatgcagttgcttatgaacaacccctacctggcagctcagattatgttgttcacaagtatgccccagctgagtgaacagtggaggcagcagctgcccacattcctgcagcagacacagatttctgatctgcttagtgcttaggcaaccctaaagcattccaagcaatattgcagattgagcaggccctccagctgctggccacagaggctcctgttcttctgccttgggttgcaccctacctatggggcctgggttggcttcctgcccccagctgcagctatcctgacacagtgccctgttcctggaatgtttcagatacagctgagcccaagggacctgagtgctgccacaagcctggaacagtcctgcagaggctacaatccccggatggggacccttcccaccctctgcaagctcctgagatttgttttagcaaacagatggattctctccaggccatgggatttgggaaccaccatgccaatctacaggcactcattgctactgaaggggacaccaatgctgctatccgcaagctcaagagatcccagagattctaaccaccatgcctacttgtttgcttgctacctgcctgctgacccacctgaccatctcatttgccttttgcacctttcctgatgcttccagccaggagaagtcctggaataagagttatcaaccaatgtgtcttgtactgaataatagatcattggtcgtggctgaaacatctgtcaataaaatggctacactcacttgctgcga

SEQ ID NO: 7964 - DNA, 1381 bp, Homo sapiens
ctgtttggggctcagctaagtgaccacacaggagagcagtgaggccatttgaggcctgagcctggtcctcaggactcgactctctctccctgccatcaagcagcctgccccagccctgccagccatctccacactcctgacagaatgaatgccctcgatggtgttcctttcaagttgcccaagggctttgtgataggcacagagcctctccctgggccagaactcagcgtcccggcctgcggggaagttctgctgggttctatgcacgacttcagcctggagaggacggcactcttctgggtggaggccgccggccagggacccagcccgtaccagtgcggtgacccggggacagcgtcagcccctccagcctggctcttgctagtcagccccgaacatgggctggcgcctgcgcccaccacaatcagagacccggaggccggacaccaggagaggccggaggaggagggtgaggacgaggcagaagcctcctctggcagcgaggaagagccggcccccagcagcctccaaccgggctccccggcgagccccggccccggccgtcgcctgtgctcgctggacgtgctacgcggcgtgcggttggagctggcaggggcgcggcggcggctctccgaggggaagctggtctcccggccccgcgccctcctgcatggcctccgcggccaccgcgcgctgagcctgtgcccgagccctgcgcagtcccccaggtctgcatcacccccggggcccgcgccccagcaccccgccgcccccgcgtcgcccccgcggccctccacggcaggcgccatccccccgctgcggagccacaagcctacggtcgcgtccctcagcccgtacacctgtctgccacctcttgggggggcaccccaacctctcaacccccacaagtcacaccctgatactgcggctgacctgctgtccgccctgagccaggaggagcaagacctcattgggccagtggtcgccctgggatatcccctgcgaagggccatcatagctctgcagaagacagggaggcagagcctgagccagtttctcagctacctcagtgcctgtgaccgcctgttacgtcagggatatgaggaaggcctggtggatgaggccatggagatgttccagttctccgagagccaggcaggggagttcctgcgcctctgggagcagttcagtgacatgggcttccagcaggaccggatcaaggaggtgctgctggtccatggcaaccgccgagagcaagccctggaggagctggtggcctgtgcccagtgaccacggaggcactccacgatgcctgggcatctaggcccaatgccagacctggcaacccatcctaactgtattattaaaaccaagtaagagt

SEQ ID NO: 7965 - DNA, 1464 bp, Homo sapiens
catttatacacgctttgtctgcagggaagttctcctggtaattacaagcactggccccctcaccttttcctttccagctgtttggggctcagctaagtgaccacacaggagagcagtgaggccatttgaggcctgagcctggtcctcaggactcgactctctctccctgccatcaagcagcctgccccagccctgccagccatctccacactcctgacagaatgaatgccctcgatggtgttcctttcaagttgcccaagggctttgtgataggcacagagcctctccctgggccagaactcagcgtcccggcctgcggggaagttctgctgggttctatgcacgacttcagcctggagaggacggcactcttctgggtggaggccgccggccagggacccagcccgtaccagtgcggtgacccggggacagcgtcagcccctccagcctggctcttgctagtcagccccgaacatgggctggcgcctgcgcccaccacaatcagagacccggaggccggacaccaggagaggccggaggaggagggtgaggacgaggcagaagcctcctctggcagcgaggaagagccggcccccagcagcctccaaccgggctccccggcgagccccggccccggccgtcgcctgtgctcgctggacgtgctacgcggcgtgcggttggagctggcaggggcgcggcggcggctctccgaggggaagctggtctcccggccccgcgccctcctgcatggcctccgcggccaccgcgcgctgagcctgtgcccgagccctgcgcagtcccccaggtctgcatcacccccggggcccgcgccccagcaccccgccgcccccgcgtcgcccccgcggccctccacggcaggcgccatccccccgctgcggagccacaagcctacggtcgcgtccctcagcccgtacacctgtctgccacctcttgggggggcaccccaacctctcaacccccacaagtcacaccctgatactgcggctgacctgctgtccgccctgagccaggaggagcaagacctcattgggccagtggtcgccctgggatatcccctgcgaagggccatcatagctctgcagaagacagggaggcagagcctgagccagtttctcagctacctcagtgcctgtgaccgcctgttacgtcagggatatgaggaaggcctggtggatgaggccatggagatgttccagttctccgagagccaggcaggggagttcctgcgcctctgggagcagttcagtgacatgggcttccagcaggaccggatcaaggaggtgctgctggtccatggcaaccgccgagagcaagccctggaggagctggtggcctgtgcccagtgaccacggaggcactccacgatgcctgggcatctaggcccaatgccagacctggcaacccatcctaactgtattattaaaaccaagtaagagtaacaaa

SEQ ID NO: 7966 - DNA, 1848 bp, Homo sapiens
attggcaggtaacgagcggcggcggcggcagcgggtcttgggtcctccgagagcagcagcgattttctattttgtacatacattattttgtatatactgtatatgatgacttcagtgagcagtgaccattgtcgaggtgctcgggaaaaaccacagatttcagcagcacaatcaacgcaaccacagaaacaagtggtacaggcaacagctgaacagatgcgtctcgctcaagtgatctttgataagaatgattcagattttgaagctaaagttaagcagcttatggaagtgacagggaaaaatcaggatgaatgcatagtggccctacatgattgtaatggagatgtgaacaaagctatcaatatattgctggaagggaattcagacacaacttcatgggagactgtagggtgtaagaaaaagaattttgcaaaagaaaattcagaaaacaaagagaatagagagaagaaaaaacacactggcgacctgactagcagccctctctctcagcttagcagttcgctctccagccaccagagcagcctctctgcacatgcagccctctcctcgagcacgtcacacacacatgccagtgtggagagcgcctcttcccaccagtcctcagccaccttctccacggcagcgacctccgtctcaagttccgcatcctcaggcgccagcctgtccagtagcatgaacaccgcgaacagcctctgtctgggtgggacccccgcgagtgcatccagcagcagtagcagggccgcgcccttggtgacctcaggcaaagcacccccaaacttacctcagggggtgcctcccctgctgcacaaccagtacctcgtaggtcccggaggactgcttcctgcctacccgatctatggctatgacgagctccagatgctgcagtcacggctgccagtggactactatggaattccctttgctgcacccacagcgcttgccagccgagatgggagcctagctaataatccatatccaggtgatgtcacaaagtttggccgtggggactctgcatcccctgcacccgctaccacaagctcagccacagcagagccaatcacagacccaccacacagcccagcagcccttcgtgaatcctgcactgccacctggagctacactggtcttccctactacacaggcatgcccagtgccttccagtatggccccaccatgtttgtccctccagcctcagccaagcaacatggggtgaacctcagcactcccacacctcccttccagcaggccagtggttatggccagcacggctacagtacaggttatgacgacctgacccaggggacagcagcaggagactactccaaaggtggctatgctggatcatcgcaggcaccaaacaagtctgcaggttctgggcctggcaaaggagtatcagtgtcttcaagcaccactggtctacctgatatgactggttctgtctacaataagacacagacttttgacaagcagggatttcatgcagggacgcctccacctttcagcctgccctcggtcttgggctccactgggcccctggcctcgggagcggcccctggctatgcacccccaccattcctacacatcttgccagcccaccagcagccccactcacagctgctgcaccaccaccttccgcaggatgcacagagtggctcgggtcagcgcagcccagctccctgcagcccaagtctcaagcctccaaacctgcctacgctctccatactggacaaactaaacccagaagagaggggtgggctggggcaaggcttatcctgggcaggagagaacacacgagcacgtatttgggagcccagtgccctttcctag

SEQ ID NO: 7967 - DNA, 4284 bp, Homo sapiens
gtgacgcgaggtcacgtgacgggttgggcagcctgtgccgccgccgccgctttgtaagaggcacattggcagattttctattttgtacatacattattttgtatatactgtatatgatgacttcagtgagcagtgaccattgtcgaggtgctcgggaaaaaccacagatttcagcagcacaatcaacgcaaccacagaaacaagtggtacaggcaacagctgaacagatgcgtctcgctcaagtgatctttgataagaatgattcagattttgaagctaaagttaagcagcttatggaagtgacagggaaaaatcaggatgaatgcatagtggccctacatgattgtaatggagatgtgaacaaagctatcaatatattgctggaagggaattcagacacaacttcatgggagactgtagggtgtaagaaaaagaattttgcaaaagaaaattcagaaaacaaagagaatagagagaagaaaagcgagaaagaatcgagtcgtggacgtggaaacaacaaccggaaaggaagaggcggcaatcgtggcagagaatttagaggtgaagaaaatggaattgattgcaatcaagtggacaaaccttcagatcgtggcaagcgagcccggggtagaggatttggacgtggcagagggagaggggcaggaaggttctcaacccaaggcatggggacatttaatcctgcagactattcagattctacatctacagatgtgtgtgggacaaagctagtagtttgggaagctgctcagaatggtgcagatgagggaactgaactggcatcaaatactcacaacatagctcaggatctgtcaaacaaaagttcttatggactcaaaggggcttggaagaattctgtggaagagtggacaacagaagactggactgaagatctttctgaaacaaaggtcttcactgcctcatctgctccagcagagaatcacatcttacctgggcaaagcattgatctggtagccttgctccagaagcctgttcctcacagtcaagcctcagaagccaactcctttgaaacttcccaacagcagggctttggccaagcccttgtcttcacaaattcgcaacacaacaatcagatggcaccagggactggcagctccactgccgtcaactcctgttctcctcagagcctgtcatccgtccttggctcaggatttggagagcttgcaccaccaaaaatggcaaacatcaccagctcccagattttggaccagttgaaagctccgagtttgggccagtttaccaccaccccaagtacacagcagaatagtacaagtcaccctacaactactacttcttgggacctcaagcccccaacatcccagtcctcagtcctcagtcatcttgacttcaaatctcaacctgagccatccccagttcttagccagttgagccagcgacaacagcaccagagccaggcagtcactgttcctcctcctggtttggagtcctttccttcccaggcaaaacttcgagaatcaacacctggagacagtccctccactgtgaacaagcttttgcagcttcccagcacgaccattgaaaatatctctgtgtctgtccaccagccacagcccaaacacatcaaacttgctaagcggcggatacccccagcttctaagatcccagcttctgcagtggaaatgcctggttcagcagatgtcacaggattaaatgtgcagtttggggctctggaatttgggtcagaaccttctctctctgaatttggatcagctccaagcagtgaaaatagtaatcagattcccatcagcttgtattcgaagtctttaagtgagcctttgaatacatctttatcaatgaccagtgcagtacagaactccacatatacaacttccgtcattacctcctgcagtctgacaagctcatcactgaattctgctagtccagtagcaatgtcttcctcttatgaccagagttctgtgcataacaggatcccataccaaagccctgtgagttcatcagagtcagctccaggaaccatcatgaatggacatggtggtggtcgaagtcagcagacactagacactccaaagacaacaggccctccctctgccctcccgtctgtgagctccctgcccagcaccacctcctgcactgcacttctgccgtccacatcccagcacactggcgacctgactagcagccctctctctcagcttagcagttcgctctccagccaccagagcagcctctctgcacatgcagccctctcctcgagcacgtcacacacacatgccagtgtggagagcgcctcttcccaccagtcctcagccaccttctccacggcagcgacctccgtctcaagttccgcatcctcaggcgccagcctgtccagtagcatgaacaccgcgaacagcctctgtctgggtgggacccccgcgagtgcatccagcagcagtagcagggccgcgcccttggtgacctcaggcaaagcacccccaaacttacctcagggggtgcctcccctgctgcacaaccagtacctcgtaggtcccggaggactgcttcctgcctacccgatctatggctatgacgagctccagatgctgcagtcacggctgccagtggactactatggaattccctttgctgcacccacagcgcttgccagccgagatgggagcctagctaataatccatatccaggtgatgtcacaaagtttggccgtggggactctgcatcccctgcacccgctaccacaccagctcagccacagcagagccaatcacagacccaccacacagcccagcagcccttcgtgaatcctgcactgccacctggctatagctacactggtcttccctactacacaggcatgcccagtgccttccagtatggccccaccatgtttgtccctccagcctcagccaagcaacatggggtgaacctcagcactcccacacctcccttccagcaggccagtggttatggccagcacggctacagtacaggttatgacgacctgacccaggggacagcagcaggagactactccaaaggtggctatgctggatcatcgcaggcaccaaacaagtctgcaggttctgggcctggcaaaggagtatcagtgtcttcaagcaccactggtctacctgatatgactggttctgtctacaataagacacagacttttgacaagcagggatttcatgcagggacgcctccacctttcagcctgccctcggtcttgggctccactgggcccctggcctcgggagcggcccctggctatgcacccccaccattcctacacatcttgccagcccaccagcagccccactcacagctgctgcaccaccaccttccgcaggatgcacagagtggctcgggtcagcgcagccagcccagctccctgcagcccaagtctcaagcctccaaacctgcctacggcaactctccatactggacaaactaaacccagaagagaggggtgggctggggcaaggcttatcctgggcaggagagaacacacgagcacgtatttgggagcccagtgccctttcctagaattcccgacatgtgtcagccatgcctctgtggggagtctgcctcccagactggctactgtatgtaatgtatttatgtatgtatttgtaaatgtgatagaagtctgggggggagttgggggatggcggcagatgttagccaggtctgccctccccattcaagccccttctccactgtagcaaaataagcacccccaccccatctgccttcaggtcttcttcacagcctgcactgcccagtgggccactaggggcagtctctggaagggctggttcaaggctgtttgggtataggggtcaggtaccaatgaagaatcacgacttgtctcactcctttggaaattgttttctttcctgtgtaattacttcatacctctgtttttgagaaactgttccgtttgtcatctgtcatggtctccttccaccaaatcttcatctgggaatagcagcggtatccctccacccaagtatggccacctgtttgtcttcatatagaacaggggcttctggtctggtcatgtccctagagacttactagagactggctgaccatgaaaaaaaaaaaaataatctgagttattcagccagtcagctcccctttaaaaatctaaggtatctccaagcaacacatctccattctagttgtcttgaaccacgtgggcaactgtttcaggggttttctcttgcccaatccccacctaataaagttctgagagcatg

SEQ ID NO: 7968 - DNA, 1809 bp, Homo sapiens
tctcaatctgctgacctcgtgatccgcctgaccttgtaatccacctaccttggcctcccaaagtgttgggattacaggcgtgagccaccgcgcccggccaacatcacgtttttaaaaattgatttcttcaaattcatggcaaatatttcccttccctttaacttcttatgtcagaatgaggaaggatagctgcatttatttagtcagttttcattgcatagtaatattttcatgtagtattttctaagttatattttagtaattcatatgttttagattataggttttaacatacttgtgaaaatacttgatatgttttaaagccttgggcagaaattctgtattgttgaggatttgttcttttatcccccttttaaagtcatccgtccttggctcaggatttggagagcttgcaccaccaaaaatggcaaacatcaccagctcccagattttggaccagttgaaagctccgagtttgggccagtttaccaccaccccaagtacacagcagaatagtacaagtcaccctacaactactacttcttgggacctcaagcccccaacatcccagtcctcagtcctcagtcatcttgacttcaaatctcaacctgagccatccccagttcttagccagttgagccagcgacaacagcaccagagccaggcagtcactgttcctcctcctggtttggagtcctttccttcccaggcaaaacttcgagaatcaacacctggagacagtccctccactgtgaacaagcttttgcagcttcccagcacgaccattgaaaatatctctgtgtctgtccaccagccacagcccaaacacatcaaacttgctaagcggcggatacccccagcttctaagatcccagcttctgcagtggaaatgcctggttcagcagatgtcacaggattaaatgtgcagtttggggctctggaatttgggtcagaaccttctctctctgaatttggatcagctccaagcagtgaaaatagtaatcagattcccatcagcttgtattcgaagtctttaagtgagcctttgaatacatctttatcaatgaccagtgcagtacagaactccacatatacaacttccgtcattacctcctgcagtctgacaagctcatcactgaattctgctagtccagtagcaatgtcttcctcttatgaccagagttctgtgcataacaggatcccataccaaagccctgtgagttcatcagagtcagctccaggaaccatcatgaatggacatggtggtggtcgaagtcagcagacactagacagtaagtatagcagcaagctactcttgtcatggctggtgccaaccaaacagaggaagaggatagctcacgtgatgtggaaaacaccagttggtcaatggcttattcgttaaaaagcagcccttttgcttttttgtttttggaccaggtgttggctgtggtgttattagaaatgtcttaaccacagcaagaaggaggtggtggtctcatattcttctgccctaatcagactgcaccacaagtgcagcatacagtatgcattttaaagatgcttgggccaggcggggtggctgatgcccataatcccagtgctttggggggccaaggcaggcagattgcccaagctcaggagtttgagaccaccctgggcaacatggtgaaactctgtctctactaaaatacgaaaaactagccgggtgtggtggcggcgcgtgcctgtaatcccagctacttgggaggctgaggcacaagaatcgcttgagccagcttgggctacaaagtgagactccgtctgaaaaga

SEQ ID NO: 7969 - DNA, 2673 bp, Homo sapiens
ttatatgctgctttctatgtcctggtttggagactggtctccctcttacagagcttttcttcccttttttgagacttgccttgtccacctaggtgtgccccccacctacctgctcggagcttgaagttcttcataggaccctgttgctagggttgggcagctaggcagggcttctgggactcggggctgatggagcatccgctggttcactctttcttcacaggggtaccttgtcaaacaggcataagtggcaggccatgcccttttaggtgggcactggtgaggcattggtggactgaaaggtgtcaccaggttttggagcaaaggcctctctcagcctcctgtttccagaccacagtggctgagaatcccaatagaagggaaatctccaaaagattgagacttacgctgggcttcctgtggcctgtgctcgcctcttctcagactgtttgctttgctctgaggtaggtacttgtcccatattcagatagtctgtgttcatttatgatccgaagttatcttgggatttctatgccctcattttggatgccaagcatgagcaacttgaaggatttttacagagagttgtggtcattaaagcttaatgttaatagttttgatgttcagtttatgtattgtatcctgatggctggaaccagctgctatgtgaggggccgcagtgagcactgagcacagagcctctcaccttaagggagcctgggtggttacatcattgcctgcctgctcagccttgagacttgggcccaagcgccaggccaggctctccccagcaccctcctcctctgcctccagatccatgtgtcctggcttttcttttgccagcatgccagtgtggagagcgcctcttcccaccagtcctcagccaccttctccacggcagcgacctccgtctcaagttccgcatcctcaggcgccagcctgtccagtagcatgaacaccgcgaacagcctctgtctgggtgggacccccgcgagtgcatccagcagcagtagcagggccgcgcccttggtgacctcaggcaaagcacccccaaacttacctcagggggtgcctcccctgctgcacaaccagtacctcgtaggtcccggaggactgcttcctgcctacccgatctatggctatgacgagctccagatgctgcagtcacggctgccagtggactactatggaattccctttgctgcacccacagcgcttgccagccgagatgggagcctagctaataatccatatccaggtgatgtcacaaagtttggccgtggggactctgcatcccctgcacccgctaccacaccagctcagccacagcagagccaatcacagacccaccacacagcccagcagcccttcgtgaatcctgcactgccacctggctatagctacactggtcttccctactacacaggcatgcccagtgccttccagtatggccccaccatgtttgtccctccagcctcagccaagcaacatggggtgaacctcagcactcccacacctcccttccagcaggccagtggttatggccagcacggctacagtacaggttatgacgacctgacccaggggacagcagcaggagactactccaaaggtggctatgctggatcatcgcaggcaccaaacaagtctgcaggttctgggcctggcaaaggagtatcagtgtcttcaagcaccactggtctacctgatatgactggttctgtctacaataagacacagacttttgacaagcagggatttcatgcagggacgcctccacctttcagcctgccctcggtcttgggctccactgggcccctggcctcgggagcggcccctggctatgcacccccaccattcctacacatcttgccagcccaccagcagccccactcacagctgctgcaccaccaccttccgcaggatgcacagagtggctcgggtcagcgcagccagcccagctccctgcagcccaagtctcaagcctccaaacctgcctacggcaactctccatactggacaaactaaacccagaagagaggggtgggctggggcaaggcttatcctgggcaggagagaacacacgagcacgtatttgggagcccagtgccctttcctagaattcccgacatgtgtcagccatgcctctgtggggagtctgcctcccagactggctactgtatgtaatgtatttatgtatgtatttgtaaatgtgatagaagtctgggggggagttgggggatggcggcagatgttagccaggtctgccctccccattcaagccccttctccactgtagcaaaataagcacccccaccccatctgccttcaggtcttcttcacagcctgcactgcccagtgggccactaggggcagtctctggaagggctggttcaaggctgtttgggtataggggtcaggtaccaatgaagaatcacgacttgtctcactcctttggaaattgttttctttcctgtgtaattacttcatacctctgtttttgagaaactgttccgtttgtcatctgtcatggtctccttccaccaaatcttcatctgggaatagcagcggtatccctccacccaagtatggccacctgtttgtcttcatatagaacaggggcttctggtctggtcatgtccctagagacttactagagactggctgaccatg

SEQ ID NO: 7970 - DNA, 4289 bp, Homo sapiens
gctttgtaagaggcacattggcaggtaacgagcggcggcggcggcagcgggtcttgggtcctccgagagcagcagcgattttctattttgtacatacattattttgtatatactgtatatgatgacttcagtgagcagtgaccattgtcgaggtgctcgggaaaaaccacagatttcagcagcacaatcaacgcaaccacagaaacaagtggtacaggcaacagctgaacagatgcgtctcgctcaagtgatctttgataagaatgattcagattttgaagctaaagttaagcagcttatggaagtgacagggaaaaatcaggatgaatgcatagtggccctacatgattgtaatggagatgtgaacaaagctatcaatatattgctggaagggaattcagacacaacttcatgggagactgtagggtgtaagaaaaagaattttgcaaaagaaaattcagaaaacaaagagaatagagagaagaaaagcgagaaagaatcgagtcgtggacgtggaaacaacaaccggaaaggaagaggcggcaatcgtggcagagaatttagaggtgaagaaaatggaattgattgcaatcaagtggacaaaccttcagatcgtggcaagcgagcccggggtagaggatttggacgtggcagagggagaggggcaggaaggttctcaacccaaggcatggggacatttaatcctgcagactattcagattctacatctacagatgtgtgtgggacaaagctagtagtttgggaagctgctcagaatggtgcagatgagggaactgaactggcatcaaatactcacaacatagctcaggatctgtcaaacaaaagttcttatggactcaaaggggcttggaagaattctgtggaagagtggacaacagaagactggactgaagatctttctgaaacaaaggtcttcactgcctcatctgctccagcagagaatcacatcttacctgggcaaagcattgatctggtagccttgctccagaagcctgttcctcacagtcaagcctcagaagccaactcctttgaaacttcccaacagcagggctttggccaagcccttgtcttcacaaattcgcaacacaacaatcagatggcaccagggactggcagctccactgccgtcaactcctgttctcctcagagcctgtcatccgtccttggctcaggatttggagagcttgcaccaccaaaaatggcaaacatcaccagctcccagattttggaccagttgaaagctccgagtttgggccagtttaccaccaccccaagtacacagcagaatagtacaagtcaccctacaactactacttcttgggacctcaagcccccaacatcccagtcctcagtcctcagtcatcttgacttcaaatctcaacctgagccatccccagttcttagccagttgagccagcgacaacagcaccagagccaggcagtcactgttcctcctcctggtttggagtcctttccttcccaggcaaaacttcgagaatcaacacctggagacagtccctccactgtgaacaagcttttgcagcttcccagcacgaccattgaaaatatctctgtgtctgtccaccagccacagcccaaacacatcaaacttgctaagcggcggatacccccagcttctaagatcccagcttctgcagtggaaatgcctggttcagcagatgtcacaggattaaatgtgcagtttggggctctggaatttgggtcagaaccttctctctctgaatttggatcagctccaagcagtgaaaatagtaatcagattcccatcagcttgtattcgaagtctttaagtgagcctttgaatacatctttatcaatgaccagtgcagtacagaactccacatatacaacttccgtcattacctcctgcagtctgacaagctcatcactgaattctgctagtccagtagcaatgtcttcctcttatgaccagagttctgtgcataacaggatcccataccaaagccctgtgagttcatcagagtcagctccaggaaccatcatgaatggacatggtggtggtcgaagtcagcagacactagacactccaaagacaacaggccctccctctgccctcccgtctgtgagctccctgcccagcaccacctcctgcactgcacttctgccgtccacatcccagcacactggcgacctgactagcagccctctctctcagcttagcagttcgctctccagccaccagagcagcctctctgcacatgcagccctctcctcgagcacgtcacacacacatgccagtgtggagagcgcctcttcccaccagtcctcagccaccttctccacggcagcgacctccgtctcaagttccgcatcctcaggcgccagcctgtccagtagcatgaacaccgcgaacagcctctgtctgggtgggacccccgcgagtgcatccagcagcagtagcagggccgcgcccttggtgacctcaggcaaagcacccccaaacttacctcagggggtgcctcccctgctgcacaaccagtacctcgtaggtcccggaggactgcttcctgcctacccgatctatggctatgacgagctccagatgctgcagtcacggctgccagtggactactatggaattccctttgctgcacccacagcgcttgccagccgagatgggagcctagctaataatccatatccaggtgatgtcacaaagtttggccgtggggactctgcatcccctgcacccgctaccacaccagctcagccacagcagagccaatcacagacccaccacacagcccagcagcccttcgtgaatcctgcactgccacctggctatagctacactggtcttccctactacacaggcatgcccagtgccttccagtatggccccaccatgtttgtccctccagcctcagccaagcaacatggggtgaacctcagcactcccacacctcccttccagcaggccagtggttatggccagcacggctacagtacaggttatgacgacctgacccaggggacagcagcaggagactactccaaaggtggctatgctggatcatcgcaggcaccaaacaagtctgcaggttctgggcctggcaaaggagtatcagtgtcttcaagcaccactggtctacctgatatgactggttctgtctacaataagacacagacttttgacaagcagggatttcatgcagggacgcctccacctttcagcctgccctcggtcttgggctccactgggcccctggcctcgggagcggcccctggctatgcacccccaccattcctacacatcttgccagcccaccagcagccccactcacagctgctgcaccaccaccttccgcaggatgcacagagtggctcgggtcagcgcagccagcccagctccctgcagcccaagtctcaagcctccaaacctgcctacggcaactctccatactggacaaactaaacccagaagagaggggtgggctggggcaaggcttatcctgggcaggagagaacacacgagcacgtatttgggagcccagtgccctttcctagaattcccgacatgtgtcagccatgcctctgtggggagtctgcctcccagactggctactgtatgtaatgtatttatgtatgtatttgtaaatgtgatagaagtctgggggggagttgggggatggcggcagatgttagccaggtctgccctccccattcaagccccttctccactgtagcaaaataagcacccccaccccatctgccttcaggtcttcttcacagcctgcactgcccagtgggccactaggggcagtctctggaagggctggttcaaggctgtttgggtataggggtcaggtaccaatgaagaatcacgacttgtctcactcctttggaaattgttttctttcctgtgtaattacttcatacctctgtttttgagaaactgttccgtttgtcatctgtcatggtctccttccaccaaatcttcatctgggaatagcagcggtatccctccacccaagtatggccacctgtttgtcttcatatagaacaggggcttctggtctggtcatgtccctagagacttactagagactggctgaccatgaaaaaaaaaaaaataatctgagttattcagccagtcagctcccctttaaaaatctaaggtatctccaagcaacacatctccattctagttgtcttgaaccacgtgggcaactgtttcaggggttttctcttgcccaatccccacctaataaagttctgagagcatg

SEQ ID NO: 7971 - DNA, 3460 bp, Homo sapiens
acattggcaggtaacgagcggcggcggcggcagcgggtcttgggtcctccgagagcagcagcggcaacagctgaacagatgcgtctcgctcaagtgatctttgataagaatgattcagattttgaagctaaagttaagcagcttatggaagtgacagggaaaaatcaggatgaatgcatagtggccctacatgattgtaatggagatgtgaacaaagctatcaatatattgctggaagggaattcagacacaacttcatgggagactgtagggtgtaagaaaaagaattttgcaaaagaaaattcagaaaacaaagagaatagagagaagaaaagcgagaaagaatcgagtcgtggacgtggaaacaacaaccggaaaggaagaggcggcaatcgtggcagagaatttagaggtgaagaaaatggaattgattgcaatcaagtggacaaaccttcagatcgtggcaagcgagcccggggtagagaactggcatcaaatactcacaacatagctcaggatctgtcaaacaaaagttcttatggactcaaaggggcttggaagaattctgtggaagagtggacaacagaagactggactgaagatcattgatctggtagccttgctccagaagcctgttcctcacagtcaagcctcagaagccaactcctttgaaacttcccaacagcagggctttggccaagcccttgtcttcacaaattcgcaacacaacaatcagatggcaccagggactggcagctccactgccgtcaactcctgttctcctcagagcctgtcatccgtccttggctcaggatttggagagcttgcaccaccaaaaatggcaaacatcaccagctcccagattttggaccagttgaaagctccgagtttgggccagtttaccaccaccccaagtacacagcagaatagtacaagtcaccctacaactactacttcttgggacctcaagcccccaacatcccagtcctcagtcctcagtcatcttgacttcaaatctcaacctgagccatccccagttcttagccagttgagccagcgacaacagcaccagagccaggcagtcactgttcctcctcctggtttggagtcctttccttcccaggcaaaacttcgagaatcaacacctggagacagtccctccactgtgaacaagcttttgcagcttcccagcacgaccattgaaaatatctctgtgtctgtccaccagccacagcccaaacacatcaaacttgctaagcggcggatacccccagcttctaagatcccagcttctgcagtggaaatgcctggttcagcagatgtcacaggattaaatgtgcagtttggggctctggaatttgggtcagaaccttctctctctgaatttggatcagctccaagcagtgaaaatagtaatcagattcccatcagcttgtattcgaagtctttaagtgagcctttgaatacatctttatcaatgaccagtgcagtacagaactccacatatacaacttccgtcattacctcctgcagtctgacaagctcatcactgaattctgctagtccagtagcaatgtcttcctcttatgaccagagttctgtgcataacaggatcccataccaaagccctgtgagttcatcagagtcagctccaggaaccatcatgaatggacatggtggtggtcgaagtcagcagacactagacactccaaagacaacaggccctccctctgccctcccgtctgtgagctccctgcccagcaccacctcctgcactgcacttctgccgtccacatcccagcacactggcgacctgactagcagccctctctctcagcttagcagttcgctctccagccaccagagcagcctctctgcacatgcagccctctcctcgagcacgtcacacacacatgccagtgtggagagcgcctcttcccaccagtcctcagccaccttctccacggcagcgacctccgtctcaagttccgcatcctcaggcgccagcctgtccagtagcatgaacaccgcgaacagcctctgtctgggtgggacccccgcgagtgcatccagcagcagtagcagggccgcgcccttggtgacctcaggcaaagcacccccaaacttacctcagggggtgcctcccctgctgcacaaccagtacctcgtaggtcccggaggactgcttcctgcctacccgatctatggctatgacgagctccagatgctgcagtcacggctgccagtggactactatggaattccctttgctgcacccacagcgcttgccagccgagatgggagcctagctaataatccatatccaggtgatgtcacaaagtttggccgtggggactctgcatcccctgcacccgctaccacaccagctcagccacagcagagccaatcacagacccaccacacagcccagcagcccttcgtgaatcctgcactgccacctggctatagctacactggtcttccctactacacaggcatgcccagtgccttccagtatggccccaccatgtttgtccctccagcctcagccaagcaacatggggtgaacctcagcactcccacacctcccttccagcaggccagtggttatggccagcacggctacagtacaggttatgacgacctgacccaggggacagcagcaggagactactccaaaggtggctatgctggatcatcgcaggcaccaaacaagtctgcaggttctgggcctggcaaaggagtatcagtgtcttcaagcaccactggtctacctgatatgactggttctgtctacaataagacacagacttttgacaagcagggatttcatgcagggacgcctccacctttcagcctgccctcggtcttgggctccactgggcccctggcctcgggagcggcccctggctatgcacccccaccattcctacacatcttgccagcccaccagcagccccactcacagctgctgcaccaccaccttccgcaggatgcacagagtggctcgggtcagcgcagccagcccagctccctgcagcccaagtctcaagcctccaaacctgcctacggcaactctccatactggacaaactaaacccagaagagaggggtgggctggggcaaggcttatcctgggcaggagagaacacacgagcacgtatttgggagcccagtgccctttcctagaattcccgacatgtgtcagccatgcctctgtggggagtctgcctcccagactggctactgtatgtaatgtatttatgtatgtatttgtaaatgtgatagaagtctgggggggagttgggggatggcggcagatgttagccaggtctgccctccccattcaagccccttctccactgtagcaaaataagcacccccaccccatctgccttcaggtcttcttcacagcctgcactgcccagtgggccactaggggcagtctctggaagggctg

SEQ ID NO: 7972 - DNA, 4218 bp, Homo sapiens
gtgacgcgaggtcacgtgacgggttgggcagcctgtgccgccgccgccgctttgtaagaggcacattggcagattttctattttgtacatacattattttgtatatactgtatatgatgacttcagtgagcagtgaccattgtcgaggtgctcgggaaaaaccacagatttcagcagcacaatcaacgcaaccacagaaacaagtggtacaggcaacagctgaacagatgcgtctcgctcaagtgatctttgataagaatgattcagattttgaagctaaagttaagcagcttatggaagtgacagggaaaaatcaggatgaatgcatagtggccctacatgattgtaatggagatgtgaacaaagctatcaatatattgctggaagggaattcagacacaacttcatgggagactgtagggtgtaagaaaaagaattttgcaaaagaaaattcagaaaacaaagagaatagagagaagaaaagcgagaaagaatcgagtcgtggacgtggaaacaacaaccggaaaggaagaggcggcaatcgtggcagagaatttagaggtgaagaaaatggaattgattgcaatcaagtggacaaaccttcagatcgtggcaagcgagcccggggtagaggatttggacgtggcagagggagaggggcaggaaggttctcaacccaaggcatggggacatttaatcctgcagactattcagattctacatctacagatgtgtgtgggacaaagctagtagtttgggaagctgctcagaatggtgcagatgagggaactggggcttggaagaattctgtggaagagtggacaacagaagactggactgaagatctttctgaaacaaaggtcttcactgcctcatctgctccagcagagaatcacatcttacctgggcaaagcattgatctggtagccttgctccagaagcctgttcctcacagtcaagcctcagaagccaactcctttgaaacttcccaacagcagggctttggccaagcccttgtcttcacaaattcgcaacacaacaatcagatggcaccagggactggcagctccactgccgtcaactcctgttctcctcagagcctgtcatccgtccttggctcaggatttggagagcttgcaccaccaaaaatggcaaacatcaccagctcccagattttggaccagttgaaagctccgagtttgggccagtttaccaccaccccaagtacacagcagaatagtacaagtcaccctacaactactacttcttgggacctcaagcccccaacatcccagtcctcagtcctcagtcatcttgacttcaaatctcaacctgagccatccccagttcttagccagttgagccagcgacaacagcaccagagccaggcagtcactgttcctcctcctggtttggagtcctttccttcccaggcaaaacttcgagaatcaacacctggagacagtccctccactgtgaacaagcttttgcagcttcccagcacgaccattgaaaatatctctgtgtctgtccaccagccacagcccaaacacatcaaacttgctaagcggcggatacccccagcttctaagatcccagcttctgcagtggaaatgcctggttcagcagatgtcacaggattaaatgtgcagtttggggctctggaatttgggtcagaaccttctctctctgaatttggatcagctccaagcagtgaaaatagtaatcagattcccatcagcttgtattcgaagtctttaagtgagcctttgaatacatctttatcaatgaccagtgcagtacagaactccacatatacaacttccgtcattacctcctgcagtctgacaagctcatcactgaattctgctagtccagtagcaatgtcttcctcttatgaccagagttctgtgcataacaggatcccataccaaagccctgtgagttcatcagagtcagctccaggaaccatcatgaatggacatggtggtggtcgaagtcagcagacactagacactccaaagacaacaggccctccctctgccctcccgtctgtgagctccctgcccagcaccacctcctgcactgcacttctgccgtccacatcccagcacactggcgacctgactagcagccctctctctcagcttagcagttcgctctccagccaccagagcagcctctctgcacatgcagccctctcctcgagcacgtcacacacacatgccagtgtggagagcgcctcttcccaccagtcctcagccaccttctccacggcagcgacctccgtctcaagttccgcatcctcaggcgccagcctgtccagtagcatgaacaccgcgaacagcctctgtctgggtgggacccccgcgagtgcatccagcagcagtagcagggccgcgcccttggtgacctcaggcaaagcacccccaaacttacctcagggggtgcctcccctgctgcacaaccagtacctcgtaggtcccggaggactgcttcctgcctacccgatctatggctatgacgagctccagatgctgcagtcacggctgccagtggactactatggaattccctttgctgcacccacagcgcttgccagccgagatgggagcctagctaataatccatatccaggtgatgtcacaaagtttggccgtggggactctgcatcccctgcacccgctaccacaccagctcagccacagcagagccaatcacagacccaccacacagcccagcagcccttcgtgaatcctgcactgccacctggctatagctacactggtcttccctactacacaggcatgcccagtgccttccagtatggccccaccatgtttgtccctccagcctcagccaagcaacatggggtgaacctcagcactcccacacctcccttccagcaggccagtggttatggccagcacggctacagtacaggttatgacgacctgacccaggggacagcagcaggagactactccaaaggtggctatgctggatcatcgcaggcaccaaacaagtctgcaggttctgggcctggcaaaggagtatcagtgtcttcaagcaccactggtctacctgatatgactggttctgtctacaataagacacagacttttgacaagcagggatttcatgcagggacgcctccacctttcagcctgccctcggtcttgggctccactgggcccctggcctcgggagcggcccctggctatgcacccccaccattcctacacatcttgccagcccaccagcagccccactcacagctgctgcaccaccaccttccgcaggatgcacagagtggctcgggtcagcgcagccagcccagctccctgcagcccaagtctcaagcctccaaacctgcctacggcaactctccatactggacaaactaaacccagaagagaggggtgggctggggcaaggcttatcctgggcaggagagaacacacgagcacgtatttgggagcccagtgccctttcctagaattcccgacatgtgtcagccatgcctctgtggggagtctgcctcccagactggctactgtatgtaatgtatttatgtatgtatttgtaaatgtgatagaagtctgggggggagttgggggatggcggcagatgttagccaggtctgccctccccattcaagccccttctccactgtagcaaaataagcacccccaccccatctgccttcaggtcttcttcacagcctgcactgcccagtgggccactaggggcagtctctggaagggctggttcaaggctgtttgggtataggggtcaggtaccaatgaagaatcacgacttgtctcactcctttggaaattgttttctttcctgtgtaattacttcatacctctgtttttgagaaactgttccgtttgtcatctgtcatggtctccttccaccaaatcttcatctgggaatagcagcggtatccctccacccaagtatggccacctgtttgtcttcatatagaacaggggcttctggtctggtcatgtccctagagacttactagagactggctgaccatgaaaaaaaaaaaaataatctgagttattcagccagtcagctcccctttaaaaatctaaggtatctccaagcaacacatctccattctagttgtcttgaaccacgtgggcaactgtttcaggggttttctcttgcccaatccccacctaataaagttctgagagcatg

SEQ ID NO: 7973 - DNA, 1349 bp, Homo sapiens
gtgacgcgaggtcacgtgacgggttgggcagcctgtgccgccgccgccgctttgtaagaggcacattggcagattttctattttgtacatacattattttgtatatactgtatatgatgacttcagtgagcagtgaccattgtcgaggtgctcgggaaaaaccacagatttcagcagcacaatcaacgcaaccacagaaacaagtggtacaggcaacagctgaacagatgcgtctcgctcaagtgatctttgataagaatgattcagattttgaagctaaagttaagcagcttatggaagtgacagggaaaaatcaggatgaatgcatagtggccctacatgattgtaatggagatgtgaacaaagctatcaatatattgctggaagggaattcagacacaacttcatgggagactgtagggtgtaagaaaaagaattttgcaaaagaaaattcagaaaacaaagagaatagagagaagaaaagcgagaaagaatcgagtcgtggacgtggaaacaacaaccggaaaggaagaggcggcaatcgtggcagagaatttagaggtgaagaaaatggaattgattgcaatcaagtggacaaaccttcagatcgtggcaagcgagcccggggtagagaactggcatcaaatactcacaacatagctcaggatctgtcaaacaaaagttcttatggactcaaaggggcttggaagaattctgtggaagagtggacaacagaagactggactgaagatctttctgaaacaaaggtcttcactgcctcatctgctccagcagagaatcacatcttacctgggcaaagcattgatctggtagccttgctccagaagcctgttcctcacagtcaagcctcagaagccaactcctttgaaacttcccaacagcagggctttggccaagcccttgtcttcacaaattcgcaacacaacaatcagatggcaccagggactggcagctccactgccgtcaactcctgttctcctcagagcctgtcatccgtccttggctcaggatttggagagcttgcaccaccaaaaatggcaaacatcaccagctcccagattttggaccagttgaaagctccgagtttgggccagtttaccaccaccccaagtacacagcagaatagtacaagtcaccctacaactactacttcttgggacctcaagcccccaacatcccagtcctcagtcctcagtcatcttgacttcaaatctcaacctgagccatccccagttcttagccagttgagccagcgacaacagcaccagagccaggcagtcactgttcctcctcctggtttggagtcctttccttcccaggcaaaactt

SEQ ID NO: 7974 - DNA, 2183 bp, Homo sapiens
gggttgggcagcctgtgccgccgccgccgctttgtaagaggcacattggcagattttctattttgtacatacattattttgtatatactgtatatgatgacttcagtgagcagtgaccattgtcgaggtgctcgggaaaaaccacagatttcagcagcacaatcaacgcaaccacagaaacaagtggtacaggcaacagctgaacagatgcgtctcgctcaagtgatctttgataagaatgattcagattttgaagctaaagttaagcagcttatggaagtgacagggaaaaatcaggatgaatgcatagtggccctacatgattgtaatggagatgtgaacaaagctatcaatatattgctggaagggaattcagacacaacttcatgggagactgtagggtgtaagaaaaagaattttgcaaaagaaaattcagaaaacaaagagaatagagagaagaaaagcgagaaagaatcgagtcgtggacgtggaaacaacaaccggaaaggaagaggcggcaatcgtggcagagaatttagaggtgaagaaaatggaattgattgcaatcaagtggacaaaccttcagatcgtggcaagcgagcccggggtagagaactggcatcaaatactcacaacatagctcaggatctgtcaaacaaaagttcttatggactcaaaggggcttggaagaattctgtggaagagtggacaacagaagactggactgaagatctttctgaaacaaaggtcttcactgcctcatctgctccagcagagaatcacatcttacctgggcaaagcattgatctggtagccttgctccagaagcctgttcctcacagtcaagcctcagaagccaactcctttgaaacttcccaacagcagggctttggccaagcccttgtcttcacaaattcgcaacacaacaatcagatggcaccagggactggcagctccactgccgtcaactcctgttctcctcagagcctgtcatccgtccttggctcaggatttggagagcttgcaccaccaaaaatggcaaacatcaccagctcccagattttggaccagttgaaagctccgagtttgggccagtttaccaccaccccaagtacacagcagaatagtacaagtcaccctacaactactacttcttgggacctcaagcccccaacatcccagtcctcagtcctcagtcatcttgacttcaaatctcaacctgagccatccccagttcttagccagttgagccagcgacaacagcaccagagccaggcagtcactgttcctcctcctggtttggagtcctttccttcccaggcaaaacttcgagaatcaacacctggagacagtccctccactgtgaacaagcttttgcagcttcccagcacgaccattgaaaatatctctgtgtctgtccaccagccacagcccaaacacatcaaacttgctaagcggcggatacccccagcttctaagatcccagcttctgcagtggaaatgcctggttcagcagatgtcacaggattaaatgtgcagtttggggctctggaatttgggtcagaaccttctctctctgaatttggatcagctccaagcagtgaaaatagtaatcagattcccatcagcttgtattcgaagtctttaagtgagcctttgaatacatctttatcaatgaccagtgcagtacagaactccacatatacaacttccgtcattacctcctgcagtctgacaagctcatcactgaattctgctagtccagtagcaatgtcttcctcttatgaccagagttctgtgcataacaggatcccataccaaagccctgtgagttcatcagagtcagctccaggaaccatcatgaatggacatggtggtggtcgaagtcagcagacactagacactccaaagacaacaggccctccctctgccctcccgtctgtgagctccctgcccagcaccacctcctgcactgcacttctgccgtccacatcccagcacactggcgacctgactagcagccctctctctcagcttagcagcatgccagtgtggagagcgcctcttcccaccagtcctcagccaccttctccacggcagcgacctccgtctcaagttccgcatcctcaggcgccagcctgtccagtagcatgaacaccgcgaacagcctctgtctgggtggg

SEQ ID NO: 7975 - DNA, 828 bp, Homo sapiens
gagaaagaatcgagtcgtggacgtggaaacaacaaccggaaaggaagaggcggcaatcgtggcagagaatttagaggtgaagaaaatggaattgattgcaatcaagtggacaaaccttcagatcgtggcaagcgagcccggggtagaggatttggacgtggcagagggagaggggcaggaaggttctcaacccaaggcatggggacatttaatcctgcagactattcagattctacatctacagatgtgtgtgggacaaagctagtagtttgggaagctgctcagaatggtgcagatgagggaactggggcttggaagaattctgtggaagagtggacaacagaagactggactgaagatctttctgaaacaaaggtcttcactgcctcatctgctccagcagagaatcacatcttacctgggcaaagcattgatctggtagccttgctccagaagcctgttcctcacagtcaagcctcagaagccaactcctttgaaacttcccaacagcagggctttggccaagcccttgtcttcacaaattcgcaacacaacaatcagatggcaccagggactggcagctccactgccgtcaactcctgttctcctcagagcctgtcatccgtccttggctcaggatttggagagcttgcaccaccaaaaatggcaaacatcaccagctcccagattttggaccagttgaaagctccgagtttgggccagtttaccaccaccccaagtacacagcagaatagtacaagtcaccctacaactactacttcttgggacctcaagcccccaacatcccagtcctcagtcctcagtcat

SEQ ID NO: 7976 - DNA, 3658 bp, Homo sapiens
attggcaggtaacgagcggcggcggcggcagcgggtcttgggtcctccgagagcagcagcgattttctattttgtacatacattattttgtatatactgtatatgatgacttcagtgagcagtgaccattgtcgaggtgctcgggaaaaaccacagatttcagcagcacaatcaacgcaaccacagaaacaagtggtacagctgtaccgacctcttgacacttcctagagctcagcctggcaacagctgaacagatgcgtctcgctcaagtgatctttgataagaatgattcagattttgaagctaaagttaagcagcttatggaagtgacagggaaaaatcaggatgaatgcatagtggccctacatgattgtaatggagatgtgaacaaagctatcaatatattgctggaagggaattcagacacaacttcatgggagactgtagggtgtaagaaaaagaattttgcaaaagaaaattcagaaaacaaagagaatagagagaagaaaagcgagaaagaatcgagtcgtggacgtggaaacaacaaccggaaaggaagaggcggcaatcgtggcagagaatttagaggtgaagaaaatggaattgattgcaatcaagtggacaaaccttcagatcgtggcaagcgagcccggggtagagaactggcatcaaatactcacaacatagctcaggatctgtcaaacaaaagttcttatggactcaaaggggcttggaagaattctgtggaagagtggacaacagaagactggactgaagatctttctgaaacaaaggtcttcactgcctcatctgctccagcagagaatcacatcttacctgggcaaagcattgatctggtagccttgctccagaagcctgttcctcacagtcaagcctcagaagccaactcctttgaaacttcccaacagcagggctttggccaagcccttgtcttcacaaattcgcaacacaacaatcagatggcaccagggactggcagctccactgccgtcaactcctgttctcctcagagcctgtcatccgtccttggctcaggatttggagagcttgcaccaccaaaaatggcaaacatcaccagctcccagattttggaccagttgaaagctccgagtttgggccagtttaccaccaccccaagtacacagcagaatagtacaagtcaccctacaactactacttcttgggacctcaagcccccaacatcccagtcctcagtcctcagtcatcttgacttcaaatctcaacctgagccatccccagttcttagccagttgagccagcgacaacagcaccagagccaggcagtcactgttcctcctcctggtttggagtcctttccttcccaggcaaaacttcgagaatcaacacctggagacagtccctccactgtgaacaagcttttgcagcttcccagcacgaccattgaaaatatctctgtgtctgtccaccagccacagcccaaacacatcaaacttgctaagcggcggatacccccagcttctaagatcccagcttctgcagtggaaatgcctggttcagcagatgtcacaggattaaatgtgcagtttggggctctggaatttgggtcagaaccttctctctctgaatttggatcagctccaagcagtgaaaatagtaatcagattcccatcagcttgtattcgaagtctttaagtgagcctttgaatacatctttatcaatgaccagtgcagtacagaactccacatatacaacttccgtcattacctcctgcagtctgacaagctcatcactgaattctgctagtccagtagcaatgtcttcctcttatgaccagagttctgtgcataacaggatcccataccaaagccctgtgagttcatcagagtcagctccaggaaccatcatgaatggacatggtggtggtcgaagtcagcagacactagacactccaaagacaacaggccctccctctgccctcccgtctgtgagctccctgcccagcaccacctcctgcactgcacttctgccgtccacatcccagcacactggcgacctgactagcagccctctctctcagcttagcagttcgctctccagccaccagagcagcctctctgcacatgcagccctctcctcgagcacgtcacacacacatgccagtgtggagagcgcctcttcccaccagtcctcagccaccttctccacggcagcgacctccgtctcaagttccgcatcctcaggcgccagcctgtccagtagcatgaacaccgcgaacagcctctgtctgggtgggacccccgcgagtgcatccagcagcagtagcagggccgcgcccttggtgacctcaggcaaagcacccccaaacttacctcagggggtgcctcccctgctgcacaaccagtacctcgtaggtcccggaggactgcttcctgcctacccgatctatggctatgacgagctccagatgctgcagtcacggctgccagtggactactatggaattccctttgctgcacccacagcgcttgccagccgagatgggagcctagctaataatccatatccaggtgatgtcacaaagtttggccgtggggactctgcatcccctgcacccgctaccacaccagctcagccacagcagagccaatcacagacccaccacacagcccagcagcccttcgtgaatcctgcactgccacctggctatagctacactggtcttccctactacacaggcatgcccagtgccttccagtatggccccaccatgtttgtccctccagcctcagccaagcaacatggggtgaacctcagcactcccacacctcccttccagcaggccagtggttatggccagcacggctacagtacaggttatgacgacctgacccaggggacagcagcaggagactactccaaaggtggctatgctggatcatcgcaggcaccaaacaagtctgcaggttctgggcctggcaaaggagtatcagtgtcttcaagcaccactggtctacctgatatgactggttctgtctacaataagacacagacttttgacaagcagggatttcatgcagggacgcctccacctttcagcctgccctcggtcttgggctccactgggcccctggcctcgggagcggcccctggctatgcacccccaccattcctacacatcttgccagcccaccagcagccccactcacagctgctgcaccaccaccttccgcaggatgcacagagtggctcgggtcagcgcagccagcccagctccctgcagcccaagtctcaagcctccaaacctgcctacggcaactctccatactggacaaactaaacccagaagagaggggtgggctggggcaaggcttatcctgggcaggagagaacacacgagcacgtatttgggagcccagtgccctttcctagaattcccgacatgtgtcagccatgcctctgtggggagtctgcctcccagactgaccatgaaaaaaaaaaaaataatctgagttattcagccagtcagctcccctttaaaaatctaaggtatctccaagcaacacatctccattctagttgtcttgaaccacgtgggcaactgtttcaggggttttctcttgcccaatccccacctaataaagttctgagagcatg

SEQ ID NO: 7977 - DNA, 3779 bp, Homo sapiens
attggcaggtaacgagcggcggcggcggcagcgggtcttgggtcctccgagagcagcagcgattttctattttgtacatacattattttgtatatactgtatatgatgacttcagtgagcagtgaccattgtcgaggtgctcgggaaaaaccacagatttcagcagcacaatcaacgcaaccacagaaacaagtggtacaggcaacagctgaacagatgcgtctcgctcaagtgatctttgataagaatgattcagattttgaagctaaagttaagcagcttatggaagtgacagggaaaaatcaggatgaatgcatagtggccctacatgattgtaatggagatgtgaacaaagctatcaatatattgctggaagggaattcagacacaacttcatgggagactgtagggtgtaagaaaaagaattttgcaaaagaaaattcagaaaacaaagagaatagagagaagaaaagcgagaaagaatcgagtcgtggacgtggaaacaacaaccggaaaggaagaggcggcaatcgtggcagagaatttagaggtgaagaaaatggaattgattgcaatcaagtggacaaaccttcagatcgtggcaagcgagcccggggtagaggatttggacgtggcagagggagaggggcaggaaggttctcaacccaaggcatggggacatttaatcctgcagactattcagattctacatctacagatgtgtgtgggacaaagctagtagtttgggaagctgctcagaatggtgcagatgagggaactgaactggcatcaaatactcacaacatagctcaggatctgtcaaacaaaagttcttatggactcaaaggggcttggaagaattctgtggaagagtggacaacagaagactggactgaagatctttctgaaacaaaggtcttcactgcctcatctgctccagcagagaatcacatcttacctgggcaaagcattgatctggtagccttgctccagaagcctgttcctcacagtcaagcctcagaagccaactcctttgaaacttcccaacagcagggctttggccaagcccttgtcttcacaaattcgcaacacaacaatcagatggcaccagggactggcagctccactgccgtcaactcctgttctcctcagagcctgtcatccgtccttggctcaggatttggagagcttgcaccaccaaaaatggcaaacatcaccagctcccagattttggaccagttgaaagctccgagtttgggccagtttaccaccaccccaagtacacagcagaatagtacaagtcaccctacaactactacttcttgggacctcaagcccccaacatcccagtcctcagtcctcagtcatcttgacttcaaatctcaacctgagccatccccagttcttagccagttgagccagcgacaacagcaccagagccaggcagtcactgttcctcctcctggtttggagtcctttccttcccaggcaaaacttcgagaatcaacacctggagacagtccctccactgtgaacaagcttttgcagcttcccagcacgaccattgaaaatatctctgtgtctgtccaccagccacagcccaaacacatcaaacttgctaagcggcggatacccccagcttctaagatcccagcttctgcagtggaaatgcctggttcagcagatgtcacaggattaaatgtgcagtttggggctctggaatttgggtcagaaccttctctctctgaatttggatcagctccaagcagtgaaaatagtaatcagattcccatcagcttgtattcgaagtctttaagtgagcctttgaatacatctttatcaatgaccagtgcagtacagaactccacatatacaacttccgtcattacctcctgcagtctgacaagctcatcactgaattctgctagtccagtagcaatgtcttcctcttatgaccagagttctgtgcataacaggatcccataccaaagccctgtgagttcatcagagtcagctccaggaaccatcatgaatggacatggtggtggtcgaagtcagcagacactagacactccaaagacaacaggccctccctctgccctcccgtctgtgagctccctgcccagcaccacctcctgcactgcacttctgccgtccacatcccagcacactggcgacctgactagcagccctctctctcagcttagcagttcgctctccagccaccagagcagcctctctgcacatgcagccctctcctcgagcacgtcacacacacatgccagtgtggagagcgcctcttcccaccagtcctcagccaccttctccacggcagcgacctccgtctcaagttccgcatcctcaggcgccagcctgtccagtagcatgaacaccgcgaacagcctctgtctgggtgggacccccgcgagtgcatccagcagcagtagcagggccgcgcccttggtgacctcaggcaaagcacccccaaacttacctcagggggtgcctcccctgctgcacaaccagtacctcgtaggtcccggaggactgcttcctgcctacccgatctatggctatgacgagctccagatgctgcagtcacggctgccagtggactactatggaattccctttgctgcacccacagcgcttgccagccgagatgggagcctagctaataatccatatccaggtgatgtcacaaagtttggccgtggggactctgcatcccctgcacccgctaccacaccagctcagccacagcagagccaatcacagacccaccacacagcccagcagcccttcgtgaatcctgcactgccacctggctatagctacactggtcttccctactacacaggcatgcccagtgccttccagtatggccccaccatgtttgtccctccagcctcagccaagcaacatggggtgaacctcagcactcccacacctcccttccagcaggccagtggttatggccagcacggctacagtacaggttatgacgacctgacccaggggacagcagcaggagactactccaaaggtggctatgctggatcatcgcaggcaccaaacaagtctgcaggttctgggcctggcaaaggagtatcagtgtcttcaagcaccactggtctacctgatatgactggttctgtctacaataagacacagacttttgacaagcagggatttcatgcagggacgcctccacctttcagcctgccctcggtcttgggctccactgggcccctggcctcgggagcggcccctggctatgcacccccaccattcctacacatcttgccagcccaccagcagccccactcacagctgctgcaccaccaccttccgcaggatgcacagagtggctcgggtcagcgcagccagcccagctccctgcagcccaagtctcaagcctccaaacctgcctacggcaactctccatactggacaaactaaacccagaagagaggggtgggctggggcaaggcttatcctgggcaggagagaacacacgagcacgtatttgggagcccagtgccctttcctagaattcccgacatgtgtcagccatgcctctgtggggagtctgcctcccagactgaccatgaaaaaaaaaaaaataatctgagttattcagccagtcagctcccctttaaaaatctaaggtatctccaagcaacacatctccattctagttgtcttgaaccacgtgggcaactgtttcaggggttttctcttgcccaatccccacctaataaagttctgagagcatg

SEQ ID NO: 7978 - DNA, 3107 bp, Homo sapiens
acattggcaggtaacgagcggcggcggcggcagcgggtcttgggtcctccgagagcagcagcgattttctattttgtacatacattattttgtatatactgtatatgatgacttcagtgagcagtgaccattgtcgaggtgctcgggaaaaaccacagatttcagcagcacaatcaacgcaaccacagaaacaagtggtacagctgtaccgacctcttgacacttcctagagctcagcctggcaacagctgaacagatgcgtctcgctcaagtgatctttgataagaatgattcagattttgaagctaaagttaagcagctttctgaaacaaaggtcttcactgcctcatctgctccagcagagaatcacatcttacctgggcaaagcattgatctggtagccttgctccagaagcctgttcctcacagtcaagcctcagaagccaactcctttgaaacttcccaacagcagggctttggccaagcccttgtcttcacaaattcgcaacacaacaatcagatggcaccagggactggcagctccactgccgtcaactcctgttctcctcagagcctgtcatccgtccttggctcaggatttggagagcttgcaccaccaaaaatggcaaacatcaccagctcccagattttggaccagttgaaagctccgagtttgggccagtttaccaccaccccaagtacacagcagaatagtacaagtcaccctacaactactacttcttgggacctcaagcccccaacatcccagtcctcagtcctcagtcatcttgacttcaaatctcaacctgagccatccccagttcttagccagttgagccagcgacaacagcaccagagccaggcagtcactgttcctcctcctggtttggagtcctttccttcccaggcaaaacttcgagaatcaacacctggagacagtccctccactgtgaacaagcttttgcagcttcccagcacgaccattgaaaatatctctgtgtctgtccaccagccacagcccaaacacatcaaacttgctaagcggcggatacccccagcttctaagatcccagcttctgcagtggaaatgcctggttcagcagatgtcacaggattaaatgtgcagtttggggctctggaatttgggtcagaaccttctctctctgaatttggatcagctccaagcagtgaaaatagtaatcagattcccatcagcttgtattcgaagtctttaagtgagcctttgaatacatctttatcaatgaccagtgcagtacagaactccacatatacaacttccgtcattacctcctgcagtctgacaagctcatcactgaattctgctagtccagtagcaatgtcttcctcttatgaccagagttctgtgcataacaggatcccataccaaagccctgtgagttcatcagagtcagctccaggaaccatcatgaatggacatggtggtggtcgaagtcagcagacactagacactccaaagacaacaggccctccctctgccctcccgtctgtgagctccctgcccagcaccacctcctgcactgcacttctgccgtccacatcccagcacactggcgacctgactagcagccctctctctcagcttagcagttcgctctccagccaccagagcagcctctctgcacatgcagccctctcctcgagcacgtcacacacacatgccagtgtggagagcgcctcttcccaccagtcctcagccaccttctccacggcagcgacctccgtctcaagttccgcatcctcaggcgccagcctgtccagtagcatgaacaccgcgaacagcctctgtctgggtgggacccccgcgagtgcatccagcagcagtagcagggccgcgcccttggtgacctcaggcaaagcacccccaaacttacctcagggggtgcctcccctgctgcacaaccagtacctcgtaggtcccggaggactgcttcctgcctacccgatctatggctatgacgagctccagatgctgcagtcacggctgccagtggactactatggaattccctttgctgcacccacagcgcttgccagccgagatgggagcctagctaataatccatatccaggtgatgtcacaaagtttggccgtggggactctgcatcccctgcacccgctaccacaccagctcagccacagcagagccaatcacagacccaccacacagcccagcagcccttcgtgaatcctgcactgccacctggctatagctacactggtcttccctactacacaggcatgcccagtgccttccagtatggccccaccatgtttgtccctccagcctcagccaagcaacatggggtgaacctcagcactcccacacctcccttccagcaggccagtggttatggccagcacggctacagtacaggttatgacgacctgacccaggggacagcagcaggagactactccaaaggtggctatgctggatcatcgcaggcaccaaacaagtctgcaggttctgggcctggcaaaggagtatcagtgtcttcaagcaccactggtctacctgatatgactggttctgtctacaataagacacagacttttgacaagcagggatttcatgcagggacgcctccacctttcagcctgccctcggtcttgggctccactgggcccctggcctcgggagcggcccctggctatgcacccccaccattcctacacatcttgccagcccaccagcagccccactcacagctgctgcaccaccaccttccgcaggatgcacagagtggctcgggtcagcgcagccagcccagctccctgcagcccaagtctcaagcctccaaacctgcctacggcaactctccatactggacaaactaaacccagaagagaggggtgggctggggcaaggcttatcctgggcaggagagaacacacgagcacgtatttgggagcccagtgccctttcctagaattcccgacatgtgtcagccatgcctctgtggggagtctgcctcccagactggctactgtatgtaatgtatttatgtatgtatttgtaaatgtgatagaagtctgggggggagttgggggatggcggcagatg

SEQ ID NO: 7979 - DNA, 1593 bp, Homo sapiens
atggaggacgactcactctacttgggaggtgagtggcagttcaaccacttttcaaaactcacatcttctcggccagatgcagcttttgctgaaatccagcgtacttctctccctgagaagtcaccactctcatgtgagacccgtgtcgacctctgtgatgatttggctcctgtggcaagacagcttgctcccagggagaagcttcctctgagtagcaggagacctgctgcggtgggggctgggctccagaatatgggaaatacctgctacgtgaacgcttccttgcagtgcctgacatacacaccgccccttgccaactacatgctgtcccgggagcactctcaaacgtgtcatcgtcacaagggctgcatgctctgtactatgcaagctcacatcacacgggccctccacaatcctggccacgtcatccagccctcacaggcattggctgctggcttccatagaggcaagcaggaagatgcccatgaatttctcatgttcactgtggatgccatgaaaaaggcatgccttcccgggcacaagcaggtagatcatccctctaaggacaccaccctcatccaccaaatatttggaggctactggagatctcaaatcaagtgtctccactgccacggcatttcagacacttttgacccttacctggacatcgccctggatatccaggcagctcagagtgtccagcaagctttggaacagttggtgaagcccgaagaactcaatggagagaatgcctatcattgtggtgtttgtctccagagggcgccggcctccaagacgttaactttacacacctctgccaaggtcctcatccttgtattgaagagattctccgatgtgacaggcaacaagattgccaagaatgtgcaatatcctgagtgccttgacatgcagccatacatgtctcagcagaacacaggacctcttgtctatgtcctctatgctgtgctggtccacgctgggtggagttgtcacaacggacattacttctcttatgtcaaagctcaagaaggccaatggtataaaatggatgatgccgaggtcaccgccgctagcatcacttctgtcctgagtcaacaggcctacgtcctcttttacatccagaagagtgaatgggaaagacacagtgagagtgtgtcaagaggcagggaaccaagagcccttggcgcagaagacacagacaggcgagcaacgcaaggagagctcaagagagaccacccctgcctccaggcccccgagttggacgagcacttggtggaaagagccactcaggaaagcaccttagaccgctggaaattccttcaagagcaaaacaaaacgaagcctgagttcaacgtcagaaaagtcgaaggtaccctgcctcccgacgtacttgtgattcatcaatcaaaatacaagtgtgggatgaagaaccatcatcctgaacagcaaagctccctgctaaacctctcttcgtcgaccccgacacatcaggagtccatgaacactggcacactcgcttccctgcgagggagggccaggagatccaaagggaagaacaaacacagcaagagggctctgcttgtgtgccagtga

SEQ ID NO: 7980 - DNA, 1706 bp, Homo sapiens
gcccctgcctggtgccccgagcgagccgggagtagctgcggcggtgcccgccccctctctccgcccctccagcggagctggtctccggccgggcaccgtcgcgggcccccctggcccggccacctgggaccgtgctggggagtctgccacttccctctctcccctggcccgcaaagttttggcggagccatcgctggggctgagcgcgcccccggggggagatcggggagcgcccgatgccgggcggccggagccattgacccgggacgccgccgtccgctgagcagccgaccaccccgccgcctccggtgcatggggactggctgaggagccagcatgggcaactgcgtggggagacagcgccgggagaggccggcagccccgggacacccccgcaagcgagcaggacgcaatgagcccctgaagaaagagcggcttaagtggaagagcgactaccccatgactgacgggcagctgcggagcaaacgggatgagttctgggacacagcgcctgccttcgagggccgcaaggagatctgggatgccctcaaggctgccgcctatgctgctgaagccaacgaccacgagctggcccaggccatcctggatggagccagcatcaccctgcctcatggcaccctctgtgaatgctacgatgagctgggcaatcgctaccagctgcccatctactgcctgtcaccgccggtgaacctgctgctggagcacacggaggaggagagcctggagccccccgagcctccacccagcgtgcgccgtgagttcccgctgaaggtgcgcctgtccacgggcaaggacgtgaggctcagcgccagcctgcccgacacagtggggcagctcaagaggcagctgcacgcccaggagggcatcgagccatcgtggcagcggtggttcttctccgggaagctgctcacagaccgcacacggctccaggagaccaagatccagaaagattttgtcatccaggtcatcatcaaccagcccccaccaccccaggactgatgggcccacggacccctgggaagaggccccgcctggagcactaggcccccaccctgctgctgccttccagtgctgtcattttcttcaggggccctcccctcggtgtggctggtgggtgagccgtgaagggaccctgcctttcagggcactacgcgccaccagttcccggtacccagggagcaggcagccacacacgggccttgcaaccttgtcagagaaaaggcgaacagggccctcaccctgcctgtctcccgaagcaggttcgagccacaagggccaaccaggaggcccctggagcccagatctgtcatctggtgctgccagctgtgctcactctggttttctgctcagggtctgaagcagctgctgtctccctcctctgcccccatcccctggctctcccctgggcacagtgccactcccttggaagggagggaaccacccgtgagccccagggcttgggaagcctgaggcgggcctctgcctctccctgcccccagcacaattggcagagatgaggcgggtggtggacagctgggctgtcgtggcagggtctgcacagggccatgtcctggctgtaacccaggcagtgggaggtctgcagcctggtcatggcctccacagcaggtccctgtggacagacatatctgcatatttatcaataaagccttttgctccttctcgct

SEQ ID NO: 7981 - DNA, 1870 bp, Homo sapiens
atgggctcgcgctgccttaaccctcctccgcccgcccactctgacaccaccggaaaggattcattcgggaacattcgtggggcggagacgggacagggggcctcggcctgtagcgtcacgtccgccagggttacctgtggggctgggagcgaaccgcactcgcaccgcaaccccggcatcagtgcccaggttggcctcgcgccgtcctacggggcggccagaggccgccgaaggcctctcgcgctgcagcagtctcctcaggagcgccgccatgtgggatggaatagcacacgtgggcttctccctgcgtcacttccggggactgcttccagccaatcggcctccgccacagccagcgcagccttgccccttaaagtcacaggccccctagcgcgaaatcccacgcccccctggacggctgcggccgcactcgccaccagggggcagaggccagagaaagggctatttcccggacccgcccccttcagcttgggaaagcgaaagcgtggcaggggccggacctgggagcggaggaggcgggtctccatagaaacctccacctgtttccggccgggctgtgagagattaggggctgctgcgggggccaatctcagccagctcgcctcttcccagcggcctctgcgggagcggtgggtgttgtacacaatcatcatggcggcggccggggccccggatggcatggaggaacctggcatggacacggaggccgagactgtggctactgaggctcccgcgcggcccgtcaactgcctggaggctgaagccgcggcgggggcggcggccgaggactccggcgccgcacgaggcagcctgcagccggccccggcccagccccctggggaccccgcagcccaggcctcggtcagcaacggcgaagacgcgggcggcggcgcgggcagggagctggtggacttgaagatcatctggaataagaccaagcatgacgtgaagttccccctggacagcacaggctccgagctgaaacagaagatccactcgattacaggtctcccgcctgccatgcagaaagtcatgtataagggactcgtccccgaggataaaacattgagagaaataaaagtgaccagtggggccaagatcatggtggttggctccaccatcaatgatgttttagcagtaaacacacccaaagatgctgcgcagcaggatgcaaaggccgaagagaacaagaaggagcctctctgcaggcagaaacaacacaggaaagtgttggataaaggaaaacctgaagatgtgatgccatctgttaagggggcccaggagcgcctgccaacggtaccgctgtccggcatgtacaataaatctggaggaaaagtgagactcacctttaaactagaacaagaccagctgtggattggcactaaagagcggactgagaaattgcccatgggctccataaaaaatgtggtcagtgaacctatcgaaggacatgaagactaccacatgatggcgtttcagttgggccccacggaagcctcttactactgggtgtactgggttccaactcaatatgtggatgcaatcaaagacactgtgctggggaaatggcagtatttttgaaagcactttcacctctggcccaggagactgacccaaagtgaaggacattgccgggagaggcctgcagcatccctggatttcagagttctggaactttgttcataaaaaatctatattcaatctgaggtgatgtggtgactgaagccagaggtgatgtactttcaccattagcttaattttaacttaaaattaccagttccctttcttgcagtcagcttcataccatttttaaagtcaatacgatggaaatcaataaatctgaattccg

SEQ ID NO: 7982 - DNA, 5110 bp, Homo sapiens
cgtgggcttctccctgcgtcacttccggggactgcttccagccaatcggcctccgccacagccagcgcagccttgccccttaaagtcacaggccccctagcgcgaaatcccacgcccccctggacggctgcggccgcactcgccaccagggggcagaggccagagaaagggctatttcccggacccgcccccttcagcttgggaaagcgaaagcgtggcaggggccggacctgggagcggaggaggcgggtctccatagaaacctccacctgtttccggccgggctgtgagagattaggggctgctgcgggggccaatctcagccagctcgcctcttcccagcggcctctgcgggagcggtgggtgttgtacacaatcatcatggcggcggccggggccccggatggcatggaggaacctggcatggacacggaggccgagactgtggctactgaggctcccgcgcggcccgtcaactgcctggaggctgaagccgcggcgggggcggcggccgaggactccggcgccgcacgaggcagcctgcagccggccccggcccagccccctggggaccccgcagcccaggcctcggtcagcaacggcgaagacgcgggcggcggcgcgggcagggagctggtggacttgaagatcatctggaataagaccaagcatgacgtgaagttccccctggacagcacaggctccgagctgaaacagaagatccactcgattacaggtctcccgcctgccatgcagaaagtcatgtataagggactcgtccccgaggataaaacattgagagaaataaaagtgaccagtggggccaagatcatggtggttggctccaccatcaatgatgttttagcagtaaacacacccaaagatgctgcgcagcaggatgcaaaggccgaagagaacaagaaggagcctctctgcaggcagaaacaacacaggaaagtgttggataaaggaaaacctgaagatgtgatgccatctgttaagggggcccaggagcgcctgccaacggtaccgctgtccggcatgtacaataaatctggaggaaaagtgagactcacctttaaactagaacaagaccagctgtggattggcactaaagagcggactgagaaattgcccatgggctccataaaaaatgtggtcagtgaacctatcgaaggacatgaagactaccacatgatggcgtttcagttgggccccacggaagcctcttactactgggtgtactgggttccaactcaatatgtggatgcaatcaaagacactgtgctggggaaatggcagtatttttgaaagcactttcacctctggcccaggagactgacccaaagtgaaggacattgccgggagaggcctgcagcatccctggatttcagagttctggaactttgttcataaaaaatctatattcaatctgaggtgatgtggtgactgaagccagaggtgatgtactttcaccattagcttaattttaacttaaaattaccagttccctttcttgcagtcagcttcataccatttttaaagtcaatacgatggaaatcaataaatctgaattccgaacatgttgtgtggaatactcttaagtgtgtttgagagtagatctgccaattatgttgacaagggaatgatcaaaagctttgttttttttaaaaaaaaaaaaagcagtttcaattgaaatattttcatacatctttggttgcaaacatttggactgcattgcaatgagttggggtgttttttttttccttttttgtataaaattgtatgcaaaatgggggtgggttagtaagccacatatttctgtccattgattcagatttaattctttccctttttcattctctcgcttcctcaatttgagtttttgttttaagaacccaaagatgtcagttcttcttttggtacctcatcaacgcttcctttcctgggctccctcccgccgtgctgctgctgcctgtgaacgcacggtgggagaggaagagctgctcagtcttgggcaaggagctctcacacttgctgtggtgttcgttgagcagcagagtatctcccagtgactcctgtttaaatgtcttgccctttgggcccccatctccaaggagttccattgctggttggatgattgtctgcacccctcactgagcttggcctagaggcccagcctggcatggttgtgcctgggctgtgccgctcaacagccccagctcccaagcagacaaagacctcttccaggaggagccaggtagaagatagttatacagccatatagctgcagatccagataaccttctttctttggaagttttcaagaaattcttaagcagtccaaggatgatttcaattatgcttctccattgggtccttctgctcatgcattcagttcaagtgtcctttatcccaggttcagagatgctgcctttctgaagaagacatctgaccctagcaggttggccagtgttattgaacaacaaaaatgggataaattgctttcatgattagctcaccttcttctggttttagcccttctgttctctgtacacgtgaacttctgtcatctccttctggcttggttgcctctgaaaggagggaaagtctcttggtaaattatctcttttgtgctgtttgctgtttctctgctgccgtctttgcagttctcctctcactggttgcaggctttcatagtaaggtttggcgagaaatgttccaaacatcacattttggattctaggctgtcacccctcattctgtgaaacgtattagcatgtgttcgcccaagatgactattccttgtgagccagttaatgatgatattctacgcccttcccttctaagctgtagttcaggaatccagcccacatagacagactcttgctttccatggtgtagtcaatgccaagtgatgcatctaggcaggaaaatctactctttgcttttttgggggcaattagtacatttgtgaagtgcagcatccaagaaacagcctgttttttcatcccttgagaaaggagcagtcattgcagcttttctgtccttgtcggcctgcagttcctggggaaaagagtacatctgagctacttgtccaagcctctgtctgcaggtgacaggttttgggggaaatgagatgcattaagtagaacatcatctcgggtcagacattgccccttttgtttgccaatgccccagtcctagagacttgtcctgacagtgccgcacacctacttttgatctctcagagcaggtggctccatccccagactagcctggctgctctccgaggcccctccacctgctccccttattgccccattcttgtggcttgccgggccacttggcctcccttcttgccggtgacagcgttccatcatctccccgctccccaagggccaactgcttctcactcaggctggtgtcatttcaggaggaccaaagcctgcgtgagcctttttattttcagtaaaatggtgcttttttccttacttcgagatactatatataaataataatgtaaatgacaccttttcgtacggagctgtttgagtattgctttacagagctcactaaatcagcttcaacaatcttgagctctgtggctcctcaccctgtctgcatggaagaccttgctggacgctctcgggagagcagacatagcaccagaagccactgggagaagtgttttcgatccgtgtctgggccacagtagtattcactgtttagtctttgagttccgtaagcagtctcttcatacatttcttacagtctggagtgtactgactaaatctgtgtaagcaaattgaaatactctttcttttaggtagcgtcacagtggttttttttttcctcaggataatttctatacaatttccttactgtcagagggaccagatctttccctcactgtggcaggggccgtgcaggtggataaaggaagagctggtttccggagagtgactgtaacagcgttgactcgaagctagagatggagggggtggccgtctcttagacattggacacctctcagagcctcctgagggcttctttgtcttctagaatctctaccggtggtcctcctgcaggttctggctcacagacatcatcatgcctttttttccctccctgaggcgccttggcagaagagcgtgaccctgtgagccaggccccccttagctctgcttcagatcacagaacacagacagactcgcgagttgctggacctctttggtattaagtgtttgaatccatggtgggccttttgcaagtagcgttagctctttttaaatgttgaactgagctaaggatgcactttcttgtggacatagaaggggcccacgtaaggccctgagtaggctccttagttgctgctttacctgatgagggccaaagagattaactctgcctcgttgccatgtctcagaaaagttgccatatttcacccagaaggggcttgttttcctcttactcttactttaaccatgtgcctggaggagccattctgggctcttgcacttgcccagcctttctttgccaggggcagagaagggaaagggggtagattgagtgtgccaagggccgtgcaagggcaggcttgctttccacccatctgctgagggagccctctcctctcgctccttgcctctgttcacacctgttgtcttggaagaggatggtccctttgtcttaaggctttgtgataaagtcatctccagttaggatctgcacctgtttccttcgtaatagtgcctggcggcctttctgaagttacaggtggttgggagccctctcgcatgcagaacatctggtagattgatctgccaggctgggtggttctactgctttctcaatttctaagaaccttttttttttcttaaagagttctgctgaattatttgacaatatttgtaagtaccatgtttccttgtggtgtatgctctgttctggtttctgttttcaaatcaaatgcctgtttgggaggagatgaacgtatttagtctattagatttgcactgctggattttttttttaaagtgtaaccttgaatagctgtcttattgtttatcctgtaagattagtcaatcgattaaagtttgataattaa

SEQ ID NO: 7983 - DNA, 4697 bp, Homo sapiens
gtgggtgttgtacacaatcatcatggcatggaggaacctggcatggacacggaggccgagactgtggctactgaggctcccgcgcggcccgtcaactgcctggaggctgaagccgcggcgggggcggcggccgaggactccggcgccgcacgaggcagcctgcagccggccccggcccagccccctggcggcgaagacgcgggcggcggcgcgggcagggagctggtggacttgaagatcatctggaataagaccaagcatgacgtgaagttccccctggacagcacaggctccgagctgaaacagaagatccactcgattacaggtctcccgcctgccatgcagaaagtcatgtataagggactcgtccccgaggataaaacattgagagaaataaaagtgaccagtggggccaagatcatggtggttggctccaccatcaatgatgttttagcagtaaacacacccaaagatgctgcgcagcaggatgcaaaggccgaagagaacaagaaggagcctctctgcaggcagaaacaacacaggaaagtgttggataaaggaaaacctgaagatgtgatgccatctgttaagggggcccaggagcgcctgccaacggtaccgctgtccggcatgtacaataaatctggaggaaaagtgagactcacctttaaactagaacaagaccagctgtggattggcactaaagagcggactgagaaattgcccatgggctccataaaaaatgtggtcagtgaacctatcgaaggacatgaagactaccacatgatggcgtttcagttgggccccacggaagcctcttactactgggtgtactgggttccaactcaatatgtggatgcaatcaaagacactgtgctggggaaatggcagtatttttgaaagcactttcacctctggcccaggagactgacccaaagtgaaggacattgccgggagaggcctgcagcatccctggatttcagagttctggaactttgttcataaaaaatctatattcaatctgaggtgatgtggtgactgaagccagaggtgatgtactttcaccattagcttaattttaacttaaaattaccagttccctttcttgcagtcagcttcataccatttttaaagtcaatacgatggaaatcaataaatctgaattccgaacatgttgtgtggaatactcttaagtgtgtttgagagtagatctgccaattatgttgacaagggaatgatcaaaagctttgttttttttaaaaaaaaaaaaagcagtttcaattgaaatattttcatacatctttggttgcaaacatttggactgcattgcaatgagttggggtgttttttttttccttttttgtataaaattgtatgcaaaatgggggtgggttagtaagccacatatttctgtccattgattcagatttaattctttccctttttcattctctcgcttcctcaatttgagtttttgttttaagaacccaaagatgtcagttcttcttttggtacctcatcaacgcttcctttcctgggctccctcccgccgtgctgctgctgcctgtgaacgcacggtgggagaggaagagctgctcagtcttgggcaaggagctctcacacttgctgtggtgttcgttgagcagcagagtatctcccagtgactcctgtttaaatgtcttgccctttgggcccccatctccaaggagttccattgctggttggatgattgtctgcacccctcactgagcttggcctagaggcccagcctggcatggttgtgcctgggctgtgccgctcaacagccccagctcccaagcagacaaagacctcttccaggaggagccaggtagaagatagttatacagccatatagctgcagatccagataaccttctttctttggaagttttcaagaaattcttaagcagtccaaggatgatttcaattatgcttctccattgggtccttctgctcatgcattcagttcaagtgtcctttatcccaggttcagagatgctgcctttctgaagaagacatctgaccctagcaggttggccagtgttattgaacaacaaaaatgggataaattgctttcatgattagctcaccttcttctggttttagcccttctgttctctgtacacgtgaacttctgtcatctccttctggcttggttgcctctgaaaggagggaaagtctcttggtaaattatctcttttgtgctgtttgctgtttctctgctgccgtctttgcagttctcctctcactggttgcaggctttcatagtaaggtttggcgagaaatgttccaaacatcacattttggattctaggctgtcacccctcattctgtgaaacgtattagcatgtgttcgcccaagatgactattccttgtgagccagttaatgatgatattctacgcccttcccttctaagctgtagttcaggaatccagcccacatagacagactcttgctttccatggtgtagtcaatgccaagtgatgcatctaggcaggaaaatctactctttgcttttttgggggcaattagtacatttgtgaagtgcagcatccaagaaacagcctgttttttcatcccttgagaaaggagcagtcattgcagcttttctgtccttgtcggcctgcagttcctggggaaaagagtacatctgagctacttgtccaagcctctgtctgcaggtgacaggttttgggggaaatgagatgcattaagtagaacatcatctcgggtcagacattgccccttttgtttgccaatgccccagtcctagagacttgtcctgacagtgccgcacacctacttttgatctctcagagcaggtggctccatccccagactagcctggctgctctccgaggcccctccacctgctccccttattgccccattcttgtggcttgccgggccacttggcctcccttcttgccggtgacagcgttccatcatctccccgctccccaagggccaactgcttctcactcaggctggtgtcatttcaggaggaccaaagcctgcgtgagcctttttattttcagtaaaatggtgcttttttccttacttcgagatactatatataaataataatgtaaatgacaccttttcgtacggagctgtttgagtattgctttacagagctcactaaatcagcttcaacaatcttgagctctgtggctcctcaccctgtctgcatggaagaccttgctggacgctctcgggagagcagacatagcaccagaagccactgggagaagtgttttcgatccgtgtctgggccacagtagtattcactgtttagtctttgagttccgtaagcagtctcttcatacatttcttacagtctggagtgtactgactaaatctgtgtaagcaaattgaaatactctttcttttaggtagcgtcacagtggttttttttttcctcaggataatttctatacaatttccttactgtcagagggaccagatctttccctcactgtggcaggggccgtgcaggtggataaaggaagagctggtttccggagagtgactgtaacagcgttgactcgaagctagagatggagggggtggccgtctcttagacattggacacctctcagagcctcctgagggcttctttgtcttctagaatctctaccggtggtcctcctgcaggttctggctcacagacatcatcatgcctttttttccctccctgaggcgccttggcagaagagcgtgaccctgtgagccaggccccccttagctctgcttcagatcacagaacacagacagactcgcgagttgctggacctctttggtattaagtgtttgaatccatggtgggccttttgcaagtagcgttagctctttttaaatgttgaactgagctaaggatgcactttcttgtggacatagaaggggcccacgtaaggccctgagtaggctccttagttgctgctttacctgatgagggccaaagagattaactctgcctcgttgccatgtctcagaaaagttgccatatttcacccagaaggggcttgttttcctcttactcttactttaaccatgtgcctggaggagccattctgggctcttgcacttgcccagcctttctttgccaggggcagagaagggaaagggggtagattgagtgtgccaagggccgtgcaagggcaggcttgctttccacccatctgctgagggagccctctcctctcgctccttgcctctgttcacacctgttgtcttggaagaggatggtccctttgtcttaaggctttgtgataaagtcatctccagttaggatctgcacctgtttccttcgtaatagtgcctggcggcctttctgaagttacaggtggttgggagccctctcgcatgcagaacatctggtagattgatctgccaggctgggtggttctactgctttctcaatttctaagaaccttttttttttcttaaagagttctgctgaattatttgacaatatttgtaagtaccatgtttccttgtggtgtatgctctgttctggtttctgttttcaaatcaaatgcctgtttgggaggagatgaacgtatttagtctattagatttgcactgctggattttttttttaaagtgtaaccttgaatagctgtcttattgtttatcctgtaagattagtcaatcgattaaagtttgataatt

SEQ ID NO: 7984 - DNA, 2730 bp, Homo sapiens
gaacaccgcggggcaagatggcggtagtgcgtcggctgctgccccgggtctggcagaactcgggtgttttgggctgagacagtggcagctgcggccccgaccccaagtgcggggacctccggcgaataaaggtcggcctgcgggtaggccggtagggcctgcggtccggcctgcgggagaactgggtcgtcagtcctccgagtggtggggctggggactttgagggagttggctctagggcacagtccctgcctggccaggtcggaggaacaagtgctgggatctggcgtgtgtgctccaggggctctttccgcggccctttccacctcttttcactttggggacggtaggcctttataaacggactaatgctgggtgatttgttcctgtggttgttgatgccgaggaaagactctgggccccaggactcacctaaactggagttcgaatactgttcgctcgctgtgtgaccttggaaaaaataacaagcttttctgaagtgagaagctgttctcagccacgagtcctgtgcaagatcactaatgattacctggcatttctgcgacacaggcaggtcctcagggtttgtgcaagtttgcaaacatgttcaccctgtctcagacctcgagagcatggttcatcgatagagcccgtcaggcacgagaagaaaggcttgtgcagaaggaacgggagcgggcagctgttgtgatccaggcccatgtccggagttttctctgtcggagtcgactgcagagagatatcaggagagagattgatgacttttttaaagcagatgaccctgagtccactaaaagaagtgcactttgtattttcaagattgccaggaaactgctgttcctattcagaatcaaagaggataatgagagatttgagaagttgtgtcgcagcatcctgagcagcatggatgctgagaatgagcctaaggtgtggtatgtgtccctggcttgttctaaggacctcaccctcctttggattcaacagatcaagaacattttgtggtactgctgtgattttctcaagcagctcaagcctgaaatcctgcaggactcccgactcatcaccctgtacctcacgatgcttgtcaccttcacagacacttcaacgtggaaaattcttcggggaaaaggtgaaagtcttcgaccagcgatgaaccacatttgtgcaaatataatgggacatctcaaccagcatggattttattctgtgctgcagatattgttaacccgtggcctggcaagaccccgtccttgtctatccaaaggcactttaacagcagctttttctctagcgttacgccctgtgattgctgcacagttctcagacaatctgattcggccgttcctcatccacatcatgtctgtgcctgctctggtgactcatctcagcacagtgacccctgagcgcctcactgttttagaatcccatgacatgcttcgtaaattcatcatatttttaagagaccaagatcgatgccgtgatgtatgtgaaagtttagaaggatgccatacgctttgtctaatgggcaacctcctacacttgggctccctcagccccagagtgttagaggaggagacagatgggttcgtgagtttgctcacccagacgctgtgctactgtcggaagtatgtgtctcagaagaagtccaacctgacccactggcatcctgtccttggctggttctcccaatctgtggattatggccttaacgagtcaatgcacttgatcaccaaacagctgcagttcttgtggggggtgcctctgatccggatcttcttctgtgacatcctgagcaagaagctactggagagccaggagccagcccacgcacagccagcatcccctcagaatgtgctcccagtgaagagtctcctaaagcgtgcttttcaaaagtcggcatcagtccggaatattctcaggcctgtcgggggtaaacgggtcgactctgcagaagtccagaaggtttgcaacatctgtgtcctctaccagacctcgctgacaactctcacacagattcggctgcagatactcacaggtctcacttaccttgatgacctgcttcccaaactgtgggcatttatctgtgagctcgggccccacggagggttaaagctcttcttggaatgcctgaacaatgacactgaagagtccaagcaactcttggccatgctgatgctgttctgtgactgttcgcggcacctcatcacaatccttgatgacattgaagtttatgaagaacagatttcattcaaactggaagagctggtcactatctcctctttcctgaattcttttgtgtttaagatgatctgggatggaattgtagagaacgccaagggtgagaccttggagctgttccagtctgtccacgggtggcttatggtgctgtacgagcgggactgccggcggcgcttcacccccgaggaccactggctgcgaaaggatctcaaacctagcgtgctcttccaagaactcgacagggacagaaaacgggcacagttgatcctgcagtacatcccacatgtcatccctcacaaaaacagagttctactgtttcgaaccatggttaccaaggagaaggagaaactggggctggtggaaaccagctctgcctccccgcatgtcactcacatcaccatccgccggtccaggatgctggagagcttgtttgagtgcccctggccactggtgatcaatgccgagagctgctag

SEQ ID NO: 7985 - DNA, 1448 bp, Homo sapiens
tggcggtagtgcgtcggctgctgccccgggtctggcagaactcgggtgttttgggctgagacagtggcagctgcggccccgaccccaagtgcggggacctccggcgaataaaggtcggcctgcgggtaggccggtagggcctgcggtccggcctgcgggagaactgggtcgtcagtcctccgagtggtggggctggggactttgagggagttggctctagggcacagtccctgcctggccaggtcggaggaacaagtgctgggatctggcgtgtgtgctccaggggctctttccgcggccctttccacctcttttcactttggggacggtaggcctttataaacggactaatgctgggtgatttgttcctgtggttgttgatgccgaggaaagactctgggccccaggactcacctaaactggagttcgaatactgttcgctcgctgtgtgaccttggaaaaaataacaagcttttctgaagtgagaagctgttctcagccacgagtcctgtgcaagatcactaatgattacctggcatttctgcgacacaggcaggtcctcagggtttgtgcaagtttgcaaacatgttcaccctgtctcagacctcgagagcatggttcatcgatagagcccgtcaggcacgagaagaaaggcttgtgcagaaggaacgggagcgggcagctgttgtgatccaggcccatgtccggagttttctctgtcggagtcgactgcagagagatatcaggagagagattgatgacttttttaaagcagatgaccctgagtccactaaaagaagtgcactttgtattttcaagattgccaggaaactgctgttcctattcagaatcaaagaggataatgagagatttgagaagttgtgtcgcagcatcctgagcagcatggatgctgagaatgagcctaaggtgtggtatgtgtccctggcttgttctaaggacctcaccctcctttggattcaacagatcaagaacattttgtggtactgctgtgattttctcaagcagctcaagcctgaaatcctgcaggactcccgactcatcaccctgtacctcacgatgcttgtcaccttcacagacacttcaacgtggaaaattcttcggggaaaaggtgaaagtcttcgaccagcgatgaaccacatttgtgcaaatataatgggacatctcaaccagcatggattttattctgtgctgcagtgctgtgatgggctgtttcctgatttggtttcatatgctcctcacaacaaccctgtgaggtggtccgttggcagaagctggtatgactggcagttgtctcgctagaggaaccttctacttcataccataattaaacggcttctaaaataatatgatgtctttaaattttaagtctggcattatttgtattagctgtttttttaactttattattaaagaatttctaaccataa

SEQ ID NO: 7986 - DNA, 5722 bp, Homo sapiens
cggggcaagatggcggtagtgcgtcggctgctgccccgggtctggcagaactcgggtgttttgggctgagacagtggcagctgcggccccgaccccaagtgcggggacctccggcgaataaaggtcggcctgcgggtaggccggtagggcctgcggtccggcctgcgggagaactgggtcgtcagtcctccgagtggtggggctggggactttgagggagttggctctagggcacagtccctgcctggccaggtcggaggaacaagtgctgggatctggcgtgtgtgctccaggggctctttccgcggccctttccacctcttttcactttggggacggtaggcctttataaacggactaatgctgggtgatttgttcctgtggttgttgatgccgaggaaagactctgggccccaggactcacctaaactggagttcgaatactgttcgctcgctgtgtgaccttggaaaaaataacaagcttttctgaagtgagaagctgttctcagccacgagtcctgtgcaagatcactaatgattacctggcatttctgcgacacaggcaggtcctcagggtttgtgcaagtttgcaaacatgttcaccctgtctcagacctcgagagcatggttcatcgatagagcccgtcaggcacgagaagaaaggcttgtgcagaaggaacgggagcgggcagctgttgtgatccaggcccatgtccggagttttctctgtcggagtcgactgcagagagatatcaggagagagattgatgacttttttaaagcagatgaccctgagtccactaaaagaagtgcactttgtattttcaagattgccaggaaactgctgttcctattcagaatcaaagaggataatgagagatttgagaagttgtgtcgcagcatcctgagcagcatggatgctgagaatgagcctaaggtgtggtatgtgtccctggcttgttctaaggacctcaccctcctttggattcaacagatcaagaacattttgtggtactgctgtgattttctcaagcagctcaagcctgaaatcctgcaggactcccgactcatcaccctgtacctcacgatgcttgtcaccttcacagacacttcaacgtggaaaattcttcggggaaaaggtgaaagtcttcgaccagcgatgaaccacatttgtgcaaatataatgggacatctcaaccagcatggattttattctgtgctgcagatattgttaacccgtggcctggcaagaccccgtccttgtctatccaaaggcactttaacagcagctttttctctagcgttacgccctgtgattgctgcacagttctcagacaatctgattcggccgttcctcatccacatcatgtctgtgcctgctctggtgactcatctcagcacagtgacccctgagcgcctcactgttttagaatcccatgacatgcttcgtaaattcatcatatttttaagagaccaagatcgatgccgtgatgtatgtgaaagtttagaaggatgccatacgctttgtctaatgggcaacctcctacacttgggctccctcagccccagagtgttagaggaggagacagatgggttcgtgagtttgctcacccagacgctgtgctactgtcggaagtatgtgtctcagaagaagtccaacctgacccactggcatcctgtccttggctggttctcccaatctgtggattatggccttaacgagtcaatgcacttgatcaccaaacagctgcagttcttgtggggggtgcctctgatccggatcttcttctgtgacatcctgagcaagaagctactggagagccaggagccagcccacgcacagccagcatcccctcagaatgtgctcccagtgaagagtctcctaaagcgtgcttttcaaaagtcggcatcagtccggaatattctcaggcctgtcgggggtaaacgggtcgactctgcagaagtccagaaggtttgcaacatctgtgtcctctaccagacctcgctgacaactctcacacagattcggctgcagatactcacaggtctcacttaccttgatgacctgcttcccaaactgtgggcatttatctgtgagctcgggccccacggagggttaaagctcttcttggaatgcctgaacaatgacactgaagagtccaagcaactcttggccatgctgatgctgttctgtgactgttcgcggcacctcatcacaatccttgatgacattgaagtttatgaagaacagatttcattcaaactggaagagctggtcactatctcctctttcctgaattcttttgtgtttaagatgatctgggatggaattgtagagaacgccaagggtgagaccttggagctgttccagtctgtccacgggtggcttatggtgctgtacgagcgggactgccggcggcgcttcacccccgaggaccactggctgcgaaaggatctcaaacctagcgtgctcttccaagaactcgacagggacagaaaacgggcacagttgatcctgcagtacatcccacatgtcatccctcacaaaaacagagttctactgtttcgaaccatggttaccaaggagaaggagaaactggggctggtggaaaccagctctgcctccccgcatgtcactcacatcaccatccgccggtccaggatgctggaggacggctacgagcagcttaggcagctctcccagcacgccatgaagggggtcatccgtgtgaagtttgtcaatgacctcggggtggacgaagcagggattgatcaagacggtgtttttaaggagttcttggaagagatcatcaagagagtttttgacccagcactcaatctgttcaagacaaccagtggggatgagaggctgtacccctcacccacatcctacatccatgagaattacctgcagctcttcgagtttgtggggaagatgctggggaaggctgtgtatgagggaattgtggtggacgtgccatttgcatccttcttcctgagccaactgcttgggcaccaccacagcgtcttctatagctcggtggatgaactgccttctctggactccgagttctataaaaacctcacctccatcaagcgctatgatggggacatcactgacctgggcctgacgctgtcttacgacgaggacgtcatgggtcagcttgtttgccatgaactgattcctggagggaagaccattcctgttacaaatgaaaataaaattagctacatccatctgatggcacattttcgaatgcacactcaaataaaaaaccaaacagctgccctcattagcggattccgttccattatcaaacccgagtggatccgaatgttctcaactcctgaactgcagcgtctcatctctggcgacaatgctgagattgatctggaagatttaaagaagcacacagtctactacggtggtttccatggaagtcacagagtcatcatctggctctgggatattctggcctccgacttcacaccggatgagagagctatgtttctgaagttcgtgaccagctgctccagacccccgctcctgggattcgcctacctcaagcctccattctccatccgctgcgtggaggtgtcggacgatcaggacaccggggacactctgggcagcgtcctccggggcttcttcaccatccgcaagcgggagccaggcggccgcctgcccacctcctccacctgcttcaacctgctcaagctgcccaactacagcaagaagagcgtcctccgcgagaagctgcgctacgccatcagcatgaacacgggctttgaactctcctagctcctgtcccagccctgcctccagggctcctgggctgccagggaccttcagctcccagaggcagtgtggtcctgggaatgtgaccaacatgccaggtgacattggcccctagaccctctctatagccatgagactccttgtggcctcaagaaatttagacgcccacgacagcactacacagcatctccaggtgatgcccaaggcacagggctgcagaaaataaacctccagattccaccaacacgggtccattcttcctggtgatggcagaggggcttcttttagctagtttgatcttttgggagtctgtctttccttagccgtctgagtgagctgtgtatgaacaagtcccaggagttccaagagtctagagtggtttttgcagcatgggttgagtgtacaaagcctactgtgcgtgagatcctctccttccgtttctgaaatctcttactcaggtaaggcctcgccaagcctctatgcaccccacaaagtttctgcctccatgccgtccacagcgcctcttcccagacagccaggcccatctgctgcccagggaagcgcaggcgcctgctagggacgctatggacaccgtgagtccaaggcgctgctcctgccttgaagccacgcgctccacgccgcggccctcccattttctgcgtcctcagcgggctgagctgccagagagtcttcccggacctattcccgtcctatgcattcacattggcatcctggtttgggggaagaaaaacaacggcccttagcagcagccccgtttccagaatgtgctgcctgttccccaaagcctgcttgtcccgcggaggacggctgcctttgaccctgcttatttgtctcactggttatctaatgaggaacaaacactaacctaaggtacacatcccatctgggcggtggcttcactcctgagtctgcaaaatcccaggaaacttgggtcttgctgcccatccttcctcagcacagggaacccggaagcccgttgcactgacagaggctcacaccctctgggttttttgttttttttttaaacttcatttctcttccaacccattgtgttcctctgccctcattctttacctttgttgtaagaactttagctccagggaactgaggcagaggccctgtttgtggtctgtgttgacagccacccaccctctcccacctcatgctcctgcacctgcaccaccaaggttgatgccggattcgaagccaggaaggcccagtccctcctctgctctcctcaaagacgcaaaacattttccaacaagagctgtcacagtggcagcaaagcaggggccacccgtctccacagtccttcagagtttcagctgcatcctggtgtcccacccaggtcgagcccccaggcttctggaaaagagtgtgtgctctactttgatggaaacatggcaaggaatttaaagacaggaatgtattaatattattgaaggtgtgttcgtaacctctgattctgtggacttgccactttctccaaacgctcggttcctttgaagatttcttctgaacgtgtgtgcgcacgctgggcgggttcgtgcatacatgcggggaccccagactgtcagcacagggaagatggatcccatcctaatttttatcacctgaaggttggaaccagtgagggactgggagagagtgatttataagcaccaatatcaacttcatgtggatttttgacaaggaggggtagtttgtaatttcatttaaattcttttcagcagctggaaatattgcactatctgaaacactgaatctccttttgtaactggtgttcactgacaccttgatggctcttgatggctctaaaaagttgtaggattttttgtttttgtagctaacttatggattgagatgtgatcaaaggctttattaaatttgtacttcagcata

SEQ ID NO: 7987 - DNA, 5617 bp, Homo sapiens
aacgtcttaagccgtccgttgtgcgcctaggggccagttttctttccagcctccccggccggagtgggttccagcttttctcggctggggagggcatttatcccacctccgctatttcagctgccagaggggaggcaaggtgtggggaagttttccttcccgggcgaagaagctctgcggaactgtcattttccggaactggatgcttgcttcctggcggggttctgaaagcgaacaccgcggggcaagatggcggtagtgcgtcggctgctgccccgggtctggcagaactcgggtgttttgggctgagacagtggcagctgcggccccgaccccaagtgcggggacctccggcgaataaagaaaaaataacaagcttttctgaagtgagaagctgttctcagccacgagtcctgtgcaagatcactaatgattacctggcatttctgcgacacaggcaggtcctcagggtttgtgcaagtttgcaaacatgttcaccctgtctcagacctcgagagcatggttcatcgatagagcccgtcaggcacgagaagaaaggcttgtgcagaaggaacgggagcgggcagctgttgtgatccaggcccatgtccggagttttctctgtcggagtcgactgcagagagatatcaggagagagattgatgacttttttaaagcagatgaccctgagtccactaaaagaagtgcactttgtattttcaagattgccaggaaactgctgttcctattcagaatcaaagaggataatgagagatttgagaagttgtgtcgcagcatcctgagcagcatggatgctgagaatgagcctaaggtgtggtatgtgtccctggcttgttctaaggacctcaccctcctttggattcaacagatcaagaacattttgtggtactgctgtgattttctcaagcagctcaagcctgaaatcctgcaggactcccgactcatcaccctgtacctcacgatgcttgtcaccttcacagacacttcaacgtggaaaattcttcggggaaaaggtgaaagtcttcgaccagcgatgaaccacatttgtgcaaatataatgggacatctcaaccagcatggattttattctgtgctgcagatattgttaacccgtggcctggcaagaccccgtccttgtctatccaaaggcactttaacagcagctttttctctagcgttacgccctgtgattgctgcacagttctcagacaatctgattcggccgttcctcatccacatcatgtctgtgcctgctctggtgactcatctcagcacagtgacccctgagcgcctcactgttttagaatcccatgacatgcttcgtaaattcatcatatttttaagagaccaagatcgatgccgtgatgtatgtgaaagtttagaaggatgccatacgctttgtctaatgggcaacctcctacacttgggctccctcagccccagagtgttagaggaggagacagatgggttcgtgagtttgctcacccagacgctgtgctactgtcggaagtatgtgtctcagaagaagtccaacctgacccactggcatcctgtccttggctggttctcccaatctgtggattatggccttaacgagtcaatgcacttgatcaccaaacagctgcagttcttgtggggggtgcctctgatccggatcttcttctgtgacatcctgagcaagaagctactggagagccaggagccagcccacgcacagccagcatcccctcagaatgtgctcccagtgaagagtctcctaaagcgtgcttttcaaaagtcggcatcagtccggaatattctcaggcctgtcgggggtaaacgggtcgactctgcagaagtccagaaggtttgcaacatctgtgtcctctaccagacctcgctgacaactctcacacagattcggctgcagatactcacaggtctcacttaccttgatgacctgcttcccaaactgtgggcatttatctgtgagctcgggccccacggagggttaaagctcttcttggaatgcctgaacaatgacactgaagagtccaagcaactcttggccatgctgatgctgttctgtgactgttcgcggcacctcatcacaatccttgatgacattgaagtttatgaagaacagatttcattcaaactggaagagctggtcactatctcctctttcctgaattcttttgtgtttaagatgatctgggatggaattgtagagaacgccaagggtgagaccttggagctgttccagtctgtccacgggtggcttatggtgctgtacgagcgggactgccggcggcgcttcacccccgaggaccactggctgcgaaaggatctcaaacctagcgtgctcttccaagaactcgacagggacagaaaacgggcacagttgatcctgcagtacatcccacatgtcatccctcacaaaaacagagttctactgtttcgaaccatggttaccaaggagaaggagaaactggggctggtggaaaccagctctgcctccccgcatgtcactcacatcaccatccgccggtccaggatgctggaggacggctacgagcagcttaggcagctctcccagcacgccatgaagggggtcatccgtgtgaagtttgtcaatgacctcggggtggacgaagcagggattgatcaagacggtgtttttaaggagttcttggaagagatcatcaagagagtttttgacccagcactcaatctgttcaagacaaccagtggggatgagaggctgtacccctcacccacatcctacatccatgagaattacctgcagctcttcgagtttgtggggaagatgctggggaaggctgtgtatgagggaattgtggtggacgtgccatttgcatccttcttcctgagccaactgcttgggcaccaccacagcgtcttctatagctcggtggatgaactgccttctctggactccgagttctataaaaacctcacctccatcaagcgctatgatggggacatcactgacctgggcctgacgctgtcttacgacgaggacgtcatgggtcagcttgtttgccatgaactgattcctggagggaagaccattcctgttacaaatgaaaataaaattagctacatccatctgatggcacattttcgaatgcacactcaaataaaaaaccaaacagctgccctcattagcggattccgttccattatcaaacccgagtggatccgaatgttctcaactcctgaactgcagcgtctcatctctggcgacaatgctgagattgatctggaagatttaaagaagcacacagtctactacggtggtttccatggaagtcacagagtcatcatctggctctgggatattctggcctccgacttcacaccggatgagagagctatgtttctgaagttcgtgaccagctgctccagacccccgctcctgggattcgcctacctcaagcctccattctccatccgctgcgtggaggtgtcggacgatcaggacaccggggacactctgggcagcgtcctccggggcttcttcaccatccgcaagcgggagccaggcggccgcctgcccacctcctccacctgcttcaacctgctcaagctgcccaactacagcaagaagagcgtcctccgcgagaagctgcgctacgccatcagcatgaacacgggctttgaactctcctagctcctgtcccagccctgcctccagggctcctgggctgccagggaccttcagctcccagaggcagtgtggtcctgggaatgtgaccaacatgccaggtgacattggcccctagaccctctctatagccatgagactccttgtggcctcaagaaatttagacgcccacgacagcactacacagcatctccaggtgatgcccaaggcacagggctgcagaaaataaacctccagattccaccaacacgggtccattcttcctggtgatggcagaggggcttcttttagctagtttgatcttttgggagtctgtctttccttagccgtctgagtgagctgtgtatgaacaagtcccaggagttccaagagtctagagtggtttttgcagcatgggttgagtgtacaaagcctactgtgcgtgagatcctctccttccgtttctgaaatctcttactcaggtaaggcctcgccaagcctctatgcaccccacaaagtttctgcctccatgccgtccacagcgcctcttcccagacagccaggcccatctgctgcccagggaagcgcaggcgcctgctagggacgctatggacaccgtgagtccaaggcgctgctcctgccttgaagccacgcgctccacgccgcggccctcccattttctgcgtcctcagcgggctgagctgccagagagtcttcccggacctattcccgtcctatgcattcacattggcatcctggtttgggggaagaaaaacaacggcccttagcagcagccccgtttccagaatgtgctgcctgttccccaaagcctgcttgtcccgcggaggacggctgcctttgaccctgcttatttgtctcactggttatctaatgaggaacaaacactaacctaaggtacacatcccatctgggcggtggcttcactcctgagtctgcaaaatcccaggaaacttgggtcttgctgcccatccttcctcagcacagggaacccggaagcccgttgcactgacagaggctcacaccctctgggttttttgttttttttttaaacttcatttctcttccaacccattgtgttcctctgccctcattctttacctttgttgtaagaactttagctccagggaactgaggcagaggccctgtttgtggtctgtgttgacagccacccaccctctcccacctcatgctcctgcacctgcaccaccaaggttgatgccggattcgaagccaggaaggcccagtccctcctctgctctcctcaaagacgcaaaacattttccaacaagagctgtcacagtggcagcaaagcaggggccacccgtctccacagtccttcagagtttcagctgcatcctggtgtcccacccaggtcgagcccccaggcttctggaaaagagtgtgtgctctactttgatggaaacatggcaaggaatttaaagacaggaatgtattaatattattgaaggtgtgttcgtaacctctgattctgtggacttgccactttctccaaacgctcggttcctttgaagatttcttctgaacgtgtgtgcgcacgctgggcgggttcgtgcatacatgcggggaccccagactgtcagcacagggaagatggatcccatcctaatttttatcacctgaaggttggaaccagtgagggactgggagagagtgatttataagcaccaatatcaacttcatgtggatttttgacaaggaggggtagtttgtaatttcatttaaattcttttcagcagctggaaatattgcactatctgaaacactgaatctccttttgtaactggtgttcactgacaccttgatggctcttgatggctctaaaaagttgtaggattttttgtttttgtagctaacttatggattgagatgtgatcaaaggctttattaaatttgtacttcagcata

SEQ ID NO: 7988 - DNA, 1230 bp, Homo sapiens
actcaaataaaaaaccaaacagctgccctcattagcggattccgttccattatcaaacccgagtggatccgaatgttctcaactcctgaactgcagcgtctcatctctggcgacaatgctgagattgatctggaagatttaaagaagcacacagtctactacggtggtttccatggaagtcacagagtcatcatctggctctgggatattctggcctccgacttcacaccggatgagagagctatgtttctgaagttcgtgaccagctgctccagacccccgctcctgggattcgcctacctcaagcctccattctccatccgctgcgtggaggtgtcggacgatcagcaaggcaggcagctggacccctcagagccaagtgaggagggccccacagttctcacggcaggagaaccagccagccccagagagactgcccacggactcagccctctctcggcagcccctttctctttccttcctcagggaagggtacctggagtgggggtgggtacgtgctgtttttagtggcgtctggcctcaccagggctccagatctgaggcagcatgggagaaagtgagagagtgggctcaggaggcaggcaggcgcagactcgaatgctactcctaccccagcaggctgtgcacgtccaggctcgctgcttcatttcctcattggccaaaggagaaggaaagccttcagggttacggagctctgtgtgtctcaagcctggcccactgtgggtgctcaaatgagagtcctactccccataaaaacccagtggccgcctctgggtgtagctgcctctcatgatgcagtttgagcccgtgatgccaccttgtacaggaagctacacagtcctcggcctccatgcttaagggaaagttggcccaagtcatggtctgccaccggccacagcaccggtgaggagggaggagtgcattcagaaatgtttgggcacctaacagtttttacagcattctactttttgtcaattggttaaccagtaattcgctgtgaaccggaaggccccatttccaaaagcttacttagtgcaggaattctctgtgcaggccccagggagaaggggttccttctctggaagccagtcgtcttgtgtctggggcttgacctcgggtagtggtgccagggcagcgccctgcactctgcccagcatccagggactggccagatcccctccctgggctccctggccttggcatcagcct

SEQ ID NO: 7989 - DNA, 1120 bp, Homo sapiens
aacaccgcggggcaagatggcggtagtgcgtcggctgctgccccgggtctggcagaactcgggtgttttgggctgagacagtggcagctgcggccccgaccccaagtgcggggacctccggcgaataaagaaaaaataacaagcttttctgaagtgagaagctgttctcagccacgagtcctgtgcaagatcactaatgattacctggcatttctgcgacacaggcaggtcctcagggtttgtgcaagtttgcaaacatgttcaccctgtctcagacctcgagagcatggttcatcgatagagcccgtcaggcacgagaagaaaggcttgtgcagaaggaacgggagcgggcagctgttgtgatccaggcccatgtccggagttttctctgtcggagtcgactgcagagagatatcaggagagagattgatgacttttttaaagcagatgaccctgagtccactaaaagaagtgcactttgtattttcaagattgccaggaaactgctgttcctattcagaatcaaagaggataatgagagatttgagaagttgtgtcgcagcatcctgagcagcatggatgctgagaatgagcctaaggtgtggtatgtgtccctggcttgttctaaggacctcaccctcctttggattcaacagatcaagaacattttgtggtactgctgtgattttctcaagcagctcaagcctgaaatcctgcaggactcccgactcatcaccctgtacctcacgatgcttgtcaccttcacagacacttcaacgtggaaaattcttcggggaaaaggtgaaagtcttcgaccagcgatgaaccacatttgtgcaaatataatgggacatctcaaccagcatggattttattctgtgctgcagtgctgtgatgggctgtttcctgatttggtttcatatgctcctcacaacaaccctgtgaggtggtccgttggcagaagctggtatgactggcagttgtctcgctagaggaaccttctacttcataccataattaaacggcttctaaaataatatgatgtctttaaattttaagtctggcattatttgtattagctgtttttttaactttattattaaagaatttctaaccataa

SEQ ID NO: 7990 - DNA, 3655 bp, Homo sapiens
gtgtgaaggctggggaggcataattttaaagcaggttggaggaactcctgcaggcagacaggaacttgatggaattctccatccgttctcatctcagtgccaagataattatcttaaatttaggcagaatggtttaaatgctgttacagctgcctgttgacttcctgtttctcccttttgtcatctaacttaatgattctcaaactttatgtacataaaaagtccttctcaggtttgcctccacaaaactgtgctcctgttcccacatgtgacttaggggtcttgagaggtaattttcccttgcccactaactttgaagcctaacccctgaatcggggcaccataggatagtcctttggggatcactgggtgaacatggcaggaaggcagcaagggttccccaaaacaggtctcgccacactggcatactgctcgtttgctttgtgatgaggggaccagacggcagccgagtggatgctgtggagacagcctgtctaacctgcgaagcatgtgacagtgttacagttgtagctgaaagggagaaatgtggcatggccttcataggacagcagggttgattggtcacttgttccatcacagtgtctgaagacatcagtttcacctggtgattgggcctctcaagtcgggccaacagactcttccctgggccctgtgctgttcagcactgtttttatagtcactgctctgaaataaaaacctcagcaccccaagtactaggaatgcattagatgatggaaccagaagccaggaaggcctcaacagattagaatcaagagacaaactaaacagatgatttagtaggagaactccaaagttgtggttctggggctgtgcatgttgaggtctggatggagtagatgtgctgaatggctgtgtcctaacagagctgaccaccagccagaagtccaggcccagcaccacccccacatctcggtctctgctccctgcgttgatccctgccatccacctgctctgctgccaatagaaagatctgacagaaagtcagccctgttactctttgcctaaaaccttctgcagctcccattaccttcaggatgtcccctaaattcctcagcatgacttgcaggcacttcatgattgggaaggcagcgggagatgaggggtgatgggtaattcttttcattttacagtgttctgtaggtttgattttttttttttttcttttttcttttttttaccatgagctaaagatactcttagcattgagagagagagaaatgtatcttgtcccggtttctttcatcctttgtctgatggccaggagcttgtcatgactcattttgtctaacttccccatctcactgctctgtccccttgaggtcagtctccccttgccaaggagtgatactgtcacatccccaaatgaatctttgcttttaatcagcactcattcaaaagcaggtgagaacggctcctgtcatgcatccacgtttcataatttgcacatttggtaatgatgctgggagagcttcgcacagaggagagggaaccccgaattgtgtgcataaggctttgggcttcctaatgggctgtaattctgctcttggcaggacggctacgagcagcttaggcagctctcccagcacgccatgaagggggtcatccgtgtgaagtttgtcaatgacctcggggtggacgaagcagggattgatcaagacggtgtttttaaggagttcttggaagagatcatcaagagagtttttgacccagcactcaatctgttcaagacaaccagtggggatgagaggctgtacccctcacccacatcctacatccatgagaattacctgcagctcttcgagtttgtggggaagatgctggggaaggctgtgtatgagggaattgtggtggacgtgccatttgcatccttcttcctgagccaactgcttgggcaccaccacagcgtcttctatagctcggtggatgaactgccttctctggactccgagttctataaaaacctcacctccatcaagcgctatgatggggacatcactgacctgggcctgacgctgtcttacgacgaggacgtcatgggtcagcttgtttgccatgaactgattcctggagggaagaccattcctgttacaaatgaaaataaaattagctacatccatctgatggcacattttcgaatgcacactcaaataaaaaaccaaacagctgccctcattagcggattccgttccattatcaaacccgagtggatccgaatgttctcaactcctgaactgcagcgtctcatctctggcgacaatgctgagattgatctggaagatttaaagaagcacacagtctactacggtggtttccatggaagtcacagagtcatcatctggctctgggatattctggcctccgacttcacaccggatgagagagctatgtttctgaagttcgtgaccagctgctccagacccccgctcctgggattcgcctacctcaagcctccattctccatccgctgcgtggaggtgtcggacgatcaggctgtgcacgtccaggctcgctgcttcatttcctcattggccaaaggagaaggaaagccttcagggttacggagctctgtgtgtctcaagcctggcccactgtgggtgctcaaatgagagtcctactccccataaaaacccagtggccgcctctgggtgtagctgcctctcatgatgcagtttgagcccgtgatgccaccttgtacaggaagctacacagtcctcggcctccatgcttaagggaaagttggcccaagtcatggtctgccaccggccacagcaccggtgaggagggaggagtgcattcagaaatgtttgggcacctaacagtttttacagcattctactttttgtcaattggttaaccagtaattcgctgtgaaccggaaggccccatttccaaaagcttacttagtgcaggaattctctgtgcaggccccagggagaaggggttccttctctggaagccagtcgtcttgtgtctggggcttgacctcgggtagtggtgccagggcagcgccctgcactctgcccagcatccagggactggccagatcccctccctgggctccctggccttggcatcagcctgggctcccaaactaggcccttcccaattcaaggccacgatgtgtgccttcaggacaccggggacactctgggcagcgtcctccggggcttcttcaccatccgcaagcgggagccaggcggccgcctgcccacctcctccacctgcttcaacctgctcaagctgcccaactacagcaagaagagcgtcctccgcgagaagctgcgctacgccatcagcatgaacacgggctttgaactctcctagctcctgtcccagccctgcctccagggctcctgggctgccagggaccttcagctcccagaggcagtgtggtcctgggaatgtgaccaacatgccaggtgacattggcccctagaccctctctatagccatgagactccttgtggcctcaagaaatttagacgcccacgacagcactacacagcatctccaggtgatgcccaaggcacagggctgcagaaaataaacctccagattccaccaacacgggtccattcttcctggtgatggcagaggggcttcttttagctag

SEQ ID NO: 7991 - DNA, 2763 bp, Homo sapiens
accgcggggcaagatggcggtagtgcgtcggctgctgccccgggtctggcagaactcgggtgttttgggctgagacagtggcagctgcggccccgaccccaagtgcggggacctccggcgaataaagggtttgtgcaagtttgcaaacatgttcaccctgtctcagacctcgagagcatggttcatcgatagagcccgtcaggcacgagaagaaaggcttgtgcagaaggaacgggagcgggcagctgttgtgatccaggcccatgtccggagttttctctgtcggagtcgactgcagagagatatcaggagagagattgatgacttttttaaagcagatgaccctgagtccactaaaagaagtgcactttgtattttcaagattgccaggaaactgctgttcctattcagaatcaaagaggataatgagagatttgagaagttgtgtcgcagcatcctgagcagcatggatgctgagaatgagcctaaggtgtggtatgtgtccctggcttgttctaaggacctcaccctcctttggattcaacagatcaagaacattttgtggtactgctgtgattttctcaagcagctcaagcctgaaatcctgcaggactcccgactcatcaccctgtacctcacgatgcttgtcaccttcacagacacttcaacgtggaaaattcttcggggaaaaggtgaaagtcttcgaccagcgatgaaccacatttgtgcaaatataatgggacatctcaaccagcatggattttattctgtgctgcagatattgttaacccgtggcctggcaagaccccgtccttgtctatccaaaggcactttaacagcagctttttctctagcgttacgccctgtgattgctgcacagttctcagacaatctgattcggccgttcctcatccacatcatgtctgtgcctgctctggtgactcatctcagcacagtgacccctgagcgcctcactgttttagaatcccatgacatgcttcgtaaattcatcatatttttaagagaccaagatcgatgccgtgatgtatgtgaaagtttagaaggatgccatacgctttgtctaatgggcaacctcctacacttgggctccctcagccccagagtgttagaggaggagacagatgggttcgtgagtttgctcacccagacgctgtgctactgtcggaagtatgtgtctcagaagaagtccaacctgacccactggcatcctgtccttggctggttctcccaatctgtggattatggccttaacgagtcaatgcacttgatcaccaaacagctgcagttcttgtggggggtgcctctgatccggatcttcttctgtgacatcctgagcaagaagctactggagagccaggagccagcccacgcacagccagcatcccctcagaatgtgctcccagtgaagagtctcctaaagcgtgcttttcaaaagtcggcatcagtccggaatattctcaggcctgtcgggggtaaacgggtcgactctgcagaagtccagaaggtttgcaacatctgtgtcctctaccagacctcgctgacaactctcacacagattcggctgcagatactcacaggtctcacttaccttgatgacctgcttcccaaactgtgggcatttatctgtgagctcgggccccacggagggttaaagctcttcttggaatgcctgaacaatgacactgaagagtccaagcaactcttggccatgctgatgctgttctgtgactgttcgcggcacctcatcacaatccttgatgacattgaagtttatgaagaacagatttcattcaaactggaagagctggtcactatctcctctttcctgaattcttttgtgtttaagatgatctgggatggaattgtagagaacgccaagggtgagaccttggagctgttccagtctgtccacgggtggcttatggtgctgtacgagcgggactgccggcggcgcttcacccccgaggaccactggctgcgaaaggatctcaaacctagcgtgctcttccaagaactcgacagggacagaaaacgggcacagttgatcctgcagtacatcccacatgtcatccctcacaaaaacagagttctactgtttcgaaccatggttaccaaggagaaggagaaactggggctggtggaaaccagctctgcctccccgcatgtcactcacatcaccatccgccggtccaggatgctggaggacggctacgagcagcttaggcagctctcccagcacgccatgaagggggtcatccgtgtgaagtttgtcaatgacctcggggtggacgaagcagggattgatcaagacggtgtttttaaggagttcttggaagagatcatcaagagagtttttgacccagcactcaatctgttcaagacaaccagtggggatgagaggctgtacccctcacccacatcctacatccatgagaattacctgcagctcttcgagtttgtggggaagatgctggggaaggctgtgtatgagggaattgtggtggacgtgccatttgcatccttcttcctgagccaactgcttgggcaccaccacagcgtcttctatagctcggtggatgaactgccttctctggactccgagttctataaaaacctcacctccatcaagcgctatgatggggacatcactgacctgggcctgacgctgtcttacgacgaggacgtcatgggtcagcttgtttgccatgaactgattcctggagggaagaccattcctgttac

SEQ ID NO: 7992 - DNA, 1541 bp, Homo sapiens
ggcggtagtgcgtcggctgctgccccgggtctggcagaactcgggtgttttgggctgagacagtggcagctgcggccccgaccccaagtgcggggacctccggcgaataaaggtcggcctgcggaaaaaataacaagcttttctgaagtgagaagctgttctcagccacgagtcctgtgcaagatcactaatgattacctggcatttctgcgacacaggcaggtcctcagggtttgtgcaagtttgcaaacatgttcaccctgtctcagacctcgagagcatggttcatcgatagagcccgtcaggcacgagaagaaaggcttgtgcagaaggaacgggagcgggcagctgttgtgatccaggcccatgtccggagttttctctgtcggagtcgactgcagagagatatcaggagagagattgatgacttttttaaagcagatgaccctgagtccactaaaagaagtgcactttgtattttcaagattgccaggaaactgctgttcctattcagaatcaaagaggataatgagagatttgagaagttgtgtcgcagcatcctgagcagcatggatgctgagaatgagcctaaggtgtggtatgtgtccctggcttgttctaaggacctcaccctcctttggattcaacagatcaagaacattttgtggtactgctgtgattttctcaagcagctcaagcctgaaatcctgcaggactcccgactcatcaccctgtacctcacgatgcttgtcaccttcacagacacttcaacgtggaaaattcttcggggaaaaggtgaaagtcttcgaccagcgatgaaccacatttgtgcaaatataatgggacatctcaaccagcatggattttattctgtgctgcagtgctgtgatgggctgtttcctgatttggtttcatatgctcctcacaacaaccctgtgaggtggtccgttggcagaagctggtatgactggcagttgtctcgctagaggaaccttctacttcataccataattaaacggcttctaaaataatatgatgtctttaaattttaagtctggcattatttgtattagctgtttttttaactttattattaaagaatttctaaccataatatttagagaaagagtggtagagttaacctcgttacccaatactttcttccctttccttttataaaaacactgcatacggttttttgtttttttgtttttttgttttttttttaagagacagggttgccctgtcacccaggctggcctcaaggaatcttcctgcctcagcctcctgagctgggactgtaggtacaagccaccatgcctggctcacaatacagtttttttatctgaagcactcagtttacttttttgctcttttatgtacaaatgaatataaagttgatatcatcctctgaccaattaaaacattcttttcagatattgttaacccgtggcctggcaagaccccgtccttgtctatccaaaggcactttaacagcagctttttctctagcgttacggtgagtaagaaaccatagctga

SEQ ID NO: 7993 - DNA, 4748 bp, Homo sapiens
atgctctggggcgtgccgccgccgtcgctgccacctcccctaccgctagtggaagaagatggcggaaggcggagcggcggatctggacacccagcggtctgacatcgcgacgctgctcaaaacctcgctccggaaaggggacacctggtacctagtcgatagtcgctggttcaaacagtggaaaaaatatgttggctttgacagttgggacaaataccagatgggagatcaaaatgtgtatcctggacccattgataactctggacttctcaaagatggtgatgcccagtcacttaaggaacaccttattgatgaattggattacatactgttgccaactgaaggttggaataaacttgtcagctggtacacattgatggaaggtcaagagccaatagcacgaaaggtggttgaacagggtatgtttgtaaagcactgcaaagtagaagtatatctcacagaattgaagctatgtgaaaatggaaacatgaataatgttgtaactcgaagatttagcaaagctgacacaatagatacaattgaaaaggaaataagaaaaatcttcagtattccagatgaaaaggagaccagattgtggaacaaatacatgagtaacacatttgaaccactgaataaaccagacagcaccattcaggatgctggtttataccaaggacaggtattagtgatagaacagaaaaatgaagatggaacatggccaaggggtccttctactcctaagtccccaggtgcatccaatttttcaactttaccaaagatctctccttcatctctatcaaataattataacaacatgaacaacagaaatgtgaaaaactcaaattactgtcttccatcatataccgcttataagaactatgattattcggaacctggaagaaacaatgaacagccaggcctctgtggcctaagtaacttgggaaatacgtgtttcatgaactcagctattcagtgtttgagcaacacacctccacttactgagtatttcctcaatgataagtatcaagaagaactgaattttgacaatcccttaggaatgagaggtgaaatagctaaatcttatgccgaactgatcaagcaaatgtggtctggaaagtttagctacgtcaccccaagagcctttaagacacaggtaggacgttttgcacctcagttctctggatatcagcagcaagactgtcaagaactgttagctttcctattagatggattacatgaggatttgaatagaattaggaaaaaaccatatatacaattaaaagatgcagatggaaggccagataaggtggttgccgaagaagcctgggaaaaccatttaaaacgaaatgattctatcatagtagatatatttcatggccttttcaaatcaactttagtttgtcctgagtgtgctaagatttcagtaacatttgatcctttttgttacttgacacttccattgcccatgaaaaaagaacgcaccttggaagtttacttagttagaatggatccacttaccaaacctatgcagtacaaagtggttgtccccaaaattggaaacatattagatctttgtacagcattgtctgctttgtcaggaatacctgcagataagatgatagttactgatatatacaatcatagatttcacagaatattcgctatggatgaaaaccttagtagtattatggaacgggatgatatttatgtgtttgaaattaacatcaataggacagaagatacagagcacgtgattattcctgtttgcctaagagaaaaattcagacactcgagttatacccaccatactggttcttcactttttggtcagccctttcttatggctgtaccacgaaacaatactgaagacaaactttataatctcctgctcttgagaatgtgccgatatgtcaaaatatctactgaaactgaagaaactgaaggatccctacactgctgtaaggaccaaaatattaatgggaatggcccaaatggcatacatgaagaaggctcaccaagtgaaatggaaacagatgagccagatgatgaatccagccaggatcaagaacttccctcagagaatgaaaacagtcagtctgaagattcagttggaggagataatgattctgaaaatggattatgtactgaggatacttgcaaaggtcaactcacgggacacaaaaaacgattgtttacattccagttcaacaacttaggcaatactgatatcaactacatcaaagatgataccaggcatataagatttgatgataggcagcttaggctagatgaaagatcttttcttgctttggattgggatcctgatttgaaaaaaagatattttgatgaaaatgctgctgaggactttgaaaaacatgaaagtgtggagtataaacctcctaaaaaaccctttgtgaaattaaaagattgcattgaactttttacaacaaaagaaaagctaggtgctgaagatccctggtattgtccgaattgtaaagaacatcagcaagccacaaagaaattggatttatggtccctgcctccagtacttgtagtacatctcaagcgattttcttacagtcgatacatgagagacaagttggataccttagttgattttcctatcaatgacttggatatgtcggaattcttaattaatccaaatgcaggtccttgccgctataatctgattgctgtttccaaccactatggagggatgggaggaggacactatactgcttttgcaaaaaataaagatgatggaaaatggtactattttgatgacagtagtgtctccactgcatctgaagaccaaattgtgtccaaagcagcatatgtactcttctaccagagacaagacactttcagtggaactggcttttttcctcttgaccgagaaactaaaggtgcttcagctgccactggcatcccattagaaagtgatgaagatagcaatgataatgacaatgatatagaaaatgaaaactgtatgcacactaactaatgaaagtcctagaagccataaaagagacactttcctgctggtggtatctatggaaatgatgaagttacccaccacattaaaacaaaagtctgagatggggagtttcagataaccgaatgtaaatcctttatcagattttaacttgtgcagtacttgaagtgaaacacaatgaaaactttaacagaaattgtctcttaatacatttacagtcttgtatttacaagctaaatatatataggaaatcacaaataaatcccttttaagtttgctgctgttttgattaattatgtttcctttaattttttggatgtgagttgatgacaaatgttaaatttgtggatgttggtcatttattttgctctaataatactgcaagaaaactatggctgaacttagtttttggataatctagttcatgtgcattaggctgccgtatatactactatgatatttagctgcagtatcaatgtggcataaatactgcggcagcattcttcgaaaaccgcattttcaaatttatccccgtaatcaatgtgggcctattaaaaaaccaaatcatgatacaagaaacaaccttggaaaagttatttccctttgtaatacctttaaaaatccagagtattatattcattttactgccactgtggaaacaggttctagatttcatactccatctaaagtcatttttcagttacatgtaagtattatttactgctattgggatctattcttcagatattcaaaaacattttttgctttaaaatgcatatctttaattgggtgttggtccaaaattaaaatttttgctgtctgtttttctctaccccattttgtggtaatttggcaacttgagctctcccaattattgtaatataaggacagacataatagtattctgtacccatagtaataattgcatcaagcttagatgagaaatttttttcatatactggcctttaaatcattaatggacaattggctataaaggtaggtctgttaactttctttgtgtgttcctgatggaattcaccatagccttacagcttttctcagaaggtaacttgttataagagaaatggcatttgcatgttccagagtcagaacctgtacagtatataaagcataaacaccttgaatttgattttagttcaccacattcaaggatccaggatgccaaaaatatgtgtgaacatttgaaacatttttatttgctgctttttccctttgatatagttgaaagaatgtattgtaaattggcatacaatactgcctttaatagaaaacctaaatgctggggcacatttcacatatcgactacctgagaaattgctttgtgtcccactgttattaaagcaaaaagtataatgttcttcacttgaactaatcaaatacaatagattataaattgtgtattgtaaataaaagttcactctgtgagtgcacattttggtaaattatttatttatgttagcatttaaaagtttaaaaaaaatgcatttgaccaggataaatgaggtatgttgatcatggctttgctttatatcttgatattaaagctggtttatcatcctggtattttaaaagctgctttggggttttttttttcttttttttttttttaatgtaaactaacctcctgcatgacagaggttaaaattttgtctgcacttgagttcacttgagtttacatttgaaatgtgcatgtttatttatatagatttcaataaagctattcaaggcctta

SEQ ID NO: 7994 - DNA, 4680 bp, Homo sapiens
gtgggacgccattcccataatgctctggggcgtgccgccgccgtcgctgccacctcccctaccgctagtggaagaagatggcggaaggcggagcggcggatctggacacccagcggtctgacatcgcgacgctgctcaaaacctcgctccggaaaggggacacctggtacctagtcgatagtcgctggttcaaacagtggaaaaaatatgttggctttgacagttgggacaaataccagatgggagatcaaaatgtgtatcctggacccattgataactctggacttctcaaagatggtgatgcccagtcacttaaggaacaccttattgatgaattggattacatactgttgccaactgaaggttggaataaacttgtcagctggtacacattgatggaaggtcaagagccaatagcacgaaaggtggttgaacagggtatgtttgtaaagcactgcaaagtagaagtatatctcacagaattgaagctatgtgaaaatggaaacatgaataatgttgtaactcgaagatttagcaaagctgacacaatagatacaattgaaaaggaaataagaaaaatcttcagtattccagatgaaaaggagaccagattgtggaacaaatacatgagtaacacatttgaaccactgaataaaccagacagcaccattcaggatgctggtttataccaaggacaggtattagtgatagaacagaaaaatgaagatggaacatggccaaggggtccttctactcctaatgtgaaaaactcaaattactgtcttccatcatataccgcttataagaactatgattattcggaacctggaagaaacaatgaacagccaggcctctgtggcctaagtaacttgggaaatacgtgtttcatgaactcagctattcagtgtttgagcaacacacctccacttactgagtatttcctcaatgataagtatcaagaagaactgaattttgacaatcccttaggaatgagaggtgaaatagctaaatcttatgccgaactgatcaagcaaatgtggtctggaaagtttagctacgtcaccccaagagcctttaagacacaggtaggacgttttgcacctcagttctctggatatcagcagcaagactgtcaagaactgttagctttcctattagatggattacatgaggatttgaatagaattaggaaaaaaccatatatacaattaaaagatgcagatggaaggccagataaggtggttgccgaagaagcctgggaaaaccatttaaaacgaaatgattctatcatagtagatatatttcatggccttttcaaatcaactttagtttgtcctgagtgtgctaagatttcagtaacatttgatcctttttgttacttgacacttccattgcccatgaaaaaagaacgcaccttggaagtttacttagttagaatggatccacttaccaaacctatgcagtacaaagtggttgtccccaaaattggaaacatattagatctttgtacagcattgtctgctttgtcaggaatacctgcagataagatgatagttactgatatatacaatcatagatttcacagaatattcgctatggatgaaaaccttagtagtattatggaacgggatgatatttatgtgtttgaaattaacatcaataggacagaagatacagagcacgtgattattcctgtttgcctaagagaaaaattcagacactcgagttatacccaccatactggttcttcactttttggtcagccctttcttatggctgtaccacgaaacaatactgaagacaaactttataatctcctgctcttgagaatgtgccgatatgtcaaaatatctactgaaactgaagaaactgaaggatccctacactgctgtaaggaccaaaatattaatgggaatggcccaaatggcatacatgaagaaggctcaccaagtgaaatggaaacagatgagccagatgatgaatccagccaggatcaagaacttccctcagagaatgaaaacagtcagtctgaagattcagttggaggagataatgattctgaaaatggattatgtactgaggatacttgcaaaggtcaactcacgggacacaaaaaacgattgtttacattccagttcaacaacttaggcaatactgatatcaactacatcaaagatgataccaggcatataagatttgatgataggcagcttaggctagatgaaagatcttttcttgctttggattgggatcctgatttgaaaaaaagatattttgatgaaaatgctgctgaggactttgaaaaacatgaaagtgtggagtataaacctcctaaaaaaccctttgtgaaattaaaagattgcattgaactttttacaacaaaagaaaagctaggtgctgaagatccctggtattgtccgaattgtaaagaacatcagcaagccacaaagaaattggatttatggtccctgcctccagtacttgtagtacatctcaagcgattttcttacagtcgatacatgagagacaagttggataccttagttgattttcctatcaatgacttggatatgtcggaattcttaattaatccaaatgcaggtccttgccgctataatctgattgctgtttccaaccactatggagggatgggaggaggacactatactgcttttgcaaaaaataaagatgatggaaaatggtactattttgatgacagtagtgtctccactgcatctgaagaccaaattgtgtccaaagcagcatatgtactcttctaccagagacaagacactttcagtggaactggcttttttcctcttgaccgagaaactaaaggtgcttcagctgccactggcatcccattagaaagtgatgaagatagcaatgataatgacaatgatatagaaaatgaaaactgtatgcacactaactaatgaaagtcctagaagccataaaagagacactttcctgctggtggtatctatggaaatgatgaagttacccaccacattaaaacaaaagtctgagatggggagtttcagataaccgaatgtaaatcctttatcagattttaacttgtgcagtacttgaagtgaaacacaatgaaaactttaacagaaattgtctcttaatacatttacagtcttgtatttacaagctaaatatatataggaaatcacaaataaatcccttttaagtttgctgctgttttgattaattatgtttcctttaattttttggatgtgagttgatgacaaatgttaaatttgtggatgttggtcatttattttgctctaataatactgcaagaaaactatggctgaacttagtttttggataatctagttcatgtgcattaggctgccgtatatactactatgatatttagctgcagtatcaatgtggcataaatactgcggcagcattcttcgaaaaccgcattttcaaatttatccccgtaatcaatgtgggcctattaaaaaaccaaatcatgatacaagaaacaaccttggaaaagttatttccctttgtaatacctttaaaaatccagagtattatattcattttactgccactgtggaaacaggttctagatttcatactccatctaaagtcatttttcagttacatgtaagtattatttactgctattgggatctattcttcagatattcaaaaacattttttgctttaaaatgcatatctttaattgggtgttggtccaaaattaaaatttttgctgtctgtttttctctaccccattttgtggtaatttggcaacttgagctctcccaattattgtaatataaggacagacataatagtattctgtacccatagtaataattgcatcaagcttagatgagaaatttttttcatatactggcctttaaatcattaatggacaattggctataaaggtaggtctgttaactttctttgtgtgttcctgatggaattcaccatagccttacagcttttctcagaaggtaacttgttataagagaaatggcatttgcatgttccagagtcagaacctgtacagtatataaagcataaacaccttgaatttgattttagttcaccacattcaaggatccaggatgccaaaaatatgtgtgaacatttgaaacatttttatttgctgctttttccctttgatatagttgaaagaatgtattgtaaattggcatacaatactgcctttaatagaaaacctaaatgctggggcacatttcacatatcgactacctgagaaattgctttgtgtcccactgttattaaagcaaaaagtataatgttcttcacttgaactaatcaaatacaatagattataaattgtgtattgtaaataaaagttcactctgtgagtgcacattttggtaaattatttatttatgttagcatttaaaagtttaaaaaaaatgcatttgaccaggataaatgaggtatgttgatcatggctttgctttatatcttgatattaaagctggtttatcatcctggtattttaaaagctgctttggggttttttttttcttttttttttttttaatgtaaactaacctcctgcatgacagaggttaaaattttgtctgcacttgagttcacttgagtttacatttgaaatgtgcatgtttatttatatagatttcaataaagctattcaaggcctta

SEQ ID NO: 7995 - DNA, 4623 bp, Homo sapiens
tggaagaagatggcggaaggcggagcggcggatctggacacccagcggtctgacatcgcgacgctgctcaaaacctcgctccggaaaggggacacctggtacctagtcgatagtcgctggttcaaacagtggaaaaaatatgttggctttgacagttgggacaaataccagatgggagatcaaaatgtgtatcctggacccattgataactctggacttctcaaagatggtgatgcccagtcacttaaggaacaccttattgatgaattggattacatactgttgccaactgaaggttggaataaacttgtcagctggtacacattgatggaaggtcaagagccaatagcacgaaaggtggttgaacagggtatgtttgtaaagcactgcaaagtagaagtatatctcacagaattgaagctatgtgaaaatggaaacatgaataatgttgtaactcgaagatttagcaaagctgacacaatagatacaattgaaaaggaaataagaaaaatcttcagtattccagatgaaaaggagaccagattgtggaacaaatacatgagtaacacatttgaaccactgaataaaccagacagcaccattcaggatgctggtttataccaaggacaggtattgtttattgtattagtgatagaacagaaaaatgaagatggaacatggccaaggggtccttctactcctaatgtgaaaaactcaaattactgtcttccatcatataccgcttataagaactatgattattcggaacctggaagaaacaatgaacagccaggcctctgtggcctaagtaacttgggaaatacgtgtttcatgaactcagctattcagtgtttgagcaacacacctccacttactgagtatttcctcaatgataagtatcaagaagaactgaattttgacaatcccttaggaatgagaggtgaaatagctaaatcttatgccgaactgatcaagcaaatgtggtctggaaagtttagctacgtcaccccaagagcctttaagacacaggtaggacgttttgcacctcagttctctggatatcagcagcaagactgtcaagaactgttagctttcctattagatggattacatgaggatttgaatagaattaggaaaaaaccatatatacaattaaaagatgcagatggaaggccagataaggtggttgccgaagaagcctgggaaaaccatttaaaacgaaatgattctatcatagtagatatatttcatggccttttcaaatcaactttagtttgtcctgagtgtgctaagatttcagtaacatttgatcctttttgttacttgacacttccattgcccatgaaaaaagaacgcaccttggaagtttacttagttagaatggatccacttaccaaacctatgcagtacaaagtggttgtccccaaaattggaaacatattagatctttgtacagcattgtctgctttgtcaggaatacctgcagataagatgatagttactgatatatacaatcatagatttcacagaatattcgctatggatgaaaaccttagtagtattatggaacgggatgatatttatgtgtttgaaattaacatcaataggacagaagatacagagcacgtgattattcctgtttgcctaagagaaaaattcagacactcgagttatacccaccatactggttcttcactttttggtcagccctttcttatggctgtaccacgaaacaatactgaagacaaactttataatctcctgctcttgagaatgtgccgatatgtcaaaatatctactgaaactgaagaaactgaaggatccctacactgctgtaaggaccaaaatattaatgggaatggcccaaatggcatacatgaagaaggctcaccaagtgaaatggaaacagatgagccagatgatgaatccagccaggatcaagaacttccctcagagaatgaaaacagtcagtctgaagattcagttggaggagataatgattctgaaaatggattatgtactgaggatacttgcaaaggtcaactcacgggacacaaaaaacgattgtttacattccagttcaacaacttaggcaatactgatatcaactacatcaaagatgataccaggcatataagatttgatgataggcagcttaggctagatgaaagatcttttcttgctttggattgggatcctgatttgaaaaaaagatattttgatgaaaatgctgctgaggactttgaaaaacatgaaagtgtggagtataaacctcctaaaaaaccctttgtgaaattaaaagattgcattgaactttttacaacaaaagaaaagctaggtgctgaagatccctggtattgtccgaattgtaaagaacatcagcaagccacaaagaaattggatttatggtccctgcctccagtacttgtagtacatctcaagcgattttcttacagtcgatacatgagagacaagttggataccttagttgattttcctatcaatgacttggatatgtcggaattcttaattaatccaaatgcaggtccttgccgctataatctgattgctgtttccaaccactatggagggatgggaggaggacactatactgcttttgcaaaaaataaagatgatggaaaatggtactattttgatgacagtagtgtctccactgcatctgaagaccaaattgtgtccaaagcagcatatgtactcttctaccagagacaagacactttcagtggaactggcttttttcctcttgaccgagaaactaaaggtgcttcagctgccactggcatcccattagaaagtgatgaagatagcaatgataatgacaatgatatagaaaatgaaaactgtatgcacactaactaatgaaagtcctagaagccataaaagagacactttcctgctggtggtatctatggaaatgatgaagttacccaccacattaaaacaaaagtctgagatggggagtttcagataaccgaatgtaaatcctttatcagattttaacttgtgcagtacttgaagtgaaacacaatgaaaactttaacagaaattgtctcttaatacatttacagtcttgtatttacaagctaaatatatataggaaatcacaaataaatcccttttaagtttgctgctgttttgattaattatgtttcctttaattttttggatgtgagttgatgacaaatgttaaatttgtggatgttggtcatttattttgctctaataatactgcaagaaaactatggctgaacttagtttttggataatctagttcatgtgcattaggctgccgtatatactactatgatatttagctgcagtatcaatgtggcataaatactgcggcagcattcttcgaaaaccgcattttcaaatttatccccgtaatcaatgtgggcctattaaaaaaccaaatcatgatacaagaaacaaccttggaaaagttatttccctttgtaatacctttaaaaatccagagtattatattcattttactgccactgtggaaacaggttctagatttcatactccatctaaagtcatttttcagttacatgtaagtattatttactgctattgggatctattcttcagatattcaaaaacattttttgctttaaaatgcatatctttaattgggtgttggtccaaaattaaaatttttgctgtctgtttttctctaccccattttgtggtaatttggcaacttgagctctcccaattattgtaatataaggacagacataatagtattctgtacccatagtaataattgcatcaagcttagatgagaaatttttttcatatactggcctttaaatcattaatggacaattggctataaaggtaggtctgttaactttctttgtgtgttcctgatggaattcaccatagccttacagcttttctcagaaggtaacttgttataagagaaatggcatttgcatgttccagagtcagaacctgtacagtatataaagcataaacaccttgaatttgattttagttcaccacattcaaggatccaggatgccaaaaatatgtgtgaacatttgaaacatttttatttgctgctttttccctttgatatagttgaaagaatgtattgtaaattggcatacaatactgcctttaatagaaaacctaaatgctggggcacatttcacatatcgactacctgagaaattgctttgtgtcccactgttattaaagcaaaaagtataatgttcttcacttgaactaatcaaatacaatagattataaattgtgtattgtaaataaaagttcactctgtgagtgcacattttggtaaattatttatttatgttagcatttaaaagtttaaaaaaaatgcatttgaccaggataaatgaggtatgttgatcatggctttgctttatatcttgatattaaagctggtttatcatcctggtattttaaaagctgctttggggttttttttttcttttttttttttttaatgtaaactaacctcctgcatgacagaggttaaaattttgtctgcacttgagttcacttgagtttacatttgaaatgtgcatgtttatttatatagatttcaataaagctattcaaggcctt

SEQ ID NO: 7996 - DNA, 2226 bp, Homo sapiens
taccgctagtggaagaagatggcggaaggcggagcggcggatctggacacccagcggtctgacatcgcgacgctgctcaaaacctcgctccggaaaggggacacctggtacctagtcgatagtcgctggttcaaacagtggaaaaaatatgttggctttgacagttgggacaaataccagatgggagatcaaaatgtgtatcctggacccattgataactctggacttctcaaagatggtgatgcccagtcacttaaggaacaccttattgatgaattggattacatactgttgccaactgaaggttggaataaacttgtcagctggtacacattgatggaaggtcaagagccaatagcacgaaaggtggttgaacagggtatgtttgtaaagcactgcaaagtagaagtatatctcacagaattgaagctatgtgaaaatggaaacatgaataatgttgtaactcgaagatttagcaaagctgacacaatagatacaattgaaaaggaaataagaaaaatcttcagtattccagatgaaaaggagaccagattgtggaacaaatacatgagtaacacatttgaaccactgaataaaccagacagcaccattcaggatgctggtttataccaaggacaggtattagtgatagaacagaaaaatgaagatggaacatggccaaggggtccttctactcctaaaaagccactagagcagagttgctagtgaacagtttaatttccacatacgtcacagaaagagagctaaagggctctggttatcatccacagactgaccagtcaacccctaaataacctgatattaactccacaaatgttagctagattggaccatgtgtaatctgagtcagaagtcggaatcagaagagataaatgatgcgttatcactcaacagtaatgtctgcaacagtattgtaaaattgttgtactttacctgtcgaccacatccatccttagctctctgatcaccttactatttaaggacagtccctctactctacctgtagtatttatctcaatgcttcctggtccttgctttttcttttattatctcctctctcctacatatataaatgcctagcatagtgccacacatatggtaaacaccagtttattatttttatttcttttctaatgtcatcttccccctcagcctatgaatataaacacatcttcatctttaaaaccaaaaaccatatacttcctccatttaccatccttaagcttttttttctttgacagccacctacatttaaaaggctatacttaatgttgcttgccacccattcaggatttaacaaagttcttatttgtctttcttttaacctagtttatttgacctgtctttagtatttctttttgataaccatcttctaaagaaattctctgaatttgaatgcatgatacgaccttttatgccaaggactttgcctctctgaccagtcctttgtctgtctagctcggttcctctttagggttgccacatttagttttgcaaattgtgcacagctctaggaggcatcattcatatcatatgtagtctatgtgataggccctccttggcacggtgcagtgcagcttcactaactgtttgcagcagctctactcagaccttaaatgcattgacattcactaaatttctgtcagaagacctcttttatcataccatagtaggtgttcaaaattaggtgattctatgctaatcctctcccccagctcaaactgacacaaaatatgccattctgtatttctagactagaccacttttctgaattccagatttttcataaatttcatgtaggactcaccacctcaaattaaaccaaatctttttacccctccttctcccatcccctcaacctaaactgtcttcatttcctgtattgcctatttcaagtaccatccaagagccatcctgagttcctcctccagcctttcttctcttgtctagttagtcagcaagtcttgcagattctgcctcctcacctgaagttttcaaacagtacccctttacattcttgaaaattattaaagatccaaagaacttctgttatatgggttatagctgttaatatttgtcatattcgaaattgaaataagattttaaggtattttaaaataacagtacaaaaccattgtattttgacatgaataacacttttatgaaaataactatattccaaaacaataaaattaccaaaaagtt

SEQ ID NO: 7997 - DNA, 3566 bp, Homo sapiens
gagatttccagagccatgggagccggaagtccaaggaactgtacctccatcatgacgactccggttacgtaaaaacattcaaacagaaaatgctggccaggctcatgcctgtaatcccagcactttgggaggccgaggcgggaggatcgcttgtgcccaggagttggagaccagcctgggcaacatagcgctatggagtctaatccaggcactttggaaggctgaggctggaggatcgattgaggccaggagtttgggaccaccctgggcaacatagcaagatctcatttctgaaaaaagaattatcatccactcacccagaacagctctccaaacttaacagccgtggcagtcagagctctgcctgcagtgtgaccatggacagctctccaaagcttaaacttcagtaaattgactcaagtttcttcggaaagaactgttacataaagaaaggatgatatctctaaaggtatgtggattcatccaaatttggagccagaagactgggatgactaagctgaaagaagctctcattgaaacagtgcaaagacaaaaggaaattaaactggtggtcactttcaaatctggaaaatttataagaatttttcagctgagcaacaacattagaagtgtggtccttagacattgtaaaaaaagacaaagtcacctgcgtttaactttgaaaaacaacgtgttcttgtttattgacaaattatcctacagagatgctaaacagttgaatatgttcctggacataatccaccaaaacaaatctcagcaacccatgaaatctgatgatgattggagtgtgtttgaaagcaggaatatgctgaaggaaattgacaaaacttcattttacagcatttgtaacaagccaagttatcagaagatgcctttgtttatgtcaaaatcaccaacacatgtgaaaaaggggatattagaaaatcaaggtgggaaggggcaaaacacactatcatctgatgtacagacaaatgaggacattctgaaggaagataaccctgtaccaaacaagaaatataagacagattccttgaaatatatacaaagcaataggaagaacccatcaagtttagaggatttagaaaaagatagagatttgaaactcgggccttcattcaataccaactgtaatggaaatcctaacctagatgagactgttcttgcaacccagactctcaatgccaaaaatggtttgacatctccattggaaccagagcacagccagggtgacccaagatgcaacaaagcccaggtgcctcttgactctcattcacagcaactgcagcaggggttccccaatttgggaaacacctgttacatgaatgcagttttacaatcgctatttgcaattccatcttttgctgatgacttactcactcaaggtgtcccatgggaatatattccctttgaggctcttattatgaccttgacccagctgcttgctttgaaagatttctgtagtacaaagatcaagagagaattacttgggaatgttaaaaaagtcatttcagcagttgcagaaatattttctggcaacatgcagaatgatgctcatgagtttttaggtcagtgtttagaccagctgaaagaagacatggaaaaattaaatgccactttgaatactgggaaagaatgtggggatgaaaattcatctccacaaatgcatgttggtagtgctgccaccaaagtgtttgtttgccctgttgttgctaattttgagtttgaattgcagctctcccttatttgtaaagcttgtggtcatgctgttctcaaggtagaacctaataattatctctccatcaacctgcaccaagaaacaaaaccacttcctttgtccattcagaattctttagatcttttctttaaagaagaagagcttgaatataactgtcagatgtgtaagcagaagagttgtgttgcaaggcatacatttagtaggctctccagggtccttatcattcatctgaaacgctatagcttcaacaatgcttggttgctggtgaagaataacgagcaagtttatattcccaaatctttaagtttatcttcttattgcaatgaaagcaccaaaccacctcttcccttgagcagtagtgcacctgttgggaaatgtgaagtcctggaagtctctcaggagatgatttctgagatcaacagcccattgacaccatcaatgaagctgacctcagaatccagtgattccctggttctacccgttgaaccagacaagaatgccgacctacaaagattccagagagactgtggagatgcaagccaagagcagcatcagagagacctggaaaatggctctgcactagagtcagaattggtccactttagagatagggcaatcggtgaaaaggagcttccagtggctgactcactgatggaccagggagacatttctcttcctgtgatgtatgaagatggagggaagctgatcagcagcccagacacaaggcttgtcgaggttcatcttcaagaggtgcctcaacatccagaacttcagaagtatgagaaaaccaatacattcgtagagttcaattttgacagtgtcactgagtccaccaatggcttttatgactgtaaagaaaacaggattccagaaggatctcaaggaatggctgaacagctccagcagtgtattgaggagagcatcatagatgaatttcttcagcaggcaccacctccaggtgttaggaagctggatgcccaggaacatacagaagagaccctcaatcagtctacagaattaagacttcaaaaggctgacctgaatcaccttggggcactgggttctgacaacccaggaaacaaaaacattttagatgcagagaacacaagaggtgaagccaaggaactaacaagaaacgtgaagatgggggatcctctccaggcctacagactcatcagtgttgtcagccatatcgggagctccccaaattcaggccattacatcagcgatgtgtatgactttcagaagcaggcctggttcacatacaacgatctatgtgtatcagaaatctcagagaccaaaatgcaggaggcgaggcttcactctgggtatatcttcttttacatgcacaatgggatttttgaggagctgttaagaaaagcagagaactctcggctacctagcacacaggcaggggtgatccctcagggggaatacgaaggtgactctttgtacagacctgcttgacagactcactcggcctcacttcatccttgcaaagagaatcctgtacttcatccttgcaaagagaatcctgtacttcactcagaatgaaggaacaagtatctcaggatgaaatctcaatgaaaaacacttattttgggggaatatctattttaactgcttcagacacctagatcccagaactcaggcgcatatgcatattttccctgcaagattagaatggtgctcttcacgttttgacggtggttttcaaaatgttgttcttcaaccagcaacagcaacagctagggactgattagaaatgcaaattcttgggtcactctctagaccaactgatgcagaaaca

SEQ ID NO: 7998 - DNA, 10699 bp, Homo sapiens
atgtccaaggtaacggcgcctgggtccgggccgccggcggcggcgagcgggaaggagaagcgctccttcagcaagcggctgtttcggagcggccgcgctggcggcggcggcgcggggggccccggggcgtccgggccggccgcgccttcctcgccctcctcgccctcctctgcacgctcggtgggcagcttcatgagccgcgttctcaagacgctgtccacgctctcgcaccttagctctgagggcgccgccccagaccgcggcggcctccgcagctgcttcccgcccgggccggccgccgcgcccacgccgccgccgtgcccgccgccgcccgcctctcccgcgccgcccgcttgcgccgccgagccggtgcccggcgtggcggggctccgcaaccacggcaacacgtgcttcatgaacgccacgctgcagtgcctcagcaacaccgagctcttcgccgagtacctggcgctgggccagtaccgggcggggcggcccgagccctcgcctgacccggagcagcctgcgggccgcggcgcgcagggccagggcgaggtcactgagcagctggcgcacctggtgcgggccctctggaccctggagtacaccccgcagcacagccgcgacttcaagactattgtgtcaaagaatgcactgcagtaccggggaaattcccaacatgatgcccaggagtttctgctgtggcttttggaccgagttcatgaagacctcaaccattcagtgaagcagagtggccagcctcctctgaagccaccatcagagactgatatgatgcctgagggaccatctttccctgtctgtagcacttttgtacaagaactctttcaagcgcaatacagatcttctttgacgtgtcctcattgtcagaaacagagcaacacttttgatcctttcctttgcatttctttgccaattcctctgccccacacaaggcctctctatgtcactgtagtgtatcaaggcaaatgttctcactgcatgaggattggtgtggccgtacctctgtctgggactgtcgccagacttcgggaagcagtgtctatggaaacaaagatccccactgatcagattgtgttaacagaaatgtactatgatgggttccatcgttccttttgtgatacagacgacctggaaacagtccatgaaagcgactgcatttttgcctttgagactcccgaaatatttaggcctgaaggaattctcagtcaaagaggaattcatttaaacaacaacctaaaccacttgaaatttggcttggattatcatagactgtcttctcctacacaaacagcagcaaagcaggggaaaatggattctcccacatcaagagcaggcagcgacaagattgtcctgttggtgtgtaaccgagcctgcactgggcaacaagggaaaagatttggactgccttttgtgctgcacttagagaagacaatagcttgggaccttctgcagaaggaaatcttggagaagatgaagtatttcttgaggcccacggtttgcattcaggtgtgtccattcagcttgcgtgtggtcagtgttgttggaataacatatttgctgccccaggaggagcagcccttgtgccacccaatagtagaaagggcattaaaatcttgtggaccaggtggcactgctcatgtgaaattagtagtcgagtgggacaaggagacaagagatttcttatttgtaaatactgaggatgagtatattcctgatgcagaaagtgttcgtctgcaaagggagcgtcatcatcagcctcaaacctgcactttatcccagtgtttccaactgtacaccaaagaggagcggcttgcccccgatgatgcctggcgttgcccacactgtaagcagctgcagcagggaagcattacgttaagcctctggactctgcctgatgtgcttattatacatctaaagagatttcggcaggaaggagacaggcgcatgaaacttcagaacatggtcaaattccccttgactggcctggacatgacacctcacgtggttaagaggagccagagcagctggagtttgccatcgcattggtccccgtggagacggccctatggactcgggagggaccctgaggactacatctatgacctgtatgctgtgtgcaatcaccatggcaccatgcaaggggggcactacacagcgtactgtaagaactctgtggacggcctctggtactgcttcgatgacagcgatgtgcagcagctgtcagaagatgaggtctgcacgcagacagcatacatcctcttctaccagaggcggacagccatcccgtcatggtcagccaacagctcggtggcaggctccacaagttcttccctgtgtgaacactgggtgagccggctcccgggcagcaagccagccagcgtgacctctgcagcttcctccagacgcacctccctggcgtcgctctctgagtccgtggagatgactggagaaaggagtgaagatgatggaggcttttcaactcgaccatttgtgagaagtgtccagcgtcagagtttgtcatccagatcttctgtcaccagccccttggccgtcaatgaaaattgcatgagaccttcatggtccctgtctgctaagctgcagatgcgctccaattctccatcccgattttcaggggattcgccaattcacagctctgcttccaccttggagaagattggggaggcagcagatgacaaggtctccatctcttgctttggtagcttgcggaacctttctagcagttaccaggaaccaagcgacagtcatagtcgccgtgagcacaaggctgtgggccgggcccctctggctgtcatggaaggcgtgttcaaagacgaatcggacacccgcagattgaactccagtgtcgtagatacacagagcaaacattcagcacaaggggaccgcctgcccccgctctctggtccatttgataacaataatcagatcgcttatgtggatcagagcgactccgtagacagctctccagtcaaagaggtgaaagcccccagccacccaggctcactcgcaaagaaaccagagagcacaactaagagatcccccagttccaaaggcacttctgagccagagaaaagcttgcggaaggggagaccagccttggcaagccaggagtcatccctttcaagtacatccccttcttctcctcttcctgtaaaagtctctctaaagccctcccgctcccgcagcaaagcagattcttcttccaggggcagtggacggcattcatcccctgcccctgcccaacccaaaaaggagtcatccccgaaatctcaggactccgtgtcatctccttcgccacagaagcagaagtcagcctcggccctcacctacactgcttcctccacatctgccaaaaaggcctcgggccctgccacaaggagccctttcccacctgggaagagcaggacttcagaccacagcttgagtagagagggctccagacaaagcttgggttctgacagagccagcgccacctccacctccaaacccaattcccctcgggtgagccaggcccgagcaggggagggcaggggggccgggaagcacgtgcggagctcctccatggccagcctgcgctcccccagcacaagcatcaagtctggtttgaagagggacagcaagtctgaggacaaggggctgtccttcttcaaatcagccttgagacagaaggaaacccggcgctcgacggatcttggcaagacagccttgctctctaaaaaggctggtgggagctctgttaagtctgtctgtaagaacaccggggacgacgaggcagagagaggccaccagcctccagcttcccagcagccaaatgcaaatacaacgggaaaagagcagcttgtcaccaaggaccctgcttctgccaaacattccctgctgtccgctcgcaaatccaagtcttcccaactagactctggagttccctcgtctccgggtggcaggcagtctgcagagaaatcctcaaaaaagttatcttctagcatgcaaacctctgcacggccttctcaaaaacctcagtgatatttctgcaatcaaagtgttttatctgtaaagatgtttatttatttagaacccctgccctcccaccaaagcctcctgtgcttttgttttgtacttttttgagtcacgtgcccgactgtgtgtgtgtgtgtgagtgtatgcgtgtgtgtgtctaattcaattgcaaattgttcaaagcgtcgccttattctgccattgaaccaaataacagccataggcaaaacattgacaccaagctaactggaataattgtagacgatacccaggacggtccctttagcaattgtacatatttctttctagagaactctaatgactttctttggatatgagggttttgaaacctgtgaaccagaaaagctaccattagtgcgtagaaggaggaaggagctgactcgtgtttcttctgagcaggacttgtccttactgtggattgtgggtggcaccaggagctctaaaaactgtgactctaacaacgaaacaaatcgagggaaaaactcttgctttctgcactttcgccccatctaccagtctttgtaaagggcaatattttaacactaatgtttctcaggtatatactcagctagtctaggatggttgcacaccagtaaatggattaaagaggaaggtgccatgtgggtgactgtgtcatttctcctactgccacagatagacattttcgaggtagaaatgaagcctttcaccaccttcctatctgtggtgacatgtgcaccaaaacctgtcttgactcttgggataggtcctaggaagtggcagattggatagccagaaagccagtcactcgtttaattttttttccttctgaaattactagctaaggctcttggaattttgcactgtagtagagcagttaacacctttgacagattcctggaaaaaacttctagattctaaactgggtgaaagactggacatcattttccttgtcaggtgttgcatttttccgttagaggtgggaagctccacgatgccctgtgtctgtgggctcatgttccctcatcttgtagcttggagaggaaagaagttgccttctgccaaaagccaatggtggtatgttgaagcgttgtgtgatcaagtgttacatatgcacttcagatcctgtctgtcagtctctgttagggctgcctttcagtaactcatttattatttcttctttgttcttaagatttcatctcatgcccagaactcacaagcaggttttggagtgtgttccatctggccgtgtcagtgcaaattgcatttcttacaaaggagaacctcaccaaaaaaaacctcacagataagcaaagtatatagttttgcaagctttttcaaggtctcctggcaatactttcctgctcaatttttagcttttcttttttttttaaatgtcaagagagtgaaggtcttgattctctctgaatagcatttgtcactttgccagtaaatacagcatgctaagtttatgtgcttttaaatattagcgtttttcgtcagactcttcaagttcttcttgaacccttggtgcacagatccatatataacctcccttttcagtattgctgtgtgtgaattaactacaacacatatgcatgcatagctgtgaattctgcactactttttttttcttttttccccccaagaatatctcttgggaaaagtttttagtacgttacttaactttattttgctgctaatttgcgcattagccggtaacttgcaagtctggagaccacttactgttgagggtagctggaattttagacccttggcagtatttaagatttagacatttagccttgtgaaagttaccacagtgctccatgtgattcattgactgtgagcctgttgtccattgcactcagccctgtactcacttcttcactcgctgtcctggttttactgttcagattttggtgggttctcaaagcagtaccactctcatctgctcagtacatctgcggcaactggctgccttcgatgctgtcattgcgttcagcccagcacatcacagccccatcagtgtgtagccaccgctctcgtttttctgtatcgcttttatctcctgaaaaagatgcaccaaataagagatcatctatatcaggaattgaatgtctaactcaaacctctcatttttgtttaataggtagatctcatttgaagtctcctatctgaatctctgaaacaattatagtttgattagacaaaggtttttaataacacttcttttttgctgtagtcaagcattaatagaaactagtttaattttcacagtggtaaatatttttattcttgagttatctaggaatggattttccacgatgtctagtgacttaaaaaaaaaaaggaaaaacgtttctacaaatccctttggttttccatgggatctggaataaaatgtcagtgtctataaactgtatgtcatggagtttagtccttgtttcaggtttaatagaaaaaatcaggaagtatcatggcattgtctagacatcatgaagctattttatttccatagttggtaaacagtgaaaatttcattatctccaactactaggtacaactttaggccacaggaaaggttatttggcccgaaagtttggaggtgctccttgaggtgggaagtatcttgtgggaaagtagttacttgattcaatttagttcattggtagggttggggacttggtgttggtttctttctttcttttctttttttttttttttttaattttcccagcaatatttagcacaatgagcgtgtatgtgctttggggttaaaaattatctgctagggatgataggcctgggtttctcgttgacatctagatgggcctgattagagcagtcatctcctggtaggcacaaaataatcaccaacagtaatgttgtatctgtaatgtttgtttgctttttaaagttttattcttgatttcttgtaaacatccattgcactgaggccgtatcattccttaagacagccctacatcttgccttggtaatcccttagataatgtggaaactcaaaccgttaggctccagtcatcttagaccatttcccatccgttttgtattttctcgtcctgaaagcagctgaactgaaagtaagtaataatatgctggaccagtgggaacggatgtgggagtatttgtggtgtgctaaaatactgtaattatctgtgaggctgcctgacacgcttttgcaatcttgttttcatcattcattctgcaaacgtttatggagggccttctttgagcacagaggcaaaactgaaagcttcagggatttgctgtagctgaggagccctgggagcacagcccatcaagcaagggatgtgatggtgtcctaaatggagtgacagttctcctgggaaaagagatcacgtggattccggtcaaatcggctaaggcttgtggttctcttgagcaagtctgttccttctggaaaccaaaagtgcccttcatctttagagacattttactcttccatccaccttttcagactgagctgtctctactatttaggggttgaaaatccattacacagtcactttacgttaacattgggtcatcttatgtttgtatgagacggatgtgggatttgaggggaacattgtcattcccttaaaataactatcatgaaaaaaatagcaacagtatgtaaagggaccaagagtggcagcctttagggaaaatggagcagagaagagctgtgaacaaagctcatttatttgaaataagcgtgctttatttcacatagaggggcatcagacgttacatttcattcggacaaattactgaacagccgaagtgattgtttccaatgtaggttattataattattggatacaaagatttaactagtgtttctgggttggatttttgaaatagtatgcaagtcataagcacagtttcaataaaacacgtattctggaggtgcgtggaactttgtattatttgtagttgagaaaggcaaactttgctgacaaaccagtacctatcacaaacgaacacaaaaagtagctgttactgtgcaggctgtctttaactttcatttcataaagggtacattattgttaaactctactacatggtttggggagaaatccagtggttttatttaaatgaacactctcacactgccttttgatcaactttcaaagtattttgcagatgcattttgagcatgaccatttttttccccaagtaaaaacaattgtgcgtggcctccatataactcagaaagcatgctcttactacctatgcaagcaaacaataaaacatatagacatgaaatgttaagtcttaaaaaaaaaaggcaacaattatggagctctatttttaaatttgtgattttcaaaatatggcttactcatcattgtgtagaagagcatgaatgcgatttcttgttttgctctgcatatatttctctgctgtttttctgatcattggcgagattgtaaagtattttgcaagcagaagtggaattggatatgttgaacacacatcattggtgtacatactgtatttagcctgaagactttcctaaagtgttttgttctaaaaataacctgccattttctatagattttaattttttatatcttcaagggttctattttggtcacaaggaaagaatgtggcttctaatagtgctaagaattaaaagatgcttttatagagacttagagctattttgaaaagctttggggcttcccagccactgatcacaattagactaagcccatggaatttctgggagtgttgtgcagtggattcggttctagatccatcttacatttgtttagtgtttcccaatttttgggagaaggggtgcacagcaaatttgagagacttttttgaatctcacacatgtattttcctcaagattcttttaagcctcttctgaatgacttgtctgagatagtgaagacccacattaactagaatcagctggggaactttaaaaaatacagtgcctgggtcccagtccctagcttttgatctaattcatgtaggggtgggatccaggaattaccatgtattttaaaagcttctgggtgtttctaatttgcagacagattgagaaccactatgatacgtcatccctttactgagaattatggcgagaatcactgccatttgaattactcaggagtgactgattcctcagttgtgtaggagaagcagaaaaaataagaataaaaagaattgagagatactgatatcaaactcccatttgaaatacaagggcccttctgattcaaggcccagttggggagcttggaccatgttgtgaatggcctagcactcgccagtctggtggaaattggtggtcttagttgctggagcaggctgagtgtccccgcggggtttgcatctgtccccagaaccttttccccaggcccgtgggggaatagggaagtcactctgagctagaaattgtcgaagaagaaaagaaacaaccttcctagccttggaaagcctgtccctgcttttgatagaattattgcctttttgtaggaattacagtagcaaaccccaggctgccgctgaatttcctacttttgctcattctctaggatagttcttatccagaatgtggtttcaggaattcttttttttagtttgaaaatgaatgtgaaacattttctttggtgtcttttttttaaaaaaaaaaaacccttattgctattttttcgtgtttttgttttgttttgttttttgtttgttttaccattaagtaatacacatcccagaatttggcactctgtgttaactgtggaggcaaataaaatttagttttaatctgtggtgagctgaatgcactacaacaccttcgaagtaatctgatggtttcattctgtcgagcctcatgctgcctacaaaacaccacaatttacctggtgttttcaacattttaaggaatgaagatacaagtagacatgcaagttggaaatgtttctttagaaaggccatccagaataatgatatctgttgcagtcgtccaaatgcaatatgaaatttcctaggtgctattataaacggtgtggtgtcataccaaatgcaaaagcagttacagtatttccgaagttggagttctctttgtaggcctttcaaatacgtgtttgcattccatagaggtctgctcaccaactgtgcctctcaccactggttaaaattgaatttaagcctcattgacataagtcgtttcttgattgaactcttcagtttttacactggaatttctgtagttgtcttgaaagctgcatgtcacatcactgtacacaaagtgctttggtattactcatgcaccgtggatagtgatttctgtgtcgttttcattttcagttgtacagtaatatggaaggcaggatgtctttcctagaggctggaagaaaagtgtatcgtacattttaaatttattttagaacaagtgcatgagatgtgtcactgatttctgttatttatttgtatgttttattattcaaagtgtatgcacttttaagaagcagaatttatatttttacgtttgaaacgttttatttctgaaacagcgttgattatatagtatacagttggaattaagagaaaagtggaaaatgtaacaaaatacaataaatttattacaagatgtcctcttcaa

SEQ ID NO: 7999 - DNA, 2676 bp, Homo sapiens
caagcttataacaccctttgatatatccttgcaggatgactgggtttgtgaactcttaagttttcgtctgtttttgctgctacttgaatgttctttatttctagctcaggcttagaatttggactgaaagaagtcctcctgcgttcatgagctcatgtgttctcagtctgccagggaacttccatggagcctggtttgtgctcctccctgagggaagcagggcaggatagggcttcaagtgcaagccaaggacttgataagcctgaaatgagctgggctcctgcctttcaccagctgcacgaccttgggcaagcagattaatctttttcaacctctggaaattgggagtaataagagaacaaatctgaggattaaatgagatgcttggcacataataagtgttacatattatatttatctgctatcatatcattatattgttatttctattcatattatttgctatttctaatagacactaaaatgttgcaacacactgaactcagggtttcttcaccctggcaccattttggtcggacagttttgtcttgcagggggctgtcctgtgcattatagaatgtttagcagcatccgtggcctctacccactagatgccagtagcacctctcccttgagttgtgacaatcaaaaacatctccattcattgccaaatcccactccccccgccacagacacagttccctggttgagacccattggtttaaataagtatgtgttttctaagatgaactggaactgcatctacttggaatggtttggaatttctcaagatattttgctcgagtgtgatacagaatttagaatttttttttaatctctttctgtgttgctatacgcagccttaaaacgttcttgagttaattagatgagccaaagagatggtgtctgtgggtcgcatgaagtggctggtgcagcctcccctggtgctgatggcgggctctctttggcagcgtactgtaagaactctgtggacggcctctggtactgcttcgatgacagcgatgtgcagcagctgtcagaagatgaggtctgcacgcagacagcatacatcctcttctaccagaggcggacagccatcccgtcatggtcagccaacagctcggtggcaggctccacaagttcttccctgtgtgaacactgggtgagccggctcccgggcagcaagccagccagcgtgacctctgcagcttcctccagacgcacctccctggcgtcgctctctgagtccgtggagatgactggagaaaggagtgaagatgatggaggcttttcaactcgaccatttgtgagaagtgtccagcgtcagagtttgtcatccagatcttctgtcaccagccccttggccgtcaatgaaaattgcatgagaccttcatggtccctgtctgctaagctgcagatgcgctccaattctccatcccgattttcaggggattcgccaattcacagctctgcttccaccttggagaagattggggaggcagcagatgacaaggtctccatctcttgctttggtagcttgcggaacctttctagcagttaccaggaaccaagcgacagtcatagtcgccgtgagcacaaggctgtgggccgggcccctctggctgtcatggaaggcgtgttcaaagacgaatcggacacccgcagattgaactccagtgtcgtagatacacagagcaaacattcagcacaaggggaccgcctgcccccgctctctggtccatttgataacaataatcagatcgcttatgtggatcagagcgactccgtagacagctctccagtcaaagaggtgaaagcccccagccacccaggctcactcgcaaagaaaccagagagcacaactaagagatcccccagttccaaaggcacttctgagccagagaaaagcttgcggaaggggagaccagccttggcaagccaggagtcatccctttcaagtacatccccttcttctcctcttcctgtaaaagtctctctaaagccctcccgctcccgcagcaaagcagattcttcttccaggggcagtggacggcattcatcccctgcccctgcccaaacccaattcccctcgggtgagccaggcccgagcaggggagggcaggggggccgggaagcacgtgcggagctcctccatggccagcctgcgctcccccagcacaagcatcaagtctggtttgaagagggacagcaagtctgaggacaaggggctgtccttcttcaaatcagccttgagacagaaggaaacccggcgctcgacggatcttggcaagacagccttgctctctaaaaaggctggtgggagctctgttaagtctgtctgtaagaacaccggggacgacgaggcagagagaggccaccagcctccagcttcccagcagccaaatgcaaatacaacgggaaaagagcagcttgtcaccaaggaccctgcttctgccaaacattccctgctgtccgctcgcaaatccaagtcttcccaactagactctggagttccctcgtctccgggtggcaggcagtctgcagagaaatcctcaaaaaagttatcttctagcatgcaaacctctgcacggccttctcaaaaacctcagtgatatttctgcaatcaaagtgttttatctgtaaagatgtttatttatttagaacccctgccctccc

SEQ ID NO: 8000 - DNA, 10831 bp, Homo sapiens
atgagaaggaaaaactcttactatgtgtggcaaatttttcaaattcagtttcccttatatactgcttacaagcataatactcaccctactattgaggatatatcaactcaagaaagtaacatattaggggcattctgtgatatgaatgatgtagaagtaccattgcatttgcttcgttatgtatgtttgttttgtgggaaaaatggcctttctctcatgaaggattgctttgaatatggaactcctgaaactttgccatttcttatagcacatgcgtttattacagttgtgtctaatattagaatatggctacatattcccgctgtcatgcagcacattataccttttaggacctatgttattaggtatttatgcaagctctcggatcaggagttacgacagagtgcagctcgtaacatggctgacttaatgtggagcacagtcaaagaaccattggatacaacattatgctttgataaagaaagcctagatcttgcatttaagtactttatgtcacctactttgactatgaggttggctggattgagtcagataacaaatcaactccataccttcaatgatgtgtgcaataatgaatcattagtatcggacacagaaacgtccattgcaaaagaacttgcagactggcttattagcaacaatgtggtggagcatatatttggaccaaatttacatattgagattatcaaacagtgccaagtgattttgaattttttggcagcagaagggcgactgagtactcaacatattgactgtatttgggctgcagcacagttgaaacattgtagtcggtatatacatgacttatttccttcactcatcaagaatttggatcccgtaccacttagacatctacttaatctggtctcagctcttgagccaagtgttcatactgaacagacactgtacttggcatccatgttaattaaagcactgtggaataacgcactagcagctaaggctcagttatctaaacagagttcttttgcatctttattaaatactaatattcccattggaaataagaaagaggaagaagagcttagaagaacagctccatcaccttggtcacctgcagctagtcctcaaagcagtgataatagcgatacacatcaaagtggaggtagtgacattgaaatggatgagcaacttattaatagaaccaaacatgtgcaacaacgactttcagacacagaggaatccatgcagggaagttctgacgaaactgccaacagtggtgaagatggaagcagtggtcctggtagcagtagtgggcatagtgatggatctagcaatgaggttaattctagccacgcaagccagtcagctgggagccctggcagtgaggtacagtcagaagacattgcagatattgaagccctcaaagaggaagatgaagacgatgatcatggtcataatcctcccaaaagcagttgtggtacagatcttcggaatagaaagttagagagtcaagcaggcatttgcctgggggactcccaaggcatgtcagaaagaaatgggacaagcagcggaacaggaaaggacctggtttttaacactgaatcattgccatcagtagataatcgaatgcgaatgctggatgcttgttcacactctgaagacccagaacatgatatttcaggggaaatgaatgctactcatatagcacaagggtctcaggagtcttgtatcacacgaactggggacttccttggggagactattgggaatgaattatttaattgtcgacaatttattggtccacagcatcaccaccaccaccaccaccatcaccaccaccacgatgggcatatggttgatgatatgctaagtgcagatgatgtcagttgtagtagctcccaggttagtgcaaaatcagaaaaaaatatggctgattttgatggtgaagaatctggatgtgaagaggagctagttcagattaattcacatgcggaactgacatctcacctccaacaacatcttcccaatttagcttccatttaccatgaacatcttagtcaaggacctgtagttcataaacatcaattcaacagtaatgctgttacagacattaatttggataatgtttgcaagaaaggaaatactttgttgtgggatatagtccaagatgaagatgcagttaatctttctgaaggattaataaatgaagcagagaaacttctttgttcgttagtatgttggtttacagatagacaaattcgaatgagattcattgaaggttgccttgaaaacttgggaaacaacagatcagtagtaatttcacttcgtcttcttccaaaactatttggtacttttcagcagtttgggagcagttacgatacacactggataacaatgtgggcagaaaaagaactgaacatgatgaagcttttctttgataatttggtatactacattcaaactgtgagagaaggaagacaaaaacatgcactgtacagccatagtgctgaagttcaagttcgtcttcaattcttgacttgtgtattttcaactctgggatcacctgatcatttcaggttaagtttagagcaagttgacatcttatggcattgtttagtagaagattctgaatgttatgatgatgcactccattggtttttaaatcaagttcgaagtaaagatcaacatgctatgggtatggaaacctacaaacatcttttcctggagaagatgccccagctaaaacctgaaacaattagcatgactggcttaaacctgtttcagcatctctgtaacttggctcgattggctaccagtgcctatgatggttgttcaaattctgagctgtgtggtatggaccaattttggggcattgctttaagagcacaatctggtgatgtcagtcgagcagctatccagtatattaactcctattatattaatggtaaaacaggtttggagaaggagcaagaatttattagtaagtgcatggagagtcttatgatagcttctagcagtcttgaacaggaatcacactcaagtctcatggttatagaaagaggactccttatgctgaagacacatctggaagcgtttaggagaaggtttgcatatcatctgagacagtggcaaattgaaggcactggtattagtagtcatttgaaagcactgagtgacaaacagtctctgccgctaagggttgtatgccagccagctggacttcctgacaagatgactattgaaatgtatcctagtgaccaggtagcagatcttagggctgaagtaactcattggtatgaaaatttacagaaagaacaaataaatcaacaagctcagcttcaggagtttggtcaaagcaaccgaaaaggagagtttcctggaggcctcatgggacctgtcaggatgatttcatctggacacgagttaacaacagattatgatgaaaaagcacttcatgagcttggttttaaggatatgcagatggtatttgtatctttgggtgcaccaaggagagagcggaaaggggaaggtgttcagctgccagcatcttgcctcccaccccctcagaaggacaacattccaatgcttttgcttttacaagagcctcatttaactactctttttgatttattagagatgcttgcatcatttaaaccaccctcaggaaaagtggcagtggatgatagtgagagcttacgatgtgaagaacttcatcttcatgcagaaaatctgtctaggcgggtctgggagctactgatgcttcttcctacatgtcctaatatgttgatggcattccagaatatctcagatgagcagagtaatgatggatttaattggaaagaacttctcaaaattaagagcgcccacaagctattgtatgctctggaaattattgaagcactgggaaaacctaatagaagaataaggagggagtctacgggaagttacagtgatctttatccagattcagatgattcaagtgaagatcaagtggaaaatagtaaaaattcctggagttgcaagtttgttgctgctggagggcttcaacagttattagaaatttttaattctggaattctagagcctaaagagcaggaatcatggactgtgtggcagctagactgtcttgcttgcttgctgaagttaatatgccagtttgcagtagatccatccgatttggatttagcttatcatgatgtctttgcctggtctggtatagcggaaagccataggaaaagaacctggcctggcaaatcaaggaaggctgctggtgatcatgctaagggtcttcatataccacgattaacagaggtatttcttgttcttgtccaaggaaccagtttgattcagcgacttatgtctgttgcttatacgtatgataatctggctcctagagttttaaaagctcagtctgatcacaggtctagacatgaagtttcacattattcaatgtggctcttggtgagttgggctcattgctgttctttagtgaaatctagccttgctgatagcgatcatttacaagattggctaaagaaattgactctccttattcctgagactgcagttcgtcatgaatcatgcagtggtctctataagttatccctgtcagggctggatggaggagactcaatcaatcgttcttttctgctattggctgcctcaacattattgaaatttcttcctgatgctcaagcactcaaacctattaggatagatgattatgaggaagaaccaatattaaaaccaggatgtaaagagtatttttggttgttatgcaaattagttgacaacatacatataaaggacgctagtcagacaacgctcctcgacttagatgccttggcaagacatttggctgactgtattcgaagtagggagatccttgatcatcaggatggtaatgtagaagatgatgggcttacaggactcctaaggcttgcaacaagtgttgttaaacacaaaccaccctttaaattttcaagggaaggacaggaatttttgagagatatcttcaatctcctgtttttgttgccaagtctaaaggaccgacaacagccaaagtgcaaatcacattcttcaagagctgccgcttacgatttgttagtagagatggtaaaggggtctgttgagaactacaggctaatacacaactgggttatggcacaacacatgcagtcccatgcaccttataaatgggattactggcctcatgaagatgtccgtgctgaatgtagatttgttggccttactaaccttggagctacttgttacttagcttctactattcagcaactttatatgatacctgaggcaagacaggctgtcttcactgccaagtattcagaggatatgaagcacaagaccactcttctggagcttcagaaaatgtttacatatttaatggagagtgaatgcaaagcatataatcctagacctttctgtaaaacatacaccatggataagcagcctctgaatactggggaacagaaagatatgacagagttttttactgatctaattaccaaaatcgaagaaatgtctcccgaactgaaaaataccgtcaaaagtttatttggaggtgtaattacaaacaatgttgtatccttggattgtgaacatgttagtcaaactgctgaagagttttatactgtgaggtgccaagtggctgatatgaagaacatttatgaatctcttgatgaagttactataaaagacactttggaaggtgataacatgtatacttgttctcattgtgggaagaaagtacgagctgaaaaaagggcatgttttaagaaattgcctcgcattttgagtttcaatactatgagatacacatttaatatggtcacgatgatgaaagagaaagtgaatacacacttttccttcccattacgtttggacatgacgccctatacagaagattttcttatgggaaagagtgagaggaaagaaggttttaaagaagtcagtgatcattcaaaagactcagagagctatgaatatgacttgataggagtgactgttcacacaggaacggcagatggtggacactattatagctttatcagagatatagtaaatccccatgcttataaaaacaataaatggtatctttttaatgatgctgaggtaaaaccttttgattctgctcaacttgcatctgaatgttttggtggagagatgacgaccaagacctatgattctgttacagataaatttatggacttctcttttgaaaagacacacagtgcatatatgctgttttacaaacgcatggaaccagaggaagaaaatggcagagaatacaaatttgatgtttcgtcagagttactagagtggatttggcatgataacatgcagtttcttcaagacaaaaacatttttgaacatacatattttggatttatgtggcaattgtgtagttgtattcccagtacattaccagatcctaaagctgtgtccttaatgacagcaaagttaagcacttcctttgtcctagagacatttattcattctaaagaaaagcccacgatgcttcagtggattgaactgttgacgaaacagtttaataatagtcaggcagcttgtgagtggtttttagatcgtatggctgatgacgactggtggccaatgcagatactaattaagtgccctaatcaaattgtgagacagatgtttcagcgtttgtgtatccatgtgattcagaggctgagacctgtgcatgctcatctctatttgcagccaggaatggaagatgggtcagatgatatggatacctcagtagaagatattggtggtcgttcatgtgtcactcgctttgtgagaaccctgttattaattatggaacatggtgtaaaacctcacagtaaacatcttacagagtattttgccttcctttacgaatttgcaaaaatgggtgaagaagagagccaatttttgctttcattgcaagctatatctacaatggtacatttttacatgggaacaaaaggacctgaaaatcctcaagttgaagtgttatcagaggaagaaggggaagaagaagaggaggaagaagatatcctctctctggcagaagaaaaatacaggccagctgcccttgaaaagatgatagctttagttgctcttttggttgaacagtctcgatcagaaaggcatttgacattatcacagactgacatggcagcattaacaggaggaaagggatttcccttcttgtttcaacatattcgtgatggcatcaatataagacaaacttgtaatctgattttcagcctgtgtcgatacaataatcgacttgcagaacatattgtatctatgcttttcacatcaatagcaaagttgactcctgaggcagccaatcctttctttaagttgttgactatgctaatggagtttgctggtggacctccaggaatgcctccctttgcatcttatattctgcagaggatatgggaggtgattgaatacaatccttctcagtgtctagattggttggcagtgcagacaccccgaaataaactggcacacagctgggtcttacagaatatggaaaactgggtcgagcggtttcttttggctcacaattatcctagagtgaggacttctgcagcttatcttctggtgtcccttataccaagcaattcattccgtcagatgttccggtcaacaaggtctttgcacatcccaacccgtgaccttccactcagtccagacacaacagtagtcctacatcaggtctacaacgtgctccttggtttgctctcaagagccaaactttatgttgatgctgctgttcatggcactacaaagctagtgccctattttagctttatgacttactgtttaatttccaaaactgagaagctgatgttttccacatatttcatggatttgtggaaccttttccagcctaaactttctgagccagcaatagctacaaatcacaataaacaggctttgctttcattttggtacaatgtctgtgctgactgtccagagaatatccgccttattgttcagaacccagtggtaaccaagaacattgccttcaattacatccttgctgaccatgatgatcaggatgtggtgctttttaaccgtgggatgctgccagcgtactatggcattctgaggctctgctgtgagcagtctcctgcattcacacgacaactggcttctcaccagaacatccagtgggcctttaagaatcttacaccacatgccagccaataccctggagcagtagaagaactgtttaacctgatgcagctgtttatagctcagaggccagatatgagagaagaagaattagaagatattaaacagttcaagaaaacaaccataagttgttacttacgttgcttagatggccgctcctgctggactactttaataagtgccttcagaatactattagaatctgatgaagacagacttcttgttgtatttaatcgaggattgattctaatgacagagtctttcaacactttgcacatgatgtatcacgaagctacagcttgccatgtgactggagatttagtagaacttctgtcaatatttctttcggttttgaagtctacacgcccttatcttcagagaaaagatgtgaaacaagcattaatccagtggcaggagcgaattgaatttgcccataaactgttaactcttcttaattcctatagtcctccagaacttagaaatgcctgtatagatgtcctcaaggaacttgtacttttgagtccccatgattttcttcatactctggttccctttctacaacacaaccattgtacttaccatcacagtaatataccaatgtctcttggaccttatttcccttgtcgagaaaatatcaagctaataggagggaaaagcaatattcggcctccgcgccctgaactcaatatgtgcctcttgcccacaatggtggaaaccagtaagggcaaagatgacgtttatgatcgtatgctgctagactacttcttttcttatcatcagttcatccatctattatgccgagttgcaatcaactgtgaaaaatttactgaaacattagttaagctgagtgtcctagttgcctatgaaggtttgccacttcatcttgcactgttccccaaactttggactgagctatgccagactcagtctgctatgtcaaaaaactgcatcaagcttttgtgtgaagatcctgttttcgcagaatatattaaatgtatcctaatggatgaaagaacttttttaaacaacaacattgtctacacgttcatgacacatttccttctaaaggttcaaagtcaagtgttttctgaagcaaactgtgccaatttgatcagcactcttattacaaacttgataagccagtatcagaacctacagtctgatttctccaaccgagttgaaatttccaaagcaagtgcttctttaaatggggacctgagggcactcgctttgctcctgtcagtacacactcccaaacagttaaacccagctctaattccaactctgcaagagcttttaagcaaatgcaggacttgtctgcaacagagaaactcactccaagagcaagaagccaaagaaagaaaaactaaagatgatgaaggagcaactcccattaaaaggcggcgtgttagcagtgatgaggagcacactgtagacagctgcatcagtgacatgaaaacagaaaccagggaggtcctgaccccaacgagcacttctgacaatgagaccagagactcctcaattattgatccaggaactgagcaagatcttccttcccctgaaaatagttctgttaaagaataccgaatggaagttccatcttcgttttcagaagacatgtcaaatatcaggtcacagcatgcagaagaacagtccaacaatggtagatatgacgattgtaaagaatttaaagacctccactgttccaaggattctaccctagctgaggaagaatctgagttcccttctacttctatctctgcagttctgtctgacttagctgacttgagaagctgtgatggccaagctttgccctcccaggaccctgaggttgctttatctctcagttgtggccattccagaggactctttagtcatatgcagcaacatgacattttagataccctgtgtaggaccattgaatctacaatccatgtcgtcacaaggatatctggcaaaggaaaccaagctgcttcttgacattaggtgtagcatgtctacttttaagtccctcacccccaacccccatgctgtttgtataagttttgcttatttgtttttgtgcttcagtttgtccagtgctctctgcttgaatggcaagatagatttataggcttaattcttggtcaggcagaactccagatgaaaaaaacttgcatcttcagtatacttcctaaagggcaatcagataatggatatgttttatgtaattaagagttcactttagtggctttcatttaatatggctgtctgggaagaacagggttgcctagccctgtacaatgtaatttaaacttacagcatttttactgtgtatgatatggtgtcctctgtgccagttttgtaccttatagaggcagattgcctccgatcgctgtggttcttattatcaaaattaagtttacttgtatacggaacaaccacaagaaatttgattctgtaaagaatcctctttagctgtggcctggcagtatataaatggtgctttatttaacagaatacctgtggaggaaataaagcacacttgatgtaaaaataattgttttatttttattgacatgactgattgattgattgctattctgtgcacttaattaaactgattgtgatgacttttcatttgttt

SEQ ID NO: 8001 - DNA, 10582 bp, Homo sapiens
atgagaaggaaaaactcttactatgtgtggcaaatttttcaaattcagtttcccttatatactgcttacaagcataatactcaccctactattgaggatatatcaactcaagaaagtaacatattaggggcattctgtgatatgaatgatgtagaagtaccattgcatttgcttcgttatgtatgtttgttttgtgggaaaaatggcctttctctcatgaaggattgctttgaatatggaactcctgaaactttgccatttcttatagcacatgcgtttattacagttgtgtctaatattagaatatggctacatattcccgctgtcatgcagcacattataccttttaggacctatgttattaggtatttatgcaagctctcggatcaggagttacgacagagtgcagctcgtaacatggctgacttaatgtggagcacagtcaaagaaccattggatacaacattatgctttgataaagaaagcctagatcttgcatttaagtactttatgtcacctactttgactatgaggttggctggattgagtcagataacaaatcaactccataccttcaatgatgtgtgcaataatgaatcattagtatcggacacagaaacgtccattgcaaaagaacttgcagactggcttattagcaacaatgtggtggagcatatatttggaccaaatttacatattgagattatcaaacagtgccaagtgattttgaattttttggcagcagaagggcgactgagtactcaacatattgactgtatttgggctgcagcacagttgaaacattgtagtcggtatatacatgacttatttccttcactcatcaagaatttggatcccgtaccacttagacatctacttaatctggtctcagctcttgagccaagtgttcatactgaacagacactgtacttggcatccatgttaattaaagcactgtggaataacgcactagcagctaaggctcagttatctaaacagagttcttttgcatctttattaaatactaatattcccattggaaataagaaagaggaagaagagcttagaagaacagctccatcaccttggtcacctgcagctagtcctcaaagcagtgataatagcgatacacatcaaagtggaggtagtgacattgaaatggatgagcaacttattaatagaaccaaacatgtgcaacaacgactttcagacacagaggaatccatgcagggaagttctgacgaaactgccaacagtggtgaagatggaagcagtggtcctggtagcagtagtgggcatagtgatggatctagcaatgaggttaattctagccacgcaagccagtcagctgggagccctggcagtgaggtacagtcagaagacattgcagatattgaagccctcaaagaggaagatgaagacgatgatcatggtcataatcctcccaaaagcagttgtggtacagatcttcggaatagaaagttagagagtcaagcaggcatttgcctgggggactcccaaggcatgtcagaaagaaatgggacaagcagcggaacaggaaaggacctggtttttaacactgaatcattgccatcagtagataatcgaatgcgaatgctggatgcttgttcacactctgaagacccagaacatgatatttcaggggaaatgaatgctactcatatagcacaagggtctcaggagtcttgtatcacacgaactggggacttccttggggagactattgggaatgaattatttaattgtcgacaatttattggtccacagcatcaccaccaccaccaccaccatcaccaccaccacgatgggcatatggttgatgatatgctaagtgcagatgatgtcagttgtagtagctcccaggttagtgcaaaatcagaaaaaaatatggctgattttgatggtgaagaatctggatgtgaagaggagctagttcagattaattcacatgcggaactgacatctcacctccaacaacatcttcccaatttagcttccatttaccatgaacatcttagtcaaggacctgtagttcataaacatcaattcaacagtaatgctgttacagacattaatttggataatgtttgcaagaaaggaaatactttgttgtgggatatagtccaagatgaagatgcagttaatctttctgaaggattaataaatgaagcagagaaacttctttgttcgttagtatgttggtttacagatagacaaattcgaatgagattcattgaaggttgccttgaaaacttgggaaacaacagatcagtagtaatttcacttcgtcttcttccaaaactatttggtacttttcagcagtttgggagcagttacgatacacactggataacaatgtgggcagaaaaagaactgaacatgatgaagcttttctttgataatttggtatactacattcaaactgtgagagaaggaagacaaaaacatgcactgtacagccatagtgctgaagttcaagttcgtcttcaattcttgacttgtgtattttcaactctgggatcacctgatcatttcaggttaagtttagagcaagttgacatcttatggcattgtttagtagaagattctgaatgttatgatgatgcactccattggtttttaaatcaagttcgaagtaaagatcaacatgctatgggtatggaaacctacaaacatcttttcctggagaagatgccccagctaaaacctgaaacaattagcatgactggcttaaacctgtttcagcatctctgtaacttggctcgattggctaccagtgcctatgatggttgttcaaattctgagctgtgtggtatggaccaattttggggcattgctttaagagcacaatctggtgatgtcagtcgagcagctatccagtatattaactcctattatattaatggtaaaacaggtttggagaaggagcaagaatttattagtaagtgcatggagagtcttatgatagcttctagcagtcttgaacaggaatcacactcaagtctcatggttatagaaagaggactccttatgctgaagacacatctggaagcgtttaggagaaggtttgcatatcatctgagacagtggcaaattgaaggcactggtattagtagtcatttgaaagcactgagtgacaaacagtctctgccgctaagggttgtatgccagccagctggacttcctgacaagatgactattgaaatgtatcctagtgaccaggtagcagatcttagggctgaagtaactcattggtatgaaaatttacagaaagaacaaataaatcaacaagctcagcttcaggagtttggtcaaagcaaccgaaaaggagagtttcctggaggcctcatgggacctgtcaggatgatttcatctggacacgagttaacaacagattatgatgaaaaagcacttcatgagcttggttttaaggatatgcagatggtatttgtatctttgggtgcaccaaggagagagcggaaaggggaaggtgttcagctgccagcatcttgcctcccaccccctcagaaggacaacattccaatgcttttgcttttacaagagcctcatttaactactctttttgatttattagagatgcttgcatcatttaaaccaccctcaggaaaagtggcagtggatgatagtgagagcttacgatgtgaagaacttcatcttcatgcagaaaatctgtctaggcgggtctgggagctactgatgcttcttcctacatgtcctaatatgttgatggcattccagaatatctcagatgagcagagtaatgatggatttaattggaaagaacttctcaaaattaagagcgcccacaagctattgtatgctctggaaattattgaagcactgggaaaacctaatagaagaataaggagggagtctacgggaagttacagtgatctttatccagattcagatgattcaagtgaagatcaagtggaaaatagtaaaaattcctggagttgcaagtttgttgctgctggagggcttcaacagttattagaaatttttaattctggaattctagagcctaaagagcaggaatcatggactgtgtggcagctagactgtcttgcttgcttgctgaagttaatatgccagtttgcagtagatccatccgatttggatttagcttatcatgatgtctttgcctggtctggtatagcggaaagccataggaaaagaacctggcctggcaaatcaaggaaggctgctggtgatcatgctaagggtcttcatataccacgattaacagaggtatttcttgttcttgtccaaggaaccagtttgattcagcgacttatgtctgttgcttatacgtatgataatctggctcctagagttttaaaagctcagtctgatcacaggtctagacatgaagtttcacattattcaatgtggctcttggtgagttgggctcattgctgttctttagtgaaatctagccttgctgatagcgatcatttacaagattggctaaagaaattgactctccttattcctgagactgcagttcgtcatgaatcatgcagtggtctctataagttatccctgtcagggctggatggaggagactcaatcaatcgttcttttctgctattggctgcctcaacattattgaaatttcttcctgatgctcaagcactcaaacctattaggatagatgattatgaggaagaaccaatattaaaaccaggatgtaaagagtatttttggttgttatgcaaattagttgacaacatacatataaaggacgctagtcagacaacgctcctcgacttagatgccttggcaagacatttggctgactgtattcgaagtagggagatccttgatcatcaggatggtaatgtagaagatgatgggcttacaggactcctaaggcttgcaacaagtgttgttaaacacaaaccaccctttaaattttcaagggaaggacaggaatttttgagagatatcttcaatctcctgtttttgttgccaagtctaaaggaccgacaacagccaaagtgcaaatcacattcttcaagagctgccgcttacgatttgttagtagagatggtaaaggggtctgttgagaactacaggctaatacacaactgggttatggcacaacacatgcagtcccatgcaccttataaatgggattactggcctcatgaagatgtccgtgctgaatgtagatttgttggccttactaaccttggagctacttgttacttagcttctactattcagcaactttatatgatacctgaggcaagacaggctgtcttcactgccaagtattcagaggatatgaagcacaagaccactcttctggagcttcagaaaatgtttacatatttaatggagagtgaatgcaaagcatataatcctagacctttctgtaaaacatacaccatggataagcagcctctgaatactggggaacagaaagatatgacagagttttttactgatctaattaccaaaatcgaagaaatgtctcccgaactgaaaaataccgtcaaaagtttatttggaggtgtaattacaaacaatgttgtatccttggattgtgaacatgttagtcaaactgctgaagagttttatactgtgaggtgccaagtggctgatatgaagaacatttatgaatctcttgatgaagttactataaaagacactttggaaggtgataacatgtatacttgttctcattgtgggaagaaagtacgagctgaaaaaagggcatgttttaagaaattgcctcgcattttgagtttcaatactatgagatacacatttaatatggtcacgatgatgaaagagaaagtgaatacacacttttccttcccattacgtttggacatgacgccctatacagaagattttcttatgggaaagagtgagaggaaagaaggttttaaagaagtcagtgatcattcaaaagactcagagagctatgaatatgacttgataggagtgactgttcacacaggaacggcagatggtggacactattatagctttatcagagatatagtaaatccccatgcttataaaaacaataaatggtatctttttaatgatgctgaggtaaaaccttttgattctgctcaacttgcatctgaatgttttggtggagagatgacgaccaagacctatgattctgttacagataaatttatggacttctcttttgaaaagacacacagtgcatatatgctgttttacaaacgcatggaaccagaggaagaaaatggcagagaatacaaatttgatgtttcgtcagagttactagagtggatttggcatgataacatgcagtttcttcaagacaaaaacatttttgaacatacatattttggatttatgtggcaattgtgtagttgtattcccagtacattaccagatcctaaagctgtgtccttaatgacagcaaagttaagcacttcctttgtcctagagacatttattcattctaaagaaaagcccacgatgcttcagtggattgaactgttgacgaaacagtttaataatagtcaggcagcttgtgagtggtttttagatcgtatggctgatgacgactggtggccaatgcagatactaattaagtgccctaatcaaattgtgagacagatgtttcagcgtttgtgtatccatgtgattcagaggctgagacctgtgcatgctcatctctatttgcagccaggaatggaagatgggtcagatgatatggatacctcagtagaagatattggtggtcgttcatgtgtcactcgctttgtgagaaccctgttattaattatggaacatggtgtaaaacctcacagtaaacatcttacagagtattttgccttcctttacgaatttgcaaaaatgggtgaagaagagagccaatttttgctttcattgcaagctatatctacaatggtacatttttacatgggaacaaaaggacctgaaaatcctcaagttgaagtgttatcagaggaagaaggggaagaagaagaggaggaagaagatatcctctctctggcagaagaaaaatacaggccagctgcccttgaaaagatgatagctttagttgctcttttggttgaacagtctcgatcagaaaggcatttgacattatcacagactgacatggcagcattaacaggaggaaagggatttcccttcttgtttcaacatattcgtgatggcatcaatataagacaaacttgtaatctgattttcagcctgtgtcgatacaataatcgacttgcagaacatattgtatctatgcttttcacatcaatagcaaagttgactcctgaggcagccaatcctttctttaagttgttgactatgctaatggagtttgctggtggacctccaggaatgcctccctttgcatcttatattctgcagaggatatgggaggtgattgaatacaatccttctcagtgtctagattggttggcagtgcagacaccccgaaataaactggcacacagctgggtcttacagaatatggaaaactgggtcgagcggtttcttttggctcacaattatcctagagtgaggacttctgcagcttatcttctggtgtcccttataccaagcaattcattccgtcagatgttccggtcaacaaggtctttgcacatcccaacccgtgaccttccactcagtccagacacaacagtagtcctacatcaggtctacaacgtgctccttggtttgctctcaagagccaaactttatgttgatgctgctgttcatggcactacaaagctagtgccctattttagctttatgacttactgtttaatttccaaaactgagaagctgatgttttccacatatttcatggatttgtggaaccttttccagcctaaactttctgagccagcaatagctacaaatcacaataaacaggctttgctttcattttggtacaatgtctgtgctgactgtccagagaatatccgccttattgttcagaacccagtggtaaccaagaacattgccttcaattacatccttgctgaccatgatgatcaggatgtggtgctttttaaccgtgggatgctgccagcgtactatggcattctgaggctctgctgtgagcagtctcctgcattcacacgacaactggcttctcaccagaacatccagtgggcctttaagaatcttacaccacatgccagccaataccctggagcagtagaagaactgtttaacctgatgcagctgtttatagctcagaggccagatatgagagaagaagaattagaagatattaaacagttcaagaaaacaaccataagttgttacttacgttgccaagcattaatccagtggcaggagcgaattgaatttgcccataaactgttaactcttcttaattcctatagtcctccagaacttagaaatgcctgtatagatgtcctcaaggaacttgtacttttgagtccccatgattttcttcatactctggttccctttctacaacacaaccattgtacttaccatcacagtaatataccaatgtctcttggaccttatttcccttgtcgagaaaatatcaagctaataggagggaaaagcaatattcggcctccgcgccctgaactcaatatgtgcctcttgcccacaatggtggaaaccagtaagggcaaagatgacgtttatgatcgtatgctgctagactacttcttttcttatcatcagttcatccatctattatgccgagttgcaatcaactgtgaaaaatttactgaaacattagttaagctgagtgtcctagttgcctatgaaggtttgccacttcatcttgcactgttccccaaactttggactgagctatgccagactcagtctgctatgtcaaaaaactgcatcaagcttttgtgtgaagatcctgttttcgcagaatatattaaatgtatcctaatggatgaaagaacttttttaaacaacaacattgtctacacgttcatgacacatttccttctaaaggttcaaagtcaagtgttttctgaagcaaactgtgccaatttgatcagcactcttattacaaacttgataagccagtatcagaacctacagtctgatttctccaaccgagttgaaatttccaaagcaagtgcttctttaaatggggacctgagggcactcgctttgctcctgtcagtacacactcccaaacagttaaacccagctctaattccaactctgcaagagcttttaagcaaatgcaggacttgtctgcaacagagaaactcactccaagagcaagaagccaaagaaagaaaaactaaagatgatgaaggagcaactcccattaaaaggcggcgtgttagcagtgatgaggagcacactgtagacagctgcatcagtgacatgaaaacagaaaccagggaggtcctgaccccaacgagcacttctgacaatgagaccagagactcctcaattattgatccaggaactgagcaagatcttccttcccctgaaaatagttctgttaaagaataccgaatggaagttccatcttcgttttcagaagacatgtcaaatatcaggtcacagcatgcagaagaacagtccaacaatggtagatatgacgattgtaaagaatttaaagacctccactgttccaaggattctaccctagctgaggaagaatctgagttcccttctacttctatctctgcagttctgtctgacttagctgacttgagaagctgtgatggccaagctttgccctcccaggaccctgaggttgctttatctctcagttgtggccattccagaggactctttagtcatatgcagcaacatgacattttagataccctgtgtaggaccattgaatctacaatccatgtcgtcacaaggatatctggcaaaggaaaccaagctgcttcttgacattaggtgtagcatgtctacttttaagtccctcacccccaacccccatgctgtttgtataagttttgcttatttgtttttgtgcttcagtttgtccagtgctctctgcttgaatggcaagatagatttataggcttaattcttggtcaggcagaactccagatgaaaaaaacttgcatcttcagtatacttcctaaagggcaatcagataatggatatgttttatgtaattaagagttcactttagtggctttcatttaatatggctgtctgggaagaacagggttgcctagccctgtacaatgtaatttaaacttacagcatttttactgtgtatgatatggtgtcctctgtgccagttttgtaccttatagaggcagattgcctccgatcgctgtggttcttattatcaaaattaagtttacttgtatacggaacaaccacaagaaatttgattctgtaaagaatcctctttagctgtggcctggcagtatataaatggtgctttatttaacagaatacctgtggaggaaataaagcacacttgatgtaaaaataattgttttatttttattgacatgactgattgattgattgctattctgtgcacttaattaaactgattgtgatgacttttcatttgttt

SEQ ID NO: 8002 - DNA, 11357 bp, Homo sapiens
tctctcccctcccccccgccggtcgggatcagtcagtgtgatccgaagcgggggagggggggggcggcggccgaacgatgtgcgagaactgcgcagacctggtggaggtgttaaatgaaatatcagatgtagaaggtggtgatggactgcagctcagaaaggaacatactctcaaaatatttacttatatcaattcctggacacagaggcaatgtctatgctgcttcaaggaatataagcatttggagatttttaatcaagtagtgtgtgcacttattaacttagtgattgcccaagttcaagtgctccgggaccagctttgtaaacattgtactaccattaacatagattccacgtggcaagatgagagtaatcaagcagaagaaccactgaatatagatagagagtgtaatgaaggaagtacagaaagacaaaaatcaatagaaaaaaaatcaaactctacaagaatttgtaatctgactgaggaggaatcttcaaagagttctgatccttttagtttatggagtacagatgagaaggaaaaactcttactatgtgtggcaaaaatttttcaaattcagtttcccttatatactgcttacaagcataatactcaccctactattgaggatatatcaactcaagaaagtaacatattaggggcattctgtgatatgaatgatgtagaagtaccattgcatttgcttcgttatgtatgtttgttttgtgggaaaaatggcctttctctcatgaaggattgctttgaatatggaactcctgaaactttgccatttcttatagcacatgcgtttattacagttgtgtctaatattagaatatggctacatattcccgctgtcatgcagcacattataccttttaggacctatgttattaggtatttatgcaagctctcggatcaggagttacgacagagtgcagctcgtaacatggctgacttaatgtggagcacagtcaaagaaccattggatacaacattatgctttgataaagaaagcctagatcttgcatttaagtactttatgtcacctactttgactatgaggttggctggattgagtcagataacaaatcaactccataccttcaatgatgtgtgcaataatgaatcattagtatcggacacagaaacgtccattgcaaaagaacttgcagactggcttattagcaacaatgtggtggagcatatatttggaccaaatttacatattgagattatcaaacagtgccaagtgattttgaattttttggcagcagaagggcgactgagtactcaacatattgactgtatttgggctgcagcacagttgaaacattgtagtcggtatatacatgacttatttccttcactcatcaagaatttggatcccgtaccacttagacatctacttaatctggtctcagctcttgagccaagtgttcatactgaacagacactgtacttggcatccatgttaattaaagcactgtggaataacgcactagcagctaaggctcagttatctaaacagagttcttttgcatctttattaaatactaatattcccattggaaataagaaagaggaagaagagcttagaagaacagctccatcaccttggtcacctgcagctagtcctcaaagcagtgataatagcgatacacatcaaagtggaggtagtgacattgaaatggatgagcaacttattaatagaaccaaacatgtgcaacaacgactttcagacacagaggaatccatgcagggaagttctgacgaaactgccaacagtggtgaagatggaagcagtggtcctggtagcagtagtgggcatagtgatggatctagcaatgaggttaattctagccacgcaagccagtcagctgggagccctggcagtgaggtacagtcagaagacattgcagatattgaagccctcaaagaggaagatgaagacgatgatcatggtcataatcctcccaaaagcagttgtggtacagatcttcggaatagaaagttagagagtcaagcaggcatttgcctgggggactcccaaggcatgtcagaaagaaatgggacaagcagcggaacaggaaaggacctggtttttaacactgaatcattgccatcagtagataatcgaatgcgaatgctggatgcttgttcacactctgaagacccagaacatgatatttcaggggaaatgaatgctactcatatagcacaagggtctcaggagtcttgtatcacacgaactggggacttccttggggagactattgggaatgaattatttaattgtcgacaatttattggtccacagcatcaccaccaccaccaccaccatcaccaccaccacgatgggcatatggttgatgatatgctaagtgcagatgatgtcagttgtagtagctcccaggttagtgcaaaatcagaaaaaaatatggctgattttgatggtgaagaatctggatgtgaagaggagctagttcagattaattcacatgcggaactgacatctcacctccaacaacatcttcccaatttagcttccatttaccatgaacatcttagtcaaggacctgtagttcataaacatcaattcaacagtaatgctgttacagacattaatttggataatgtttgcaagaaaggaaatactttgttgtgggatatagtccaagatgaagatgcagttaatctttctgaaggattaataaatgaagcagagaaacttctttgttcgttagtatgttggtttacagatagacaaattcgaatgagattcattgaaggttgccttgaaaacttgggaaacaacagatcagtagtaatttcacttcgtcttcttccaaaactatttggtacttttcagcagtttgggagcagttacgatacacactggataacaatgtgggcagaaaaagaactgaacatgatgaagcttttctttgataatttggtatactacattcaaactgtgagagaaggaagacaaaaacatgcactgtacagccatagtgctgaagttcaagttcgtcttcaattcttgacttgtgtattttcaactctgggatcacctgatcatttcaggttaagtttagagcaagttgacatcttatggcattgtttagtagaagattctgaatgttatgatgatgcactccattggtttttaaatcaagttcgaagtaaagatcaacatgctatgggtatggaaacctacaaacatcttttcctggagaagatgccccagctaaaacctgaaacaattagcatgactggcttaaacctgtttcagcatctctgtaacttggctcgattggctaccagtgcctatgatggttgttcaaattctgagctgtgtggtatggaccaattttggggcattgctttaagagcacaatctggtgatgtcagtcgagcagctatccagtatattaactcctattatattaatggtaaaacaggtttggagaaggagcaagaatttattagtaagtgcatggagagtcttatgatagcttctagcagtcttgaacaggaatcacactcaagtctcatggttatagaaagaggactccttatgctgaagacacatctggaagcgtttaggagaaggtttgcatatcatctgagacagtggcaaattgaaggcactggtattagtagtcatttgaaagcactgagtgacaaacagtctctgccgctaagggttgtatgccagccagctggacttcctgacaagatgactattgaaatgtatcctagtgaccaggtagcagatcttagggctgaagtaactcattggtatgaaaatttacagaaagaacaaataaatcaacaagctcagcttcaggagtttggtcaaagcaaccgaaaaggagagtttcctggaggcctcatgggacctgtcaggatgatttcatctggacacgagttaacaacagattatgatgaaaaagcacttcatgagcttggttttaaggatatgcagatggtatttgtatctttgggtgcaccaaggagagagcggaaaggggaaggtgttcagctgccagcatcttgcctcccaccccctcagaaggacaacattccaatgcttttgcttttacaagagcctcatttaactactctttttgatttattagagatgcttgcatcatttaaaccaccctcaggaaaagtggcagtggatgatagtgagagcttacgatgtgaagaacttcatcttcatgcagaaaatctgtctaggcgggtctgggagctactgatgcttcttcctacatgtcctaatatgttgatggcattccagaatatctcagatgagcagagtaatgatggatttaattggaaagaacttctcaaaattaagagcgcccacaagctattgtatgctctggaaattattgaagcactgggaaaacctaatagaagaataaggagggagtctacgggaagttacagtgatctttatccagattcagatgattcaagtgaagatcaagtggaaaatagtaaaaattcctggagttgcaagtttgttgctgctggagggcttcaacagttattagaaatttttaattctggaattctagagcctaaagagcaggaatcatggactgtgtggcagctagactgtcttgcttgcttgctgaagttaatatgccagtttgcagtagatccatccgatttggatttagcttatcatgatgtctttgcctggtctggtatagcggaaagccataggaaaagaacctggcctggcaaatcaaggaaggctgctggtgatcatgctaagggtcttcatataccacgattaacagaggtatttcttgttcttgtccaaggaaccagtttgattcagcgacttatgtctgttgcttatacgtatgataatctggctcctagagttttaaaagctcagtctgatcacaggtctagacatgaagtttcacattattcaatgtggctcttggtgagttgggctcattgctgttctttagtgaaatctagccttgctgatagcgatcatttacaagattggctaaagaaattgactctccttattcctgagactgcagttcgtcatgaatcatgcagtggtctctataagttatccctgtcagggctggatggaggagactcaatcaatcgttcttttctgctattggctgcctcaacattattgaaatttcttcctgatgctcaagcactcaaacctattaggatagatgattatgaggaagaaccaatattaaaaccaggatgtaaagagtatttttggttgttatgcaaattagttgacaacatacatataaaggacgctagtcagacaacgctcctcgacttagatgccttggcaagacatttggctgactgtattcgaagtagggagatccttgatcatcaggatggtaatgtagaagatgatgggcttacaggactcctaaggcttgcaacaagtgttgttaaacacaaaccaccctttaaattttcaagggaaggacaggaatttttgagagatatcttcaatctcctgtttttgttgccaagtctaaaggaccgacaacagccaaagtgcaaatcacattcttcaagagctgccgcttacgatttgttagtagagatggtaaaggggtctgttgagaactacaggctaatacacaactgggttatggcacaacacatgcagtcccatgcaccttataaatgggattactggcctcatgaagatgtccgtgctgaatgtagatttgttggccttactaaccttggagctacttgttacttagcttctactattcagcaactttatatgatacctgaggcaagacaggctgtcttcactgccaagtattcagaggatatgaagcacaagaccactcttctggagcttcagaaaatgtttacatatttaatggagagtgaatgcaaagcatataatcctagacctttctgtaaaacatacaccatggataagcagcctctgaatactggggaacagaaagatatgacagagttttttactgatctaattaccaaaatcgaagaaatgtctcccgaactgaaaaataccgtcaaaagtttatttggaggtgtaattacaaacaatgttgtatccttggattgtgaacatgttagtcaaactgctgaagagttttatactgtgaggtgccaagtggctgatatgaagaacatttatgaatctcttgatgaagttactataaaagacactttggaaggtgataacatgtatacttgttctcattgtgggaagaaagtacgagctgaaaaaagggcatgttttaagaaattgcctcgcattttgagtttcaatactatgagatacacatttaatatggtcacgatgatgaaagagaaagtgaatacacacttttccttcccattacgtttggacatgacgccctatacagaagattttcttatgggaaagagtgagaggaaagaaggttttaaagaagtcagtgatcattcaaaagactcagagagctatgaatatgacttgataggagtgactgttcacacaggaacggcagatggtggacactattatagctttatcagagatatagtaaatccccatgcttataaaaacaataaatggtatctttttaatgatgctgaggtaaaaccttttgattctgctcaacttgcatctgaatgttttggtggagagatgacgaccaagacctatgattctgttacagataaatttatggacttctcttttgaaaagacacacagtgcatatatgctgttttacaaacgcatggaaccagaggaagaaaatggcagagaatacaaatttgatgtttcgtcagagttactagagtggatttggcatgataacatgcagtttcttcaagacaaaaacatttttgaacatacatattttggatttatgtggcaattgtgtagttgtattcccagtacattaccagatcctaaagctgtgtccttaatgacagcaaagttaagcacttcctttgtcctagagacatttattcattctaaagaaaagcccacgatgcttcagtggattgaactgttgacgaaacagtttaataatagtcaggcagcttgtgagtggtttttagatcgtatggctgatgacgactggtggccaatgcagatactaattaagtgccctaatcaaattgtgagacagatgtttcagcgtttgtgtatccatgtgattcagaggctgagacctgtgcatgctcatctctatttgcagccaggaatggaagatgggtcagatgatatggatacctcagtagaagatattggtggtcgttcatgtgtcactcgctttgtgagaaccctgttattaattatggaacatggtgtaaaacctcacagtaaacatcttacagagtattttgccttcctttacgaatttgcaaaaatgggtgaagaagagagccaatttttgctttcattgcaagctatatctacaatggtacatttttacatgggaacaaaaggacctgaaaatcctcaagttgaagtgttatcagaggaagaaggggaagaagaagaggaggaagaagatatcctctctctggcagaagaaaaatacaggccagctgcccttgaaaagatgatagctttagttgctcttttggttgaacagtctcgatcagaaaggcatttgacattatcacagactgacatggcagcattaacaggaggaaagggatttcccttcttgtttcaacatattcgtgatggcatcaatataagacaaacttgtaatctgattttcagcctgtgtcgatacaataatcgacttgcagaacatattgtatctatgcttttcacatcaatagcaaagttgactcctgaggcagccaatcctttctttaagttgttgactatgctaatggagtttgctggtggacctccaggaatgcctccctttgcatcttatattctgcagaggatatgggaggtgattgaatacaatccttctcagtgtctagattggttggcagtgcagacaccccgaaataaactggcacacagctgggtcttacagaatatggaaaactgggtcgagcggtttcttttggctcacaattatcctagagtgaggacttctgcagcttatcttctggtgtcccttataccaagcaattcattccgtcagatgttccggtcaacaaggtctttgcacatcccaacccgtgaccttccactcagtccagacacaacagtagtcctacatcaggtctacaacgtgctccttggtttgctctcaagagccaaactttatgttgatgctgctgttcatggcactacaaagctagtgccctattttagctttatgacttactgtttaatttccaaaactgagaagctgatgttttccacatatttcatggatttgtggaaccttttccagcctaaactttctgagccagcaatagctacaaatcacaataaacaggctttgctttcattttggtacaatgtctgtgctgactgtccagagaatatccgccttattgttcagaacccagtggtaaccaagaacattgccttcaattacatccttgctgaccatgatgatcaggatgtggtgctttttaaccgtgggatgctgccagcgtactatggcattctgaggctctgctgtgagcagtctcctgcattcacacgacaactggcttctcaccagaacatccagtgggcctttaagaatcttacaccacatgccagccaataccctggagcagtagaagaactgtttaacctgatgcagctgtttatagctcagaggccagatatgagagaagaagaattagaagatattaaacagttcaagaaaacaaccataagttgttacttacgttgcttagatggccgctcctgctggactactttaataagtgccttcagaatactattagaatctgatgaagacagacttcttgttgtatttaatcgaggattgattctaatgacagagtctttcaacactttgcacatgatgtatcacgaagctacagcttgccatgtgactggagatttagtagaacttctgtcaatatttctttcggttttgaagtctacacgcccttatcttcagagaaaagatgtgaaacaagcattaatccagtggcaggagcgaattgaatttgcccataaactgttaactcttcttaattcctatagtcctccagaacttagaaatgcctgtatagatgtcctcaaggaacttgtacttttgagtccccatgattttcttcatactctggttccctttctacaacacaaccattgtacttaccatcacagtaatataccaatgtctcttggaccttatttcccttgtcgagaaaatatcaagctaataggagggaaaagcaatattcggcctccgcgccctgaactcaatatgtgcctcttgcccacaatggtggaaaccagtaagggcaaagatgacgtttatgatcgtatgctgctagactacttcttttcttatcatcagttcatccatctattatgccgagttgcaatcaactgtgaaaaatttactgaaacattagttaagctgagtgtcctagttgcctatgaaggtttgccacttcatcttgcactgttccccaaactttggactgagctatgccagactcagtctgctatgtcaaaaaactgcatcaagcttttgtgtgaagatcctgttttcgcagaatatattaaatgtatcctaatggatgaaagaacttttttaaacaacaacattgtctacacgttcatgacacatttccttctaaaggttcaaagtcaagtgttttctgaagcaaactgtgccaatttgatcagcactcttattacaaacttgataagccagtatcagaacctacagtctgatttctccaaccgagttgaaatttccaaagcaagtgcttctttaaatggggacctgagggcactcgctttgctcctgtcagtacacactcccaaacagttaaacccagctctaattccaactctgcaagagcttttaagcaaatgcaggacttgtctgcaacagagaaactcactccaagagcaagaagccaaagaaagaaaaactaaagatgatgaaggagcaactcccattaaaaggcggcgtgttagcagtgatgaggagcacactgtagacagctgcatcagtgacatgaaaacagaaaccagggaggtcctgaccccaacgagcacttctgacaatgagaccagagactcctcaattattgatccaggaactgagcaagatcttccttcccctgaaaatagttctgttaaagaataccgaatggaagttccatcttcgttttcagaagacatgtcaaatatcaggtcacagcatgcagaagaacagtccaacaatggtagatatgacgattgtaaagaatttaaagacctccactgttccaaggattctaccctagctgaggaagaatctgagttcccttctacttctatctctgcagttctgtctgacttagctgacttgagaagctgtgatggccaagctttgccctcccaggaccctgaggttgctttatctctcagttgtggccattccagaggactctttagtcatatgcagcaacatgacattttagataccctgtgtaggaccattgaatctacaatccatgtcgtcacaaggatatctggcaaaggaaaccaagctgcttcttgacattaggtgtagcatgtctacttttaagtccctcacccccaacccccatgctgtttgtataagttttgcttatttgtttttgtgcttcagtttgtccagtgctctctgcttgaatggcaagatagatttataggcttaattcttggtcaggcagaactccagatgaaaaaaacttgcatcttcagtatacttcctaaagggcaatcagataatggatatgttttatgtaattaagagttcactttagtggctttcatttaatatggctgtctgggaagaacagggttgcctagccctgtacaatgtaatttaaacttacagcatttttactgtgtatgatatggtgtcctctgtgccagttttgtaccttatagaggcagattgcctccgatcgctgtggttcttattatcaaaattaagtttacttgtatacggaacaaccacaagaaatttgattctgtaaagaatcctctttagctgtggcctggcagtatataaatggtgctttatttaacagaatacctgtggaggaaataaagcacacttgatgtaaaaataattgttttatttttattgacatgactgattgattgattgctattctgtgcacttaattaaactgattgtgatgacttttca

SEQ ID NO: 8003 - DNA, 2986 bp, Homo sapiens
cgccgtggagttcctagagcaggcccagcaggtgagcgggctcctggcgcagctgtggcgcgcacagcccgccgccatcctgccctgcctcaaagagctgttcgcagtcatctcctgcgcagaggaggagccaccatctagcgccctggccagcgtggtccagcacctcccattggagctcatggatggtgttgtccggaacctcagcaatgatgacagtgtgacagactcgcagatgctgactgccattagcaggttttctctaagctgctgtaccccatcgtccggggagctgccttgtctgtgctcaagtacatgctcctgaccttccagcactcccacgaagccttccacctgctcctccctcacatcccccccatggtggcctctctggtcaaggaggactcgaactcggggaccagctgcctggagcagctggcggagctggtccactgcatggtgttccggttcccgggcttcccggatctgtatgagcctgtcatggaggccatcaaggacctccatgttcccaatgaggaccgcatcaagcagctgctggggcaggatgcctggacttcgcagaagagcgagctggcgggtttctatccccggctcatggccaagtcagacacgggcaagattggtctcatcaacctgggcaacacatgctatgtcaacagcatccttcaggccttattcatggcgtctgagtagcttcagacattgtgtgctccgcttgactgagaacaactcacagcccctgatgaccaagctgcagtggctctttggcttcctagaacacagccagcggcctgccatttccccagagaacttcctctccgcatcctggacgccctggttcagccctggcacccagcaggactgctcggagtatctgaagtacctgctggatcggctgcacgaagaggagaaaacgggcacaaggatctgccagaaactcaagcagtccagctcgccctctccgcccgaggagcccccggccccaagttcaacctctgtggaaaaaatgtttggaggcaagatagtgactcggatctgctgtctctgctgcctcaacgtctcctcccgggaggaggccttcacggacctctctctcgccttccctcctcctgagcgctgtcgccgccgccgcctgggctctgtgatgcgccccacagaagacatcacagcccgggagttgcccccaccaaccagtgcacaggggccaggcagggtgggtcctcggaggcaaaggaaacactgcatcacagaggacaccccccccaccagcctgtacatcgaaggcctggactccaaggaagctggtgggcagagcagtcaggaggaaaggatagagagggaggaagaagggaaggaggagagaacggagaaggaagaagtgggggaggaggaggaaagcaccagaggggaaggagagagggagaaagaggaggaggtggaagaggaagaagagaaggtggagaaggagacagaaaaggaggctgagcaggaaaaggaagaagacagcctgggagcggggacccacccggatgctgccatcccctccggggagcggacatgtggctctgagggctcccgctccgtcctggacctggttaactacttcctgtcccccgagaagctgacagcagaaaaccgctactactgcgagtcgtgtgcctccctgcaggatgccgagaaggtggtggagctgagccaagggccgtgctacctcatcctcacactgctgcgcttctctttcgacctgcgcaccatgcggcgccgcaagatcctggatgacgtctccatccccctgctgctccgcctgccactggctggtggccgtggccaggcctatgacctctgcagtgtggtggtgcactctggagtgtcttcggagagtggtcactactactgctatgcccgtgagggcgctgcccgccctgccgcttctctgggaactgccgataggccagagcccgagaaccagtggtacctgttcaatgacactcgggtgtccttctcttccttcgaatctgtcagcaacgtcacctccttcttccctaaggacacagcctatgtgctgttttaccggcagcggcccagggaggggcccgaggctgagttgggctcttctagagtccggacagagcccaccctgcacaaggacttgatggaagccatttccaaagacaacatcctttacctacaggagcaggagaaggaggcccggagcagggcggcctacatctctgcactccccacatctccgcactgggggaggggctttgatgaagacaaggatgaggatgaaggctctccagggggctgcaatcctgcaggtggcaatggtggtgacttccacagactggtcttctaatgtgaacctgctgccaacctgaccccttccctccaggagccaggtagggcctgagggaagctgtggaggcaggccctaccaagaggaaggatggtacagctcatggcaccttagtcctcagcctgatgaagggtacacagagattctctcagatatggaagtaagacctaagtccctttcattggggatcagtcccattaaaactttacacccaagtgtcctggttaacttgaagcagccgagatgggcacacacgggtctttgcctccccctccttccctagcaggctccccatgcgggaagatctgatgatgttcaggaaacaggctagacctcagctccaatgttttgacatcaagtactattttccttccgactgctgtacggtataaagcacagcaggatccaagccttgcacaaaggggtggggggggcagtgtctcctctggctgtcctgtttgtttgtttctcatatgggggtggggggtacctgcactgtctgtacctttctgagaagaacagagaccgagacctgcccccttaccaagcgccactgcatggttttgggggggggggcggggggctagcttctcacagcaggaggcc

SEQ ID NO: 8004 - DNA, 4216 bp, Homo sapiens
gcttcatcccgcagccccggggccgcgccgcagagtcgggcttcctggatacatagaggcttgtgccaggcggggtgggaagactggattttgcagtggaagcagcatctcttccgtctgggacctggctgagggcgtccccaccctggggggagcagaggaccagccctgacctagccgggcccagcctcgtcctgcccggcctgagcgccccgcccagcagccggctctggcccaccggggtccgggagcgcgggcgccatggacaagatcttggaggcggtggtgacgtcgtcatacccggtcagcgtgaagcaggggctggttcggcgcgtgctggaggcggcgcggcagccgctggagcgtgagcagtgcctggcgctgctggcgctgggcgcgcgcctctacgtgggcggcgcggaggagctgccgcgccgcgtgggctgccagctgctgcacgtggccggccgccaccaccccgacgtcttcgccgagttcttcagcgcgcgtcgcgtgctgcgcctgctgcagggtggcgccggccccccgggcccccgcgcgctcgcctgcgtgcagctgggtctgcagctgctgcccgaggggcctgcggccgacgaggtgttcgcgctgctgcggcgcgaggtgctgcgcaccgtgtgcgagcgcccgggccccgcggcctgcgcgcaggtggcacggctgctggctcgccacccgcgctgtgtgcccgacggaccccaccgcctgctcttctgccagcagctggtgcgttgcctcggccgcttccgctgcccagccgaaggcgaggagggcgccgtggagttcctagagcaggcccagcaggtgagcgggctcctggcgcagctgtggcgcgcacagcccgccgccatcctgccctgcctcaaagagctgttcgcagtcatctcctgcgcagaggaggagccaccatctagcgccctggccagcgtggtccagcacctcccattggagctcatggatggtgttgtccggaacctcagcaatgatgacagtgtgacagactcgcagatgctgactgccattagcaggatgattgactgggtgtcctggcccctggggaagaatattgacaagtggatcattgcactgctgaagggcctggctgctgttaagaagttcagcatcttgatcgaggtttcgctcaccaaaattgagaaggttttctctaagctgctgtaccccatcgtccggggagctgccttgtctgtgctcaagtacatgctcctgaccttccagcactcccacgaagccttccacctgctcctccctcacatcccccccatggtggcctctctggtcaaggaggactcgaactcggggaccagctgcctggagcagctggcggagctggtccactgcatggtgttccggttcccgggcttcccggatctgtatgagcctgtcatggaggccatcaaggacctccatgttcccaatgaggaccgcatcaagcagctgctggggcaggatgcctggacttcgcagaagagcgagctggcgggtttctatccccggctcatggccaagtcagacacgggcaagattggtctcatcaacctgggcaacacatgctatgtcaacagcatccttcaggccttattcatggcgtctgacttcagacattgtgtgctccgcttgactgagaacaactcacagcccctgatgaccaagctgcagtggctctttggcttcctagaacacagccagcggcctgccatttccccagagaacttcctctccgcatcctggacgccctggttcagccctggcacccagcaggactgctcggagtatctgaagtacctgctggatcggctgcacgaagaggagaaaacgggcacaaggatctgccagaaactcaagcagtccagctcgccctctccgcccgaggagcccccggccccaagttcaacctctgtggaaaaaatgtttggaggcaagatagtgactcggatctgctgtctctgctgcctcaacgtctcctcccgggaggaggccttcacggacctctctctcgccttccctcctcctgagcgctgtcgccgccgccgcctgggctctgtgatgcgccccacagaagacatcacagcccgggagttgcccccaccaaccagtgcacaggggccaggcagggtgggtcctcggaggcaaaggaaacactgcatcacagaggacaccccccccaccagcctgtacatcgaaggcctggactccaaggaagctggtgggcagagcagtcaggaggaaaggatagagagggaggaagaagggaaggaggagagaacggagaaggaagaagtgggggaggaggaggaaagcaccagaggggaaggagagagggagaaagaggaggaggtggaagaggaagaagagaaggtggagaaggagacagaaaaggaggctgagcaggaaaaggaagaagacagcctgggagcggggacccacccggatgctgccatcccctccggggagcggacatgtggctctgagggctcccgctccgtcctggacctggttaactacttcctgtcccccgagaagctgacagcagaaaaccgctactactgcgagtcgtgtgcctccctgcaggatgccgagaaggtggtggagctgagccaagggccgtgctacctcatcctcacactgctgcgcttctctttcgacctgcgcaccatgcggcgccgcaagatcctggatgacgtctccatccccctgctgctccgcctgccactggctggtggccgtggccaggcctatgacctctgcagtgtggtggtgcactctggagtgtcttcggagagtggtcactactactgctatgcccgtgagggcgctgcccgccctgccgcttctctgggaactgccgataggccagagcccgagaaccagtggtacctgttcaatgacactcgggtgtccttctcttccttcgaatctgtcagcaacgtcacctccttcttccctaaggacacagcctatgtgctgttttaccggcagcggcccagggaggggcccgaggctgagttgggctcttctagagtccggacagagcccaccctgcacaaggacttgatggaagccatttccaaagacaacatcctttacctacaggagcaggagaaggaggcccggagcagggcggcctacatctctgcactccccacatctccgcactgggggaggggctttgatgaagacaaggatgaggatgaaggctctccagggggctgcaatcctgcaggtggcaatggtggtgacttccacagactggtcttctaatgtgaacctgctgccaacctgaccccttccctccaggagccaggtagggcctgagggaagctgtggaggcaggccctaccaagaggaaggatggtacagctcatggcaccttagtcctcagcctgatgaagggtacacagagattctctcagatatggaagtaagacctaagtccctttcattggggatcagtcccattaaaactttacacccaagtgtcctggttaacttgaagcagccgagatgggcacacacgggtctttgcctccccctccttccctagcaggctccccatgcgggaagatctgatgatgttcaggaaacaggctagacctcagctccaatgttttgacatcaagtactattttccttccgactgctgtacggtataaagcacagcaggatccaagccttgcacaaaggggtggggggggcagtgtctcctctggctgtcctgtttgtttgtttctcatatgggggtggggggtacctgcactgtctgtacctttctgagaagaacagagaccgagacctgcccccttaccaagcgccactgcatggttttgggggggggggcggggggctagcttctcacagcaggaggcctttgcccccacagcccctccacgcctgcctcagggcctgagaagccaccacttgtatcccccttgtggttagagtcctgattttactgcaaaggtgttcatgttccttgtgaagtgtgggctcttaggaagcctgtgggctcctctgagcagttggcctttgtagctgcaacagcagccacctgcaggttgggtgaagtgccctgacactgctgtagcccccttctaacttctaaccgaagacaagacagacacccatgttcataaataaataaaagtaagcctaagcaaga

SEQ ID NO: 8005 - DNA, 7009 bp, Homo sapiens
cttcggtctcttctccccggctgatcccagcactctccgtgacagcgcctcctgactcagcccaggaccggcttcttctcacgacctgctggagactggacgcccacacctgacccggaactcggaggcgtgcttcctccacccgccggctagcagccccgggccctgagctcccgccgacgccgctggggggcccgacaggcccctcggcgctgatgctgagtgggatcgagggcccggggcggcggcggagtacgggcctctggcgccttaggccagccgcaggtgtcggttcttaggctctccaggctcgctagctcccgccccggcttggatgggtctccctgcgccataaatgtggctgctgaggcggcggtggccgtggcccgtcgcgctgctgctgcggcgctccaagttcatctccgccccggggctctcctgccccacctcggggctgccgccacccgctccttatcccctggccctggccttgcagcgtggcgacaatggacaagatcctggagggccttgtgagttcctcgcatcccctgcccctcaagcgggtgattgtgcggaaggtggtggaatcggcggagcactggctagacgaggcgcagtgcgaggccatgtttgacctgacgacccggctcatcctggagggccaggaccctttccagcggcaggtggggcaccaggtgctggaggcctacgcacgataccaccggccagagttcgagtccttcttcaacaagaccttcgtgttgggcctccttcatcagggctaccactctctggacaggaaggatgtagccatcctggactacattcacaacggcctgaagctgattatgagctgtccgtcggtgctggatctctttagcctcctgcaggtagaggtgttacggatggtgtgtgagaggccggagccgcagctctgtgcccgactgagcgaccttctgaccgactttgtgcaatgcatccccaaggggaaattgtccatcacgttctgtcaacagctggttcgaacgataggccatttccagtgcgtgtccacccaggaaagagagctgcgggaatatgtctcccaggtgacaaaagtgagtaacttgctgcagaacatctggaaggccgagcctgccacactactgccttccctgcaagaagtttttgcaagcatctcttccacagatgcatcatttgaaccttctgtagcattggcaagccttgtgcagcatattcctcttcagatgattacagttctcatcaggagccttactacggatccaaatgtaaaagatgcaagtatgacccaagccctttgcagaatgattgactggctatcctggccattggctcagcatgtggatacatgggtaattgcactcctgaaaggactggcagctgtccagaagtttactattttgatagatgttactttgctgaaaatagaactggtttttaatcgactttggtttcctcttgtgagacctggtgctcttgcagttctttctcacatgctgcttagctttcagcattctccagaggcgttccatttgattgttcctcatgtggttaatttggttcattctttcaaaaatgatggtctgccttcaagtacagccttcttagtacaattaacagaattgatacactgtatgatgtatcattattctggatttccagatctctatgaacctattctggaggcaataaaggattttcctaagcccagtgaagagaagattaagttaattctcaatcaaagtgcctggacttctcaatccaattctttggcgtcttgcttgtctagactttctggaaaatctgaaactgggaaaactggtcttattaacctaggaaatacatgttatatgaacagtgttatacaagccttgtttatggccacagatttcaggagacaagtattatctttaaatctaaatgggtgcaattcattaatgaaaaaattacagcatctttttgcctttctggcccatacacagagggaagcatacgcacctcggatattctttgaggcttccagacctccatggtttactcccagatcacagcaagactgttctgaatacctcagatttctccttgacaggctccatgaagaagaaaagatcttgaaagttcaggcctcacacaagccttctgaaattctggaatgcagtgaaacttctttacaggaagtagctagtaaagcagcagtactaacagagacccctcgtacaagtgacggtgagaagactttaatagaaaaaatgtttggaggaaaactacgaactcacatacgttgtttgaactgcaggagtacctcacaaaaagtggaagcctttacagatctttcgcttgccttttgtccttcctcttctttggaaaacatgtctgtccaagatccagcatcatcacccagtatacaagatggtggtctaatgcaagcctctgtacccggtccttcagaagaaccagtagtttataatccaacaacagctgccttcatctgtgactcacttgtgaatgaaaaaaccataggcagtcctcctaatgagttttactgttctgaaaacacttctgtccctaacgaatctaacaagattcttgttaataaagatgtacctcagaaaccaggaggtgaaaccacaccttcagtaactgacttactaaattattttttggctccagagattcttactggtgataaccaatattattgtgaaaactgtgcctctctgcaaaatgctgagaaaactatgcaaatcacggaggaacctgaataccttattcttactctcctgagattttcatatgatcagaagtatcatgtgagaaggaaaattttagacaatgtatcactgccactggttttggagttgccagttaaaagaattacttctttctcttcattgtcagaaagttggtctgtagatgttgacttcactgatcttagtgagaaccttgctaaaaaattaaagccttcagggactgatgaagcttcctgcacaaaattggtgccctatctattaagttccgttgtggttcactctggtatatcctctgaaagtgggcattactattcttatgccaggaatatcacaagtacagactcttcatatcagatgtaccaccagtctgaggctctggcattagcatcctcccagagtcatttactagggagagatagtcccagtgcagtttttgaacaggatttggaaaataaggaaatgtcaaaagaatggtttttatttaatgacagtagagtgacatttacttcatttcagtcagtccagaaaattacgagcaggtttccaaaggacacagcttatgtgcttttgtataaaaaacagcatagtactaatggtttaagtggtaataacccaaccagtggactctggataaatggagacccacctctacagaaagaacttatggatgctataacaaaagacaataaactatatttacaggaacaagagttgaatgctcgagcccgggccctccaagctgcatctgcttcatgttcatttcggcccaatggatttgatgacaacgacccaccaggaagctgtggaccaactggtggagggggtggaggaggatttaatacagttggcagactcgtattttgatcctgagagagtccaaaatgcactggtcacgaaacgtctaatactatgactgttaaaatgtcagactataacaaatatctatcttttatttttcattagacccttatacttcaagagaacacactcagtgcttgtttttattttcttgacacatttattaacaaaatgcatcatggaaaaaaaaatctacctcttaaaattccatttgcttttatggttagacatgcttgaccaaaaatgttcagaagaaaatatgtacctggtccctaattaagctgcgttaaatttggtagaagcatttaaatggtctatcttcagttttactgaacaaaaaatgtaatttatttagcattctttataaaagaattgatgctagaggtaaaaaaaaatacttgtttttaaaaaatcctttacgtcttgtgtaattaccccattattaaattcaagtccttgaaaatcaactagagattataaagtctctaaagaaggcaataacaaaatttatcaagatatagtacttttcagtttttgtttagtgtcttcagcatcactgtgtctgtatttcaagtacaaatgtttttaaaaaggattctttatacatatgtgctgaattgattttaagaaagttgcatgatcctgtaggagcaacatttttacctaaaaaatgctaactttatagtatttctaattgttcaaggattttaaaattctatttcagggagtatatcttctgtggttttgaaggaggtgagttctgtatgtgccttgcagtactgtaattcaaaaataggaatctttggctgcaaaattttaatgaaatgttaggaagtaattttcgtgctaacattaaaattataactttttgaaaggtaatagattttccagaagtaaaatctgatggttctaaatcaatcaatgtgatagttcatttttaactcttagaagaattcagaggaaattaacccagctaagtaaaaaatctgtcttgattttgttacttattcctcagaatattaaacattgatcacatatttttagagttttacatttgggttttttgtttgtttgtttcagtcatatgtttggcactgttgtttctattttcgtagttttagataaaatgttaaaatgccaaaccctaccttcctacactttttcttttgccaggaaactggaaacatgtcagttctcctggttcttgattatacagtactcaagagttatcccagttatcccccttcctaaaggttttaacttatccacagttgtgcattgttctgaagattggtctcatatttattttgaaaacactttaaggaaacaatgttcttcgatgatttggggtttatctttttcccaagcttttatgacagtggttaaaaaacagaaatcctcatgtttattccattacctcccattcctaacctgtttccaatcaccaggaagattaggaaggcagattagattaaaaactgaaaattctttgcagatttaatgaaggttctcctccttataaatgaatgaaccagttatcatgcttttctgtggttttcctatcccaatagtgaatttctgagctatcctgtgtgttcagttatccacttacttgatagcaacttacgaccagattatatcagtcttggcatttattgaaattggtaaagtgatttaatacttgatagattgatattgggctaagatgcttctaggaactttcataaaagcaattatacttgtgcagctttatctatgaatatcaggtctctcaaggattttatgtatcaagataatatgtattgacttttttaaatgataaaatgaattctagttagagtctttccttggtatctgcagtggattggttccagaacaccatcccccaatattaaaatccacagatactcaagtcccttatttatataaaatagcacagtatttgcatataacctgtgcacatcctcccatatactttaatctccagatgattagatatgattgcatagcacttacgttgtgctatgtagttgttatattgttttttcatttgtactattttttatgatatttattggttttttaaattttctatccaaagttgtttgaatctaaggatacagagcctgaggatatggaaagctgactaaatatagtaacactgaagagtattcaaatgataactcataccagtaccaaaaacttgaagacttccttttaacattaaaaatacagtaactttttacgtgatttgttgaattcaacatatttggaaccagaataatcagaaacttcattcaaaacctatgcatctgaacttttttagtaaggtaatactcaggactgttctgattctaacagatccctgttaattacagatttatttgtcatattaggtcttttctttctcccatattcctaacccgtgtactagctccaactgttgtgaggtttgactctgaagactgagtagagtactattgttgtttttctttccttagtcagagtaatcagtttaaatgaagttgctcattgctgctaagaagcattaggcttcactgctagcaaaaatgaaaaactacaaatctgagtctttctttcaaagatgtttattgacataattaaagtaaaaaattgtttagagatatgcaaagaaggaaatatatatgatgtcacacaagctccagtaagctatccactaagcaggtgcctgtgcaactctgatttatggcattaacatatcaaattgaaggaaggattctagctcattttccattcaagcatcttcccactgcctctcttccagctaaataatcagagaagcagggcagtatatccctggagatccctgacttttatctccataccttaaattgttggtagatcctttggatgtagagataaaaattcattatgatgctagaggcattggggggtccatgcgaaaggttcaaacagcctattacattaatgcacatgtggaaagaacaaaaattttcaagctaagtcttaagttcaaatctataatttttttctcttcagttctgttctttgtatgataatccttaaaaaagtagttgtcttcttttcacatacacctctttaaagctatcatcttataataagtggaattggatgcttattgtgtgcccagcacagtttaggaaaaaaataattggcactgtttgtccagttactggagatcttcattttgatgctttgtactttgttccaggtctttaattctcagtccatcttttcctatgattgtgtacttcacatgatacattccatataaagagctcttttaaaatgactatttcaaaaatactgtacatttatatatagtattttttctcataaaaatgtgatagtttata

SEQ ID NO: 8006 - DNA, 5692 bp, Homo sapiens
actttctggagacccgccctcgccaacatggcggcgcccagttggggcgggttcgttcgcttcgcgttttggccagggcgggggtctgggctttaggcaggtagtatttagtttcacaatgtttggggacctgtttgaagaggagtattccactgtgtctaataatcagtatggaaaagggaagaaattaaagactaaagctttggagccacctgctcctagagaattcaccaatttaagcggaatcagaaatcagggtggaacctgttacctcaattcccttcttcagactcttcatttcacacctgaattcagagaagctctattttctcttggcccagaagagcttggtttgtttgaagataaggataaacccgatgcaaaggttcgaatcatccctttacagttacagcgcttgtttgctcagcttctgctcttagaccaggaagctgcatccacagcagacctcactgacagctttgggtggaccagtaatgaggaaatgaggcaacatgatgtgcaggaactgaatcgaatcctcttcagcgctttggaaacttctttagttgggacctccggtcatgacctcatctatcgtctgtaccatggaaccattgttaaccagattgtttgtaaagaatgtaagaacgttagcgagaggcaggaagacttcttagatctaacagtagcagtcaaaaatgtatccggtttggaagatgctctctggaacatgtatgtagaagaggaagtttttgattgtgacaacttgtaccactgtggaacttgtgacaggctggttaaagcagcaaagtcggccaaattacgtaagctgcctccttttcttactgtttcattactaagatttaattttgattttgtgaaatgcgaacgctacaaggaaactagctgttatacattccctctccggattaatctcaagcccttttgtgaacagagtgaattggatgacttagaatatatatatgacctcttctcagttattatacacaaaggtggctgctacggaggccattaccatgtatatattaaagatgttgatcatttgggaaactggcagtttcaagaggaaaaaagtaaaccagatgtgaatctgaaagatctccagagtgaagaagagattgatcatccactgatgattctaaaagcaatcttattagaggagaataatctaattcctgttgatcagctgggccagaaacttttgaaaaagataggaatatcttggaacaagaagtacagaaaacagcatggaccactgcggaagttcttacagctccattctcagatatttctactcagttcagatgaaagtacagttcgtctcttgaagaatagttctctccaggctgagtctgatttccaaaggaatgaccagcaaattttcaagatgcttcctccagaatccccaggtttaaacaatagcatctcctgtccccactggtttgatataaatgattctaaagtccagccaatcagggaaaaggatattgaacagcaatttcagggtaaagaaagtgcctacatgttgttttatcggaaatcccagttgcagagaccccctgaagctcgagctaatccaagatatggggttccatgtcatttactgaatgaaatggatgcagctaacattgaactgcaaaccaaaagggcagaatgtgattctgcaaacaatacttttgaattgcatcttcacctgggccctcagtatcatttcttcaatggggctctgcacccagtagtctctcaaacagaaagcgtgtgggatttgacctttgataaaagaaaaactttaggagatctccggcagtcaatatttcagctgttagaattttgggaaggagacatggttcttagtgttgcaaagcttgtaccagcaggacttcacatttaccagtcacttggcggggatgaactgacactgtgtgaaactgaaattgctgatggggaagacatctttgtgtggaatggggtggaggttggtggagtccacattcaaactggtattgactgcgaacctctacttttaaatgttcttcatctagacacaagcagtgatggagaaaagtgttgtcaggtgatagaatctccacatgtctttccagctaatgcagaagtgggcactgtcctcacagccttagcaatcccagcaggtgtcatcttcatcaacagtgctggatgtccaggtggggagggttggacggccatccccaaggaagacatgaggaagacgttcagggagcaagggctcagaaatggaagctcaattttaattcaggattctcatgatgataacagcttgttgaccaaggaagagaaatgggtcactagtatgaatgagattgactggctccacgttaaaaatttatgccagttagaatctgaagagaagcaagttaaaatatcagcaactgttaacacaatggtgtttgatattcgaattaaagccataaaggaattaaaattaatgaaggaactagctgacaacagctgtttgagacctattgatagaaatgggaagcttctttgtccagtgccggacagctatactttgaaggaagcagaattgaagatgggaagttcattgggactgtgtcttggaaaagcaccaagttcgtctcagttgttcctgttttttgcaatggggagtgacgttcaacctgggacagaaatggaaatcgtagtagaagaaacaatatctgtgagagattgtttaaagttaatgctgaagaaatctggcctacaaggagatgcctggcatttacgaaaaatggattggtgctatgaagctggagagcctttatgtgaagaagatgcaacactgaaagaacttctgatatgttctggagatactttgcttttaattgaaggacaacttcctcctctgggtttcctgaaggtgcccatctggtggtaccagcttcagggtccctcaggacactgggagagtcatcaggaccagaccaactgtacttcgtcttggggcagagtttggagagccacttccagccaaggtgcttctgggaacgagcctgcgcaagtttctctcctctacttgggagacatagagatctcagaagatgccacgctggcggagctgaagtctcaggccatgaccttgcctcctttcctggagttcggtgtcccgtccccagcccacctcagagcctggacggtggagaggaagcgcccaggcaggcttttacgaactgaccggcagccactcagggaatataaactaggacggagaattgagatctgcttagagccccttcagaaaggcgaaaacttgggcccccaggacgtgctgctgaggacacaggtgcgcatccctggtgagaggacctatgcccctgccctggacctggtgtggaacgcggcccagggtgggactgccggctccctgaggcagagagttgccgatttctatcgtcttcccgtggagaagattgaaattgccaaatactttcccgaaaagttcgagtggcttccgatatctagctggaaccaacaaataaccaagaggaaaaagaaaaaaaaacaagattatttgcaaggggcaccgtattacttgaaagacggagatactattggtgttaagaatctcctgattgacgacgatgatgatttcagtacaatcagagatgacactggaaaagaaaagcagaaacaacgggccctggggagaaggaaaagccaagaagccctccatgagcagagcagctacatcctctccagtgcagagacgcctgcccggccccgagccccggaaacttctctctccatccacgtggggagcttcagataaccgcgccgctgcacggctctactcccgatgaactctccggctgatgccacaaacgtgggtttcctgggcatggggactggctgcctggcgcctccaatcccaaatcctctgcttcctttgagcacagggacggctcctctgaggcctggccagtgcatgtagtcacttagctctgcaacacgtggcagccacgggggctggtgcagctctggatgtcgcccacccagctgccagtaggtgctgggctctctcacacagcacccggccccagctgcctttttttttcttttaaccagaaaatgcacaacgtgtgcgtgaaccgcaggtatggaggcagcggcatgccgttgctccgctgtgggaggtgtgtggggtcaggccagccactttcctccgtgttcagatgactctcgttcgccctgaccggcttctcacagtgtctcaggccactgcgccaccgcgctggtgctgagcagaagcgggcagaagtggggtctgctttcaggacttcatttcccccactcgttccggccccgcatgctccacgtctgccctttggtctgagttaaaactgcgatgctgaaaagtgcgagctctttccacgaggaggagccacacagggtggcctccgagggtgagtcgctctgctaagcaagggcagccgctgcacgtcagcccgcaggccaagggtccagcttatcctgggtgctctgtgatcagaaggtccttggatcccgaggactgcagctgctgccgtccacagcgcctcagcctctcttcctgtgtggaagcggggcaggcagggctgtggcagacaggcctggcatagcccaggttccaggtgtcctgggcagcctgaccggtttcctgagtagcctcaatgaaaacacctgagaaaaagaaaatgtaaactaaggaagggttttcccacttaatccaacccagatttctattcaacttaaaggatttaattggcatttgtgagaaataatagtacctgtgtcactgagttgattgatttgggacatagacggttgactttcccagacagcagcttagcggaaagcagcatcccgaagacggtgtcgcatgtcctgagcctgcttgtcacctgggcctcacggtttctcgtcagccccgtcactgatgggaagcagcactgaagtgtgagggcagaaaggacaccgctggagtcaggcgctcccctgcctgtgacccttttccaacaagctgatgctgagccagcggcctgctttgtccctcatactcctcccaacagtccaaacccctaccagacagaagccacgtcgcttctgcacacgtgtctgagagcgtctgccatagacgtctgtgcgtttccgtgaagcactgcgccctaaggacccaactctgactagcagctgcctcccactcccaaacactaaccccgctcaggagactcgcactgggtgtagactgcgtctttgcagagggagatgatagaggcttctgatgacgccagagctgtaagtgtcgtgacgagctgggcgcccagcccttcttaagctgttctgtttctgtggctttaactgacatatttctgtagcatctgccttcatctcatctcagcgtaatgaaatattaatgaaatcgctgaaaagctttgccttcgagaggccagaagcctcgcggaatgtctgcaagtccaaagacgcgtgtgggttgtgccctgaagtgccgtccagcaggcgcgtgcggccgggccggcctgtgcgtgtggcctttgccttcttccctttcttcctgttttctgtttttttaatttggggattgagaaagctgtacgattttgttaaagaaaaaaataaaccattttttaaagttgta

SEQ ID NO: 8007 - DNA, 1946 bp, Homo sapiens
ctccaatacctaatatttaaaaattaccttttggaaactgatttataggacatattttcttccaggtatcttacctttatattgcagaaatccttaaccagaaacaaacacttctgttttctaaatgaaacaccattctttctgattatccgattctcattttactcacgggtttgatctagttatattttttccagctttattttcaaaatttttccatttttttgtgaattttattgcgataccaattatgaaataaaatcttcagttctcatctctgtatcacctcttaccattagatttaatttagtcatggatgagcctaattattgatggtaataacaatctcaactttaaacttggaagaagctacttcttcatttatggattgatttggattatctggcttttaatctatataaacaacagctctttgaacaagtcatttttattaagtaggaaactagactttcatagcttccatttagcattgttacatagaaaacaggaagacaatatcttaagagtatggaaattgaaaatcaaacctaatcttagtgcatgtaatccttttgtctgaagtgcaactcatttttcttctttcttgatattcttgattttcaaagaaatactgatttcagcatttatttttcttagagagctaggaattaataaccttcatcatattatcaaaatttttttaagtgccggacagctatactttgaaggaagcagaattgaagatgggaagttcattgggactgtgtcttggaaaagcaccaagttcgtctcagttgttcctgttttttgcaatggggagtgacgttcaacctgggacagaaatggaaatcgtagtagaagaaacaatatctgtgagagattgtttaaagttaatgctgaagaaatctggcctacaaggagatgcctggcatttacgaaaaatggattggtgctatgaagctggagagcctttatgtgaagaagatgcaacactgaaagaacttctgatatgttctggagatactttgcttttaattgaaggacaacttcctcctctgggtttcctgaaggtgcccatctggtggtaccagcttcagggtccctcaggacactgggagagtcatcaggaccagaccaactgtacttcgtcttggggcagagtttggagagccacttccagccaaggtgagaacagaatgggatttcagcagccagtgcatcataaagagaagtaaattgactgcctgtgctctgagagtcaattgatatatttatttttaaaacgtaagatcttgaaaatcaagacctattaatttcataagtcattccagacatcacataataataacactgtgccatttctgtacgtgctctgtaacctctgtaaagcactatatatcttgttgtttattattatatcaatatattacactttccaaagacttttatgtatcatctctcaagatcctcagggcaacaggggccccatttatcaccacgtaccagaatattgagacttcatccaattctaatgatgtcattttagcccacaggggcagagaccaggagtccacatcctacatgtcttccaatctttctgcctcaaaaccctcaggaactgcttctagggcatttgatatcatctcactgacttctgagaaggaacatagacaagtacaagcatgttgtcttactcagcactcagccgcacacatcacgatgggcagaagtcactatcagtgagttctgttgcccttgtacaaagaggagttccacttcattataaagaaatggagcgagtatatttttaataggcccaactctttagctatgtttttctttttatcaggctttacttatttagtttttctagtgccttgaagtatattacttatatttctttttaatcttttcagcctcagtaataaaattaatataaatgagtc

SEQ ID NO: 8008 - DNA, 3744 bp, Homo sapiens
atgtcactttttttaagggtagtatttagtttcacaatgtttggggacctgtttgaagaggagtattccactgtgtctaataatcagtatggaaaagggaagaaattaaagactaaagctttggagccacctgctcctagagaattcaccaatttaagcggaatcagaaatcagggtggaacctgttacctcaattcccttcttcagactcttcatttcacacctgaattcagagaagctctattttctcttggcccagaagagcttggtttgtttgaagataaggataaacccgatgcaaaggttcgaatcatccctttacagttacagcgcttgtttgctcagcttctgctcttagaccaggaagctgcatccacagcagacctcactgacagctttgggtggaccagtaatgaggaaatgaggcaacatgatgtgcaggaactgaatcgaatcctcttcagcgctttggaaacttctttagttgggacctccggtcatgacctcatctatcgtctgtaccatggaaccattgttaaccagattgtttgtaaagaatgtaagaacgttagcgagaggcaggaagacttcttagatctaacagtagcagtcaaaaatgtatccggtttggaagatgctctctggaacatgtatgtagaagaggaagtttttgattgtgacaacttgtaccactgtggaacttgtgacaggctggttaaagcagcaaagtcggccaaattacgtaagctgcctccttttcttactgtttcattactaagatttaattttgattttgtgaaatgcgaacgctacaaggaaactagctgttatacattccctctccggattaatctcaagcccttttgtgaacagagtgaattggatgacttagaatatatatatgacctcttctcagttattatacacaaaggtggctgctacggaggccattaccatgtatatattaaagatgttgatcatttgggaaactggcagtttcaagaggaaaaaagtaaaccagatgtgaatctgaaagatctccagagtgaagaagagattgatcatccactgatgattctaaaagcaatcttattagaggagaataatctaattcctgttgatcagctgggccagaaacttttgaaaaagataggaatatcttggaacaagaagtacagaaaacagcatggaccactgcggaagttcttacagctccattctcagatatttctactcagttcagatgaaagtacagttcgtctcttgaagaatagttctctccaggctgagtctgatttccaaaggaatgaccagcaaattttcaagatgcttcctccagaatccccaggtttaaacaatagcatctcctgtccccactggtttgatataaatgattctaaagtccagccaatcagggaaaaggatattgaacagcaatttcagggtaaagaaagtgcctacatgttgttttatcggaaatcccagttgcagagaccccctgaagctcgagctaatccaagatatggggttccatgtcatttactgaatgaaatggatgcagctaacattgaactgcaaaccaaaagggcagaatgtgattctgcaaacaatacttttgaattgcatcttcacctgggccctcagtatcatttcttcaatggggctctgcacccagtagtctctcaaacagaaagcgtgtgggatttgacctttgataaaagaaaaactttaggagatctccggcagtcaatatttcagctgttagaattttgggaaggagacatggttcttagtgttgcaaagcttgtaccagcaggacttcacatttaccagtcacttggcggggatgaactgacactgtgtgaaactgaaattgctgatggggaagacatctttgtgtggaatggggtggaggttggtggagtccacattcaaactggtattgactgcgaacctctacttttaaatgttcttcatctagacacaagcagtgatggagaaaagtgttgtcaggtgatagaatctccacatgtctttccagctaatgcagaagtgggcactgtcctcacagccttagcaatcccagcaggtgtcatcttcatcaacagtgctggatgtccaggtggggagggttggacggccatccccaaggaagacatgaggaagacgttcagggagcaagggctcagaaatggaagctcaattttaattcaggattctcatgatgataacagcttgttgaccaaggaagagaaatgggtcactagtatgaatgagattgactggctccacgttaaaaatttatgccagttagaatctgaagagaagcaagttaaaatatcagcaactgttaacacaatggtgtttgatattcgaattaaagccataaaggaattaaaattaatgaaggaactagctgacaacagctgtttgagacctattgatagaaatgggaagcttctttgtccagtgccggacagctatactttgaaggaagcagaattgaagatgggaagttcattgggactgtgtcttggaaaagcaccaagttcgtctcagttgttcctgttttttgcaatggggagtgacgttcaacctgggacagaaatggaaatcgtagtagaagaaacaatatctgtgagagattgtttaaagttaatgctgaagaaatctggcctacaaggagatgcctggcatttacgaaaaatggattggtgctatgaagctggagagcctttatgtgaagaagatgcaacactgaaagaacttctgatatgttctggagatactttgcttttaattgaaggacaacttcctcctctgggtttcctgaaggtgcccatctggtggtaccagcttcagggtccctcaggacactgggagagtcatcaggaccagaccaactgtacttcgtcttggggcagagtttggagagccacttccagccaaggtgcttctgggaacgagcctgcgcaagtttctctcctctacttgggagacatagagatctcagaagatgccacgctggcggagctgaagtctcaggccatgaccttgcctcctttcctggagttcggtgtcccgtccccagcccacctcagagcctggacggtggagaggaagcgcccaggcaggcttttacgaactgaccggcagccactcagggaatataaactaggacggagaattgagatctgcttagagccccttcagaaaggcgaaaacttgggcccccaggacgtgctgctgaggacacaggtgcgcatccctggtgagaggacctatgcccctgccctggacctggtgtggaacgcggcccagggtgggactgccggctccctgaggcagagagttgccgatttctatcgtcttcccgtggagaagattgaaattgccaaatactttcccgaaaagttcgagtggcttccgatatctagctggaaccaacaaataaccaagaggaaaaagaaaaaaaaacaagattatttgcaaggggcaccgtattacttgaaagacggagatactattggtgttaagaatctcctgattgacgacgatgatgatttcagtacaatcagagatgacactggaaaagaaaagcagaaacaacgggccctggggagaaggaaaagccaagaagccctccatgagcagagcagctacatcctctccagtgcagagacgcctgcccggccccgagccccggaaacttctctctccatccacgtggggagcttcagataa

SEQ ID NO: 8009 - DNA, 1110 bp, Homo sapiens
actttctggagacccgccctcgccaacatggcggcgcccagttggggcgggttcgttcgcttcgcgttttggccagggcgggggtctgggctttaggcaggtagtatttagtttcacaatgtttggggacctgtttgaagaggagtattccactgtgtctaataatcagtatggaaaagggaagaaattaaagactaaagctttggagccacctgctcctagagaattcaccaatttaagcggaatcagaaatcagggtggaacctgttacctcaattcccttcttcagactcttcatttcacacctgaattcagagaagctctattttctcttggcccagaagagcttggtttgtttgaagataaggataaacccgatgcaaaggttcgaatcatccctttacagttacagcgcttgtttgctcagcttctgctcttagaccaggaagctgcatccacagcagacctcactgacagctttgggtggaccagtaatgaggaaatgaggcaacatgatgtgcaggaactgaatcgaatcctcttcagcgctttggaaacttctttagttgggacctccggtcatgacctcatctatcgtctgtaccatggaaccattgttaaccagattgtttgtaaagaatgtaagaacgttagcgagaggcaggaagacttcttagatctaacagtagcagtcaaaaatgtatccggtttggaagatgctctctggaacatgtatgtagaagaggaagtttttgattgtgacaacttgtaccactgtggaacttgtgacaggctggttaaagcagcaaagtcggccaaattacgtaagctgcctccttttcttactgtttcattactaagatttaattttgattttgtgaaatgcgaacgctacaaggaaactagctgttatacattccctctccggattaatctcaagcccttttgtgaacagagtgaattggatgacttagaatatatgacctcttctcagttattatacacaaaggtggctgctacggaggccattaccatgtatatattaaagatgttgatcatttgggaaactggcagtttcaagaggaaaaaagtaaaccagatgtgaatctg

SEQ ID NO: 8010 - DNA, 5616 bp, Homo sapiens
atgtcactttttttaagggtagtatttagtttcacaatgtttggggacctgtttgaagaggagtattccactgtgtctaataatcagtatggaaaagggaagaaattaaagactaaagctttggagccacctgctcctagagaattcaccaatttaagcggaatcagaaatcagggtggaacctgttacctcaattcccttcttcagactcttcatttcacacctgaattcagagaagctctattttctcttggcccagaagagcttggtttgtttgaagataaggataaacccgatgcaaaggttcgaatcatccctttacagttacagcgcttgtttgctcagcttctgctcttagaccaggaagctgcatccacagcagacctcactgacagctttgggtggaccagtaatgaggaaatgaggcaacatgatgtgcaggaactgaatcgaatcctcttcagcgctttggaaacttctttagttgggacctccggtcatgacctcatctatcgtctgtaccatggaaccattgttaaccagattgtttgtaaagaatgtaagaacgttagcgagaggcaggaagacttcttagatctaacagtagcagtcaaaaatgtatccggtttggaagatgctctctggaacatgtatgtagaagaggaagtttttgattgtgacaacttgtaccactgtggaacttgtgacaggctggttaaagcagcaaagtcggccaaattacgtaagctgcctccttttcttactgtttcattactaagatttaattttgattttgtgaaatgcgaacgctacaaggaaactagctgttatacattccctctccggattaatctcaagcccttttgtgaacagagtgaattggatgacttagaatatatatatgacctcttctcagttattatacacaaaggtggctgctacggaggccattaccatgtatatattaaagatgttgatcatttgggaaactggcagtttcaagaggaaaaaagtaaaccagatgtgaatctgaaagatctccagagtgaagaagagattgatcatccactgatgattctaaaagcaatcttattagaggagaataatctaattcctgttgatcagctgggccagaaacttttgaaaaagataggaatatcttggaacaagaagtacagaaaacagcatggaccactgcggaagttcttacagctccattctcagatatttctactcagttcagatgaaagtacagttcgtctcttgaagaatagttctctccaggctgagtctgatttccaaaggaatgaccagcaaattttcaagatgcttcctccagaatccccaggtttaaacaatagcatctcctgtccccactggtttgatataaatgattctaaagtccagccaatcagggaaaaggatattgaacagcaatttcagggtaaagaaagtgcctacatgttgttttatcggaaatcccagttgcagagaccccctgaagctcgagctaatccaagatatggggttccatgtcatttactgaatgaaatggatgcagctaacattgaactgcaaaccaaaagggcagaatgtgattctgcaaacaatacttttgaattgcatcttcacctgggccctcagtatcatttcttcaatggggctctgcacccagtagtctctcaaacagaaagcgtgtgggatttgacctttgataaaagaaaaactttaggagatctccggcagtcaatatttcagctgttagaattttgggaaggagacatggttcttagtgttgcaaagcttgtaccagcaggacttcacatttaccagtcacttggcggggatgaactgacactgtgtgaaactgaaattgctgatggggaagacatctttgtgtggaatggggtggaggttggtggagtccacattcaaactggtattgactgcgaacctctacttttaaatgttcttcatctagacacaagcagtgatggagaaaagtgttgtcaggtgatagaatctccacatgtctttccagctaatgcagaagtgggcactgtcctcacagccttagcaatcccagcaggtgtcatcttcatcaacagtgctggatgtccaggtggggagggttggacggccatccccaaggaagacatgaggaagacgttcagggagcaagggctcagaaatggaagctcaattttaattcaggattctcatgatgataacagcttgttgaccaaggaagagaaatgggtcactagtatgaatgagattgactggctccacgttaaaaatttatgccagttagaatctgaagagaagcaagttaaaatatcagcaactgttaacacaatggtgtttgatattcgaattaaagccataaaggaattaaaattaatgaaggaactagctgacaacagctgtttgagacctattgatagaaatgggaagcttctttgtccagtgccggacagctatactttgaaggaagcagaattgaagatgggaagttcattgggactgtgtcttggaaaagcaccaagttcgtctcagttgttcctgttttttgcaatggggagtgacgttcaacctgggacagaaatggaaatcgtagtagaagaaacaatatctgtgagagattgtttaaagttaatgctgaagaaatctggcctacaaggagatgcctggcatttacgaaaaatggattggtgctatgaagctggagagcctttatgtgaagaagatgcaacactgaaagaacttctgatatgttctggagatactttgcttttaattgaaggacaacttcctcctctgggtttcctgaaggtgcccatctggtggtaccagcttcagggtccctcaggacactgggagagtcatcaggaccagaccaactgtacttcgtcttggggcagagtttggagagccacttccagccaaggtgcttctgggaacgagcctgcgcaagtttctctcctctacttgggagacatagagatctcagaagatgccacgctggcggagctgaagtctcaggccatgaccttgcctcctttcctggagttcggtgtcccgtccccagcccacctcagagcctggacggtggagaggaagcgcccaggcaggcttttacgaactgaccggcagccactcagggaatataaactaggacggagaattgagatctgcttagagccccttcagaaaggcgaaaacttgggcccccaggacgtgctgctgaggacacaggtgcgcatccctggtgagaggacctatgcccctgccctggacctggtgtggaacgcggcccagggtgggactgccggctccctgaggcagagagttgccgatttctatcgtcttcccgtggagaagattgaaattgccaaatactttcccgaaaagttcgagtggcttccgatatctagctggaaccaacaaataaccaagaggaaaaagaaaaaaaaacaagattatttgcaaggggcaccgtattacttgaaagacggagatactattggtgttaagaatctcctgattgacgacgatgatgatttcagtacaatcagagatgacactggaaaagaaaagcagaaacaacgggccctggggagaaggaaaagccaagaagccctccatgagcagagcagctacatcctctccagtgcagagacgcctgcccggccccgagccccggaaacttctctctccatccacgtggggagcttcagataaccgcgccgctgcacggctctactcccgatgaactctccggctgatgccacaaacgtgggtttcctgggcatggggactggctgcctggcgcctccaatcccaaatcctctgcttcctttgagcacagggacggctcctctgaggcctggccagtgcatgtagtcacttagctctgcaacacgtggcagccacgggggctggtgcagctctggatgtcgcccacccagctgccagtaggtgctgggctctctcacacagcacccggccccagctgcctttttttttcttttaaccagaaaatgcacaacgtgtgcgtgaaccgcaggtatggaggcagcggcatgccgttgctccgctgtgggaggtgtgtggggtcaggccagccactttcctccgtgttcagatgactctcgttcgccctgaccggcttctcacagtgtctcaggccactgcgccaccgcgctggtgctgagcagaagcgggcagaagtggggtctgctttcaggacttcatttcccccactcgttccggccccgcatgctccacgtctgccctttggtctgagttaaaactgcgatgctgaaaagtgcgagctctttccacgaggaggagccacacagggtggcctccgagggtgagtcgctctgctaagcaagggcagccgctgcacgtcagcccgcaggccaagggtccagcttatcctgggtgctctgtgatcagaaggtccttggatcccgaggactgcagctgctgccgtccacagcgcctcagcctctcttcctgtgtggaagcggggcaggcagggctgtggcagacaggcctggcatagcccaggttccaggtgtcctgggcagcctgaccggtttcctgagtagcctcaatgaaaacacctgagaaaaagaaaatgtaaactaaggaagggttttcccacttaatccaacccagatttctattcaacttaaaggatttaattggcatttgtgagaaataatagtacctgtgtcactgagttgattgatttgggacatagacggttgactttcccagacagcagcttagcggaaagcagcatcccgaagacggtgtcgcatgtcctgagcctgcttgtcacctgggcctcacggtttctcgtcagccccgtcactgatgggaagcagcactgaagtgtgagggcagaaaggacaccgctggagtcaggcgctcccctgcctgtgacccttttccaacaagctgatgctgagccagcggcctgctttgtccctcatactcctcccaacagtccaaacccctaccagacagaagccacgtcgcttctgcacacgtgtctgagagcgtctgccatagacgtctgtgcgtttccgtgaagcactgcgccctaaggacccaactctgactagcagctgcctcccactcccaaacactaaccccgctcaggagactcgcactgggtgtagactgcgtctttgcagagggagatgatagaggcttctgatgacgccagagctgtaagtgtcgtgacgagctgggcgcccagcccttcttaagctgttctgtttctgtggctttaactgacatatttctgtagcatctgccttcatctcatctcagcgtaatgaaatattaatgaaatcgctgaaaagctttgccttcgagaggccagaagcctcgcggaatgtctgcaagtccaaagacgcgtgtgggttgtgccctgaagtgccgtccagcaggcgcgtgcggccgggccggcctgtgcgtgtggcctttgccttcttccctttcttcctgttttctgtttttttaatttggggattgagaaagctgtacgattttgttaaagaaaaaaataaaccattttttaaagttgtagccctt

SEQ ID NO: 8011 - DNA, 1427 bp, Homo sapiens
atggacggcgtcttgttcagggctcatcagtgtcagtacgtgcatccttgtgtacatgtgtatgtcactgtgggcctcatggatcccctgtgtctacaaaggcacaaagaacacgccaaggggcgtgagccaccatgcccagccttgtcaacttcaggcctggttggtttacacaacattggacagacctgctgccttaactccttgattcaggtgtttgtaatgaatgtggacttcgccaggatattgaagaggatcacggtgcccaggggagctgacgagcagaggagaagcgtccctttccagatgcttctgctgctggagaagatgcaggacagccggcagaaagcagtgtggcccctggagctggcctactgcctgcagaagtacaacgtgcccctgtttgtccaacatgatgctgcccaactgtacctcaaactctggaacctgattaaggaccagatcgctgatgtgcacttggtggagagactgcaggccctgtatatgatccggatgaaggactccttgatttgccttgactgtgccatggagagtagcagaaacagcagcatgctcaccctccgactttctttttttgatgtggactcaaagcccctgaagacactggaggacgccctgcactgcttcttccagcccagggagttatcaagcaaaagcaaatgcttctgtgagaactgtgggaagaagacccgtgggaaacaggtcttgaagctgacccatttgccccagaccctgacaatccacctcatgcgattctccatcaggaattcacagacgagaaagatctgccactccctgtacttcccccagagcttggatttcagccagatccttccaatgaagcgagagtcttgtgatgctgaggagcagtctggagggcagtatgagctttttgctgtgattgcgcacgtgggaatggcagactccggtcattactgtgtctacatccggaatgctgtggatggaaaatggttctgcttcaatgactccaatatttgcttggtgtcctgggaagacatccagtgtacctacggaaatcctaactaccactggcctccttttctttgtcatgcatgcatattaattgaggatggagaatatctacgcttgttcaggccagccaacatacgacagtttacttcaagagaggagacatgggttgaatgctggtgtgttttaactctgcagcgcaaacagttgcaacaagtgtggtgaactaaacaccagatggccctttgctgccttatttgtcattgtgccttacatgtagcttgcaggatttgattacgcttatgttttgtggtgatcatactttcaactattcctaaaatactgcttcagtcttatctgtttggggtcaactgccgaggatttcatacaaattaatgaagtttgtgaatctaaag

SEQ ID NO: 8012 - DNA, 5155 bp, Homo sapiens
aggggcgcggcgggcgcggcgctgacccggaggcggcggcggcggtgcccggatggaggcacgtcattgtcccccgccgggcggctgggctgtgtgcggcggcggcggcggcggccgagggggatggagcgagcgccgagccgggtcagagttgaacaatgaccatagttgacaaagcttctgaatcttcagacccatcagcctatcagaatcagcctggcagctccgaggcagtctcacctggagacatggatgcaggttctgccagctggggtgctgtgtcttcattgaatgatgtgtcaaatcacacactttctttaggaccagtacctggtgctgtagtttattcgagttcatctgtacctgataaatcaaaaccatcaccacaaaaggatcaagccctaggtgatggcatcgctcctccacagaaagttcttttcccatctgagaagatttgtcttaagtggcaacaaactcatagagttggagctgggctccagaatttgggcaatacctgttttgccaatgcagcactgcagtgtttaacctacacaccacctcttgccaattacatgctatcacatgaacactccaaaacatgtcatgcagaaggcttttgtatgatgtgtacaatgcaagcacatattacccaggcactcagtaatcctggggacgttattaaaccaatgtttgtcatcaatgagatgcggcgtatagctaggcacttccgttttggaaaccaagaagatgcccatgaattccttcaatacactgttgatgctatgcagaaagcatgcttgaatggcagcaataaattagacagacacacccaggccaccactcttgtttgtcagatatttggaggatacctaagatctagagtcaaatgtttaaattgcaagggcgtttcagatacttttgatccatatcttgatataacattggagataaaggctgctcagagtgtcaacaaggcattggagcagtttgtgaagccggaacagcttgatggagaaaactcgtacaagtgcagcaagtgtaaaaagatggttccagcttcaaagaggttcactatccatagatcctctaatgttcttacactttctctgaaacgttttgcaaattttaccggtggaaaaattgctaaggatgtgaaataccctgagtatcttgatattcggccatatatgtctcaacccaacggagagccaattgtctacgtcttgtatgcagtgctggtccacactggttttaattgccatgctggccattacttctgctacataaaagctagcaatggcctctggtatcaaatgaatgactccattgtatctaccagtgatattagatcggtactcagccaacaagcctatgtgctcttttatatcaggtcccatgatgtgaaaaatggaggtgaacttactcatcccacccatagccccggccagtcctctccccgccccgtcatcagtcagcgggttgtcaccaacaaacaggctgcgccaggctttatcggaccacagcttccctctcacatgataaagaatccacctcacttaaatgggactggaccattgaaagacacgccaagcagttccatgtcgagtcctaacgggaattccagtgtcaacagggctagtcctgttaatgcttcagcttctgtccaaaactggtcagttaataggtcctcagtgatcccagaacatcctaagaaacaaaaaattacaatcagtattcacaacaagttgcctgttcgccagtgtcagtctcaacctaaccttcatagtaattctttggagaaccctaccaagcccgttccctcttctaccattaccaattctgcagtacagtctacctcgaacgcatctacgatgtcagtttctagtaaagtaacaaaaccgatcccccgcagtgaatcctgctcccagcccgtgatgaatggcaaatccaagctgaactccagcgtgctggtgccctatggcgccgagtcctctgaggactctgacgaggagtcaaaggggctgggcaaggagaatgggattggtacgattgtgagctcccactctcccggccaagatgccgaagatgaggaggccactccgcacgagcttcaagaacccatgaccctaaacggtgctaatagtgcagacagcgacagtgacccgaaagaaaacggcctagcgcctgatggtgccagctgccaaggccagcctgccctgcactcagaaaatccctttgctaaggcaaacggtcttcctggaaagttgatgcctgctcctttgctgtctctcccagaagacaaaatcttagagaccttcaggcttagcaacaaactgaaaggctcgacggatgaaatgagtgcacctggagcagagaggggccctcccgaggaccgcgacgccgagcctcagcctggcagccccgccgccgaatccctggaggagccagatgcggccgccggcctcagcagcaccaagaaggctccgccgccccgcgatcccggcacccccgctaccaaagaaggcgcctgggaggccatggccgtcgcccccgaggagcctccgcccagcgccggcgaggacatcgtgggggacacagcaccccctgacctgtgtgatcccgggagcttaacaggcgatgcgagcccgttgtcccaggacgcaaaggggatgatcgcggagggcccgcgggactcggcgttggcggaagccccggaagggttgagtccggctccgcctgcgcggtcggaggagccctgcgagcagccactccttgttcaccccagcggggaccacgcccgggacgctcaggacccatcccagagcttgggcgcacccgaggccgcagagcggccgccagctcctgtgctggacatggccccggccggtcacccggaaggggacgctgagcctagccccggcgagagggtcgaggacgccgcggcgccgaaagccccaggcccttccccagcgaaggagaaaatcggcagcctcagaaaggtggaccgaggccactaccgcagccggagagagcgctcgtccagcggggagcccgccagagagagcaggagcaagactgagggccaccgtcaccggcggcgccgcacctgcccccgggagcgcgaccgccaggaccgccacgccccggagcaccaccccggccacggcgacaggctcagccctggcgagcgccgctctctgggcaggtgcagtcaccaccactcccgacaccggagcggggtggagctggactgggtcagacaccactacaccgagggcgagcgtggctggggccgggagaagttctaccccgacaggccgcgctgggacaggtgccggtactaccatgacaggtacgccctgtacgctgcccgggactggaagcccttccacggcggccgcgagcacgagcgggccgggctgcacgagcggccgcacaaggaccacaaccggggccgtaggggctgcgagccggcccgggagagggagcggcaccgccccagcagcccccgcgcaggcgcgccccacgccctcgccccgcaccccgaccgcttctcccacgacagaactgcacttgtagccggagacaactgtaacctctctgatcggtttcacgaacacgaaaatggaaagtcccggaaacggagacacgacagtgtggagaacagtgacagtcatgttgaaaagaaagcccggaggagcgaacagaaggatcctctagaagagcctaaagcaaagaagcacaaaaaatcaaagaagaaaaagaaatccaaagacaaacaccgagaccgcgactccaggcatcagcaggactcagacctctcagcagcgtgctctgacgctgacctccacagacacaaaaaaaagaagaagaaaaagaagagacattcaagaaaatcagaggactttgttaaagattcagaactgcacttacccagggtcaccagcttggagactgtcgcccagttccggagagcccagggtggctttcctctctctggtggcccgcctctggaaggcgtcggacctttccgtgagaaaacgaaacacttacggatggaaagcagggatgacaggtgtcgtctctttgagtatggccagggtgattgaaaactcagcctcaaaacaaaaaattcactagttatgattcaacgcgttcaacagaagccatccccagcccagcttaaattataaagatagacaataactctgttccaatctgcgtggtgcttctttagtaaatactgtacagattttaccatggagaactttttttttagtttttaccttttcttaattacccttattccgaatggacgaacactttctaccactgctgaccattgtaaaataccgtgtatataaatcccattgaaataatgccctggaatagaacatctcaaatgctgcttaattacagactcaggtcgattacttgtatttcatgtaatgttcctccaagttagacatctggtgcaagaccaaccgggagaccatggaattgtcaaaagtacaaactgacagtgtgtatatttaatttaaagacttatttaaaaactcacaagctctcacctagactttggagagcagtctgttttctgtaatgtctgatactagaaactaatttgcttattttagttgtattcaagatttgaagatgtattttatagacaagttctgtttttgaactttgtggaactgttccaatcaatcaatttcccagttatgatgagtatttacattatgaatgtataacccagacatgatttgtaaagccgacagtatgtttctattacacaacactttttgatacagcgtctcttgtcttcactgatactggagtctccgttgtctgcttggtcccttcgagtttctagttacagacacaatcatactgtgattttatttttaatatggatatgctatcaaactgtgatacacttataattcactggtcctgcatcaggagatggagtggggaaaactgtatttaatacagtttgtatctgaataatctgtatggtttatacagtttgtgttgttcagagatgtttaaagtttgatctttgtttttctaaagattaaaaaagcacttgccccactgtaaatatacagcatgtaaaatttctatagtatataaatggcagcaaatcaca

SEQ ID NO: 8013 - DNA, 4066 bp, Homo sapiens
atggacctgggccccggggacgcggcaggagggggaccgctcgcgccccggccccgccgccgccgctccctgcgccgcctgttcagccgcttcctgctggcgctgggcagccgctcacgccccggggactcaccgccccggccccagccgggacactgtgatggcgacggtgaggggggcttcgcctgcgccccgggcccagttccagcggcccccgggagccccggggaggaacgcccgcccggaccccagccccagctccagctccccgccggcgatggggcgcggccgccgggcgctcagggcttgaagaaccacggcaacacctgtttcatgaacgcggtggtgcagtgtctcagcaacaccgacctgctggccgagttcctggcgctggggcgctaccgggcggctccgggccgcgccgaggtcaccgagcagctggcggcgctggtgcgcgcgctctggactcgcgaatacacgccccaactttccgcggagttcaagaatgcagtttccaagtacggctctcagttccaaggcaattcccagcacgacgccctggaattcctgctctggttgctggatcgtgtacatgaggacctggagggttcatcccgagggccggtgtcggagaagcttccgcctgaagccactaaaacctctgagaactgcctgtcaccatcagctcagcttcctctaggtcaaagctttgtgcaaagccactttcaagcacaatatagatcttccttgacttgtccccactgcctgaaacagagcaacacctttgatcctttcctgtgtgtgtccctacctatccccttgcgccagacgaggttcttgagtgtcaccttggtcttcccctctaagagccagcggttcctgcgggttggcctggccgtgccgatcctcagcacagtggcagccctgaggaagatggttgcagaggaaggaggcgtccctgcagatgaggtgatcttggttgaactgtatcccagtggattccagcggtctttctttgatgaagaggacctgaataccatcgcagagggagataatgtgtatgcctttcaagttcctccctcacccagccaggggactctctcagctcatccactgggtctgtcggcctccccacgcctggcagcccgtgagggccagcgattctccctctctctccacagtgagagcaaggtgctaatcctcttctgtaacttggtggggtcagggcagcaggctagcaggtttgggccacccttcctgataagggaagacagagctgtttcctgggcccagctccagcagtctatcctcagcaaggtccgccatcttatgaagagtgaggcccctgtacagaacctggggtctctgttctccatccgtgttgtgggactctctgtggcctgcagctatttgtctccgaaggacagtcggcccctctgtcactgggcagttgacagggttttgcatctcaggaggccaggaggccctccacatgtcaagctggcggtggagtgggatagctctgtcaaggagcgcctgttcgggagcctccaggaggagcgagcgcaggatgccgacagtgtgtggcagcagcagcaggcgcatcagcagcacagctgtaccttggatgaatgttttcagttctacaccaaggaggagcagctggcccaggatgacgcctggaagtgtcctcactgccaagtcctgcagcaggggatggtgaagctgagtttgtggacgctgcctgacatcctcatcatccacctcaaaaggttctgccaggtgggcgagagaagaaacaagctctccacgctggtgaagtttccgctctctggactcaacatggctccccatgtggcccagagaagcaccagccctgaggcaggactgggcccctggccttcctggaagcagccggactgcctgcccaccagttacccgctggacttcctgtacgacctgtatgccgtctgcaaccaccatggcaacctgcaaggtgggcattacacagcctactgccggaactctctggatggccagtggtacagttatgatgacagcacggtggaaccgcttcgagaagatgaggtcaacaccagaggggcttatatcctgttctatcagaagcggaacagcatccctccctggtcagccagcagctccatgagaggctctaccagctcctccctgtctgatcactggctcttacggctcgggagccacgctggcagcacaaggggaagcctgctgtcctggagctctgccccctgcccctccctgccccaggttcctgactctcccatcttcaccaacagcctctgcaatcaggaaaagggagggttggagcccaggcgtttggtacggggcgtgaaaggcagaagcattagcatgaaggcacccaccacttcccgagccaagcagggaccattcaagaccatgcctctgcggtggtcctttggatccaaggagaaaccaccaggtgcctccgtcgagttggtggagtacttggaatccagacgaagacctcggtccacgagccagtccattgtgtcgctgttgacgggcactgcgggtgaggatgagaagtcagcatcgccgaggtccaacgtcgcccttcctgctaacagcgaagatggtgggcgggccattgaaagaggtccagccggggtgccctgtccctcggctcaacccaaccactgtctggcccctggaaactcagatggtccaaacacagcaaggaaactcaaggaaaatgcagggcaggacatcaagcttcccagaaagtttgacctgcctctcactgtgatgccttcagtggagcatgagaaaccagctcgaccggagggccagaaggccatgaactggaaggagagcttccagatgggaagcaaaagcagcccaccctccccctatatgggattctctggaaacagcaaagacagtcgccgaggcacctctgagctagacagacccctgcaggggacactcacccttctgaggtccgtgtttcggaagaaggagaacaggaggaatgagagggcagaggtctctccacaggtgccccccgtctccctggtgagtggcgggctgagccctgccatggacgggcaggctccaggctcacctcctgccctcaggatcccagagggcctggccaggggcctgggcagccggctcgagagggatgtctggtcagcccccagctctctccgcctccctcgtaaagccagcagggccccgagaggcagtgcactgggcatgtcacaaaggactgttccaggggagcaggcttcttatggcacctttcagagagtcaaatatcacactctttctttaggtcgaaagaaaaccttaccggagtccagcttttgatggagcgtgtcagtattgtgtgacgctggcattcttgggactttgccaagcaactgtaggcagctcatgttgagaatgggtttccaggaaacccgttgtcttgtaatctctaaaaaaaaatttttttttttttgtggtggggggtctccatatctagacttccaacacccaaggtccatataacccaaggtcgaaaaccttcctgcatcattgggtgctttgctacagtttggccactagaggatgctattgggtcagtattaccagtttcagggcaagaactgatatttactaaagagttttggatgtgggcaaacaagatgaggctggtttaataagaatcttcaatgtcatgtcaaatactgtcaatggcttttcctttttctttcttttttttttttaaattgtggacttaaagaaaaatattttatttttaatgcttttctgggataagcattaaagatgccaaaaagaaaaaaaaaacaaaagaatgatagtgatggtaaggcaagattctagcaaagagagatgggagataaatggctgagagttcaggtgaatatttaatatattaaaaattgtattaaagtttttcaaggtattttaaaaataactattttgatactagaaaaaaagtccattttttaatttaaatatgagatctatgtacaattttaataaaatcctgtccatg

SEQ ID NO: 8014 - DNA, 3500 bp, Homo sapiens
cggcaccaggagccttagagaagctgtagggcctgctggccgctcgtccgcctcgcgcccgggggctccgcgcctggagctgcgccggcggcagccatggacctgggccccggggacgcggcaggagggggaccgctcgcgccccggccccgccgccgccgctccctgcgccgcctgttcagccgcttcctgctggcgctgggcagccgctcacgccccggggactcaccgccccggccccagccgggacactgtgatggcgacggtgaggggggcttcgcctgcgccccgggcccagttccagcggcccccgggagccccggggaggaacgcccgcccggaccccagccccagctccagctccccgccggcgatggggcgcggccgccgggcgctcagggcttgaagaaccacggcaacacctgtttcatgaacgcggtggtgcagtgtctcagcaacaccgacctgctggccgagttcctggcgctggggcgctaccgggcggctccgggccgcgccgaggtcaccgagcagctggcggcgctggtgcgcgcgctctggactcgcgaatacacgccccaactttccgcggagttcaagaatgcagtttccaagtacggctctcagttccaaggcaattcccagcacgacgccctggaattcctgctctggttgctggatcgtgtacatgaggacctggagggttcatcccgagggccggtgtcggagaagcttccgcctgaagccactaaaacctctgagaactgcctgtcaccatcagctcagcttcctctaggtcaaagctttgtgcaaagccactttcaagcacaatatagatcttccttgacttgtccccactgcctgaaacagagcaacacctttgatcctttcctgtgtgtgtccctacctatccccttgcgccagacgaggttcttgagtgtcaccttggtcttcccctctaagagccagcggttcctgcgggttggcctggccgtgccgatcctcagcacagtggcagccctgaggaagatggttgcagaggaaggaggcgtccctgcagatgaggtgatcttggttgaactgtatcccagtggattccagcggtctttctttgatgaagaggacctgaataccatcgcagagggagataatgtgtatgcctttcaagttcctccctcacccagccaggggactctctcagctcatccactgggtctgtcggcctccccacgcctggcagcccgtgagggccagcgattctccctctctctccacagtgagagcaaggtgctaatcctcttctgtaacttggtggggtcagggcagcaggctagcaggtttgggccacccttcctgataagggaagacagagctgtttcctgggcccagctccagcagtctatcctcagcaaggtccgccatcttatgaagagtgaggcccctgtacagaacctggggtctctgttctccatccgtgttgtgggactctctgtggcctgcagctatttgtctccgaaggacagtcggcccctctgtcactgggcagttgacagggttttgcatctcaggaggccaggaggccctccacatgtcaagctggcggtggagtgggatagctctgtcaaggagcgcctgttcgggagcctccaggaggagcgagcgcaggatgccgacagtgtgtggcagcagcagcaggcgcatcagcagcacagctgtaccttggatgaatgttttcagttctacaccaaggaggagcagctggcccaggatgacgcctggaagtgtcctcactgccaagtcctgcagcaggggatggtgaagctgagtttgtggacgctgcctgacatcctcatcatccacctcaaaaggttctgccaggtgggcgagagaagaaacaagctctccacgctggtgaagtttccgctctctggactcaacatggctccccatgtggcccagagaagcaccagccctgaggcaggactgggcccctggccttcctggaagcagccggactgcctgcccaccagttacccgctggacttcctgtacgacctgtatgccgtctgcaaccaccatggcaacctgcaagcctactgccggaactctctggatggccagtggtacagttatgatgacagcacggtggaaccgcttcgagaagatgaggtcaacaccagaggggcttatatcctgttctatcagaagcggaacagcatccctccctggtcagccagcagctccatgagaggctctaccagctcctccctgtctgatcactggctcttacggctcgggagccacgctggcagcacaaggggaagcctgctgtcctggagctctgccccctgcccctccctgccccaggttcctgactctcccatcttcaccaacagcctctgcaatcaggaaaagggagggttggagcccaggcgtttggtacggggcgtgaaaggcagaagcattagcatgaaggcacccaccacttcccgagccaagcagggaccattcaagaccatgcctctgcggtggtcctttggatccaaggagaaaccaccaggtgcctccgtcgagttggtggagtacttggaatccagacgaagacctcggtccacgagccagtccattgtgtcgctgttgacgggcactgcgggtgaggatgagaagtcagcatcgccgaggtccaacgtcgcccttcctgctaacagcgaagatggtgggcgggccattgaaagaggtccagccggggtgccctgtccctcggctcaacccaaccactgtctggcccctggaaactcagatggtccaaacacagcaaggaaactcaaggaaaatgcagggcaggacatcaagcttcccagaaagtttgacctgcctctcactgtgatgccttcagtggagcatgagaaaccagctcgaccggagggccagaaggccatgaactggaaggagagcttccagatgggaagcaaaagcagcccaccctccccctatatgggattctctggaaacagcaaagacagtcgccgaggcacctctgagctagacagacccctgcaggggacactcacccttctgaggtccgtgtttcggaagaaggagaacaggaggaatgagagggcagaggtctctccacaggtgccccccgtctccctggtgagtggcgggctgagccctgccatggacgggcaggctccaggctcacctcctgccctcaggatcccagagggcctggccaggggcctgggcagccggctcgagagggatgtctggtcagcccccagctctctccgcctccctcgtaaagccagcagggccccgagaggcagtgcactgggcatgtcacaaaggactgttccaggggagcaggcttcttatggcacctttcagagagtcaaatatcacactctttctttaggtcgaaagaaaaccttaccggagtccagcttttgatggagcgtgtcagtattgtgtgacgctggcattcttgggactttgcc

SEQ ID NO: 8015 - DNA, 6255 bp, Homo sapiens
ggcgctttggtcgcagcggcggtatggtcgccgcagtttctcggtcttcgcttcggcgaccttgacccccttgtgggtgggcgaggctggaagagaggctccccaccccactcggcttcctgatccctgggggcgccgggcggtcaccgagggccgtgtgagcgccgctctgccggctccgggtccatgcggctgcgggagaagccctgggcgtcggggctggcctgggaggggcccgagtcccctggtgacctgggcgcgcggcggccccacacctttccgtccgcctcatcgcggcgcatttctcttcacatcctcggggtgtgtgtgtgttggtgaccggaggaagcctgtctaatgacttttctggaagcgtcgtgtattaggagctccggggccggactgcttgggtccgcatctccatccaccgcttactggctttgggacctctgcaagtcacttcacttctctttctcagtttcaagtgtaaaatgcggaaaataatagcaacttatctcctaagtaaataacagatgcgggtgaaagatccaactaaagctttacctgagaaagccaaaagaagtaaaaggcctactgtacctcatgatgaagactcttcagatgatattgctgtaggtttaacttgccaacatgtaagtcatgctatcagcgtgaatcatgtaaagagagcaatagctgagaatctgtggtcagtttgctcagaatgtttaaaagaaagaagattctatgatgggcagctagtacttacttctgatatttggttgtgcctcaagtgtggcttccagggatgtggtaaaaactcagaaagccaacattcattgaagcactttaagagttccagaacagagccccattgtattataattaatctgagcacatggattatatggtgttatgaatgtgatgaaaaattatcaacgcattgtaataagaaggttttggctcagatagttgattttctccagaaacatgcttctaaaacacaaacaagtgcattttctagaatcatgaaactttgtgaagaaaaatgtgaaacagatgaaatacagaagggaggaaaatgcagaaatttatctgtaagaggaattacaaatttaggaaatacttgcttttttaatgcagtcatgcagaacttggcacagacttatactcttactgatctgatgaatgagatcaaagaaagtagtacaaaactcaagatttttccttcctcagactctcagctggacccattggtggtggaactttcaaggcctggaccactgacctcagccttgttcctgtttcttcacagcatgaaggagactgaaaaaggaccactttctcctaaagttctttttaatcagctttgtcagaaggcacctcgatttaaagatttccagcaacaggacagtcaggagcttcttcattatcttctggatgcagtgaggacagaagaaacaaagcgaatacaagctagcattctaaaagcatttaacaacccaactactaaaactgctgatgatgaaactagaaaaaaagtcaaagcatatggaaaagaaggtgtgaaaatgaacttcatagatcggatctttattggtgaattaactagcacggtcatgtgtgaagaatgtgcaaatatctccacggtgaaagatccattcattgatatttcacttcctataatagaagaaagggtttcaaaacctttactttggggaagaatgaataaatatagaagtttacgggagacagatcatgatcgatacagtggcaatgttactatagaaaatattcatcaacctagagctgccaagaagcattcttcatctaaagataagagtcaactaattcatgaccgaaaatgtattagaaaattgtcatctggagaaactgtcacataccagaaaaatgaaaaccttgaaatgaatggggattctttaatgtttgccagcctcatgaattctgagtcacgtctgaatgaaagccctactgatgacagtgaaaaagaagccagccattctgaaagcaatgttgatgctgacagtgagccttcagaatctgaaagtgcttcaaagcagactgggctgttcagatccagtagtggatccggtgtgcagccagatggacccctttaccctctgtcagcaggtaaactgctgtacaccaaggagactgacagtggtgataaggaaatggcagaagctatttctgaacttcgtttgagcagcactgtaactggagatcaagattttgacagagaaaatcagccactaaatatttcaaataatttatgttttttagaggggaagcatttgaggtcttatagtccccaaaatgcttttcagaccctttctcagagctatataactacttctaaagaatgttcaattcagtcctgtctctaccagtttacatctatggaattactaatggggaataataagcttctatgtgagaattgtactaaaaacaaacagaagtaccaagaagaaaccagttttgcagaaaagaaagtagaaggagtttatactaatgccaggaagcaattgctcatttctgctgttccagctgtcctaattctccacctgaaaagatttcatcaggctggcttgagtcttcgtaaagtaaacagacatgtagattttccacttatgctcgatttagcaccattctgctctgctacttgtaagaatgcaagtgtgggagataaagttctctacggtctctatggcatagtggaacatagtggctcgatgagagaaggccactacactgcttatgtgaaagtgagaacaccctccaggaaattatcggaacataacactaaaaagaaaaatgtgcctggtttgaaagcggctgataatgaatcagcaggccagtgggtccatgttagtgacacttacttacaggtggttccagaatcaagagcacttagtgcacaagcctaccttcttttctatgaaagagtattataactattaatggtaatgattatttaggtcatttgtttttgaatgccacagtgataactataatatataatgtgcctttctagtcttccctcttctgtaggaatagcatgttcctcaaatggtcctgaactttttcaccattttggtgaacccttttaaagtaaatttactcaatgctttaaaattcatagtcttaaaataaatgtgaattttgtttccaggtatttattctggggtacaaaaacttcccagaatttacagtaggaaaggaaacccctttatgatgtggcttattattacaagcattcagaaatgatgctggctaagtcaaatcattccttgagacagtgattcctaaatgtaatgccaccttcctgaactctcacatattctatatcatggttattttaaaaaatatatttttagccttttgtaaccttagtcttgttttgagcaatcatattccgtgttttatgtgcttttatatttttataataaatattaaagtaaaactattaaaaattgtttatccacgtaccacttaacttaaaatcatctcagggccatctagtggtatatatgtgtactaccatttaggaaactgctataacacataatttcatgaagtaacacctaatacggtgtagttccctggtcatattttatacaattcaaccatataaaagggtgtcactgtaatttcagtagtgtgggtttacaaataatctgctggttagcttattaccttgaggttttgaaaaactagaattatattgaggcatttcataaacatatctcttgcaccctcttcatggtggagttaaggataacttgcaggtggttggccaaggcccaatatagatgattataacatttagaattggcaattagaagttgataatccatataggaccataggatagctttgaaatataaattaccaaattatatttgtaaatgatagagaattatattcttaacagaaaaatatatactttttctacttcttgtaaatactaaacacagttttggggttttgaaatcactttgtcttcagcaagcatcattaataagttcaggtgaatttagcttttaatggggcattaagctggcatttttgattttctttttaaataatagcaaaaatatcatttttcccctctagaatacaaattattgagctgtcaaaacttggcatgaagaatatactattacttaggcttaaatatcaaaagataatggctacttcagtgtcatattgttgaaatagaaacaaaactgcatggttcaagcatcctaatcattagtgccaatgaatgatagtgcaggcaagtgccaggtaaatgcctagtcccacttcattctcctcctgggaagaaaggataagaatagtggctgcagataaggtatggaaatatttaatcaagactgtcttaaacacataagcatatataatgttatcaaggttaccagtgctgccttttgatatatggatgaacataactgtaattaaagacggtaatagtatacaaaatgcagagcttaaaaatgtcattgcataaattctatttttaagatgttgaaatgttagtagtgtttttcttgatttttaacagtgaaataatcaagaaatatatctttaagttaatctgcaaagtcaggctgtgttctgtaaaaggtatttcacagcattttctgtttaactgtaatctgttatcatggagatctcagtaccagagcagtgaattttttgaaaaatattgactgtctttattcaagtcagccatcttggtaagagcagttttcatccccccactgcccaaatgtaaatatagatcacctaatttttcttacagaaagatactgttaagaggcatgcacttttcatcggatggtcacttgtttcttgtttcaaagacaaatatttggatagatacccatacttgctatgagtcagtcacagtgctgacactattttaacatcatttaaaatggaaagatctacatagatttttgacattattccagaagtaacatgcaagtaagatatttttattgtcattttcttcatgttaaaggagctacttatgaaacctatttttttatggcctagagtttatgagtgctttttccttgtcttctgaaaatggaataaattggatttttgatacttaagaatttcctaaagatagcttttgtaacagagaaagcatgttaaattacacatgggtctaccttaaaatttttgttattatttccaaagcacatttgcagggatagtaaatgtatatagtagcaagtctactataataacagtagtttctggatcacctcaggaaacagtataaataaataataatgtttacttatcatcaacataactaccatagtgtttgaatgaattaaagtttcattagctttatttagaaactggtttaccccagcttcccgtttttttccaaatataaaatgataaaatattgattatgtgccaatattgtcatttaatgttcttaaaacttgtgaagaccacctttttaggtagctgagaagagtgatagttggtatcaatttgttagccaggcatggtggctcatgctgttgggaggctgagtggggaagatgcttgagcccaggaggtcaaggtgcagtgaaccatgatcacaccactgcattcctgcagagtgacggagtgagaccctgtctcaaaaataaataaaaagaagacagttggtatcaattcaaagaatagttgatgcctgttctcttattttaaatgtaccaacagagctattttactgtatttaatagttcttagcttccatgtgtgatgattttaatcagtgattttatgcaatagctgaagaaaattttctgaagattaagctgtgaaatgtatcaaccctcatctaatttttgtagtacaaaatgacatcctgattccttttaaaaattcacgtttgtaatttatttttctgcatgtattgatcaaataagcctaaaccaaatatgtgcaataaaattgagcctttagatagtatctagtgcattgttaaaaaagattatttctagatatttatgatgtttttgtttacgtagaaatcatgaattcaaatgtttaaaagatgaccatattttcaattttgagtaatacatattattcctactgttttttttcttttgccatgtttctagaaaacagctgtgtaacttattgagcgttattttggtgttactgtataaaacatgcataataaatattcttatttatctcatgtta

SEQ ID NO: 8016 - DNA, 1445 bp, Homo sapiens
tgggggcgggcgaacgaggccccacctctgccgggagcgggacgagcgcgcaggcgcagtctccccaggttgtagacgctgcggcccggcccggcgggtaaataacagatgcgggtgaaagatccaactaaagctttacctgagaaagccaaaagaagtaaaaggcctactgtacctcatgatgaagactcttcagatgatattgctgtaggtttaacttgccaacatgtaagtcatgctatcagcgtgaatcatgtaaagagagcaatagctgagaatctgtggtcagtttgctcagaatgtttaaaagaaagaagattctatgatgggcagctagtacttacttctgatatttggttgtgcctcaagtgtggcttccagggatgtggtaaaaactcagaaagccaacattcattgaagcactttaagagttccagaacagagccccattgtattataattaatctgagcacatggattatatggtgttatgaatgtgatgaaaaattatcaacgcattgtaataagaaggttttggctcagatagttgattttctccagaaacatgcttctaaaacacaaacaagtgcattttctagaatcatgaaactttgtgaagaaaaatgtgaaacagatgaaatacagaagggaggaaaatgcagaaatttatctgtaagaggaattacaaatttaggaaatacttgcttttttaatgcagtcatgcagaacttggcacagacttatactcttactgatctgatgaatgagatcaaagaaagtagtacaaaactcaagatttttccttcctcagactctcagctggacccattggtggtggaactttcaaggcctggaccactgacctcagccttgttcctgtttcttcacagcatgaaggagactgaaaaaggaccactttctcctaaagttctttttaatcagctttgtcagaagtgggtgcatctacatttaatataaataattatgagttacaaaatactaatgtattcatcatttaacatgaatagtcgtttttactgtaactttgctcttattgccctgactatgaagagaactaaaatttgttacagctctatgctttatgaaaattatatctcagtcctcagaagaagcagcttatcctcatatataaggaaatggagacacagaaattaaatggctcacctagtctgagtgaaaagctgagaatcaaatggagatctgtcctgacttggatgcctatgttgtaataccataaagtgagaaaaccatagagttgtaaaatctagaaagtaccgtaagataacatctaatctagctttcttattttaaaagatgagctgtgaggcaaatagagtttaagtgaatttctcaaggtattacagtatgtttaaaaaccaaatccttatgtgcctggaaataaacacataaaggatctgacttga

SEQ ID NO: 8017 - DNA, 569 bp, Homo sapiens
atcccttcagtaaataacagatgcgggtgaaagatccaactaaagctttacctgagaaagccaaaagaagtaaaaggcctactgtacctcatgatgaagactcttcagatgatattgctgtaggtttaacttgccaacatgtaagtcatgctatcagcgtgaatcatgtaaagagagcaatagctgagaatctgtggtcagtttgctcagaatgtttaaaagaaagaagattctatgatgggcagctagtacttacttctgatatttggttgtgcctcaagtgtggcttccagggatgtggtaaaaactcagaaagccaacattcattgaagcactttaagagttccagaacagagccccattgtattataattaatctgagcacatggattatatggtgttatgaatgtgatgaaaaattatcaacgcattgtaataagaaggttttggctcagatagttgattttctccagaaacatgcttctaaaacacaaacaaggccaggccccatcctgattcatctcttcagcataaactgtctaggggcccacagtgagtcagtttgttga

SEQ ID NO: 8018 - DNA, 6075 bp, Homo sapiens
ggcgctttggtcgcagcggcggtatggtcgccgcagtttctcggtcttcgcttcggcgaccttgacccccttgtgggtgggcgaggctggaagagaggctccccaccccactcggcttcctgatccctgggggcgccgggcggtcaccgagggccgtgtgagcgccgctctgccggctccgggtccatgcggctgcgggagaagccctgggcgtcggggctggcctgggaggggcccgagtcccctggtgacctgggcgcgcggcggccccacacctttccgtccgcctcatcgcggcgcatttctcttcacatcctcggggtgtgtgtgtgttggtgaccggaggaagcctgtctaatgacttttctggaagcgtcgtgtattaggagctccggggccggactgcttgggtccgcatctccatccaccgcttactggctttgggacctctgcaagtcacttcacttctctttctcagtttcaagtgtaaaatgcggaaaataatagcaacttatctcctaagtaaataacagatgcgggtgaaagatccaactaaagctttacctgagaaagccaaaagaagtaaaaggcctactgtacctcatgatgaagactcttcagatgatattgctgtaggtttaacttgccaacatgtaagtcatgctatcagcgtgaatcatgtaaagagagcaatagctgagaatctgtggtcagtttgctcagaatgtttaaaagaaagaagattctatgatgggcagctagtacttacttctgatatttggttgtgcctcaagtgtggcttccagggatgtggtaaaaactcagaaagccaacattcattgaagcactttaagagttccagaacagagccccattgtattataattaatctgagcacatggattatatggtgttatgaatgtgatgaaaaattatcaacgcattgtaataagaaggttttggctcagatagttgattttctccagaaacatgcttctaaaacacaaacaagtgcattttctagaatcatgaaactttgtgaagaaaaatgtgaaacagatgaaatacagaagggaggaaaatgcagaaatttatctgtaagaggaattacaaatttaggaaatacttgcttttttaatgcagtcatgcagaacttggcacagacttatactcttactgatctgatgaatgagatcaaagaaagtagtacaaaactcaagatttttccttcctcagactctcagctgggcacctcgatttaaagatttccagcaacaggacagtcaggagcttcttcattatcttctggatgcagtgaggacagaagaaacaaagatctccacggtgaaagatccattcattgatatttcacttcctataatagaagaaagggtttcaaaacctttactttggggaagaatgaataaatatagaagtttacgggagacagatcatgatcgatacagtggcaatgttactatagaaaatattcatcaacctagagctgccaagaagcattcttcatctaaagataagagtcaactaattcatgaccgaaaatgtattagaaaattgtcatctggagaaactgtcacataccagaaaaatgaaaaccttgaaatgaatggggattctttaatgtttgccagcctcatgaattctgagtcacgtctgaatgaaagccctactgatgacagtgaaaaagaagccagccattctgaaagcaatgttgatgctgacagtgagccttcagaatctgaaagtgcttcaaagcagactgggctgttcagatccagtagtggatccggtgtgcagccagatggacccctttaccctctgtcagcaggtaaactgctgtacaccaaggagactgacagtggtgataaggaaatggcagaagctatttctgaacttcgtttgagcagcactgtaactggagatcaagattttgacagagaaaatcagccactaaatatttcaaataatttatgttttttagaggggaagcatttgaggtcttatagtccccaaaatgcttttcagaccctttctcagagctatataactacttctaaagaatgttcaattcagtcctgtctctaccagtttacatctatggaattactaatggggaataataagcttctatgtgagaattgtactaaaaacaaacagaagtaccaagaagaaaccagttttgcagaaaagaaagtagaaggagtttatactaatgccaggaagcaattgctcatttctgctgttccagctgtcctaattctccacctgaaaagatttcatcaggctggcttgagtcttcgtaaagtaaacagacatgtagattttccacttatgctcgatttagcaccattctgctctgctacttgtaagaatgcaagtgtgggagataaagttctctacggtctctatggcatagtggaacatagtggctcgatgagagaaggccactacactgcttatgtgaaagtgagaacaccctccaggaaattatcggaacataacactaaaaagaaaaatgtgcctggtttgaaagcggctgataatgaatcagcaggccagtgggtccatgttagtgacacttacttacaggtggttccagaatcaagagcacttagtgcacaagcctaccttcttttctatgaaagagtattataactattaatggtaatgattatttaggtcatttgtttttgaatgccacagtgataactataatatataatgtgcctttctagtcttccctcttctgtaggaatagcatgttcctcaaatggtcctgaactttttcaccattttggtgaacccttttaaagtaaatttactcaatgctttaaaattcatagtcttaaaataaatgtgaattttgtttccaggtatttattctggggtacaaaaacttcccagaatttacagtaggaaaggaaacccctttatgatgtggcttattattacaagcattcagaaatgatgctggctaagtcaaatcattccttgagacagtgattcctaaatgtaatgccaccttcctgaactctcacatattctatatcatggttattttaaaaaatatatttttagccttttgtaaccttagtcttgttttgagcaatcatattccgtgttttatgtgcttttatatttttataataaatattaaagtaaaactattaaaaattgtttatccacgtaccacttaacttaaaatcatctcagggccatctagtggtatatatgtgtactaccatttaggaaactgctataacacataatttcatgaagtaacacctaatacggtgtagttccctggtcatattttatacaattcaaccatataaaagggtgtcactgtaatttcagtagtgtgggtttacaaataatctgctggttagcttattaccttgaggttttgaaaaactagaattatattgaggcatttcataaacatatctcttgcaccctcttcatggtggagttaaggataacttgcaggtggttggccaaggcccaatatagatgattataacatttagaattggcaattagaagttgataatccatataggaccataggatagctttgaaatataaattaccaaattatatttgtaaatgatagagaattatattcttaacagaaaaatatatactttttctacttcttgtaaatactaaacacagttttggggttttgaaatcactttgtcttcagcaagcatcattaataagttcaggtgaatttagcttttaatggggcattaagctggcatttttgattttctttttaaataatagcaaaaatatcatttttcccctctagaatacaaattattgagctgtcaaaacttggcatgaagaatatactattacttaggcttaaatatcaaaagataatggctacttcagtgtcatattgttgaaatagaaacaaaactgcatggttcaagcatcctaatcattagtgccaatgaatgatagtgcaggcaagtgccaggtaaatgcctagtcccacttcattctcctcctgggaagaaaggataagaatagtggctgcagataaggtatggaaatatttaatcaagactgtcttaaacacataagcatatataatgttatcaaggttaccagtgctgccttttgatatatggatgaacataactgtaattaaagacggtaatagtatacaaaatgcagagcttaaaaatgtcattgcataaattctatttttaagatgttgaaatgttagtagtgtttttcttgatttttaacagtgaaataatcaagaaatatatctttaagttaatctgcaaagtcaggctgtgttctgtaaaaggtatttcacagcattttctgtttaactgtaatctgttatcatggagatctcagtaccagagcagtgaattttttgaaaaatattgactgtctttattcaagtcagccatcttggtaagagcagttttcatccccccactgcccaaatgtaaatatagatcacctaatttttcttacagaaagatactgttaagaggcatgcacttttcatcggatggtcacttgtttcttgtttcaaagacaaatatttggatagatacccatacttgctatgagtcagtcacagtgctgacactattttaacatcatttaaaatggaaagatctacatagatttttgacattattccagaagtaacatgcaagtaagatatttttattgtcattttcttcatgttaaaggagctacttatgaaacctatttttttatggcctagagtttatgagtgctttttccttgtcttctgaaaatggaataaattggatttttgatacttaagaatttcctaaagatagcttttgtaacagagaaagcatgttaaattacacatgggtctaccttaaaatttttgttattatttccaaagcacatttgcagggatagtaaatgtatatagtagcaagtctactataataacagtagtttctggatcacctcaggaaacagtataaataaataataatgtttacttatcatcaacataactaccatagtgtttgaatgaattaaagtttcattagctttatttagaaactggtttaccccagcttcccgtttttttccaaatataaaatgataaaatattgattatgtgccaatattgtcatttaatgttcttaaaacttgtgaagaccacctttttaggtagctgagaagagtgatagttggtatcaatttgttagccaggcatggtggctcatgctgttgggaggctgagtggggaagatgcttgagcccaggaggtcaaggtgcagtgaaccatgatcacaccactgcattcctgcagagtgacggagtgagaccctgtctcaaaaataaataaaaagaagacagttggtatcaattcaaagaatagttgatgcctgttctcttattttaaatgtaccaacagagctattttactgtatttaatagttcttagcttccatgtgtgatgattttaatcagtgattttatgcaatagctgaagaaaattttctgaagattaagctgtgaaatgtatcaaccctcatctaatttttgtagtacaaaatgacatcctgattccttttaaaaattcacgtttgtaatttatttttctgcatgtattgatcaaataagcctaaaccaaatatgtgcaataaaattgagcctttagatagtatctagtgcattgttaaaaaagattatttctagatatttatgatgtttttgtttacgtagaaatcatgaattcaaatgtttaaaagatgaccatattttcaattttgagtaatacatattattcctactgttttttttcttttgccatgtttctagaaaacagctgtgtaacttattgagcgttattttggtgttactgtataaaacatgcataataaatattcttatttatctcatgttacaagattggtcctggaattttcacagtttacgttattgacagaatgttttatcaacaatgcatttgcttatgtcttagtccactcaggctgctataataaaataccatcaactatgtggtgtatt

SEQ ID NO: 8019 - DNA, 1617 bp, Homo sapiens
ggcgctttggtcgcagcggcggtatggtcgccgcagtttctcggtcttcgcttcggcgaccttgacccccttgtgggtgggcgaggctggaagagaggctccccaccccactcggcttcctgatccctgggggcgccgggcggtcaccgagggccgtgtgagcgccgctctgccggctccgggtccatgcggctgcgggagaagccctgggcgtcggggctggcctgggaggggcccgagtcccctggtgacctgggcgcgcggcggccccacacctttccgtccgcctcatcgcggcgcatttctcttcacatcctcggggtgtgtgtgtgttggtgaccggaggaagcctgtctaatgacttttctggaagcgtcgtgtattaggagctccggggccggactgcttgggtccgcatctccatccaccgcttactggctttgggacctctgcaagtcacttcacttctctttctcagtttcaagtgtaaaatgcggaaaataatagcaacttatctcctaagtaaataacagatgcgggtgaaagatccaactaaagctttacctgagaaagccaaaagaagtaaaaggcctactgtacctcatgatgaagactcttcagatgatattgctgtaggtttaacttgccaacatgtaagtcatgctatcagcgtgaatcatgtaaagagagcaatagctgagaatctgtggtcagtttgctcagaatgtttaaaagaaagaagattctatgatgggcagctagtacttacttctgatatttggttgtgcctcaagtgtggcttccagggatgtggtaaaaactcagaaagccaacattcattgaagcactttaagagttccagaacagagccccattgtattataattaatctgagcacatggattatatggtgttatgaatgtgatgaaaaattatcaacgcattgtaataagaaggttttggctcagatagttgattttctccagaaacatgcttctaaaacacaaacaagtgcattttctagaatcatgaaactttgtgaagaaaaatgtgaaacagatgaaatacagaagggaggaaaatgcagaaatttatctgtaagaggaattacaaatttaggaaatacttgcttttttaatgcagtcatgcagaacttggcacagacttatactcttactgatctgatgaatgagatcaaagaaagtagtacaaaactcaagatttttccttcctcagactctcagctggacccattggtggtggaactttcaaggcctggaccactgacctcagccttgttcctgtttcttcacagcatgaaggagactgaaaaaggaccactttctcctaaagttctttttaatcagctttgtcagaagtgggtgcatctacatttaatataaataattatgagttacaaaatactaatgtattcatcatttaacatgaatagtcgtttttactgtaactttgctcttattgccctgactatgaagagaactaaaatttgttacagctctatgctttatgaaaattatatctcagtcctcagaagaagcagcttatcctcatatataaggaaatggagacacagaaattaaatggctcacctagtct

SEQ ID NO: 8020 - DNA, 5826 bp, Homo sapiens
ccaggttgtagacgctgcggcccggcccggcgggtaaataacagatgcgggtgaaagatccaactaaagctttacctgagaaagccaaaagaagtaaaaggcctactgtacctcatgatgaagactcttcagatgatattgctgtaggtttaacttgccaacatgtaagtcatgctatcagcgtgaatcatgtaaagagagcaatagctgagaatctgtggtcagtttgctcagaatgtttaaaagaaagaagattctatgatgggcagctagtacttacttctgatatttggttgtgcctcaagtgtggcttccagggatgtggtaaaaactcagaaagccaacattcattgaagcactttaagagttccagaacagagccccattgtattataattaatctgagcacatggattatatggtgttatgaatgtgatgaaaaattatcaacgcattgtaataagaaggttttggctcagatagttgattttctccagaaacatgcttctaaaacacaaacaagtgcattttctagaatcatgaaactttgtgaagaaaaatgtgaaacagatgaaatacagaagggaggaaaatgcagaaatttatctgtaagaggaattacaaatttaggaaatacttgcttttttaatgcagtcatgcagaacttggcacagacttatactcttactgatctgatgaatgagatcaaagaaagtagtacaaaactcaagatttttccttcctcagactctcagctggacccattggtggtggaactttcaaggcctggaccactgacctcagccttgttcctgtttcttcacagcatgaaggagactgaaaaaggaccactttctcctaaagttctttttaatcagctttgtcagaaggcacctcgatttaaagatttccagcaacaggacagtcaggagcttcttcattatcttctggatgcagtgaggacagaagaaacaaagcgaatacaagctagcattctaaaagcatttaacaacccaactactaaaactgctgatgatgaaactagaaaaaaagtcaaagcatatggaaaagaaggtgtgaaaatgaacttcatagatcggatctttattggtgaattaactagcacggtcatgtgtgaagaatgtgcaaatatctccacggtgaaagatccattcattgatatttcacttcctataatagaagaaagggtttcaaaacctttactttggggaagaatgaataaatatagaagtttacgggagacagatcatgatcgatacagtggcaatgttactatagaaaatattcatcaacctagagctgccaagaagcattcttcatctaaagataagagtcaactaattcatgaccgaaaatgtattagaaaattgtcatctggagaaactgtcacataccagaaaaatgaaaaccttgaaatgaatggggattctttaatgtttgccagcctcatgaattctgagtcacgtctgaatgaaagccctactgatgacagtgaaaaagaagccagccattctgaaagcaatgttgatgctgacagtgagccttcagaatctgaaagtgcttcaaagcagactgggctgttcagatccagtagtggatccggtgtgcagccagatggacccctttaccctctgtcagcaggtaaactgctgtacaccaaggagactgacagtggtgataaggaaatggcagaagctatttctgaacttcgtttgagcagcactgtaactggagatcaagattttgacagagaaaatcagccactaaatatttcaaataatttatgttttttagaggggaagcatttgaggtcttatagtccccaaaatgcttttcagaccctttctcagagctatataactacttctaaagaatgttcaattcagtcctgtctctaccagtttacatctatggaattactaatggggaataataagcttctatgtgagaattgtactaaaaacaaacagaagtaccaagaagaaaccagttttgcagaaaagaaagtagaaggagtttatactaatgccaggaagcaattgctcatttctgctgttccagctgtcctaattctccacctgaaaagatttcatcaggctggcttgagtcttcgtaaagtaaacagacatgtagattttccacttatgctcgatttagcaccattctgctctgctacttgtaagaatgcaagtgtgggagataaagttctctacggtctctatggcatagtggaacatagtggctcgatgagagaaggccactacactgcttatgtgaaagtgagaacaccctccaggaaattatcggaacataacactaaaaagaaaaatgtgcctggtttgaaagcggctgataatgaatcagcaggccagtgggtccatgttagtgacacttacttacaggtggttccagaatcaagagcacttagtgcacaagcctaccttcttttctatgaaagagtattataactattaatggtaatgattatttaggtcatttgtttttgaatgccacagtgataactataatatataatgtgcctttctagtcttccctcttctgtaggaatagcatgttcctcaaatggtcctgaactttttcaccattttggtgaacccttttaaagtaaatttactcaatgctttaaaattcatagtcttaaaataaatgtgaattttgtttccaggtatttattctggggtacaaaaacttcccagaatttacagtaggaaaggaaacccctttatgatgtggcttattattacaagcattcagaaatgatgctggctaagtcaaatcattccttgagacagtgattcctaaatgtaatgccaccttcctgaactctcacatattctatatcatggttattttaaaaaatatatttttagccttttgtaaccttagtcttgttttgagcaatcatattccgtgttttatgtgcttttatatttttataataaatattaaagtaaaactattaaaaattgtttatccacgtaccacttaacttaaaatcatctcagggccatctagtggtatatatgtgtactaccatttaggaaactgctataacacataatttcatgaagtaacacctaatacggtgtagttccctggtcatattttatacaattcaaccatataaaagggtgtcactgtaatttcagtagtgtgggtttacaaataatctgctggttagcttattaccttgaggttttgaaaaactagaattatattgaggcatttcataaacatatctcttgcaccctcttcatggtggagttaaggataacttgcaggtggttggccaaggcccaatatagatgattataacatttagaattggcaattagaagttgataatccatataggaccataggatagctttgaaatataaattaccaaattatatttgtaaatgatagagaattatattcttaacagaaaaatatatactttttctacttcttgtaaatactaaacacagttttggggttttgaaatcactttgtcttcagcaagcatcattaataagttcaggtgaatttagcttttaatggggcattaagctggcatttttgattttctttttaaataatagcaaaaatatcatttttcccctctagaatacaaattattgagctgtcaaaacttggcatgaagaatatactattacttaggcttaaatatcaaaagataatggctacttcagtgtcatattgttgaaatagaaacaaaactgcatggttcaagcatcctaatcattagtgccaatgaatgatagtgcaggcaagtgccaggtaaatgcctagtcccacttcattctcctcctgggaagaaaggataagaatagtggctgcagataaggtatggaaatatttaatcaagactgtcttaaacacataagcatatataatgttatcaaggttaccagtgctgccttttgatatatggatgaacataactgtaattaaagacggtaatagtatacaaaatgcagagcttaaaaatgtcattgcataaattctatttttaagatgttgaaatgttagtagtgtttttcttgatttttaacagtgaaataatcaagaaatatatctttaagttaatctgcaaagtcaggctgtgttctgtaaaaggtatttcacagcattttctgtttaactgtaatctgttatcatggagatctcagtaccagagcagtgaattttttgaaaaatattgactgtctttattcaagtcagccatcttggtaagagcagttttcatccccccactgcccaaatgtaaatatagatcacctaatttttcttacagaaagatactgttaagaggcatgcacttttcatcggatggtcacttgtttcttgtttcaaagacaaatatttggatagatacccatacttgctatgagtcagtcacagtgctgacactattttaacatcatttaaaatggaaagatctacatagatttttgacattattccagaagtaacatgcaagtaagatatttttattgtcattttcttcatgttaaaggagctacttatgaaacctatttttttatggcctagagtttatgagtgctttttccttgtcttctgaaaatggaataaattggatttttgatacttaagaatttcctaaagatagcttttgtaacagagaaagcatgttaaattacacatgggtctaccttaaaatttttgttattatttccaaagcacatttgcagggatagtaaatgtatatagtagcaagtctactataataacagtagtttctggatcacctcaggaaacagtataaataaataataatgtttacttatcatcaacataactaccatagtgtttgaatgaattaaagtttcattagctttatttagaaactggtttaccccagcttcccgtttttttccaaatataaaatgataaaatattgattatgtgccaatattgtcatttaatgttcttaaaacttgtgaagaccacctttttaggtagctgagaagagtgatagttggtatcaatttgttagccaggcatggtggctcatgctgttgggaggctgagtggggaagatgcttgagcccaggaggtcaaggtgcagtgaaccatgatcacaccactgcattcctgcagagtgacggagtgagaccctgtctcaaaaataaataaaaagaagacagttggtatcaattcaaagaatagttgatgcctgttctcttattttaaatgtaccaacagagctattttactgtatttaatagttcttagcttccatgtgtgatgattttaatcagtgattttatgcaatagctgaagaaaattttctgaagattaagctgtgaaatgtatcaaccctcatctaatttttgtagtacaaaatgacatcctgattccttttaaaaattcacgtttgtaatttatttttctgcatgtattgatcaaataagcctaaaccaaatatgtgcaataaaattgagcctttagatagtatctagtgcattgttaaaaaagattatttctagatatttatgatgtttttgtttacgtagaaatcatgaattcaaatgtttaaaagatgaccatattttcaattttgagtaatacatattattcctactgttttttttcttttgccatgtttctagaaaacagctgtgtaacttattgagcgttattttggtgttactgtataaaacatgcataataaatattcttatttatctcatgttacaagattggtcctggaattttcacagtttacgttattgacagaatgttttatcaacaatg

SEQ ID NO: 8021 - DNA, 469 bp, Homo sapiens
gataaaagttggtgctggagaggcagcatgcaaagcgaaaagaagggactgctttgagttctagacccaacgcctccgggaccaccaagctcaccgcagagcgcagcctccgcggacccgaggaccgccctgcgcgcagtctcgagcagcaaccagggtagcaccattgcgggccggcggccgccgcgctagtgaccacttcctcctactccttctcctcctgctccggcctcctggcgccctgctccaggctctccggcgccctccagccaggcaccggccgaaccgggtagtgccgcaagtaaataacagatgcgggtgaaagatccaactaaagctttacctgagaaagccaaaagaagtaaaaggcctactgtacctcatgatgaagactcttcagatgatattgctgtaggtttaacttgccaacatgtaagtcatgctatcagcgtgaatcatgtaaagagag

SEQ ID NO: 8022 - DNA, 3778 bp, Homo sapiens
gctgccaagaagcattcttcatctaaagataagaaaagaaagtagaaggagtttatactaatgccaggaagcaattgctcatttctgctgttccagctgtcctaattctccacctgaaaagatttcatcaggctggcttgagtcttcgtaaagtaaacagacatgtagattttccacttatgctcgatttagcaccattctgctctgctacttgtaagaatgcaagtgtgggagataaagttctctacggtctctatggcatagtggaacatagtggctcgatgagagaaggccactacactgcttatgtgaaagtgagaacaccctccaggaaattatcggaacataacactaaaaagaaaaatgtgcctggtttgaaagcggctgataatgaatcagcaggccagtgggtccatgttagtgacacttacttacaggtggttccagaatcaagagcacttagtgcacaagcctaccttcttttctatgaaagagtattataactattaatggtaatgattatttaggtcatttgtttttgaatgccacagtgataactataatatataatgtgcctttctagtcttccctcttctgtaggaatagcatgttcctcaaatggtcctgaactttttcaccattttggtgaacccttttaaagtaaatttactcaatgctttaaaattcatagtcttaaaataaatgtgaattttgtttccaggtatttattctggggtacaaaaacttcccagaatttacagtaggaaaggaaacccctttatgatgtggcttattattacaagcattcagaaatgatgctggctaagtcaaatcattccttgagacagtgattcctaaatgtaatgccaccttcctgaactctcacatattctatatcatggttattttaaaaaatatatttttagccttttgtaaccttagtcttgttttgagcaatcatattccgtgttttatgtgcttttatatttttataataaatattaaagtaaaactattaaaaattgtttatccacgtaccacttaacttaaaatcatctcagggccatctagtggtatatatgtgtactaccatttaggaaactgctataacacataatttcatgaagtaacacctaatacggtgtagttccctggtcatattttatacaattcaaccatataaaagggtgtcactgtaatttcagtagtgtgggtttacaaataatctgctggttagcttattaccttgaggttttgaaaaactagaattatattgaggcatttcataaacatatctcttgcaccctcttcatggtggagttaaggataacttgcaggtggttggccaaggcccaatatagatgattataacatttagaattggcaattagaagttgataatccatataggaccataggatagctttgaaatataaattaccaaattatatttgtaaatgatagagaattatattcttaacagaaaaatatatactttttctacttcttgtaaatactaaacacagttttggggttttgaaatcactttgtcttcagcaagcatcattaataagttcaggtgaatttagcttttaatggggcattaagctggcatttttgattttctttttaaataatagcaaaaatatcatttttcccctctagaatacaaattattgagctgtcaaaacttggcatgaagaatatactattacttaggcttaaatatcaaaagataatggctacttcagtgtcatattgttgaaatagaaacaaaactgcatggttcaagcatcctaatcattagtgccaatgaatgatagtgcaggcaagtgccaggtaaatgcctagtcccacttcattctcctcctgggaagaaaggataagaatagtggctgcagataaggtatggaaatatttaatcaagactgtcttaaacacataagcatatataatgttatcaaggttaccagtgctgccttttgatatatggatgaacataactgtaattaaagacggtaatagtatacaaaatgcagagcttaaaaatgtcattgcataaattctatttttaagatgttgaaatgttagtagtgtttttcttgatttttaacagtgaaataatcaagaaatatatctttaagttaatctgcaaagtcaggctgtgttctgtaaaaggtatttcacagcattttctgtttaactgtaatctgttatcatggagatctcagtaccagagcagtgaattttttgaaaaatattgactgtctttattcaagtcagccatcttggtaagagcagttttcatccccccactgcccaaatgtaaatatagatcacctaatttttcttacagaaagatactgttaagaggcatgcacttttcatcggatggtcacttgtttcttgtttcaaagacaaatatttggatagatacccatacttgctatgagtcagtcacagtgctgacactattttaacatcatttaaaatggaaagatctacatagatttttgacattattccagaagtaacatgcaagtaagatatttttattgtcattttcttcatgttaaaggagctacttatgaaacctatttttttatggcctagagtttatgagtgctttttccttgtcttctgaaaatggaataaattggatttttgatacttaagaatttcctaaagatagcttttgtaacagagaaagcatgttaaattacacatgggtctaccttaaaatttttgttattatttccaaagcacatttgcagggatagtaaatgtatatagtagcaagtctactataataacagtagtttctggatcacctcaggaaacagtataaataaataataatgtttacttatcatcaacataactaccatagtgtttgaatgaattaaagtttcattagctttatttagaaactggtttaccccagcttcccgtttttttccaaatataaaatgataaaatattgattatgtgccaatattgtcatttaatgttcttaaaacttgtgaagaccacctttttaggtagctgagaagagtgatagttggtatcaatttgttagccaggcatggtggctcatgctgttgggaggctgagtggggaagatgcttgagcccaggaggtcaaggtgcagtgaaccatgatcacaccactgcattcctgcagagtgacggagtgagaccctgtctcaaaaataaataaaaagaagacagttggtatcaattcaaagaatagttgatgcctgttctcttattttaaatgtaccaacagagctattttactgtatttaatagttcttagcttccatgtgtgatgattttaatcagtgattttatgcaatagctgaagaaaattttctgaagattaagctgtgaaatgtatcaaccctcatctaatttttgtagtacaaaatgacatcctgattccttttaaaaattcacgtttgtaatttatttttctgcatgtattgatcaaataagcctaaaccaaatatgtgcaataaaattgagcctttagatagtatctagtgcattgttaaaaaagattatttctagatatttatgatgtttttgtttacgtagaaatcatgaattcaaatgtttaaaagatgaccatattttcaattttgagtaatacatattattcctactgttttttttcttttgccatgtttctagaaaacagctgtgtaacttattgagcgttattttggtgttactgtataaaacatgcataataaatattcttatttatctcatgt

SEQ ID NO: 8023 - DNA, 3062 bp, Homo sapiens
ttgtaggtaatagagaagaggaaacctaaccaatgactgtggaataatatggaagaagatggaaaaaacttgtttaatgggttgagaaagtggcgacttctataagacatggatagatgcaaacatgtagggcggttacggctcgcccaggaccactccatcctgaaccctcagaagtggtgctgcttagagtgtgccaccaccgagtccgtgtgggcctgcctcaagtgctcccacgtggcctgcggccgctatattgaggaccacgccctgaaacactttgaggagacgggacacccgctagccatggaagtccgggatctctacgtgttctgttacctgtgcaaggactacgtgctcaatgataacccagagggggacctgaagctgctaagaagctccctcctggcggtccggggccagaaacaggacacgccggtgagacgtgggcggacgctgcggtccatggcttcgggtgaggacgtggtcctgccgcagcgcgctcctcagggacagccgcagatgctcacggctctgtggtaccggcgtcagcgcctgctggccaggacgctgcggctgtggttcgagaagagctcccggggccaggcgaagctggagcagcggcggcaggaggaggccctggagcgcaagaaggaggaggcgcggaggcggcggcgcgaggtgaaacggcggctgctggaggagctggccagcacccctccgcgcaagagtgcacggctgctcctgcacacgccccgcgacgcgggcccggctgcctcgcgccccgccgccctccctacctcacgcagagtgcccgccgccacactcaagctgcgtcgccagccggccatggccccaggcgtcacgggcctgcgcaacctgggcaacacctgctacatgaactccatcctccaggtgctcagccacctccagaagttccgagaatgtttcctcaaccttgacccttccaaaacggaacatctgtttcccaaagccaccaacgggaagactcagctttctggcaagccaaccaacagctcggccacggagctgtccttgagaaatgacagggccgaggcatgcgagcgggagggcttctgctggaacggcagggcctccattagtcggagtctggagctcatccagaacaaggagccgagttcaaagcacatttccctctgccgtgaactgcacaccctcttccgagtcatgtggtccgggaagtgggccctagtgtcgcccttcgccatgctccactcagtgtggagcctgatccctgccttccgcggctacgaccaacaggacgcgcaggaatttctctgcgagctgctgcacaaggtgcagcaggaactcgagtctgagggcaccacacgccggatcctcatccccttctcccagaggaagctcaccaaacaggtcttaaaggtggtgaataccatatttcatgggcagctgctcagtcaggtcacatgtatatcatgcaattacaaatccaataccattgagcccttttgggacctatccctggaattccctgaacgctatcactgcatagaaaaggggtttgtccctttgaatcaaacagagtgcttgctcactgagatgctggccaaattcacagagacagaggccctggaagggagaatctacgcttgtgaccagtgtaacagcaaacgacgaaaatccaatcccaaaccccttgttctgagtgaagctagaaagcagttaatgatctacagactacctcaggttctccggctgcaccttaaaagattcaggtggtctggccgtaatcatcgagagaagattggggtccatgtcgtctttgaccaggtattaaccatggaaccttactgctgcagggacatgctctcctctcttgacaaagagacctttgcctatgatctctccgcagtggtcatgcatcacgggaaagggtttggctcaggacactacacagcctattgctacaacacagagggaggtgcgtgcgctttactctgtggggtgggggacacggaaaggggttgatttgtccacattttattgttttccttttatttccatcccatggattacctagagggaaattacatacatcaaaaatccagtggaaagaattgtgaaaattgggttgggcgccgtggctcacacctgtaatcctagcgctttgggaggccgcggtgggtggatcacctgaggtcaggagttcgagaccagcctggccaacatggttaaaccccgtctctactaaaatagtacaaaaattagccgggcgtggtggtgggcactggtaatcccaggtactcaagaggctgaggcaggagaatcgcttgaacctgggaggcagaggttgcagtgagccaagattatgccactgcacttcagcctgggtgacagagcaagactcttatctcaaaaaaaataaaaagaattatgaaagttggattcaaattttgggtatattactaagtaacaacatatggttgttctaagaattaaaaggaactgacatgtaaaagtgcttagaacaggacctaggccctgtgcaatggctcacacctgtaattccaacactttgggaggcagaggcgggaggattgcttgaggccgagggttcaagactagcctgggcaacatagcgagactgcatctctacaaaaaatttaaaaattatccaggtgtaatggtgtgcacctgtgatcctagctacttgggaggctgaggtgggagaattgctcaagcccaggagtttgaagttgcaatgagctatgatttcaccactgcattctagcctgggcaacagagtgagatcctgactcaaataaataaataagaagagcagttgcctaccacatagtacttattcagtcagtgttagaggatattgtagtattatcaaaagtattggttattgataatattactgttttgtggtaatgctacttctgcacaccccagtttccttcttggttatgcagaaacagtagaacctgtgtaacctcaaggagatattgtatgaatctcactagccgcagcttataataaagccgagaacattt

SEQ ID NO: 8024 - DNA, 3177 bp, Homo sapiens
cgcgccctggtgacagctcgcgcgtgctgatgatggcgattctttggatgggaagagaccttgaaaggacctctagtttatcctgcaactccagtcaatatcccacttaaatcattccaggtaatagagaagaggaaacctaaccaatgactgtggaataatatggaagaagatggaaaaaacttgtttaatgggttgagaaagtggcgacttctataagacatggatagatgcaaacatgtagggcggttacggctcgcccaggaccactccatcctgaaccctcagaagtggtgctgcttagagtgtgccaccaccgagtccgtgtgggcctgcctcaagtgctcccacgtggcctgcggccgctatattgaggaccacgccctgaaacactttgaggagacgggacacccgctagccatggaagtccgggatctctacgtgttctgttacctgtgcaaggactacgtgctcaatgataacccagagggggacctgaagctgctaagaagctccctcctggcggtccggggccagaaacaggacacgccggtgagacgtgggcggacgctgcggtccatggcttcgggtgaggacgtggtcctgccgcagcgcgctcctcagggacagccgcagatgctcacggctctgtggtaccggcgtcagcgcctgctggccaggacgctgcggctgtggttcgagaagagctcccggggccaggcgaagctggagcagcggcggcaggaggaggccctggagcgcaagaaggaggaggcgcggaggcggcggcgcgaggtgaaacggcggctgctggaggagctggccagcacccctccgcgcaagagtgcacggctgctcctgcacacgccccgcgacgcgggcccggctgcctcgcgccccgccgccctccctacctcacgcagagtgcccgccgccacactcaagctgcgtcgccagccggccatggccccaggcgtcacgggcctgcgcaacctgggcaacacctgctacatgaactccatcctccaggtgctcagccacctccagaagttccgagaatgtttcctcaaccttgacccttccaaaacggaacatctgtttcccaaagccaccaacgggaagactcagctttctggcaagccaaccaacagctcggccacggagctgtccttgagaaatgacagggccgaggcatgcgagcgggagggcttctgctggaacggcagggcctccattagtcggagtctggagctcatccagaacaaggagccgagttcaaagcacatttccctctgccgtgaactgcacaccctcttccgagtcatgtggtccgggaagtgggccctagtgtcgcccttcgccatgctccactcagtgtggagcctgatccctgccttccgcggctacgaccaacaggacgcgcaggaatttctctgcgagctgctgcacaaggtgcagcaggaactcgagtctgagggcaccacacgccggatcctcatccccttctcccagaggaagctcaccaaacaggtcttaaaggtggtgaataccatatttcatgggcagctgctcagtcaggtcacatgtatatcatgcaattacaaatccaataccattgagcccttttgggacctatccctggaattccctgaacgctatcactgcatagaaaaggggtttgtccctttgaatcaaacagagtgcttgctcactgagatgctggccaaattcacagagacagaggccctggaagggagaatctacgcttgtgaccagtgtaacagcaaacgacgaaaatccaatcccaaaccccttgttctgagtgaagctagaaagcagttaatgatctacagactacctcaggttctccggctgcaccttaaaagattcaggtggtctggccgtaatcatcgagagaagattggggtccatgtcgtctttgaccaggtattaaccatggaaccttactgctgcagggacatgctctcctctcttgacaaagagacctttgcctatgatctctccgcagtggtcatgcatcacgggaaagggtttggctcaggacactacacagcctattgctacaacacagagggaggtgcgtgcgctttactctgtggggtgggggacacggaaaggggttgatttgtccacattttattgttttccttttatttccatcccatggattacctagagggaaattacatacatcaaaaatccagtggaaagaattgtgaaaattgggttgggcgccgtggctcacacctgtaatcctagcgctttgggaggccgcggtgggtggatcacctgaggtcaggagttcgagaccagcctggccaacatggttaaaccccgtctctactaaaatagtacaaaaattagccgggcgtggtggtgggcactggtaatcccaggtactcaagaggctgaggcaggagaatcgcttgaacctgggaggcagaggttgcagtgagccaagattatgccactgcacttcagcctgggtgacagagcaagactcttatctcaaaaaaaataaaaagaattatgaaagttggattcaaattttgggtatattactaagtaacaacatatggttgttctaagaattaaaaggaactgacatgtaaaagtgcttagaacaggacctaggccctgtgcaatggctcacacctgtaattccaacactttgggaggcagaggcgggaggattgcttgaggccgagggttcaagactagcctgggcaacatagcgagactgcatctctacaaaaaatttaaaaattatccaggtgtaatggtgtgcacctgtgatcctagctacttgggaggctgaggtgggagaattgctcaagcccaggagtttgaagttgcaatgagctatgatttcaccactgcattctagcctgggcaacagagtgagatcctgactcaaataaataaataagaagagcagttgcctaccacatagtacttattcagtcagtgttagaggatattgtagtattatcaaaagtattggttattgataatattactgttttgtggtaatgctacttctgcacaccccagtttccttcttggttatgcagaaacagtagaacctgtgtaacctcaaggagatattgtatgaatctcactagccgcagcttataataaagccgagaacattta

SEQ ID NO: 8025 - DNA, 2067 bp, Homo sapiens
atggatagatgcaaacatgtagggcggttacggctcgcccaggaccactccatcctgaaccctcagaagtggtgctgcttagagtgtgccaccaccgagtccgtgtgggcctgcctcaagtgctcccacgtggcctgcggccgctatattgaggaccacgccctgaaacactttgaggagacgggacacccgctagccatggaagtccgggatctctacgtgttctgttacctgtgcaaggactacgtgctcaatgataacccagagggggacctgaagctgctaagaagctccctcctggcggtccggggccagaaacaggacacgccggtgagacgtgggcggacgctgcggtccatggcttcgggtgaggacgtggtcctgccgcagcgcgctcctcagggacagccgcagatgctcacggctctgtggtaccggcgtcagcgcctgctggccaggacgctgcggctgtggttcgagaagagctcccggggccaggcgaagctggagcagcggcggcaggaggaggccctggagcgcaagaaggaggaggcgcggaggcggcggcgcgaggtgaaacggcggctgctggaggagctggccagcacccctccgcgcaagagtgcacggctgctcctgcacacgccccgcgacgcgggcccggctgcctcgcgccccgccgccctccctacctcacgcagagtgcccgccgccacactcaagctgcgtcgccagccggccatggccccaggcgtcacgggcctgcgcaacctgggcaacacctgctacatgaactccatcctccaggtgctcagccacctccagaagttccgagaatgtttcctcaaccttgacccttccaaaacggaacatctgtttcccaaagccaccaacgggaagactcagctttctggcaagccaaccaacagctcggccacggagctgtccttgagaaatgacagggccgaggcatgcgagcgggagggcttctgctggaacggcagggcctccattagtcggagtctggagctcatccagaacaaggagccgagttcaaagcacatttccctctgccgtgaactgcacaccctcttccgagtcatgtggtccgggaagtgggccctagtgtcgcccttcgccatgctccactcagtgtggagcctgatccctgccttccgcggctacgaccaacaggacgcgcaggaatttctctgcgagctgctgcacaaggtgcagcaggaactcgagtctgagggcaccacacgccggatcctcatccccttctcccagaggaagctcaccaaacaggtcttaaaggtggtgaataccatatttcatgggcagctgctcagtcaggtcacatgtatatcatgcaattacaaatccaataccattgagcccttttgggacctatccctggaattccctgaacgctatcactgcatagaaaaggggtttgtccctttgaatcaaacagagtgcttgctcactgagatgctggccaaattcacagagacagaggccctggaagggagaatctacgcttgtgaccagtgtaacagcaaacgacgaaaatccaatcccaaaccccttgttctgagtgaagctagaaagcagttaatgatctacagactacctcaggttctccggctgcaccttaaaagattcaggtggtctggccgtaatcatcgagagaagattggggtccatgtcgtctttgaccaggtattaaccatggaaccttactgctgcagggacatgctctcctctcttgacaaagagacctttgcctatgatctctccgcagtggtcatgcatcacgggaaagggtttggctcaggacactacacagcctattgctacaacacagagggaggtttttgggtccactgcaatgactcaaagctgaatgtatgcagtgtcgaggaagtgtgcaaaacccaggcctacatccttttttacactcaaagaacagtgcagggcaatgcaagaatctcagaaacccatctccaagctcaggtgcagtccagcaacaatgatgaaggcagaccacagacattttcctga

SEQ ID NO: 8026 - DNA, 4561 bp, Homo sapiens
gggccccagaatttaaaggatgagatggggagtaagggaagagagggggctaagagaagctgggggagtcctgatggatgtagaactggggtagactgcaggggggtgggaatcgaatgtgcgtgttatggggagttgctccagaaggtctgcaagggtcagggcagaaatgctgtagtgaaagatcaagtgtaagagagcctttggtgcagaagacgaggaaccatggtaatagagaagaggaaacctaaccaatgactgtggaataatatggaagaagatggaaaaaacttgtttaatgggttgagaaagtggcgacttctataagacatggatagatgcaaacatgtagggcggttacggctcgcccaggaccactccatcctgaaccctcagaagtggtgctgcttagagtgtgccaccaccgagtccgtgtgggcctgcctcaagtgctcccacgtggcctgcggccgctatattgaggaccacgccctgaaacactttgaggagacgggacacccgctagccatggaagtccgggatctctacgtgttctgttacctgtgcaaggactacgtgctcaatgataacccagagggggacctgaagctgctaagaagctccctcctggcggtccggggccagaaacaggacacgccggtgagacgtgggcggacgctgcggtccatggcttcgggtgaggacgtggtcctgccgcagcgcgctcctcagggacagccgcagatgctcacggctctgtggtaccggcgtcagcgcctgctggccaggacgctgcggctgtggttcgagaagagctcccggggccaggcgaagctggagcagcggcggcaggaggaggccctggagcgcaagaaggaggaggcgcggaggcggcggcgcgaggtgaaacggcggctgctggaggagctggccagcacccctccgcgcaagagtgcacggctgctcctgcacacgccccgcgacgcgggcccggctgcctcgcgccccgccgccctccctacctcacgcagagtgcccgccgccacactcaagctgcgtcgccagccggccatggccccaggcgtcacgggcctgcgcaacctgggcaacacctgctacatgaactccatcctccaggtgctcagccacctccagaagttccgagaatgtttcctcaaccttgacccttccaaaacggaacatctgtttcccaaagccaccaacgggaagactcagctttctggcaagccaaccaacagctcggccacggagctgtccttgagaaatgacagggccgaggcatgcgagcgggagggcttctgctggaacggcagggcctccattagtcggagtctggagctcatccagaacaaggagccgagttcaaagcacatttccctctgccgtgaactgcacaccctcttccgagtcatgtggtccgggaagtgggccctagtgtcgcccttcgccatgctccactcagtgtggagcctgatccctgccttccgcggctacgaccaacaggacgcgcaggaatttctctgcgagctgctgcacaaggtgcagcaggaactcgagtctgagggcaccacacgccggatcctcatccccttctcccagaggaagctcaccaaacaggtcttaaaggtggtgaataccatatttcatgggcagctgctcagtcaggtcacatgtatatcatgcaattacaaatccaataccattgagcccttttgggacctatccctggaattccctgaacgctatcactgcatagaaaaggggtttgtccctttgaatcaaacagagtgcttgctcactgagatgctggccaaattcacagagacagaggccctggaagggagaatctacgcttgtgaccagtgtaacagcaaacgacgaaaatccaatcccaaaccccttgttctgagtgaagctagaaagcagttaatgatctacagactacctcaggttctccggctgcaccttaaaagattcaggtggtctggccgtaatcatcgagagaagattggggtccatgtcgtctttgaccaggtattaaccatggaaccttactgctgcagggacatgctctcctctcttgacaaagagacctttgcctatgatctctccgcagtggtcatgcatcacgggaaagggtttggctcaggacactacacagcctattgctacaacacagagggaggtttttgggtccactgcaatgactcaaagctgaatgtatgcagtgtcgaggaagtgtgcaaaacccaggcctacatccttttttacactcaaagaacagtgcagggcaatgcaagaatctcagaaacccatctccaagctcaggtgcagtccagcaacaatgatgaaggcagaccacagacattttcctgaatgggaggcatgtatcaaagactggcttttgtgtattggtgtccatacatctttcctcttataggaaataaggctactgcaggaacagattactaggtttgccttgctgggtctagagtagaaggtgccaggtgattcgtgtcctgtcgtaaattttatagtctctttcttttgaatgagtttgggagttccctcctttcctaaaaacaaaagaagtaacttctatgaagatcctttcatcagttgcttctgaatatagagggatctgggtggaggaaagcggggcgggggggtaaatcaatcatatccacacaggagagcagccatgttttctctccatgatgtgattcccctgctaatcaggacctccttgcagcaccagaagaaccctccggatgtgagcagtcctggacagagcacgtgaggaggggccctgggctagcagtttgctggatgggattggctccaagatgggagatgaagtctaaagggtttattcccacaaaggaagtaaccttcaagggtttaaaacaaacttccttttttggggatagcagctgaagagtggagtgagatgcatggaacaaatttccccatgcaaagtgggatggttttcatatgtcataccctccctacttgctgctgtcatataatcattccatacttctgagactggcatgaataccccttcattctaaagaaggggcaggtcatataaagaagcaatagactagcacatgttccatgctgagccaaaggacactcctggctatctcagttctgtagcagatccctggttcaggtctagggcaagcacatggtttggtttaaattgattcttaggttttctcagaactcaattgagggtgggcagagatagctgatgctccagggcttattgaaggcctgtcacccgttctcacttcagtgcggcatgcagcttcttagcctgcagcttctttcttgctcctggagagctagaacattcatgttcacagggtttgggagcttttggttctctagggtatgttaactgcttaggagtccacctcgtacatatctgaagagttgattaccaatggccttgacctgtttcctcccaaatctgataatccctactgttgctttaccccccatactcagtccatcagagaaaaaaacaagagtgccccgtcctttcccccagtgctagtaaaatacatcttcctttttaaattgggtcagtttctaaacagaatgaaattgcccagataaaaacccttgtccccatcaggcaccacttcattcttagttcttcacttagatttgctggtgaaagtgaatgcaaaccctaacttttgttgctgtggtcactgcagtgagcctcactcaacctgtcactatgaatgctcatcttttgactgagtatatcatattaatgtttgaattcaggtagaagtacagttgtcacttgaagggagtagatgtggaagggcgttcggggaggagtgggaagtggggaaagccaggctaaagaatgagggttatagctttagcaatgttgatgagccacatttcccacacagatctgtagcatttgctgttgacctcttttgagatgaactctcccataggccctgccaggcagcactgagacatggaggaaattcagacaaaaaatggctcaccctgatagggaaggagtgactatattttaaattaaacttgctttttccaacactgtgaggtttctgtaatatttagcttttatttggaagcgatagcgtatggcattttttatgctgtttggtttatattgtctactgcaggcttctttgtataagctttgcctgggctcaccctctcctggacactgttttaaagtgtcaccgctgtccatgctgccagaggctctgatgtgaagctgtactctcaagatccacgtttttaagtcggcatgattagtaatgactttttgtggcaatagaaaagcccattaactcaaaaaaaccaaggagagtaaaaaggaaaggaaactatgaatcgtgcctcatctttcattgaatcctatatttattattctagaaaaaaagaacttacaagatagagaagaactaatagagcatctactttacccctcaggctgtccagtggggataattattaataaacatttaatggaaaa

SEQ ID NO: 8027 - DNA, 752 bp, Homo sapiens
attctgtaaagtgagggagggcaaatgagacctggactggaaccaggtggagtcaggaataagagtgtggtggaagggcgaaaggaaacagataagagatgggtgtctgtaggacgattctgggaccagaagagctgaaaggagactagagttagggtgtaagaagtgatggccatctgggacaaggataactgggtaattacgttaattgaagaggttcagcaagatccaaggtgaaaacagtgaggtaaagagacagggctaaaagcaaatggtgagaggagcaggaagagatgggccccagaatttaaaggatgagatggggagtaagggaagagagggggctaagagaagctgggggagtcctgatggatgtagaactggggtagactgcaggggggtgggaatcgaatgtgcgtgttatggggagttgctccagaaggtctgcaagggtcagggcagaaatgctgtagtgaaagatcaagtgtaagagagcctttggtgcagaagacgaggaaccatgattctttggatgggaagagaccttgaaaggacctctagtttatcctgcaactccagtcaatatcccacttaaatcattccaggtaatagagaagaggaaacctaaccaatgactgtggaataatatggaagaagatggaaaaaacttgtttaatgggttgagaaagtggcgacttctataagacatggatagatgcaaacatgtagggcggttacggctcgcccaggac

SEQ ID NO: 8028 - DNA, 553 bp, Homo sapiens
atttgtgtgttttttcctgagtttcagattgtatgcaaatataatgtgtaatttttaagacctaaaacaaatgcagaagtgctttttttcaggaagtaaacctttaatacttccatttgtagatcagtctacccataagtgactgactctttggttactcttagctgaaaagaaagatcacagttttttttttactcttacatcagttttaaggacttgtagggagtttaatgcattgtaatttactggtccttttttgaatttgtattacaattaatgaaattgcttttttcttgccatgtattagcccaatcttacagattgtttcccacttgtaggtaatagagaagaggaaacctaaccaatgactgtggaataatatggaagaagatggaaaaaacttgtttaatgggttgagaaagtggcgacttctataagacatggatagatgcaaacatgtagggcggttacggctcgcccaggaccactccatcctgaaccctcagaagtggtgctgcttagagtgtgccaccaccgagtccgtgtgggcctg

SEQ ID NO: 8029 - DNA, 1386 bp, Homo sapiens
aagttggagtggtgcctgatacaggtgaaaatcagttcgcagctactggaagagagaggagcatatcaattgtttaaaacaaaaagccagcgttaacaggctcagagaaatgaagttgaaaggaatagatgtagctcctgaatagaagcaaaagtccaacgtggttccattaaaatgacttctcagccgtctctccctgcagatgacttcgatatctaccacgtccttgcagagtgcacagattactatgatacccttccagttaaggaggctgatgggaaccagccccattttcagggtgtcactggcttgtggaacttgggcaacacatgctgcgtgaatgccatctcacagtgtctctgcagcatcttgccgctggtggaatactttctcaccgggaagtatatcaccgctctgcaaaacgattgcagtgaagttgccactgcttttgcctatctgatgacagacatgtggctgggagactcagactgtgtctcaccagaaatattctggtcagctcttggcaacctctacccagcatttacgaaaaagatgcaacaagatgctcaggaattcttgatttgtgtcctaaatgaacttcatgaagctctaaaaaagtaccactactcccggagaagatcatatgagaaaggatctactcagagatgctgcaggaagtggattaccactgagacatccatcatcacccagctgtttgaagagcagctcaattatagcatcgtatgtttaaagtgtgagaaatgcacctacaagaacgaagtcttcactgtcttctcactccccattccatccaaatatgaatgctcccttcgggactgtctccaatgtttttttcaacaagacgcactgacctggaacaacgaaattcactgctccttttgtgaaaccaagcaagaaactgctgtgagggccagtatttccaaagcaccaaaaataattattttccacctaaaaaggtttgacattcagggtacaacaaaaaggaagctgagaacggatattcattacccactcactaacttggacctcactccttatatttgctcaattttccggaaatatcctaaatacaacctctgtgcagtggtgaaccattttggtgatttggatggtggccactacactgctttctgcaagaattcagtcacccaggcctgatatagctttgataacacacgagtcagtgagattccagatacttctgttcaaaatgctatggatctcctgttctatagctgccagcccttttccataccaatacaaaagcgttaagagccaggaaaatggtgtttcctgaacactgcaaaacaagcagtcagcatctggtggtagagttttgcttggtcattaaactcttagaactta

SEQ ID NO: 8030 - DNA, 4407 bp, Homo sapiens
gtcccctggcatgatctgatcgcctttgaagcagtcgcagctgttttccagacgccttgctcctcaggtcggggagtgatctgatggcccaggttcgagaaacttctttgccctccggctctggggtccgctggatctccggaggtgggggaggagcctctcctgaggaggcggttgagaaggcggggaaaatggaggaggcggcggcgggggctacgaaggcgtcttcgagacgtgaagccgaggagatgaagctggagccattacaagagcgtgagcccgcgccggaggagaacttgacgtggagcagcagcggcggcgacgagaaggtgctcccttcaatcccccttcgctgtcacagcagctcctcgcccgtttgcccgcgccgcaagccccgccctcggccccagccccgggcccgctcccgcagccagcctgggctctcggccccacccccgcctccagcccggcccccgcccccgccgccacccccgcccccacccgcaccgcggcccagggcctggcgtggatcccggcgcagatcccggcctgggtccaggcctcagacacggagaagctgctctggtgacctagacgggtcgggggatcctggcggcttaggggactggttgctggaggtcgagtttggtcagggtcccacaggctgctctcatgtggagagctttaaagtaggtaagaactggcagaagaacctgaggttgatctaccagcgtttcgtttggagtgggaccccagagactaggaaacgtaaagcaaagtcatgcatctgtcacgtatgtagtacccatatgaacagactccactcttgtctctcctgtgtcttttttggctgcttcactgagaaacatattcacaaacatgcagaaacaaagcagcaccatttagctgtagacctttatcatggggtcatatattgcttcatgtgtaaggattatgtatatgacaaagacatagaacagattgccaaagaaacaaaagaaaaaattttgagattattaacttccacctcaacagatgtttctcatcaacagtttatgacatcagggtttgaagacaagcaatcaacctgtgagacaaaggaacaggagccaaaattggtgaaacccaagaaaaagagaagaaaaaagtcagtctatactgtaggcctgagagggctaatcaatcttgggaacacttgttttatgaattgtattgtccaggcacttacccatattcctctactgaaagatttcttcctctctgacaagcacaaatgtataatgacaagccccagcttgtgtctggtctgtgaaatgtcttcgctttttcatgctatgtactctgggagccgaactcctcacattccctataagttactgcatctgatatggatccatgcagaacatttagcagggtacaggcagcaggatgcccatgagttccttattgcaatattagacgtgctacatagacacagcaaagatgatagtggtgggcaggaggccaataaccccaactgctgtaactgcatcatagaccaaatctttacaggtggcctgcaatcagatgtcacatgtcaagcctgccatagtgtttctaccaccatagacccatgctgggacatcagtttggacttgcctggctcttgtgccacattcgattcccagaacccagagagggctgacagcacagtgagcagggatgaccacataccaggaatcccctcacttacagactgtctacagtggtttacaaggccagagcacctaggaagcagtgccaaaatcaaatgcaatagttgccaaagctaccaggagtctactaaacagctcacaatgaaaaaattacccattgtggcttgttttcatctcaagcggtttgagcatgtaggcaaacagaggcgaaagattaatacctttatctcctttcccttggagctggacatgactccgtttttggcctctactaaagagagcagaatgaaagaaggccagccaccaacagattgtgtgcccaatgagaataagtattccttgtttgcagtgattaatcaccatggaactttggaaagtggccactataccagcttcatccggcaacaaaaggaccagtggttcagctgtgatgatgccatcatcaccaaggctaccattgaggacttactctacagtgaagggtatttactgttctatcacaaacagggtctagagaaagactagtcttaccagaccacttactgaaaaaaaagtaaatgattaggcaaggattttgaagtgacacacagacctacttggaatggacaatgacagtaacacctatgtgacagctagtatcttgatataaagaacctattttagcatggcccatgggtctgtcggaagaaaaaaatgaatactaaccagtgaccattcaaccttaagaaatggggagagggagaagaggttgaaaatggtcacataaagcataatgaaatgaaaagaatgctttaggtggggacaacgggagtagaagtgttctgatgctactctatgtcatttgtttttacagaaatatcttgtgaagtcagggagtattcctttatcagcaaaaacttcacaattggtgttccagctgtggctgaccagctaaatagtttgaaagaaaaataatattttaaaataaagtttaaagagctttaaaagaaaaacatttaaaaaggaaaaaatcatttttaagattttaaaagaaaaaaacttttaaatgttgaaaaaaatttaagttgttatttttaaaagaaatattttaaaagttaaaaataattttttaatttaaagaagtttcagaattttaaaaattaaaagcaaagaaaattaaattcttaaagtttaaaaatgtaaaataaattaaggaacaaggttaaaaatgaaagtttaccaaaaaaaggaagaaaatactgttaaaaattaaagttagaaacaaaggaacatcttaaaagtttcaaatgaaggaaaataatataaatagatatttcaaaattaaagcataaaatatacgtatttaaaaagtgttaacaaaattactactataatgattaagaaataaattttcaaaaatacagaatggaatgcaattcagattttagagaaaagttttaaaagaggcaagtttagaataattcaagacaaaaagacaaaatgtgtttaaagacaaaaattgaaaaaatacaggaagaaaatagagacttgtaaaataaaaagaaccttagataagttcaagagatttaaatgaaaactttaaatatttaaataaagatttaaaaatttaagcttttaaaaagaaaaacagttacataaaaattgaccagtgaaaaaatgtgaaagattcaagtagaaaaaattattaaaattaaaagtttaagaagttctatttttttatttaagcatattaaaatacagacgggtatgaaagaaataaatggaggagacaggaataacgacagcggtgtgtgagtatatatatatatatatatttttttttttgagctttatgttgatatatcaatatacgttggaaaaggaaatagacattttaatcattatcttaccatccaattgtgaaatggctgcaaggcctaaacactaactaacccaccttcccctcttgagattccatgccccatctcatatcctgaaggaagtcaaattacttcctaggcagaatcaattcatctgagaaaaatgaaaacattagggactttcccatttagaactgcattattcatacaaattcttagcttctgaaaaggggctcttgataatttggtggcttagagaagttagatcacagctgtgaagctctggctttggtatttgagccccatggcctgattgaggaagtggcagggacccatatctgaggccttcccaccttcctttttccctcttccccctccaaggagaaacaagacctttaatttccacagtagagcaatgggtttgtgcttgcagtccttctgctcattctttattccctctttatttcctttttttgtcactcatgcctagttccctgaaccccttacttacctggccttacctacatctctgagccccagcctgcagggctccttctttgactattcacctggtggcttttactcctccttcaagacccaactcacagatgacttctctggagtcttccctgaatgctctaggcaggtataaatgagaaaattgttcctctcttcccctctttattcctctcactgtgcctccaaagtactttgtccatacctcggtgatagtacttattctactgtgattttattgtagctttgtgattgtctgcccctctgcactgagcatctaagaacagggggccaagccttattcatttctgtgttaataaatatttgttaaatgtgaa

SEQ ID NO: 8031 - DNA, 5847 bp, Homo sapiens
ctgggtattggggcgtatgcgcatgctccgctcacagggtcgggctctgggcggcggagaccagccgcctgtgctccagttcccggtgagcctcggtactgtggcagcagtcagtgtgtctggcgggtgtcggcgtgaagcggggctgggccagcgggaggtagctctgtgggagtggaaggcctgtatttctctacctggaccgcacgctcctcgcgcaaggagggtagagctcaagttccgtgatgatggtctaagcaaagacccttcgtcctgttaaagataaattaaaaaaaaaaaaaaaaaaccaaagggaacaaaacttactctgcaaaagtaatatatgatttacctgctgttgtcataagaattccaaatagacaaactcggtatgcttgggatttgctttacattctaagtggatttggagaagagacaataaagaataagcagtcaattctataatatatttagaaggagaaaagtgccaaggaggaatgaaaaagtagaacaagagacagcatcttgctgccacccaggctggagtgcagtggtgcagtcttagcttactgcagcctcaaacttctgggctcaagtaatcctcccgcctcagcttcctgagtagctgagattacagatttgctttgaggtcacattgatatgaaatatggagtcaccttttataacttcacctgggaaagagagagaaaactttcttgttaaaaaaacataaggaaaacaaacaaccaaaggaatcatgccaaatgccaactctacatctttttgtattattaacatattttatgcatcaagacaaatggcttatgcattaaaggggatgattcgttcatcagtatttttagccattaaaaaaaatcgttttcatattaaccttatacagctcccataaaatttaacacatataaacatctttaacgccttgtttaaaatagctttcttttttagtgcttagaacttcaatgtttatgcaccctattgttacttgtcagagtctttaagagtttataacatcaggaaagatatggacttggaaacttacattattaaaatagactgcagtggatttaattggacaattcaagacatccattttattgtccaaaatattacataaaagtgtacagtttttagcctaaatgcaaacaaagttgcttgaaaatggcatgggtaaaattcttacggaaacctggtggcaatcttggaaaagtttatcagcctggaagtatgctatcactagcccctaccaaaggcttgttaaatgaaccaggacaaaacagctgctttcttaatagcgctgtacaggttttatggcaattggatatattccgacgaagcttgcgggttttgactggacatgtttgtcagggagatgcctgtatattttgtgcattgaagacgatatttgcacagttccaacacagtcgagaaaaagcacttccctcagataacataaggcatgctcttgcagaaagtttcaaagatgagcagcgatttcaacttggccttatggatgatgctgcggagtgctttgaaaatatgttggagaggattcattttcacatagtgccaagcagagatgcagacatgtgtacctctaaatcttgtatcactcaccagaagtttgctatgactctgtatgaacagtgtgtgtgtcgtagctgtggagcatcgtcagatcctctaccttttacagaatttgtgcggtacatttctacaacagccttatgcaatgaggttgaaagaatgttggaaaggcatgaacgctttaaacctgaaatgtttgcagaattgctacaagcagcaaatacaacagatgactataggaaatgtcctagtaactgtggccaaaaaataaaaattcgccgtgttttaatgaattgcccagagattgttacaattggtttagtctgggactccgagcattctgacttgaccgaagctgttgttcggaatctagcaacacatctttatcttcctgggcttttttatagagttactgatgaaaatgccaaaaatagtgaacttaaccttgttggtatgatctgctacaccagccaacattattgtgcctttgcatttcacaccaaaagttccaaatgggtattttttgatgatgcaaatgtgaaagagattggaactagatggaaagatgttgtctccaaatgcattcgatgccactttcagccactacttttgttttatgcaaacccagatggcacagcagtttctactgaggatgcactcaggcaggtcatcagctggtcacattacaaatctgttgcagaaaatatgggatgtgaaaagcctgtaattcataagtcagataatttaaaagaaaatggatttggtgatcaggcaaagcagagagaaaatcagaaatttccaactgataatatttcatcatctaatcggagccacagtcacacaggtgtagggaaaggaccagctaagttaagtcacattgatcaaagggaaaagataaaagacatttccagagaatgtgctctgaaagctattgaacagaaaaacttactttcttcacaaaggaaagatttagagaagggacaaagaaaagatttaggacgacatagagatttggttgatgaagacctttcacatttccaatctggatcacctcctgccccaaatggttttaaacaacatgggaatccacatctatatcatagtcaaggaaaaggatcatataaacatgaccgagttgtacctcagagtcgagcttctgcacaaataataagttcaagtaaatcccagattcttgctccaggagagaaaataactggcaaagttaagagtgacaatggcactggatatgacacagacagcagccaagattctagggatagaggaaacagctgtgatagcagcagtaaaagccggaaccgaggttggaaacctatgagagaaacattaaatgttgatagtatttttagtgaaagtgaaaaaagacagcatagtccaagacataaaccaaatatcagtaataagcctaaatctagcaaggatccgagttttagtaattggccaaaagagaatccaaagcaaaaaggtttaatgaccatatatgaagatgaaatgaagcaggaaataggaagcagaagttcccttgaatctaatggaaaaggagcagagaaaaataaaggccttgtagagggtaaagtgcatggtgataattggcagatgcaaaggactgagtctggatatgaaagcagtgatcacatcagtaatggttctactaatttggactcacctgttatcgatggaaatggtacagtaatggatatcagtggtgttaaagaaacagtatgcttcagtgaccagattacgacaagcaacctaaataaagaacgtggggactgtacctcccttcagagccaacatcacttagaaggctttagaaaagaactcaggaatttggaagcaggctataaatctcatgaattccacccagaatcacatttacaaataaaaaatcatttgataaaaagatcacatgtacatgaagacaatggaaagttatttccttcatccagtctacaaatacccaaggaccataatgcaagagaacatatccaccagtcagatgaacagaaacttgaaaaaccgaatgaatgcaaattttctgagtggcttaatatagaaaattctgagagaacaggtttgccttttcacgttgataactctgcttctgggaagagagtgaacagtaatgaaccatcttcattatggtcttcacacctaagaactgttgggttaaagccagaaactgctcctctcatccagcaacaaaatatcatggatcaatgttactttgagaactctctatccacagaatgtataattcggtcagccagcagatctgatgggtgtcagatgccaaaacttttttgccagaatctaccaccccctttgccaccaaagaaatatgctataaccagtgtgccacagtcagagaaaagcgaatctacacctgatgtcaaacttacagaggtgtttaaagctacctctcatcttccgaagcacagtttaagtacagcttcagaaccaagtttagaagtgagtacacatatgaatgatgaaagacataaagaaacatttcaagtgagagaatgttttggcaacacaccaaactgtccatccagctcctcaactaacgattttcaggcaaactcaggtgccattgatgcattttgccaaccagaactagactctatttctacctgtccaaatgagacagtttcattaactacctatttttcagttgatagctgcatgacggatacatatagattgaaataccatcagaggcccaagctctcttttccagagagcagtggcttttgtaataattcactatcttagagtgaaaaaggactagacctgtgttacataataatcttggttcaagctgcccttctgaacaaagatataaacctagcatacattgtaatagataactggtaaaactgaccaacttttacttctcagaggccatttaaatataataggaacctactgaccaaacctagtgatacataaaattaaagcctgtggcatttttaaagttgttaatcactatacatatgtatgtgtatatgtgtatacacatatataattttatgatcaatatcttagatattttagaaattccctttgaatagtcttggcgtgccgtgaaaaatagaaaatcagggagatataataattcatttgtcatatgctacagttgaataaaaattaaatttgtccccctattttgtggccagtagactgggaagtattaaactaaccagtactcatgtatggagattataaactatgctaattgaaaagtaccaggtgatacatagcctggtacttttttgtcaaagaattgctttatgaagaagcactttctaatgggtaaccagaaaagggcttcacccatttgtttttgacttctatgatagtcactgcatatgatccctttaagtgtctttaaaaaaaatgacttatgaatttgatagcatttggggaaaaaaagccttatatgattaacaatttgtaagttttcaagatcggatggaatttaattttgctcctagaatttttgtcttcagaatatctagttaagataaattaggcctttgactattataggtattcataaatgctactttagccatgtaagttaaaaagttaaaatacttaaactttagtgtatttatttatctcgttactttttttctaattttatatgaaatgtgaaaggtctttattttggtttggtttactttgggctgctaaccaccagtgttaggaattaatgtagggcaccctcttattgggaatgtcactgtaattgcctacattttctttgctgtaatattacctgcttataggttgtcaacccattttatctgaatttgaaaatctatctaggtttccagattaaatttctacctttcatatagagagtttaattttaataaaatgtttaattagagcatccttcccttttattctactttgaacaaatagtaattttaccccaactacttttcatgaagagtgctttgaaaattaaaggaatttttattattatggtaaccttatgagtaaaaataagttactttaattgctttatttcgttagttgtcattttattttgtactatgctggtaaactaattgtggtttagaatagttttatgttcactcctgataactgagaaacagaactaaagttttccttacattgctaaatggataaacctcatattcaataaactagtaaatgtagccacttgactgattgcgtaaatcgtgt

SEQ ID NO: 8032 - DNA, 6072 bp, Homo sapiens
agatttgctttgaggtcacattgatatgaaatatggagtcaccttttataacttcacctgggaaagagagagaaaactttcttgttaaaaaaacataaggaaaacaaacaaccaaaggaatcatgccaaatgccaactctacatctttttgtattattaacatattttatgcatcaagacaaatggcttatgcattaaaggggatgattcgttcatcagtatttttagccattaaaaaaaatcgttttcatattaaccttatacagctcccataaaatttaacacatataaacatctttaacgccttgtttaaaatagctttcttttttagtgcttagaacttcaatgtttatgcaccctattgttacttgtcagagtctttaagagtttataacatcaggaaagatatggacttggaaacttacattattaaaatagactgcagtggatttaattggacaattcaagacatccattttattgtccaaaatattacataaaagtgtacagtttttagcctaaatgcaaacaaagttgcttgaaaatggcatgggtaaaattcttacggaaacctggtggcaatcttggaaaagtttatcagcctggaagtatgctatcactagcccctaccaaaggcttgttaaatgaaccaggacaaaacagctgctttcttaatagcgctgtacaggttttatggcaattggatatattccgacgaagcttgcgggttttgactggacatgtttgtcagggagatgcctgtatattttgtgcattgaagacgatatttgcacagttccaacacagtcgagaaaaagcacttccctcagataacataaggcatgctcttgcagaaagtttcaaagatgagcagcgatttcaacttggccttatggatgatgctgcggagtgctttgaaaatatgttggagaggattcattttcacatagtgccaagcagagatgcagacatgtgtacctctaaatcttgtatcactcaccagaagtttgctatgactctgtatgaacagtgtgtgtgtcgtagctgtggagcatcgtcagatcctctaccttttacagaatttgtgcggtacatttctacaacagccttatgcaatgaggttgaaagaatgttggaaaggcatgaacgctttaaacctgaaatgtttgcagaattgctacaagcagcaaatacaacagatgactataggaaatgtcctagtaactgtggccaaaaaataaaaattcgccgtgttttaatgaattgcccagagattgttacaattggtttagtctgggactccgagcattctgacttgaccgaagctgttgttcggaatctagcaacacatctttatcttcctgggcttttttatagagttactgatgaaaatgccaaaaatagtgaacttaaccttgttggtatgatctgctacaccagccaacattattgtgcctttgcatttcacaccaaaagttccaaatgggtattttttgatgatgcaaatgtgaaagagattggaactagatggaaagatgttgtctccaaatgcattcgatgccactttcagccactacttttgttttatgcaaacccagatggcacagcagtttctactgaggatgcactcaggcaggtcatcagctggtcacattacaaatctgttgcagaaaatatgggatgtgaaaagcctgtaattcataagtcagataatttaaaagaaaatggatttggtgatcaggcaaagcagagagaaaatcagaaatttccaactgataatatttcatcatctaatcggagccacagtcacacaggtgtagggaaaggaccagctaagttaagtcacattgatcaaagggaaaagataaaagacatttccagagaatgtgctctgaaagctattgaacagaaaaacttactttcttcacaaaggaaagatttagagaagggacaaagaaaagatttaggacgacatagagatttggttgatgaagacctttcacatttccaatctggatcacctcctgccccaaatggttttaaacaacatgggaatccacatctatatcatagtcaaggaaaaggatcatataaacatgaccgagttgtacctcagagtcgagcttctgcacaaataataagttcaagtaaatcccagattcttgctccaggagagaaaataactggcaaagttaagagtgacaatggcactggatatgacacagacagcagccaagattctagggatagaggaaacagctgtgatagcagcagtaaaagccggaaccgaggttggaaacctatgagagaaacattaaatgttgatagtatttttagtgaaagtgaaaaaagacagcatagtccaagacataaaccaaatatcagtaataagcctaaatctagcaaggatccgagttttagtaattggccaaaagagaatccaaagcaaaaaggtttaatgaccatatatgaagatgaaatgaagcaggaaataggaagcagaagttcccttgaatctaatggaaaaggagcagagaaaaataaaggccttgtagagggtaaagtgcatggtgataattggcagatgcaaaggactgagtctggatatgaaagcagtgatcacatcagtaatggttctactaatttggactcacctgttatcgatggaaatggtacagtaatggatatcagtggtgttaaagaaacagtatgcttcagtgaccagattacgacaagcaacctaaataaagaacgtggggactgtacctcccttcagagccaacatcacttagaaggctttagaaaagaactcaggaatttggaagcaggctataaatctcatgaattccacccagaatcacatttacaaataaaaaatcatttgataaaaagatcacatgtacatgaagacaatggaaagttatttccttcatccagtctacaaatacccaaggaccataatgcaagagaacatatccaccagtcagatgaacagaaacttgaaaaaccgaatgaatgcaaattttctgagtggcttaatatagaaaattctgagagaacaggtttgccttttcacgttgataactctgcttctgggaagagagtgaacagtaatgaaccatcttcattatggtcttcacacctaagaactgttgggttaaagccagaaactgctcctctcatccagcaacaaaatatcatggatcaatgttactttgagaactctctatccacagaatgtataattcggtcagccagcagatctgatgggtgtcagatgccaaaacttttttgccagaatctaccaccccctttgccaccaaagaaatatgctataaccagtgtgccacagtcagagaaaagcgaatctacacctgatgtcaaacttacagaggtgtttaaagctacctctcatcttccgaagcacagtttaagtacagcttcagaaccaagtttagaagtgagtacacatatgaatgatgaaagacataaagaaacatttcaagtgagagaatgttttggcaacacaccaaactgtccatccagctcctcaactaacgattttcaggcaaactcaggtgccattgatgcattttgccaaccagaactagactctatttctacctgtccaaatgagacagtttcattaactacctatttttcagttgatagctgcatgacggatacatatagattgaaataccatcagaggcccaagctctcttttccagagagcagtggcttttgtaataattcactatcttagagtgaaaaaggactagacctgtgttacataataatcttggttcaagctgcccttctgaacaaagatataaacctagcatacattgtaatagataactggtaaaactgaccaacttttacttctcagaggccatttaaatataataggaacctactgaccaaacctagtgatacataaaattaaagcctgtggcatttttaaagttgttaatcactatacatatgtatgtgtatatgtgtatacacatatataattttatgatcaatatcttagatattttagaaattccctttgaatagtcttggcgtgccgtgaaaaatagaaaatcagggagatataataattcatttgtcatatgctacagttgaataaaaattaaatttgtccccctattttgtggccagtagactgggaagtattaaactaaccagtactcatgtatggagattataaactatgctaattgaaaagtaccaggtgatacatagcctggtacttttttgtcaaagaattgctttatgaagaagcactttctaatgggtaaccagaaaagggcttcacccatttgtttttgacttctatgatagtcactgcatatgatccctttaagtgtctttaaaaaaaatgacttatgaatttgatagcatttggggaaaaaaagccttatatgattaacaatttgtaagttttcaagatcggatggaatttaattttgctcctagaatttttgtcttcagaatatctagttaagataaattaggcctttgactattataggtattcataaatgctactttagccatgtaagttaaaaagttaaaatacttaaactttagtgtatttatttatctcgttactttttttctaattttatatgaaatgtgaaaggtctttattttggtttggtttactttgggctgctaaccaccagtgttaggaattaatgtagggcaccctcttattgggaatgtcactgtaattgcctacattttctttgctgtaatattacctgcttataggttgtcaacccattttatctgaatttgaaaatctatctaggtttccagattaaatttctacctttcatatagagagtttaattttaataaaatgtttaattagagcatccttcccttttattctactttgaacaaatagtaattttaccccaactacttttcatgaagagtgctttgaaaattaaaggaatttttattattatggtaaccttatgagtaaaaataagttactttaattgctttatttcgttagttgtcattttattttgtactatgctggtaaactaattgtggtttagaatagttttatgttcactcctgataactgagaaacagaactaaagttttccttacattgctaaatggataaacctcatattcaataaactagtaaatgtagccacttgactgattgcgtaaatcgtgttaaaacattctaaaatgttgtaactaatttaatgtgaatactgttaaacagaaaataattgcttataaaagtctaacttcacccagttaccaagtcttggccaaattttatcttctgcctatagtttttactagcctttttaaactataatagtgagtgatcattactttatattctcgtaagttagaaatacttgaatgccaaattaattttgttttaagaaagcttatttttaacataattttttagtgtggagggtttgtaaataatgtaaagtttgtaaacctgtatttaaaataccaaagtttttcttcttttataacattgtaagatactagaaaaatgggcttcaagttttttaatagctttcacagtttgtgtagttttttttttctatttggttaagatgtgagttggaaatgtattatttgaaacatttaaactaatttttgtatttaacagcagtctcagacatttgtcttttcaactcagttgagttgtagatatcaaatagaaatgtccagttttgcctcttttaagtactgtccagttgaaacctcctgactcatgtactactacacaaactagaaaatgcccatttatttttgttgattcaacactccagatacagattgatacatatatactaatcattttatttcatgtaaaagttttacatctagggtgcctatttatttttatagatgctttcatccagttataagcttattataactttgtaaatatttcagccaacagttgtaatgtttaaaatacttaccttcagaatgttatattttcatgtgaaatcaatttcttctaattcaaaaaaattttaagataaactgatttttaagttt

SEQ ID NO: 8033 - DNA, 3395 bp, Homo sapiens
aactttgtcatgaattgtcagtgctgagttcctggtagttggtaaaaagaattgccttctctctgatatcctgttctgcgggaagtccttgtggtttagattcacagtttctcattgttgctagctacagtcgtctcctccctcctagccttccctccccacagctctagctattcccatatccctccccattcttgtatcacttgccccacagataccctcgtgattagaggtcttttgctggaggttgactgtgctgtctgctctctgacacagctggctattctagtcccagaagaaagaggagagacttgctgaagatctggatgggacaatagaagtttggggcacattaaaaagaagcagcaagaacatcaacaaaaacctcagatgattcaaacaggcttcttcttggctttgtggaaccttttgcagttgctcagaatttgagtttttgcttcagaggatgatgagacaaggcaatagagggtgaggaggatcatgttggattcttgcttctctgtctgcctctccttccagttggaaaaatcttcagtccataagaagcattatcaacaagcctgaagaacacatcttaccctgatcctggatgctgttggagttgagaattacatccacttcaccaggactttatggaggctgttcaagaaaaatagaaggaagcaatacttaaggatttctctgtttgcattagtcctgtgccatgttacattttggagattgtttggaacaagtgagggagggctctgtcatcttgatctaggaggatacctgagtcccttgactacacagatgatatttggaaggctaaatgtgaacaataatgtcttggaagagaaattatttttcagggggtcgtggtagtgtacaagggatgtttgcacctcgaagctcaacctccatagcccccagcaaaggcctcagcaatgagccagggcaaaacagctgcttcctcaacagtgccctgcaggttttgtggcacttggatatcttccgacgtagctttaggcagcttacaactcacaagtgcatgggagattcctgcatcttttgcgctctcaagggaatctttaaccagtttcagtgtagtagtgaaaaagtgcttccatctgacactctccgcagtgctctggcaaagactttccaggatgaacaacgtttccagctgggaattatggatgatgctgcagagtgctttgaaaacctcctgatgagaattcacttccacattgctgatgaaaccaaagaggatatatgtactgcccaacactgcatttcccatcagaaatttgcaatgacattgtttgagcagtgtgtatgtactagctgtggtgccacttctgatccgctgcctttcatccagatggtacattatatctccaccacttccctttgcaatcaggctatttgtatgctggaaagacgagagaaaccttcaccaagcatgtttggtgagctgctgcagaatgccagcaccatgggggatctgcggaactgtccaagcaactgtggagagaggatcaggattcgccgtgtgttgatgaatgctccacagattatcacgattgggctggtatgggactcagaccactcagacttagcagaagatgttatccacagcctgggaacctgccttaagctgggtgatctgtttttcagagtgacggatgaccgggccaagcaatctgaactgtacttagttggaatgatctgttactatggcaaacattattctacattcttttttcaaacaaagattcgcaaatggatgtattttgatgatgctcatgtcaaggagattgggcccaaatggaaggatgtggtgaccaaatgcatcaaggggcattatcagcccctgctgctgctttatgcagatccccagggtaccccagtttccacccaggacctgcctccccaagctgagttccagtcatacagcaggacatgctacgacagtgaagattcagggagggagccctccatctcaagtgacactcgaacagattcctcaacggagagctatccctacaaacattcccaccatgagtctgtggtcagtcacttctcttctgattctcaggggacagtcatctataatgtggaaaatgattccatgtctcagagcagtcgggacacaggacacctgactgatagtgaatgtaatcagaaacacacatccaagaaagggtcactgatagagcgcaagaggagctctggtcgggttaggaggaaaggcgatgagccccaggcctcgggataccacagtgaaggagaaacactgaaagagaagcaggctcctagaaatgcctccaaaccatccagcagcaccaacaggctgagagattttaaagagacagtcagcaatatgatccataacagaccatccctggcttctcagaccaatgtaggctctcactgcaggggcagaggaggagaccagcctgacaaaaaacctcctaggaccctgcctttacactctcgtgactgggaaatagagagtaccagcagtgagtcaaaatccagttcttccagcaagtatcgtcccacatggagacccaaacgagaatctctgaatattgacagtatctttagtaaggacaaaaggaagcactgtggctatacccagcttagccccttttctgaggattcagctaaagaatttataccagatgaaccaagcaagccaccttcttacgacattaaatttggtggaccaagcccccagtacaagcgctggggcccagcacggccaggctctcaccttttagagcagcacccccgactaatccagcgaatggaatctggctatgaaagcagtgagaggaacagcagcagccctgtcagcctggatgcagccctgcctgagagctcaaatgtctacaggtattgtttggcctttgaacagcaacattgtctcttgcagcaatgtgagccacctacttggggctttcaggcatggctgagacaagtggagggatggcctttgctattatctctatgtgctctttcaacttcctataacaacagcaccctctgctggaagaacagaggcacttgagaaaggagagagaactttctatttgaaatacagttatcatgtataaaataattttaaaaaattaggttcagggggcatatgtgcaggtttgttaggataaacttgtgtcataggagttcattgtacagattattttgttacccacatattaagctagtactcactaattatttttcctgatcctttctttcctcccaccctccaccctccgataggcctgtgtctgttgttcccctctgtgtgttcatgtgtcctcaccatgtagctcccacttataagtgacaatatgctgtatttggttttctgttcctgtctt

SEQ ID NO: 8034 - DNA, 6247 bp, Homo sapiens
gtttacggagactcggaactggataaagggaccaggctacattgggaaagaagtgggaagaaatggggtacagcgacgaggagggctaaatgtgaacaataatgtcttggaagagaaattatttttcagggggtcgtggtagtgtacaagggatgtttgcacctcgaagctcaacctccatagcccccagcaaaggcctcagcaatgagccagggcaaaacagctgcttcctcaacagtgccctgcaggttttgtggcacttggatatcttccgacgtagctttaggcagcttacaactcacaagtgcatgggagattcctgcatcttttgcgctctcaagggaatctttaaccagtttcagtgtagtagtgaaaaagtgcttccatctgacactctccgcagtgctctggcaaagactttccaggatgaacaacgtttccagctgggaattatggatgatgctgcagagtgctttgaaaacctcctgatgagaattcacttccacattgctgatgaaaccaaagaggatatatgtactgcccaacactgcatttcccatcagaaatttgcaatgacattgtttgagcagtgtgtatgtactagctgtggtgccacttctgatccgctgcctttcatccagatggtacattatatctccaccacttccctttgcaatcaggctatttgtatgctggaaagacgagagaaaccttcaccaagcatgtttggtgagctgctgcagaatgccagcaccatgggggatctgcggaactgtccaagcaactgtggagagaggatcaggattcgccgtgtgttgatgaatgctccacagattatcacgattgggctggtatgggactcagaccactcagacttagcagaagatgttatccacagcctgggaacctgccttaagctgggtgatctgtttttcagagtgacggatgaccgggccaagcaatctgaactgtacttagttggaatgatctgttactatggcaaacattattctacattcttttttcaaacaaagattcgcaaatggatgtattttgatgatgctcatgtcaaggagattgggcccaaatggaaggatgtggtgaccaaatgcatcaaggggcattatcagcccctgctgctgctttatgcagatccccagggtaccccagtttccacccaggacctgcctccccaagctgagttccagtcatacagcaggacatgctacgacagtgaagattcagggagggagccctccatctcaagtgacactcgaacagattcctcaacggagagctatccctacaaacattcccaccatgagtctgtggtcagtcacttctcttctgattctcaggggacagtcatctataatgtggaaaatgattccatgtctcagagcagtcgggacacaggacacctgactgatagtgaatgtaatcagaaacacacatccaagaaagggtcactgatagagcgcaagaggagctctggtcgggttaggaggaaaggcgatgagccccaggcctcgggataccacagtgaaggagaaacactgaaagagaagcaggctcctagaaatgcctccaaaccatccagcagcaccaacaggctgagagattttaaagagacagtcagcaatatgatccataacagaccatccctggcttctcagaccaatgtaggctctcactgcaggggcagaggaggagaccagcctgacaaaaaacctcctaggaccctgcctttacactctcgtgactgggaaatagagagtaccagcagtgagtcaaaatccagttcttccagcaagtatcgtcccacatggagacccaaacgagaatctctgaatattgacagtatctttagtaaggacaaaaggaagcactgtggctatacccagcttagccccttttctgaggattcagctaaagaatttataccagatgaaccaagcaagccaccttcttacgacattaaatttggtggaccaagcccccagtacaagcgctggggcccagcacggccaggctctcaccttttagagcagcacccccgactaatccagcgaatggaatctggctatgaaagcagtgagaggaacagcagcagccctgtcagcctggatgcagccctgcctgagagctcaaatgtctacagggatccaagtgctaagagatcagctgggttggttccttcctggcgtcatatcccaaagtcgcacagcagtagcatcctggaggtagactccacagcatccatgggtggctggacaaagagtcagcctttctctggtgaggagatatcttctaaaagtgaactggatgaattgcaggaagaggtggccaggagggcgcaggaacaggaacttcgaagaaaacgggagaaggagttagaggcagcgaaagggtttaaccctcatcctagccgcttcatggacttggatgaactgcagaatcaggggaggagtgacggctttgagaggtccctgcaagaggcagagtcagtgtttgaagagtcactacatctggaacagaaaggagactgtgctgcagctttggctctctgtaatgaagctatctctaaactaagacttgccctgcatggtgccagctgtagcacgcacagcagagccctagtcgataagaagttgcaaatcagtattcgaaaagcacggagcctgcaggatcgcatgcagcagcagcaatcaccacagcagccgtcgcagccctcagcctgcctcccaacacaggcggggactctctctcagccaacaagtgaacagcctatcccgctccaagtattgttaagccaagaggcccaactggaatccggcatggatacagagtttggggccagttctttcttccattcacctgcttcctgccatgagtcacactcatcactatctccagagtcatctgccccacagcacagctcccccagtagatctgccttgaagcttctgacttcggttgaagtagacaacattgaaccctctgcattccacaggcaaggtttacctaaagcaccagggtggactgagaagaattctcatcatagttgggagccattggatgccccagagggtaagctgcaaggctctaggtgtgacaacagcagttgcagcaagctccctccacaagaaggaagaggcattgctcaagaacagctgttccaagaaaagaaggatcctgctaacccctccccggtgatgcctggaatagccacctctgagaggggtgatgaacacagcctaggctgtagtccttcaaattcatcagctcagcccagccttcccctgtatagaacctgccaccccataatgcctgttgcttcttcatttgtgcttcactgtcctgatcctgtgcagaaaactaaccaatgcctccaaggccaaagcctcaaaacttcattgactttaaaagtggacagaggcagtgaggagacctataggccagagtttcccagcacaaaggggcttgtccgttctctggctgagcagttccagaggatgcagggtgtctccatgagggatagtacaggtttcaaggatagaagtttgtcaggtagtctaaggaagaactcttccccttctgattctaagcctcctttctcacagggtcaagagaaaggccactggccatgggcaaagcaacaatcctctctggagggtggggatagaccactttcctgggaagagtccactgaacattcttctcttgccttaaactctgggctgcctaatggtgaaacttctagcggaggacagcccaggttggcagagccagacatataccaagagaagctgtcccaagtgagagatgttaggtctaaggatctgggcagcagtactgacttggggacttccttgcctttggattcctgggtgaatatcacaaggttctgtgattctcagcttaagcatggggcacctaggccaggaatgaagtcctcccctcatgattcccatacgtgtgtaacctatccagagagaaatcacatccttttgcatccacattggaaccaagacacagagcaggagacctcagaattggagtctctgtatcaggccagtcttcaggcttctcaagctggctgttctggatgggggcagcaggataccgcctggcacccacttagccaaacaggctctgcagatggcatggggaggaggttgcactcagcccatgatcctggtctctcaaagacttcaacagcagaaatggagcatggtctccatgaagccagaacagtgcgtacttctcaggctacaccttgccgaggcctcagcagggagtgtggggaggatgagcagtacagtgcagagaatttacgtcgcatctcacgcagtctcagtggcaccgttgtctcagagagggaggaagctccggtttcttcccacagttttgattcatcaaacgtgaggaagcctttggaaaccgggcaccgttgttccagctcctcttccctccctgtcatccatgacccttctgtgtttctcctcggtccccaactctaccttccccaaccacagttcctgtccccagatgtcctgatgcccaccatggcaggggagcccaatagactcccaggaacttcaaggagtgtccagcagtttctggctatgtgtgacaggggtgaaacttcccaaggggccaagtacacaggaaggactttgaactaccagagcctcccccatcgctccagaacagacaactcctgggcaccctggtcagagaccaaccagcatattgggaccagattcctgactactccagggtgcaatcctcaactaacctacactgccacactaccagaaagaagcaagggccttcaggttcctcacactcagtcctggagtgatcttttccattcaccctcccaccctcccattgttcatcctgtgtacccaccatctagcagtcttcatgtacccctgaggtcagcttggaattcagatcctgttccagggtcccgaacccctggtcctcgaagagtagatatgcccccagatgatgactggaggcaaagcagttatgcctcccactctggacacaggagaacagtgggagaggggtttctgtttgttctatcagatgctcccagaagagagcagatcagggctagagtcctgcagcacagtcaatggtaaaggttattcctttcctttcctggagctacacctttctttgtaaaactgtactgtgggccgggcgcggtggctcacacctgtaatcccagcactttgggaggctgaggcgggtggatcacgaggtcaggagattgagaccatcctggccaacatggtgaaaccccgtctctaccaaaatacaaaaaattagccaggcgtgacggtgcgtgcctgtagtcccaactactcggaaggctgaggcaggagaattgcttgaacccgggaggcagaggttgcagtgagccgagatcgcaccactgcactccagcttggcaatagagtgagactccatctcaaaaaacaaaacaaaacaacaacaaaataaactactgtggcagcgttggtaccctgcatcactgccatggttgtgctattctcatctcaacatagaattggtgggttctcctaagggtgtcaggaacctctaaaaagatgtgattctttgggaggggatatttgaaattccaacttccattccccctagcaaaaggaagcagctgctgtttaagggttttatctgagccactttaaagatgaatccatggtattactctggatactagccattccttaggattttaaggtcacattttattcctggatgctttatgtccccacctccacctgagccctcatcctctgttccctactatactcccaacttctactctttgttttatccacctatccctattacctgaccctttgtcttccctgtctcccatccttggggggacatgtagccctgtggtcatggttctgatgacatcatcagggcagcccccctgcccaggtattatggcctgtcagcattccctgtgccctccaaaccttaggcctagaatgcggagctgccaacataacattcacccttttgaacagatggagtcaggcacactaacacagccttctgtcctcaataacacagccattattgccacttgctcagtcgtcaatgtaaaccctcagagtcagctgaactattttaggccaaacatactgtttttgtaaagtatttttcattaataaatctataagacagttctatttaa

SEQ ID NO: 8035 - DNA, 6020 bp, Homo sapiens
gctaaatgtgaacaataatgtcttggaagagaaattatttttcagggggtcgtggtagtgtacaagggatgtttgcacctcgaagctcaacctccatagcccccagcaaaggcctcagcaatgagccagggcaaaacagctgcttcctcaacagtgccctgcaggttttgtggcacttggatatcttccgacgtagctttaggcagcttacaactcacaagtgcatgggagattcctgcatcttttgcgctctcaagggaatctttaaccagtttcagtgtagtagtgaaaaagtgcttccatctgacactctccgcagtgctctggcaaagactttccaggatgaacaacgtttccagctgggaattatggatgatgctgcagagtgctttgaaaacctcctgatgagaattcacttccacattgctgatgaaaccaaagaggatatatgtactgcccaacactgcatttcccatcagaaatttgcaatgacattgtttgagcagtgtgtatgtactagctgtggtgccacttctgatccgctgcctttcatccagatggtacattatatctccaccacttccctttgcaatcaggctatttgtatgctggaaagacgagagaaaccttcaccaagcatgtttggtgagctgctgcagaatgccagcaccatgggggatctgcggaactgtccaagcaactgtggagagaggatcaggattcgccgtgtgttgatgaatgctccacagattatcacgattgggctggtatgggactcagaccactcagacttagcagaagatgttatccacagcctgggaacctgccttaagctgggtgatctgtttttcagagtgacggatgaccgggccaagcaatctgaactgtacttagttggaatgatctgttactatggcaaacattattctacattcttttttcaaacaaagattcgcaaatggatgtattttgatgatgctcatgtcaaggagattgggcccaaatggaaggatgtggtgaccaaatgcatcaaggggcattatcagcccctgctgctgctttatgcagatccccagggtaccccagtttccacccaggacctgcctccccaagctgagttccagtcatacagcaggacatgctacgacagtgaagattcagggagggagccctccatctcaagtgacactcgaacagattcctcaacggagagctatccctacaaacattcccaccatgagtctgtggtcagtcacttctcttctgattctcaggggacagtcatctataatgtggaaaatgattccatgtctcagagcagtcgggacacaggacacctgactgatagtgaatgtaatcagaaacacacatccaagaaagggtcactgatagagcgcaagaggagctctggtcgggttaggaggaaaggcgatgagccccaggcctcgggataccacagtgaaggagaaacactgaaagagaagcaggctcctagaaatgcctccaaaccatccagcagcaccaacaggctgagagattttaaagagacagtcagcaatatgatccataacagaccatccctggcttctcagaccaatgtaggctctcactgcaggggcagaggaggagaccagcctgacaaaaaacctcctaggaccctgcctttacactctcgtgactgggaaatagagagtaccagcagtgagtcaaaatccagttcttccagcaagtatcgtcccacatggagacccaaacgagaatctctgaatattgacagtatctttagtaaggacaaaaggaagcactgtggctatacccagcttagccccttttctgaggattcagctaaagaatttataccagatgaaccaagcaagccaccttcttacgacattaaatttggtggaccaagcccccagtacaagcgctggggcccagcacggccaggctctcaccttttagagcagcacccccgactaatccagcgaatggaatctggctatgaaagcagtgagaggaacagcagcagccctgtcagcctggatgcagccctgcctgagagctcaaatgtctacagggatccaagtgctaagagatcagctgggttggttccttcctggcgtcatatcccaaagtcgcacagcagtagcatcctggaggtagactccacagcatccatgggtggctggacaaagagtcagcctttctctggtgaggagatatcttctaaaagtgaactggatgaattgcaggaagaggtggccaggagggcgcaggaacaggaacttcgaagaaaacgggagaaggagttagaggcagcgaaagggtttaaccctcatcctagccgcttcatggacttggatgaactgcagaatcaggggaggagtgacggctttgagaggtccctgcaagaggcagagtcagtgtttgaagagtcactacatctggaacagaaaggagactgtgctgcagctttggctctctgtaatgaagctatctctaaactaagacttgccctgcatggtgccagctgtagcacgcacagcagagccctagtcgataagaagttgcaaatcagtattcgaaaagcacggagcctgcaggatcgcatgcagcagcagcaatcaccacagcagccgtcgcagccctcagcctgcctcccaacacaggcggggactctctctcagccaacaagtgaacagcctatcccgctccaagtattgttaagccaagaggcccaactggaatccggcatggatacagagtttggggccagttctttcttccattcacctgcttcctgccatgagtcacactcatcactatctccagagtcatctgccccacagcacagctcccccagtagatctgccttgaagcttctgacttcggttgaagtagacaacattgaaccctctgcattccacaggcaaggtttacctaaagcaccagggtggactgagaagaattctcatcatagttgggagccattggatgccccagagggtaagctgcaaggctctaggtgtgacaacagcagttgcagcaagctccctccacaagaaggaagaggcattgctcaagaacagctgttccaagaaaagaaggatcctgctaacccctccccggtgatgcctggaatagccacctctgagaggggtgatgaacacagcctaggctgtagtccttcaaattcatcagctcagcccagccttcccctgtatagaacctgccaccccataatgcctgttgcttcttcatttgtgcttcactgtcctgatcctgtgcagaaaactaaccaatgcctccaaggccaaagcctcaaaacttcattgactttaaaagtggacagaggcagtgaggagacctataggccagagtttcccagcacaaaggggcttgtccgttctctggctgagcagttccagaggatgcagggtgtctccatgagggatagtacaggtttcaaggatagaagtttgtcaggtagtctaaggaagaactcttccccttctgattctaagcctcctttctcacagggtcaagagaaaggccactggccatgggcaaagcaacaatcctctctggagggtggggatagaccactttcctgggaagagtccactgaacattcttctcttgccttaaactctgggctgcctaatggtgaaacttctagcggaggacagcccaggttggcagagccagacatataccaagagaagctgtcccaagtgagagatgttaggtctaaggatctgggcagcagtactgacttggggacttccttgcctttggattcctgggtgaatatcacaaggttctgtgattctcagcttaagcatggggcacctaggccaggaatgaagtcctcccctcatgattcccatacgtgtgtaacctatccagagagaaatcacatccttttgcatccacattggaaccaagacacagagcaggagacctcagaattggagtctctgtatcaggccagtcttcaggcttctcaagctggctgttctggatgggggcagcaggataccgcctggcacccacttagccaaacaggctctgcagatggcatggggaggaggttgcactcagcccatgatcctggtctctcaaagacttcaacagcagaaatggagcatggtctccatgaagccagaacagtgcgtacttctcaggattcatcaaacgtgaggaagcctttggaaaccgggcaccgttgttccagctcctcttccctccctgtcatccatgacccttctgtgtttctcctcggtccccaactctaccttccccaaccacagttcctgtccccagatgtcctgatgcccaccatggcaggggagcccaatagactcccaggaacttcaaggagtgtccagcagtttctggctatgtgtgacaggggtgaaacttcccaaggggccaagtacacaggaaggactttgaactaccagagcctcccccatcgctccagaacagacaactcctgggcaccctggtcagagaccaaccagcatattgggaccagattcctgactactccagggtgcaatcctcaactaacctacactgccacactaccagaaagaagcaagggccttcaggttcctcacactcagtcctggagtgatcttttccattcaccctcccaccctcccattgttcatcctgtgtacccaccatctagcagtcttcatgtacccctgaggtcagcttggaattcagatcctgttccagggtcccgaacccctggtcctcgaagagtagatatgcccccagatgatgactggaggcaaagcagttatgcctcccactctggacacaggagaacagtgggagaggggtttctgtttgttctatcagatgctcccagaagagagcagatcagggctagagtcctgcagcacagtcaatggtaaaggttattcctttcctttcctggagctacacctttctttgtaaaactgtactgtgggccgggcgcggtggctcacacctgtaatcccagcactttgggaggctgaggcgggtggatcacgaggtcaggagattgagaccatcctggccaacatggtgaaaccccgtctctaccaaaatacaaaaaattagccaggcgtgacggtgcgtgcctgtagtcccaactactcggaaggctgaggcaggagaattgcttgaacccgggaggcagaggttgcagtgagccgagatcgcaccactgcactccagcttggcaatagagtgagactccatctcaaaaaacaaaacaaaacaacaacaaaataaactactgtggcagcgttggtaccctgcatcactgccatggttgtgctattctcatctcaacatagaattggtgggttctcctaagggtgtcaggaacctctaaaaagatgtgattctttgggaggggatatttgaaattccaacttccattccccctagcaaaaggaagcagctgctgtttaagggttttatctgagccactttaaagatgaatccatggtattactctggatactagccattccttaggattttaaggtcacattttattcctggatgctttatgtccccacctccacctgagccctcatcctctgttccctactatactcccaacttctactctttgttttatccacctatccctattacctgaccctttgtcttccctgtctcccatccttggggggacatgtagccctgtggtcatggttctgatgacatcatcagggcagcccccctgcccaggtattatggcctgtcagcattccctgtgccctccaaaccttaggcctagaatgcggagctgccaacataacattcacccttttgaacagatggagtcaggcacactaacacagccttctgtcctcaataacacagccattattgccacttgctcagtcgtcaatgtaaaccctcagagtcagctgaactattttaggccaaacatactgtttttgtaaagtatttttcattaataaatctataagacagttctattt

SEQ ID NO: 8036 - DNA, 6161 bp, Homo sapiens
gctaaatgtgaacaataatgtcttggaagagaaattatttttcagggggtcgtggtagtgtacaagggatgtttgcacctcgaagctcaacctccatagcccccagcaaaggcctcagcaatgagccagggcaaaacagctgcttcctcaacagtgccctgcaggttttgtggcacttggatatcttccgacgtagctttaggcagcttacaactcacaagtgcatgggagattcctgcatcttttgcgctctcaagggaatctttaaccagtttcagtgtagtagtgaaaaagtgcttccatctgacactctccgcagtgctctggcaaagactttccaggatgaacaacgtttccagctgggaattatggatgatgctgcagagtgctttgaaaacctcctgatgagaattcacttccacattgctgatgaaaccaaagaggatatatgtactgcccaacactgcatttcccatcagaaatttgcaatgacattgtttgagcagtgtgtatgtactagctgtggtgccacttctgatccgctgcctttcatccagatggtacattatatctccaccacttccctttgcaatcaggctatttgtatgctggaaagacgagagaaaccttcaccaagcatgtttggtgagctgctgcagaatgccagcaccatgggggatctgcggaactgtccaagcaactgtggagagaggatcaggattcgccgtgtgttgatgaatgctccacagattatcacgattgggctggtatgggactcagaccactcagacttagcagaagatgttatccacagcctgggaacctgccttaagctgggtgatctgtttttcagagtgacggatgaccgggccaagcaatctgaactgtacttagttggaatgatctgttactatggcaaacattattctacattcttttttcaaacaaagattcgcaaatggatgtattttgatgatgctcatgtcaaggagattgggcccaaatggaaggatgtggtgaccaaatgcatcaaggggcattatcagcccctgctgctgctttatgcagatccccagggtaccccagtttccacccaggacctgcctccccaagctgagttccagtcatacagcaggacatgctacgacagtgaagattcagggagggagccctccatctcaagtgacactcgaacagattcctcaacggagagctatccctacaaacattcccaccatgagtctgtggtcagtcacttctcttctgattctcaggggacagtcatctataatgtggaaaatgattccatgtctcagagcagtcgggacacaggacacctgactgatagtgaatgtaatcagaaacacacatccaagaaagggtcactgatagagcgcaagaggagctctggtcgggttaggaggaaaggcgatgagccccaggcctcgggataccacagtgaaggagaaacactgaaagagaagcaggctcctagaaatgcctccaaaccatccagcagcaccaacaggctgagagattttaaagagacagtcagcaatatgatccataacagaccatccctggcttctcagaccaatgtaggctctcactgcaggggcagaggaggagaccagcctgacaaaaaacctcctaggaccctgcctttacactctcgtgactgggaaatagagagtaccagcagtgagtcaaaatccagttcttccagcaagtatcgtcccacatggagacccaaacgagaatctctgaatattgacagtatctttagtaaggacaaaaggaagcactgtggctatacccagcttagccccttttctgaggattcagctaaagaatttataccagatgaaccaagcaagccaccttcttacgacattaaatttggtggaccaagcccccagtacaagcgctggggcccagcacggccaggctctcaccttttagagcagcacccccgactaatccagcgaatggaatctggctatgaaagcagtgagaggaacagcagcagccctgtcagcctggatgcagccctgcctgagagctcaaatgtctacagggatccaagtgctaagagatcagctgggttggttccttcctggcgtcatatcccaaagtcgcacagcagtagcatcctggaggtagactccacagcatccatgggtggctggacaaagagtcagcctttctctggtgaggagatatcttctaaaagtgaactggatgaattgcaggaagaggtggccaggagggcgcaggaacaggaacttcgaagaaaacgggagaaggagttagaggcagcgaaagggtttaaccctcatcctagccgcttcatggacttggatgaactgcagaatcaggggaggagtgacggctttgagaggtccctgcaagaggcagagtcagtgtttgaagagtcactacatctggaacagaaaggagactgtgctgcagctttggctctctgtaatgaagctatctctaaactaagacttgccctgcatggtgccagctgtagcacgcacagcagagccctagtcgataagaagttgcaaatcagtattcgaaaagcacggagcctgcaggatcgcatgcagcagcagcaatcaccacagcagccgtcgcagccctcagcctgcctcccaacacaggcggggactctctctcagccaacaagtgaacagcctatcccgctccaagtattgttaagccaagaggcccaactggaatccggcatggatacagagtttggggccagttctttcttccattcacctgcttcctgccatgagtcacactcatcactatctccagagtcatctgccccacagcacagctcccccagtagatctgccttgaagcttctgacttcggttgaagtagacaacattgaaccctctgcattccacaggcaaggtttacctaaagcaccagggtggactgagaagaattctcatcatagttgggagccattggatgccccagagggtaagctgcaaggctctaggtgtgacaacagcagttgcagcaagctccctccacaagaaggaagaggcattgctcaagaacagctgttccaagaaaagaaggatcctgctaacccctccccggtgatgcctggaatagccacctctgagaggggtgatgaacacagcctaggctgtagtccttcaaattcatcagctcagcccagccttcccctgtatagaacctgccaccccataatgcctgttgcttcttcatttgtgcttcactgtcctgatcctgtgcagaaaactaaccaatgcctccaaggccaaagcctcaaaacttcattgactttaaaagtggacagaggcagtgaggagacctataggccagagtttcccagcacaaaggggcttgtccgttctctggctgagcagttccagaggatgcagggtgtctccatgagggatagtacaggtttcaaggatagaagtttgtcaggtagtctaaggaagaactcttccccttctgattctaagcctcctttctcacagggtcaagagaaaggccactggccatgggcaaagcaacaatcctctctggagggtggggatagaccactttcctgggaagagtccactgaacattcttctcttgccttaaactctgggctgcctaatggtgaaacttctagcggaggacagcccaggttggcagagccagacatataccaagagaagctgtcccaagtgagagatgttaggtctaaggatctgggcagcagtactgacttggggacttccttgcctttggattcctgggtgaatatcacaaggttctgtgattctcagcttaagcatggggcacctaggccaggaatgaagtcctcccctcatgattcccatacgtgtgtaacctatccagagagaaatcacatccttttgcatccacattggaaccaagacacagagcaggagacctcagaattggagtctctgtatcaggccagtcttcaggcttctcaagctggctgttctggatgggggcagcaggataccgcctggcacccacttagccaaacaggctctgcagatggcatggggaggaggttgcactcagcccatgatcctggtctctcaaagacttcaacagcagaaatggagcatggtctccatgaagccagaacagtgcgtacttctcaggctacaccttgccgaggcctcagcagggagtgtggggaggatgagcagtacagtgcagagaatttacgtcgcatctcacgcagtctcagtggcaccgttgtctcagagagggaggaagctccggtttcttcccacagttttgattcatcaaacgtgaggaagcctttggaaaccgggcaccgttgttccagctcctcttccctccctgtcatccatgacccttctgtgtttctcctcggtccccaactctaccttccccaaccacagttcctgtccccagatgtcctgatgcccaccatggcaggggagcccaatagactcccaggaacttcaaggagtgtccagcagtttctggctatgtgtgacaggggtgaaacttcccaaggggccaagtacacaggaaggactttgaactaccagagcctcccccatcgctccagaacagacaactcctgggcaccctggtcagagaccaaccagcatattgggaccagattcctgactactccagggtgcaatcctcaactaacctacactgccacactaccagaaagaagcaagggccttcaggttcctcacactcagtcctggagtgatcttttccattcaccctcccaccctcccattgttcatcctgtgtacccaccatctagcagtcttcatgtacccctgaggtcagcttggaattcagatcctgttccagggtcccgaacccctggtcctcgaagagtagatatgcccccagatgatgactggaggcaaagcagttatgcctcccactctggacacaggagaacagtgggagaggggtttctgtttgttctatcagatgctcccagaagagagcagatcagggctagagtcctgcagcacagtcaatggtaaaggttattcctttcctttcctggagctacacctttctttgtaaaactgtactgtgggccgggcgcggtggctcacacctgtaatcccagcactttgggaggctgaggcgggtggatcacgaggtcaggagattgagaccatcctggccaacatggtgaaaccccgtctctaccaaaatacaaaaaattagccaggcgtgacggtgcgtgcctgtagtcccaactactcggaaggctgaggcaggagaattgcttgaacccgggaggcagaggttgcagtgagccgagatcgcaccactgcactccagcttggcaatagagtgagactccatctcaaaaaacaaaacaaaacaacaacaaaataaactactgtggcagcgttggtaccctgcatcactgccatggttgtgctattctcatctcaacatagaattggtgggttctcctaagggtgtcaggaacctctaaaaagatgtgattctttgggaggggatatttgaaattccaacttccattccccctagcaaaaggaagcagctgctgtttaagggttttatctgagccactttaaagatgaatccatggtattactctggatactagccattccttaggattttaaggtcacattttattcctggatgctttatgtccccacctccacctgagccctcatcctctgttccctactatactcccaacttctactctttgttttatccacctatccctattacctgaccctttgtcttccctgtctcccatccttggggggacatgtagccctgtggtcatggttctgatgacatcatcagggcagcccccctgcccaggtattatggcctgtcagcattccctgtgccctccaaaccttaggcctagaatgcggagctgccaacataacattcacccttttgaacagatggagtcaggcacactaacacagccttctgtcctcaataacacagccattattgccacttgctcagtcgtcaatgtaaaccctcagagtcagctgaactattttaggccaaacatactgtttttgtaaagtatttttcattaataaatctataagacagttctattt

SEQ ID NO: 8037 - DNA, 543 bp, Homo sapiens
atcacttgccccacagataccctcgtgattagaggtcttttgctggaggttgactgtgctgtctggctaaatgtgaacaataatgtcttggaagagaaattatttttcagggggtcgtggtagtgtacaagggatgtttgcacctcgaagctcaacctccatagcccccagcaaaggcctcagcaatgagccagggcaaaacagctgcttcctcaacagtgccctgcaggttttgtggcacttggatatcttccgacgtagctttaggcagcttacaactcacaagtgcatgggagattcctgcatcttttgcgctctcaagggaatctttaaccagtttcagtgtagtagtgaaaaagtgcttccatctgacactctccgcagtgctctggcaaagactttccaggatgaacaacgtttccagctgggaattatggatgatgctgcagagtgctttgaaaacctcctgatgagaattcacttccacattgctgatgaaaccaaagaggatatatgtactgcccaacactgcatttcccatca

SEQ ID NO: 8038 - DNA, 2775 bp, Homo sapiens
tcgaagaaaacgggagaaggagttagaggcagcgaaagggtttaaccctcatcctagccgcttcatggacttggatgaactgcagaatcaggctaaactaagacttgccctgcatggtgccagctgtagcacgcacagcagagccctagtcgataagaagttgcaaatcagtattcgaaaagcacggagcctgcaggatcgcatgcagcagcagcaatcaccacagcagccgtcgcagccctcagcctgcctcccaacacaggcggggactctctctcagccaacaagtgaacagcctatcccgctccaagtattgttaagccaagaggcccaactggaatccggcatggatacagagtttggggccagttctttcttccattcacctgcttcctgccatgagtcacactcatcactatctccagagtcatctgccccacagcacagctcccccagtagatctgccttgaagcttctgacttcggttgaagtagacaacattgaaccctctgcattccacaggcaaggtttacctaaagcaccagggtggactgagaagaattctcatcatagttgggagccattggatgccccagagggtaagctgcaaggctctaggtgtgacaacagcagttgcagcaagctccctccacaagaaggaagaggcattgctcaagaacagctgttccaagaaaagaaggatcctgctaacccctccccggtgatgcctggaatagccacctctgagaggggtgatgaacacagcctaggctgtagtccttcaaattcatcagctcagcccagccttcccctgtatagaacctgccaccccataatgcctgttgcttcttcatttgtgcttcactgtcctgatcctgtgcagaaaactaaccaatgcctccaaggccaaagcctcaaaacttcattgactttaaaagtggacagaggcagtgaggagacctataggccagagtttcccagcacaaaggggcttgtccgttctctggctgagcagttccagaggatgcagggtgtctccatgagggatagtacaggtttcaaggatagaagtttgtcaggtagtctaaggaagaactcttccccttctgattctaagcctcctttctcacagggtcaagagaaaggccactggccatgggcaaagcaacaatcctctctggagggtggggatagaccactttcctgggaagagtccactgaacattcttctcttgccttaaactctgggctgcctaatggtgaaacttctagcggaggacagcccaggttggcagagccagacatataccaagagaagctgtcccaagtgagagatgttaggtctaaggatctgggcagcagtactgacttggggacttccttgcctttggattcctgggtgaatatcacaaggttctgtgattctcagcttaagcatggggcacctaggccaggaatgaagtcctcccctcatgattcccatacgtgtgtaacctatccagagagaaatcacatccttttgcatccacattggaaccaagacacagagcaggagacctcagaattggagtctctgtatcaggccagtcttcaggcttctcaagctggctgttctggatgggggcagcaggataccgcctggcacccacttagccaaacaggctctgcagatggcatggggaggaggttgcactcagcccatgatcctggtctctcaaagacttcaacagcagaaatggagcatggtctccatgaagccagaacagtgcgtacttctcaggattcatcaaacgtgaggaagcctttggaaaccgggcaccgttgttccagctcctcttccctccctgtcatccatgacccttctgtgtttctcctcggtccccaactctaccttccccaaccacagttcctgtccccagatgtcctgatgcccaccatggcaggggagcccaatagactcccaggaacttcaaggagtgtccagcagtttctggctatgtgtgacaggggtgaaacttcccaaggggccaagtacacaggaaggactttgaactaccagagcctcccccatcgctccagaacagacaactcctgggcaccctggtcagagaccaaccagcatattgggaccagattcctgactactccagggtgcaatcctcaactaacctacactgccacactaccagaaagaagcaagggccttcaggttcctcacactcagtcctggagtgatcttttccattcaccctcccaccctcccattgttcatcctgtgtacccaccatctagcagtcttcatgtacccctgaggtcagcttggaattcagatcctgttccagggtcccgaacccctggtcctcgaagagtagatatgcccccagatgatgactggaggcaaagcagttatgcctcccactctggacacaggagaacagtgggagaggggtttctgtttgttctatcagatgctcccagaagagagcagatcagggctagagtcctgcagcacagtcaatggtaaaggttattcctttcctttcctggagctacacctttctttgtaaaactgtactgtgggccgggcgcggtggctcacacctgtaatcccagcactttgggaggctgaggcgggtggatcacgaggtcaggagattgagaccatcctggccaacatggtgaaaccccgtctctaccaaaatacaaaaaattagccaggcgtgacggtgcgtgcctgtagtcccaactactcggaaggctgaggcaggagaattg

SEQ ID NO: 8039 - DNA, 5711 bp, Homo sapiens
gctaaatgtgaacaataatgtcttggaagagaaattatttttcagggggtcgtggtagtgtacaagggatgtttgcacctcgaagctcaacctccatagcccccagcaaaggcctcagcaatgagccagggcaaaacagctgcttcctcaacagtgccctgcaggttttgtggcacttggatatcttccgacgtagctttaggcagcttacaactcacaagtgcatgggagattcctgcatcttttgcgctctcaagggaatctttaaccagtttcagtgtagtagtgaaaaagtgcttccatctgacactctccgcagtgctctggcaaagactttccaggatgaacaacgtttccagctgggaattatggatgatgctgcagagtgctttctgtttttcagagtgacggatgaccgggccaagcaatctgaactgtacttagttggaatgatctgttactatggcaaacattattctacattcttttttcaaacaaagattcgcaaatggatgtattttgatgatgctcatgtcaaggagattgggcccaaatggaaggatgtggtgaccaaatgcatcaaggggcattatcagcccctgctgctgctttatgcagatccccagggtaccccagtttccacccaggacctgcctccccaagctgagttccagtcatacagcaggacatgctacgacagtgaagattcagggagggagccctccatctcaagtgacactcgaacagattcctcaacggagagctatccctacaaacattcccaccatgagtctgtggtcagtcacttctcttctgattctcaggggacagtcatctataatgtggaaaatgattccatgtctcagagcagtcgggacacaggacacctgactgatagtgaatgtaatcagaaacacacatccaagaaagggtcactgatagagcgcaagaggagctctggtcgggttaggaggaaaggcgatgagccccaggcctcgggataccacagtgaaggagaaacactgaaagagaagcaggctcctagaaatgcctccaaaccatccagcagcaccaacaggctgagagattttaaagagacagtcagcaatatgatccataacagaccatccctggcttctcagaccaatgtaggctctcactgcaggggcagaggaggagaccagcctgacaaaaaacctcctaggaccctgcctttacactctcgtgactgggaaatagagagtaccagcagtgagtcaaaatccagttcttccagcaagtatcgtcccacatggagacccaaacgagaatctctgaatattgacagtatctttagtaaggacaaaaggaagcactgtggctatacccagcttagccccttttctgaggattcagctaaagaatttataccagatgaaccaagcaagccaccttcttacgacattaaatttggtggaccaagcccccagtacaagcgctggggcccagcacggccaggctctcaccttttagagcagcacccccgactaatccagcgaatggaatctggctatgaaagcagtgagaggaacagcagcagccctgtcagcctggatgcagccctgcctgagagctcaaatgtctacagggatccaagtgctaagagatcagctgggttggttccttcctggcgtcatatcccaaagtcgcacagcagtagcatcctggaggtagactccacagcatccatgggtggctggacaaagagtcagcctttctctggtgaggagatatcttctaaaagtgaactggatgaattgcaggaagaggtggccaggagggcgcaggaacaggaacttcgaagaaaacgggagaaggagttagaggcagcgaaagggtttaaccctcatcctagccgcttcatggacttggatgaactgcagaatcaggggaggagtgacggctttgagaggtccctgcaagaggcagagtcagtgtttgaagagtcactacatctggaacagaaaggagactgtgctgcagctttggctctctgtaatgaagctatctctaaactaagacttgccctgcatggtgccagctgtagcacgcacagcagagccctagtcgataagaagttgcaaatcagtattcgaaaagcacggagcctgcaggatcgcatgcagcagcagcaatcaccacagcagccgtcgcagccctcagcctgcctcccaacacaggcggggactctctctcagccaacaagtgaacagcctatcccgctccaagtattgttaagccaagaggcccaactggaatccggcatggatacagagtttggggccagttctttcttccattcacctgcttcctgccatgagtcacactcatcactatctccagagtcatctgccccacagcacagctcccccagtagatctgccttgaagcttctgacttcggttgaagtagacaacattgaaccctctgcattccacaggcaaggtttacctaaagcaccagggtggactgagaagaattctcatcatagttgggagccattggatgccccagagggtaagctgcaaggctctaggtgtgacaacagcagttgcagcaagctccctccacaagaaggaagaggcattgctcaagaacagctgttccaagaaaagaaggatcctgctaacccctccccggtgatgcctggaatagccacctctgagaggggtgatgaacacagcctaggctgtagtccttcaaattcatcagctcagcccagccttcccctgtatagaacctgccaccccataatgcctgttgcttcttcatttgtgcttcactgtcctgatcctgtgcagaaaactaaccaatgcctccaaggccaaagcctcaaaacttcattgactttaaaagtggacagaggcagtgaggagacctataggccagagtttcccagcacaaaggggcttgtccgttctctggctgagcagttccagaggatgcagggtgtctccatgagggatagtacaggtttcaaggatagaagtttgtcaggtagtctaaggaagaactcttccccttctgattctaagcctcctttctcacagggtcaagagaaaggccactggccatgggcaaagcaacaatcctctctggagggtggggatagaccactttcctgggaagagtccactgaacattcttctcttgccttaaactctgggctgcctaatggtgaaacttctagcggaggacagcccaggttggcagagccagacatataccaagagaagctgtcccaagtgagagatgttaggtctaaggatctgggcagcagtactgacttggggacttccttgcctttggattcctgggtgaatatcacaaggttctgtgattctcagcttaagcatggggcacctaggccaggaatgaagtcctcccctcatgattcccatacgtgtgtaacctatccagagagaaatcacatccttttgcatccacattggaaccaagacacagagcaggagacctcagaattggagtctctgtatcaggccagtcttcaggcttctcaagctggctgttctggatgggggcagcaggataccgcctggcacccacttagccaaacaggctctgcagatggcatggggaggaggttgcactcagcccatgatcctggtctctcaaagacttcaacagcagaaatggagcatggtctccatgaagccagaacagtgcgtacttctcaggctacaccttgccgaggcctcagcagggagtgtggggaggatgagcagtacagtgcagagaatttacgtcgcatctcacgcagtctcagtggcaccgttgtctcagagagggaggaagctccggtttcttcccacagttttgattcatcaaacgtgaggaagcctttggaaaccgggcaccgttgttccagctcctcttccctccctgtcatccatgacccttctgtgtttctcctcggtccccaactctaccttccccaaccacagttcctgtccccagatgtcctgatgcccaccatggcaggggagcccaatagactcccaggaacttcaaggagtgtccagcagtttctggctatgtgtgacaggggtgaaacttcccaaggggccaagtacacaggaaggactttgaactaccagagcctcccccatcgctccagaacagacaactcctgggcaccctggtcagagaccaaccagcatattgggaccagattcctgactactccagggtgcaatcctcaactaacctacactgccacactaccagaaagaagcaagggccttcaggttcctcacactcagtcctggagtgatcttttccattcaccctcccaccctcccattgttcatcctgtgtacccaccatctagcagtcttcatgtacccctgaggtcagcttggaattcagatcctgttccagggtcccgaacccctggtcctcgaagagtagatatgcccccagatgatgactggaggcaaagcagttatgcctcccactctggacacaggagaacagtgggagaggggtttctgtttgttctatcagatgctcccagaagagagcagatcagggctagagtcctgcagcacagtcaatggtaaaggttattcctttcctttcctggagctacacctttctttgtaaaactgtactgtgggccgggcgcggtggctcacacctgtaatcccagcactttgggaggctgaggcgggtggatcacgaggtcaggagattgagaccatcctggccaacatggtgaaaccccgtctctaccaaaatacaaaaaattagccaggcgtgacggtgcgtgcctgtagtcccaactactcggaaggctgaggcaggagaattgcttgaacccgggaggcagaggttgcagtgagccgagatcgcaccactgcactccagcttggcaatagagtgagactccatctcaaaaaacaaaacaaaacaacaacaaaataaactactgtggcagcgttggtaccctgcatcactgccatggttgtgctattctcatctcaacatagaattggtgggttctcctaagggtgtcaggaacctctaaaaagatgtgattctttgggaggggatatttgaaattccaacttccattccccctagcaaaaggaagcagctgctgtttaagggttttatctgagccactttaaagatgaatccatggtattactctggatactagccattccttaggattttaaggtcacattttattcctggatgctttatgtccccacctccacctgagccctcatcctctgttccctactatactcccaacttctactctttgttttatccacctatccctattacctgaccctttgtcttccctgtctcccatccttggggggacatgtagccctgtggtcatggttctgatgacatcatcagggcagcccccctgcccaggtattatggcctgtcagcattccctgtgccctccaaaccttaggcctagaatgcggagctgccaacataacattcacccttttgaacagatggagtcaggcacactaacacagccttctgtcctcaataacacagccattattgccacttgctcagtcgtcaatgtaaaccctcagagtcagctgaactattttaggccaaacatactgtttttgtaaagtatttttcattaataaatctataagacagttctattt

SEQ ID NO: 8040 - DNA, 600 bp, Homo sapiens
atgcggcgccaggagctgctaagagatgggctctcctgtgttgcccaggctgtactcgaactcctaggctcaagtaattccttcccacctcagcctcctgattggctgggactacagctctctgacacagctggctattctagtcccagaagaaagaggagagacttgctgaagatctggatgggacaatagaagtttggggcacattaaaaagaagcagcaagaacatcaacaaaaacctcagatgattcaaacaggcttcttcttggctttgtggaaccttttgcagttgctcagaatttgagtttttgcttcagaggatgatgagacaaggcaatagagggctaaatgtgaacaataatgtcttggaagagaaattatttttcagggggtcgtggtagtgtacaagggatgtttgcacctcgaagctcaacctccatagcccccagcaaaggcctcagcaatgagccagggcaaaacagctgcttcctcaacagtgccctgcaggttttgtggcacttggatatcttccgacgtagctttaggcagcttacaactcacaagtgcatgggagattcctgcatcttttgcgctctcaag

SEQ ID NO: 8041 - DNA, 3814 bp, Homo sapiens
agggcggacagccacgcctctgcggagggcgaccggaagtgctcacgtcttcaccttccccgccacgccaccgtcctttcaggcccagcgtgcagcaggaaggaggactcttttgccgcggactcaagccggaagccgccttcctagtggagacgcgagtgggggaggagcagtccgaggggaacgtgggttgaacgttgcaactagggtggagatcaagctggaacaggagttccgatcgacccggtaccaagaaggggagtgcccgcggcagggttcattgaaaaaatccttagtgatattgacatgtctcaagtgacataaattagccaatgactcggaatgatggattctccgaagattggaaatggtttgccagtgattggaccagggactgatatagggatatcttcactccacatggtggggtatttgggaaaaaattttgattcagctaaagttccatcagatgagtattgccctgcttgtagagagaagggaaagttaaaagccttaaagacttaccgaattagttttcaagaatctatctttttgtgtgaggatctgcagtgcatctatcctttgggctctaaatcacttaataacctaatttctcctgatttggaagaatgtcacactccacataagcctcagaaaaggaagagcttagaaagcagctataaggattcacttcttttagcaaattccaaaaagactagaaattatattgctattgacggtggaaaagttttgaacagcaaacataatggagaagtatatgacgaaacctcgtcaaacttacctgatagtagtggtcaacagaatccaattaggacagctgattccttggagcggaatgagattttggaagctgatactgttgacatggctactacaaaagatcctgctacagttgatgtctctggaactggcagaccttcccctcaaaatgaaggatgtacatctaaactggaaatgccactggagagcaaatgtacatcatttccccaggctttatgtgtccagtggaaaaatgcttatgctctctgttggttagactgtatcctgtcagctttggtgcactcggaagagttaaagaacaccgtgactggactgtgctcgaaggaggaatctatattctggcggttgcttacaaaatataatcaagcaaatacacttctatataccagtcaattgagtggtgttaaagatggagattgtaaaaaacttacctcagaaatatttgcagagatagagacctgtctgaatgaagttagagatgaaatttttattagccttcagccccagcttagatgcacattaggtgatatggaaagccctgtgtttgcatttcccctgctcttaaaactagaaacccacattgaaaagctcttcctatattctttttcttgggactttgaatgttcgcagtgtggacaccaatatcaaaacaggcatatgaagagtctggtcacctttacaaatgtcatccctgagtggcacccacttaatgctgcccattttggtccatgtaacaattgcaacagtaaatcacaaataagaaaaatggtattagaaaaagtatctcccatattcatgttgcactttgtagaaggcttaccacagaatgacttgcagcactatgcatttcattttgaaggctgtctttatcagataacttctgtaattcagtatcgagcaaataatcattttataacatggattttagatgctgatggaagttggctggaatgtgatgacttaaaaggcccatgttctgaaaggcacaagaaatttgaagttcctgcttcagagatacatattgttatttgggaaagaaaaatatcccaagtgacagataaagaagctgcctgccttccacttaaaaagactaatgaccaacacgctctcagtaatgagaaaccagtatctttaacatcgtgttctgtgggtgatgctgcctcagctgaaacagcctcagtaactcaccctaaagatatatcagttgcccctcgtactctttcacaggacacagctgtaactcatggagatcatttactttcaggtccaaaaggtttggttgacaatattttacctctgacacttgaagaaactatccagaaaacagcctcagtttcacagttaaattctgaagctttcctgttagaaaataaacctgtagcagaaaatacaggaattctcaaaaccaatactttgctatcacaagaatcactaatggcttcttcagtatcagctccatgtaatgaaaagcttattcaagaccaatttgtggacataagttttccatcccaagttgtaaatacaaacatgcagtcagtacagctgaatacagaagatactgtaaatactaaatctgtgaataatactgatgctactggtcttatacagggagtgaagtcagtagaaattgagaaggacgctcagttaaaacaattccttacaccaaaaactgaacaattaaaaccagaacgtgtcacatctcaggtatctaatttgaagaaaaaagaaactacagcagattctcaaaccacaacatctaagtcattacagaatcagtctctgaaagaaaatcagaagaagccatttgtgggaagttgggttaaaggcttaataagcaggggtgcttcttttatgccactctgtgtttcagctcataatagaaacactataactgatttacaaccttcagttaaaggggtaaataattttggtggctttaaaactaaaggtataaaccagaaggccagccacgtatccaagaaagctcgtaagagtgcaagtaagcctcctcccatcagtaagccaccagcaggccctccatcgtctaatggcacagctgcccacccacatgctcatgctgcttcagaagttttggaaaagtctggaagcacctcatgtggagctcaactcaaccacagttcttatgggaatggtatttcttcagcaaaccatgaagacttggtggaaggtcagattcataaacttcgtctaaaacttcgtaaaaagctaaaggcagaaaagaagaaattagctgctcttatgtcttccccgcaaagcagaacagttcgaagtgaaaatctagaacaggtgccccaggatgggtctccaaatgattgtgaatcaatagaggacttgttaaatgagctaccatatccaattgatattgccagtgagtctgcatgcaccactgttcctggtgtttccctgtacagtagtcaaactcatgaagaaattttagcggaattattgtctcctacacctgtttcaacagagctgtcagaaaatggggaaggtgactttaggtatttgggaatgggagatagtcatatcccaccaccagtaccaagtgaattcaatgatgtttcccagaacacacatctgagacaggaccataattattgtagccccaccaagaaaaatccatgtgaagttcagccagactctctgacaaataatgcctgcgttagaacattaaacttggagagtccgatgaagactgatattttcgatgagtttttttcctcctcagcattaaatgctttagcaaatgacacattagacctacctcatttcgatgaatatctgtttgagaattattgaattaatgcttgttaacttttttcatataatatttattattattagaagaacttacaatgtgttcaggtagtgtttatacactggacttgtgtaattacttgtgtaataaccatgaacaaaatgcaaggtttaacctttggttctgcccatgaagcatgtaatctttcttacacattaaaatcactgaatgtgt

SEQ ID NO: 8042 - DNA, 2864 bp, Homo sapiens
gcttcgcagcgtcacgccctccggggccgtggcggcgacggcggtgcgtagcttactcacaggggcggcccgtatccctccgccgccggcgcggctcggccctccctcccctggcccgccaatccccgcgcctcccgacctgcccctcggtcgggcccaccccgtgctccgacggccccaccccggcggcgcagcccgcccgcccgcgcgtccctcggtccacctgcagcagggaggaagacaggcaatccctccggctgtccgaccaagagaggccggccgagcccgaggcttgggcttttgctttctggcggagggatctgcggcggtttaggaggcggcgctgatcctgggaggaagaggcagctacggcggcggcggcggtggcggctagggcggcggcgaataaaggggccgccgccgggtgatgcggtgaccgctgcggcaggcccaggagctgagtgggccccggccctcagcccgtcccgccggacccgctttcctcaactctccatcttctcctgccgaccgagatcgccgaggcggcctcaggctccctagccccttccccgtcccttccccgcccccgtccccgccccgggggccgccgccacccgcctcccaccatggctctgaagagaatccacaagctccctccacaaaaccgcctgagctcgggctgacagaggaagccgttttgcccgatccacaagtatatcctgagttcacttacctcttgggtggcagcacacatcggtccaccctgcttgtccagaaactgttaagagttggaagttcagaagaaaaaaaaaaggaattgaatgatctggcacgggaccctccagcacagtgttcagcaggtcctgttggagatgatatgttccattggcaagctacaataatggggccaaatgacagtccctatcagggtggagtatttttcttgacaattcatttcccaacagattaccccttcaaaccacctaaggttgcatttacaacaagaatttatcatccaaatattaacagtaatggcagcatttgtcttgatattctacgatcacagtggtctccagcactaactatttcaaaagtactcttgtccatctgttctctgttgtgtgatcccaatccagatgatcctttagtgcctgagattgctcggatctacaaaacagatagagaaaagtacaacagaatagctcgggaatggactcagaagtatgcgatgtaattaaagaaattattggataacctctacaaataaagataggggaactctgaaagagaaagtccttttgatttccatttgactgctttctatgagcccacgcctcatcttcccctgtgcacatgtttacctgatacagcagtgctgcgtgttgtacatacttggaacaacaaactagaaatactgtacttctgtaccaacattgcctcctagcagagaagtgtgtgtgtgacaagccagttctacaggcattacctaggtgtgagactaaaagcttttcttattgacttaaatttggataacagcaaggtgtgaggggggtggtgggtatggtgtgtgcttggatgggaaagaaaaggctccactcacctataggagattatttttaagtggaatccatttaaactcaaaacagttatgaaaagcaaggtgaagaacatgaagctgtgtctgtattcattttattccgaaggagctacgtcttaggtgaaagttatgaccaaccagattaaactctacccacatcctgcattttaaggtctaagtttaactggtcaacatttaaatggattggagctattagtacatcaagtgtgatgggctttgttcccaactcttttacatctccctaccccttcaacctttggcctttcagcccttctttctctcttccatattctttggtttgtatgtggtttctcagttaatacatagctaatagctcttatttttcttatgtttttaaccgcttaggtctatttggatgtaagggtgaaaattcatttgatggaaatacttgtgtatatttaaagacccaattgctcctctggagcttgtactttcaagaatgattaatctgtgtaataaactggttactacagtcattacatataattttgtgtgaataggctttttcatttttaagaagtttgtctagctgagattagtggtggattttctcccacttctgaaatgttcatttatactggttgcattttaagatcatgaaacaattccagttacattgtaaaaaggatatcttacgagtaattttattgaacaagttagaggcataagcttaagagcatttccatgaaacaacacatgcagcattccaggaacttgattgttaaattcaataagaaatttgctttattaatgaaactaagctgcatttcatcaaaaccttgtgacattcccttggtacataggacataaaacacagaggcattgctatttggtaagttaagcttctgtgattgtaattataaaagagcaacattgaccaaacctgggaaacaagagcacagtcttgtttggagagtctacataattactttgcactaacatttgcaggatgttcacacaattttaaattgtactgtatgtggctttttgaagtcttcccttgaccctagtaaaatatagcttgaaacttgtaaacaactgtgtttgccagaaacatcattcatgtgaactaggcaagttaccttttttccccccttcttttcctaattgtaaactaggccaacctgaaagccatggctgatgctctagccatcaggttctttcaaatgcatctttacactcttgcacaaaagttaaggaataaatgtccactgcttttggtttt

SEQ ID NO: 8043 - DNA, 2702 bp, Homo sapiens
gcttcgcagcgtcacgccctccggggccgtggcggcgacggcggtgcgtagcttactcacaggggcggcccgtatccctccgccgccggcgcggctcggccctccctcccctggcccgccaatccccgcgcctcccgacctgcccctcggtcgggcccaccccgtgctccgacggccccaccccggcggcgcagcccgcccgcccgcgcgtccctcggtccacctgcagcagggaggaagacaggcaatccctccggctgtccgaccaagagaggccggccgagcccgaggcttgggcttttgctttctggcggagggatctgcggcggtttaggaggcggcgctgatcctgggaggaagaggcagctacggcggcggcggcggtggcggctagggcggcggcgaataaaggggccgccgccgggtgatgcggtgaccgctgcggcaggcccaggagctgagtgggccccggccctcagcccgtcccgccggacccgctttcctcaactctccatcttctcctgccgaccgagatcgccgaggcggcctcaggctccctagccccttccccgtcccttccccgcccccgtccccgccccgggggccgccgccacccgcctcccaccatggctctgaagagaatccacaaggaattgaatgatctggcacgggaccctccagcacagtgttcagcaggtcctgttggagatgatatgttccattggcaagctacaataatggggccaaatgacagtccctatcagggtggagtatttttcttgacaattcatttcccaacagattaccccttcaaaccacctaaggttgcatttacaacaagaatttatcatccaaatattaacagtaatggcagcatttgtcttgatattctacgatcacagtggtctccagcactaactatttcaaaagtactcttgtccatctgttctctgttgtgtgatcccaatccagatgatcctttagtgcctgagattgctcggatctacaaaacagatagagaaaagtacaacagaatagctcgggaatggactcagaagtatgcgatgtaattaaagaaattattggataacctctacaaataaagataggggaactctgaaagagaaagtccttttgatttccatttgactgctttctatgagcccacgcctcatcttcccctgtgcacatgtttacctgatacagcagtgctgcgtgttgtacatacttggaacaacaaactagaaatactgtacttctgtaccaacattgcctcctagcagagaagtgtgtgtgtgacaagccagttctacaggcattacctaggtgtgagactaaaagcttttcttattgacttaaatttggataacagcaaggtgtgaggggggtggtgggtatggtgtgtgcttggatgggaaagaaaaggctccactcacctataggagattatttttaagtggaatccatttaaactcaaaacagttatgaaaagcaaggtgaagaacatgaagctgtgtctgtattcattttattccgaaggagctacgtcttaggtgaaagttatgaccaaccagattaaactctacccacatcctgcattttaaggtctaagtttaactggtcaacatttaaatggattggagctattagtacatcaagtgtgatgggctttgttcccaactcttttacatctccctaccccttcaacctttggcctttcagcccttctttctctcttccatattctttggtttgtatgtggtttctcagttaatacatagctaatagctcttatttttcttatgtttttaaccgcttaggtctatttggatgtaagggtgaaaattcatttgatggaaatacttgtgtatatttaaagacccaattgctcctctggagcttgtactttcaagaatgattaatctgtgtaataaactggttactacagtcattacatataattttgtgtgaataggctttttcatttttaagaagtttgtctagctgagattagtggtggattttctcccacttctgaaatgttcatttatactggttgcattttaagatcatgaaacaattccagttacattgtaaaaaggatatcttacgagtaattttattgaacaagttagaggcataagcttaagagcatttccatgaaacaacacatgcagcattccaggaacttgattgttaaattcaataagaaatttgctttattaatgaaactaagctgcatttcatcaaaaccttgtgacattcccttggtacataggacataaaacacagaggcattgctatttggtaagttaagcttctgtgattgtaattataaaagagcaacattgaccaaacctgggaaacaagagcacagtcttgtttggagagtctacataattactttgcactaacatttgcaggatgttcacacaattttaaattgtactgtatgtggctttttgaagtcttcccttgaccctagtaaaatatagcttgaaacttgtaaacaactgtgtttgccagaaacatcattcatgtgaactaggcaagttaccttttttccccccttcttttcctaattgtaaactaggccaacctgaaagccatggctgatgctctagccatcaggttctttcaaatgcatctttacactcttgcacaaaagttaaggaataaatgtccactgcttttggttttaa

SEQ ID NO: 8044 - DNA, 901 bp, Homo sapiens
gccccttccccgtcccttccccgcccccgtccccgccccgggggccgccgccacccgcctcccaccatggctctgaagagaatccacaaggaattgaatgatctggcacgggaccctccagcacagtgttcagcaggtcctgttggagatgatatgttccattggcaagctacaataatggggccaaatgacagtccctatcagggtggagtatttttcttgacaattcatttcccaacagattaccccttcaaaccacctaaggttgcatttacaacaagaatttatcatccaaatattaacagtaatggcagcatttgtcttgatattctacgatcacagtggtctccagcactaactatttcaaaagtactcttgtccatctgttctctgttgtgtgatcccaatccagatgatcctttagtgcctgagattgctcggatctacaaaacagatagagaaaagtacaacagaatagctcgggaatggactcagaagtatgcgatgtaattaaagaaattattggataacctctacaaataaagataggggaactctgaaagagaaagtccttttgatttccatttgactgctttctatgagcccacgcctcatcttcccctgtgcacatgtttacctgatacagcagtgctgcgtgttgtacatacttggaacaacaaactagaaatactgtacttctgtaccaacattgcctcctagcagagaagtgtgtgtgtgacaagccagttctacaggcattacctaggtctatttggatgtaagggtgaaaattcatttgatggaaatacttgtgtatatttaaagacccaattgctcctctggagcttgtactttcaagaatgattaatctgtgtaataaactggttactacagtcattac

SEQ ID NO: 8045 - DNA, 1113 bp, Homo sapiens
agcgttcctccccggctgcccttccaggcccgcatggtgtggactcttagggcttctctccagtctgggactgccgctgcacttgagggccattgtcgggccaggatggcggggttggggccgaggggggcgctggggcgttgggcggccccttcgacagaggtcgaaagggcttctcgccccatttctgttccctcctcccacacctgccctagctccctccacaaaaccgcctgagctcgggctgacagaggaagccgttttgcccgatccacaagtatatcctgagttcacttacctcttgggtggcagcacacatcggtccaccctgcttgtccagaaactgttaagagttggaagttcagaagaaaaaaaaaaggaattgaatgatctggcacgggaccctccagcacagtgttcagcaggtcctgttggagatgatatgttccattggcaagctacaataatggggccaaatgacagtccctatcagggtggagtatttttcttgacaattcatttcccaacagattaccccttcaaaccacctaaggttgcatttacaacaagaatttatcatccaaatattaacagtaatggcagcatttgtcttgatattctacgatcacagtggtctccagcactaactatttcaaaagtactcttgtccatctgttctctgttgtgtgatcccaatccagatgatcctttagtgcctgagattgctcggatctacaaaacagatagagaaaagtacaacagaatagctcgggaatggactcagaagtatgcgatgtaattaaagaaattattggataacctctacaaataaagataggggaactctgaaagagaaagtccttttgatttccatttgactgctttctatgagcccacgcctcatcttcccctgtgcacatgtttacctgatacagcagtgctgcgtgttgtacatacttggaacaacaaactagaaatactgtacttctgtaccaacattgcctcctagcagagaagtgtgtgtgtgacaagccagttctacaggcattacctaggtgtgagactaaaagcttttcttattgacttaaatttggataacagcaaggtgtgagg

SEQ ID NO: 8046 - DNA, 1405 bp, Homo sapiens
cggcgtgcagcttggtggcggctgagccggcagcgggccgcctcaggcagccccggccgggccgcccgggtccccggcagcggggtaggatggcgctaaagcggatccagaaggaattaaccgacttgcagagggatcctcctgcccagtgttctgcaggacctgtcggtgatgacttgttccactggcaggccaccatcatgggcccgaatgacagtccttaccaaggaggtgttttcttcctgaccatccactttcctacagattacccgttcaagcccccaaaggttgctttcacaaccaaaatttatcaccctaatatcaacagcaatggcagcatctgccttgatatcctgcggtctcagtggtctccagcgttgactgtgtcaaaagttctcttgtccatctgctcgctgctctgcgaccccaaccccgatgaccccctggtgccagagatagcacacacctacaaggccgacagagagaagtacaacagactagcaagagagtggacacaaaaatatgctatgtaagtgccttggaggttttacatgagacactgtccaagagaagctggcagagaggtcttcccttaaaactttgggctgttggctgagccattcaaagagcatcatctgttcttcaaacaaatgttggtcacccactctctccagctgcagcatgttggtgccattttcagcaattacggctttgacagtgccacctctttgatgccaaatcagcaaccattgttgttatgatctgcagtcttcctggtgacactggaatctctctctctgccgcctcagtttgtctgctggtctcttggggggccaggccctgcacgtctctcctacccggcctcaaatggtgctgctgcccatgatggtaccacaccagggcctcagcctggcccctcaccacataccctttgccttttagaactcagtgccatcctgggtgcccagggcagagcaggctttgttcgcacctcatctgctgcagaaccacatcctgaggagtctcagcttatcctggagggaattgggaacagtgtcactgggaagtgaaggcctagccctgtggcttccaccagtctcctcctgcagtgccacgtggtggcatttctcgcctcacaccaagaagcagcaagtggaaaatttcaggatacaaagcacataacaccccataagagatgattatgtttttagaagcaagagcaaaattatgaaacctctagagatttgggtcatgttactccatttgatgaagattctcactaccgcccgctcctcccataggagcctacactaagtccaagtgtgagccattcacagactagaacacaaggagggagagagactcttaaacgtaaataaaaatgcaattcactcacaactctaaa

SEQ ID NO: 8047 - DNA, 1296 bp, Homo sapiens
cggcagcggggtaggatggcgctaaagcggatccagaaggaattaaccgacttgcagagggatcctcctgcccagtgttctgcaggacctgtcggtgatgactaatgacagtccttaccaaggaggtgttttcttcctgaccatccactttcctacagattacccgttcaagcccccaaaggttgctttcacaaccaaaatttatcaccctaatatcaacagcaatggcagcatctgccttgatatcctgcggtctcagtggtctccagcgttgactgtgtcaaaagttctcttgtccatctgctcgctgctctgcgaccccaaccccgatgaccccctggtgccagagatagcacacacctacaaggccgacagagagaagtacaacagactagcaagagagtggacacaaaaatatgctatgtaagtgccttggaggttttacatgagacactgtccaagagaagctggcagagaggtcttcccttaaaactttgggctgttggctgagccattcaaagagcatcatctgttcttcaaacaaatgttggtcacccactctctccagctgcagcatgttggtgccattttcagcaattacggctttgacagtgccacctctttgatgccaaatcagcaaccattgttgttatgatctgcagtcttcctggtgacactggaatctctctctctgccgcctcagtttgtctgctggtctcttggggggccaggccctgcacgtctctcctacccggcctcaaatggtgctgctgcccatgatggtaccacaccagggcctcagcctggcccctcaccacataccctttgccttttagaactcagtgccatcctgggtgcccagggcagagcaggctttgttcgcacctcatctgctgcagaaccacatcctgaggagtctcagcttatcctggagggaattgggaacagtgtcactgggaagtgaaggcctagccctgtggcttccaccagtctcctcctgcagtgccacgtggtggcatttctcgcctcacaccaagaagcagcaagtggaaaatttcaggatacaaagcacataacaccccataagagatgattatgtttttagaagcaagagcaaaattatgaaacctctagagatttgggtcatgttactccatttgatgaagattctcactaccgcccgctcctcccataggagcctacactaagtccaagtgtgagccattcacagactagaacacaaggagggagagagactcttaaacgtaaataaaaatgcaattcactcacaactct

SEQ ID NO: 8048 - DNA, 2009 bp, Homo sapiens
aaagcgcccgctgctgtctcggctgccgcgggcgagagcggccgagtccccgccccgccacttccggtcccgccgccgggagccggtgcggctgtgaggggccgcgtctcgcagcagccgcccggaccgggcatggtgttgggcgccgggcccgcctcgcctgtctcggggagcccagggtaaaggcagcagtaatgctaacgctagcaagtaaactgaagcgtgacgatggtctcaaagggtcccggacggcagccacagcgtccgactcgactcggagggtttctgtgagagacaaattgcttgttaaagaggttgcagaacttgaagctaatttaccttgtacatgtaaagtgcattttcctgatccaaacaagcttcattgttttcagctaacagtaaccccagatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgagtttattgagagaacattcaattgatggcactggctgggctcccacaagaacattaaaggatgtcgtttggggattaaactctttgtttactgatcttttgaattttgatgatccactgaatattgaagctgcagaacatcatttgcgggacaaggaggacttccggaataaagtggatgactacatcaaacgttatgccagatgataaaaggggacgattgcaggcccatggactgtgttacagtttgtctctaacatgaaacagcaagaggtagccccctctcccgtcctcatgctccctctcagtcccctggattgccccagtcctgtgaccatgttgccctgaagaagaccatcttcatgactgctcattgtagatggagaattcaacataaatacagcaagaaaatgtgtttgggcttctgaagagttgtctgcttaccttaacatgtttacttttttgaacttgtactgtataggctgttggtgaaattcttaagaagttgtaatgaactcaaaattgaggccagagcttgctttcccttttcccaaacaaaattggttttctgcacaagcgatgctaatgatgtgttcagtgtaactcgcagattggcaataagatacccgctacaaactgtgattggatgcaaaatctcttagcttctttcacgaatgttggccctgcctagatgttgtgaagcctcccagaatgcatagagtcattcactgtagatctcttattgaaatgcgtattttatttaatgtaagtatattttggaacagatttgtaatttgtacaattcaatgctttaattattttttctattctcatttagtttgtattttcattgtatagagcagacagaaagatgttgggtcaagcaactattgaagagaaatacaaagaaaatatgaaaggcacattattcattttgtccaaatgcaatgagaatctcactcttaaaaatcagctcttgctttcgggtccggatgtggtgagcacattttggagccctttgaagctagatttggatgatcaaaacaaaaaggcagggagcccattctaacatgctgcccagaggaaactggctggagcctggaccagctggggttgatgcttttgcagtggtcatgtgattgtgacctggtagctacttatcagagagccagaccctgctgtcctgggagacaggagcgatgcctcaggaatcagcccaatgtctgatgtcactgagactgtacctgtggccttcttctgagtttgctatggctccaggccctgccggtggggtgagcctcctaggccttggaggaccaggagtcaacagtggcatatgccatcctcggccaggttaatatactgcagaggaaaagccctgaagagaggcaagtggatttactccagcatgtagacatttgaaccagtgaaatcaaacacaaaataaatgtctgtctagtttca

SEQ ID NO: 8049 - DNA, 1555 bp, Homo sapiens
gagccggtgcggctgtgaggggccgcgtctcgcagcagccgcccggaccgggcatggtgttgggcgccgggcccgcctcgcctgtctcggggagcccagggtaaaggcagcagtaatgctaacgctagcaagtaaactgaagcgtgacgatggtctcaaagggtcccggacggcagccacagcgtccgactcgactcggagggtttctgtgagagacaaattgcttgttaaagatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgagtttattgagagaacattcaattgatggcactggctgggctcccacaagaacattaaaggatgtcgtttggggattaaactctttgtttactgatcttttgaattttgatgatccactgaatattgaagctgcagaacatcatttgcgggacaaggaggacttccggaataaagtggatgactacatcaaacgttatgccagatgataaaaggggacgattgcaggcccatggactgtgttacagtttgtctctaacatgaaacagcaagaggtagccccctctcccgtcctcatgctccctctcagtcccctggattgccccagtcctgtgaccatgttgccctgaagaagaccatcttcatgactgctcattgtagatggagaattcaacataaatacagcaagaaaatgtgtttgggcttctgaagagttgtctgcttaccttaacatgtttacttttttgaacttgtactgtataggctgttggtgaaattcttaagaagttgtaatgaactcaaaattgaggccagagcttgctttcccttttcccaaacaaaattggttttctgcacaagcgatgctaatgatgtgttcagtgtaactcgcagattggcaataagatacccgctacaaactgtgattggatgcaaaatctcttagcttctttcacgaatgttggccctgcctagatgttgtgaagcctcccagaatgcatagagtcattcactgtagatctcttattgaaatgcgtattttatttaatgtaagtatattttggaacagatttgtaatttgtacaattcaatgctttaattattttttctattctcatttagtttgtattttcattgtatagagcagacagaaagatgttgggtcaagcaactattgaagagaaatacaaagaaaatatgaaaggcacattattcattttgtccaaatgcaatgagaatctcactcttaaaaatcagctcttgctttcgggtccggatgtggtgagcacattttggagccctttgaagctagatttggatgatcaaaacaaaaaggcagggagcccattctaacatgctgcccagaggaaactggctggagcctggaccagctggggttgatgcttttgcagtggtcatgtgattgtgacctggtagctacttatcagagagccagaccctgctgtcct

SEQ ID NO: 8050 - DNA, 648 bp, Homo sapiens
gttaccgaaatgctgccttagagcgtaatttgcaggaaagaggaagttttgttttaaaccagatcttcaagagttgaagcatattgaagaaggaaaagaattctgaagcaactgcagggtaaaggcagcagtaatgctaacgctagcaagtaaactgaagcgtgacgatggtctcaaagggtcccggacggcagccacagcgtccgactcgactcggagggtttctgtgagagacaaattgcttgttaaagaggttgcagaacttgaagctaatttaccttgtacatgtaaagtgcattttcctgatccaaacaagcttcattgttttcagctaacagtaaccccagatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgagtttattgagagaacattcaattgatggcactggctgggctcccacaagaacattaaaggatgtcgtttggggattaaactctttgtttactgatcttttgaattttgatgatccactgaatattgaagctgcagaacatcatttgcgggacaaggaggactt

SEQ ID NO: 8051 - DNA, 4208 bp, Homo sapiens
gtctcagcgcgcctgcgccgagcggccctgcgcgcagtgaggcagtggcgggggaaggcaccggtggggccgacgggcgggttgaaggagggaagcgggcgagcgaagtcccagtgcgcgccgcggcagcccgggcaccctccccttccgggcgtgagtcgctgtgaaaagagctgaagcgagcggactcgcaccggcagcgaggcgccgctcccgccgcctcagcccggccttcctcggctccggcgctccggtcgcggggcccgggttcctcggcacaccccgctccagccgcccccagagcctgtccccagcccttcggaagccccggcgccagcccgggccctcggcagggaggatgacggagctgcagtcggcactgctactgcgaagacagctggcagaactcaacaaaaatccagtggaaggcttttctgcaggtttaatagatgacaatgatctctaccgatgggaagtccttattattggccctccagatacactttatgaaggtggtgtttttaaggctcatcttactttcccaaaagattatcccctccgacctcctaaaatgaaattcattacagaaatctggcacccaaatgttgataaaaatggtgatgtgtgcatttctattcttcatgagcctggggaagataagtatggttatgaaaagccagaggaacgctggctccctatccacactgtggaaaccatcatgattagtgtcatttctatgctggcagaccctaatggagactcacctgctaatgttgatgctgcgaaagaatggagggaagatagaaatggagaatttaaaagaaaagttgcccgctgtgtaagaaaaagccaagagactgcttttgagtgacatttatttagcagctagtaacttcacttatttcagggtctccaattgagaaacatggcactgtttttcctgcactctacccacctattgctggacttctgttgtacaagttggcaaacactggctggaactgggctgcaataaaacatgccagttatcaatgctgacaagagcctaacaagtgccaacttacagatgattacgcattttgaattctaatgaactgttttaaccttcaggaagaattgtaaagacctgtacatagcacaacatgatccggataatatatatactgttcatgtacatccacaaatacaccttgtaccaaataatgctttcttgtagtagaataagaatcgtgtaaattctaagagattttagcaggttttctttcctattcattgtttcttatcagtttaaaaggattcctttaagcatgtcagatgaaaagcaattaggattaaaagtttccatttaatttcccttaaacccttgaggcttcattaaactcttttcacttactaaacttttgtatcttctttgttttgacacactcccctttgcttttatctcttacctgccagaatgttctcaaatgatttagttcaaatactgaaatacttaatgagcaattacttgatttttaatgatgacttcgaaggagtcatcactaggtgctttgtcctttttgtattctagttgcacccacctcttggattggatatagcaataacatttattggccgttgtgagctcttgatcccagtcattacccctgagaactaaaaatagatggttcttaattcaacttactgaaaatttccccaaacaatagcaaatctgacttttccctcttcagttgcctggtattaaggttggataaatgaagcatgcacagctacaggctttctacttaacttctgggtttgctattacaaatcctatttactctcatacccttctccttagtccttcatatttctctgcctctattcttctatactgcagatttttctcacctattgtacaaagaaattgcgatgtatattttcatgtaatttgattttggaattctgtcaccttatgtagtgagttcttccaaaatataattttttttcaataattgtcaagttgttggcttttattgtattgaatgaaggctataatactgagtgccagagaagtggtttaggaaaatctcaggttgattccttatgcaaatgaacttttaatacttgaaaatcacatggccatggcagtatatgtatttggttctatctagattcttctgtgaatctaaaagcattacaggggtaaatgctttgctatttgacgtatagatcccgtcactaacaatagtacacttggatgtgattaatgtttgagcttcaatatatttcatatcatacagttttctaaaacaacttcagcaaatggtaaaatgaacatgtgcagtgttaaaggcaggccttaggctccttcatgtttgttgtgaggttgtgtgtgggaagtagtctttggcttataagggatagaacttgagacagtagcagatgggacatggtgtttgattgtgagaatcagtgagaattcgtgcatctctgctctgtggggtttggagaaatgctttggcagaagagtgaaagaactcctgccaagagcccagacctctacaaacgttgtatgtccttttttaagcagaaataaaatggttgaggatgtagtcacagtagagagtgatttttttctaagtccctgtcctctactctgaagcgttataaaaacctgtaaacattatacaaacccacaaaccttatagaaactcgtaagtgtgttgtgactggaaattgattcattagaacccagttttctttaagaactttgtgacttggttttttttttccttttccaaagactgtaaaaatagttgccccaaaatgtcagcactgcacaccctccagggacttggaatacaatcctttttacttttttttttttttttttaagaaactgggtctctctgtcacccaggctggagtgcagtggcaacgatcatagctaactgcagctttgacctcctgggctcaagtgatcctcctgcctcagcctcctgagtagctaggactacaggtgtatgccaccatgcctggctaatacaaaaaaattcttttaagagatgggatccctcccttttaaaatcagaacttgttcacatggtggttgcttgtggcaaaacggagttcaaattttgctctcctattgctataattctgctagcaatctgttgaggtgaaacttgggatctgactcttcagcaagcagcaaatgacctagtaactcagggacaactatttttgaactttaagtgccactttaatgcagttagtttgataaaaccatgtgggttttttttttagggctagctctacgggagtggaagtgagagccaggcatgagtgcgtctccacatgcttttccacctgccctgagtgtgttacatactgaaacaggcctacatagatgttacaacttcccttcctctgtcggagatgtcatctgtgcctttctcagtgttcatctgataatgtaaatttaaatgcctctacatttgatacgaaacccacattcaggtgacactgaacgaggtggcttttgtcccaccagtgcctcatcagtgtgaggcgattcctctctgctttaggaaaatgatttttccccctaaacttgtgccaaccatcaacaacatctccatagatcttatggattgtagaactgttggctgtttcctaaatttattccaagttctcgtagaggcatatagatttcagtctgtgcttgtatgggatagatgatctgagtggctttctggcctcttttttgagtttaaaatccatatgaggttgacgtgtcatactaaggtaacatgtttgtgaggttattccactagtactgtgatcacgtgggtgtcagtatctttaacggccttcattcttggttgtgagattttatttgatatgcccactcaccctcgacgaatctgcccgctttgggctgtggtgcctgtgtatctttgcccgtctggtctccagttggtggaattaccttttttgtactgccacttctcagcatctttgaaatttgacataatgttgcttcatttcagtttttttagttctgtaatttgttgattgtatttaactatgtgagttctgttgtgatgtttactgtattgtaaagcacctcattcatgtgatgagtgctctataaatcaataaatgatgacttagaggctgtatcacgagctattttggttttaggatgcaggtctcaaaagcaa

SEQ ID NO: 8052 - DNA, 1523 bp, Homo sapiens
aggcgcacaacgcaggccgggcgggaagagccaaagcgggcaggcggcggaaatatccgaagcggcggggcgcccgaggccgttgccgacctccgcgctaaagccgctgctgccgcggaagacgatcctccagtacccgcccgccgtcaccgcagctgccgtgtcctcctcccacccctagccgcaccccctcgcggagggatcagctgagcggccaaacggcacggtcgggggagccccgagtccgcagctgcagcggggcctgagaccagagttggcgagggcaaggaaggagcggccccgggcagtgggggcggggccgggcgggcccgagaacagccgaatttggccgagcgctgccgagcgagtccgaggcgctgggccaggccggagccggactacgggagccgaggcgggccgcgcggtgggcgcggagaggagcggagcggcgcggcaggccgggcgggtggcggcagcagcggaggaggccgcagctgcgggtccgaggagcggaggcgacgcgggcggcggcggggggccgggtggccggggtcccgggccccgcggcggcggcagcggcggcggcggcggcaggatgatcaagctgttctcgctgaagcagcagaagaaggaggaggagtcggcgggcggcaccaagggcagcagcaagaaggcgtcggcggcgcagctgcggatccagaaggacataaacgagctgaacctgcccaagacgtgtgatatcagcttctcagatccagacgacctcctcaacttcaagctggtcatctgtcctgatgagggcttctacaagagtgggaagtttgtgttcagttttaaggtgggccagggttacccgcatgatccccccaaggtgaagtgtgagacaatggtctatcaccccaacattgacctcgagggcaacgtctgcctcaacatcctcagagaggactggaagccagtccttacgataaactccataatttatggcctgcagtatctcttcttggagcccaaccccgaggacccactgaacaaggaggccgcagaggtcctgcagaacaaccggcggctgtttgagcagaacgtgcagcgctccatgcggggtggctacatcggctccacctactttgagcgctgcctgaaatagggttggcgcatacccacccccgccacggccacaagccctggcatcccctgcaaatatttattgggggccatgggtaggggtttggggggcggccggtgggggaatcccctgccttggccttgcctccccttcctgccacgtgcccctagttatttttttttttttaacaccatgtgattaaggtcggcgctgcctcccccgacccactcagcgatgggaaatgaattggcttgtctagcccccctgctgggtgcttgttcagcccccactctgggctgtggagtgggtgggcaacgggcctgggtagctgggcccaggcaacccacccctccacctctggaggtcccaccaggctattaaaggggaatgttactgc

SEQ ID NO: 8053 - DNA, 5354 bp, Homo sapiens
cgcctccccgcgcctcgttcgccgccgctgtcgccgccgccgcccgagactcgcgcagagcagttatggcggatcccgcagcccccacgcccgcagctcccgctccagcccaggccccggctccagccccggaggcagtcccggccccagccgcagcccccgtcccggcgccggcgcccgcctcggactcggcctccgggccgtcctcggactccggcccagaagccggctcgcagcgcctgctgttttctcacgacctggtgtcgggccgttaccgtggctccgtgcacttcgggctggtgcgcctcatccacggcgaggactcggactcggagggcgaggaggagggccgcgggagctcggggtgctccgaggccgggggcgcgggccacgaggagggccgggccagccccctgcgccgcggctacgtgcgcgtccagtggtacccggagggcgtcaagcagcatgtgaaggagaccaagctgaaactagaggaccgttctgtggtgccccgagatgtggtccggcacatgcgatccaccgacagtcagtgtggcacggtgatcgacgtcaacatcgactgtgccgtcaagctcatcggcaccaactgcatcatctatcccgtcaacagcaaggacctgcagcacatctggcccttcatgtatggggactacattgcctatgactgctggctggggaaggtctacgacttgaagaaccagatcatcctgaagctatccaacggcgccaggtgctccatgaacacggaagatggcgccaagctctacgacgtctgcccgcacgtcagcgactcgggtctcttcttcgatgattcctatggcttctacccaggccaggtgctcattggccctgccaagatcttctccagcgtccagtggctgtcaggtgtcaagcccgtgctcagcaccaagagcaagttccgagtggtggtggaagaggtgcaggttgtagagttgaaagttacatggattaccaagagtttctgtccagggggcacggacagcgtcagccccccaccctctgtcatcacccaggaaaacctaggcagggtgaagcgtctcggatgctttgaccatgctcagcggcagcttggggagcgctgtctgtatgtcttcccagccaaggtagagccagccaagattgcctgggaatgtccagaaaaaaactgcgcccagggggagggctctatggccaagaaggtgaagcgcctgttgaagaagcaggttgtgcggatcatgtcatgctccccagacacccagtgttcccgggaccattccatggaagacccagacaagaagggggaatccaaaaccaagagcgaagcggagtctgccagccctgaggagacgcccgatggctctgccagtccagtggagatgcaggacgagggtgcagaggagccccacgaggcaggagagcagctgcccccattcctgctaaaagaaggcagagatgacaggctgcactcggcagagcaggacgcagatgatgaggctgctgatgacacggacgacaccagttcggtgacctcctctgccagctccaccacttcctcccagagcggcagcggcacgagtcgcaaaaagagcatccccttgtccatcaagaacttaaagcgcaaacacaagaggaagaagaataaaatcactcgagacttcaagccaggggacagggtggcagtggaggtggtgaccacgatgacctcagccgacgtgatgtggcaggatggctccgtggaatgcaacatccgctccaacgacctcttccctgtgcaccacctggacaacaacgagttctgccctggagacttcgtggtagataagcgagtccagagctgtccagaccctgctgtctacggtgtggtacagtctggggaccacatcggccgtacctgcatggtgaagtggttcaagctgaggccgagtggggacgacgtggagctgattggagaagaggaagatgtgagtgtttacgacattgctgaccaccctgactttaggttccgtacaactgacatcgtcatccgcatcggcaatactgaggatggggctcctcacaaggaggatgagccatcggtgggccaggtggcccgtgtggacgtcagcagcaaggtggaggtggtgtgggctgacaactcaaagaccatcatcctgccccagcacttgtacaacatagagtctgagattgaggagtcagactacgattcggtagaaggcagcaccagcggggcatcctcggatgaatgggaagatgatagtgacagctgggagacggacaatgggctggtggaggacgagcaccccaagatagaggagccccccatcccacccctggagcagccggtggcccctgaggacaagggagtggtgatcagtgaagaggcagccacagctgccgtccagggggctgtggccatggctgcccccatggccgggctgatggagaaggctggcaaggacgggccacccaagagcttccgggagttgaaagaggccatcaagatcctggagagcctcaagaacatgactgtggagcagctgctgacgggctcgcccacctctccgactgtggagcctgagaagccaactcgggagaagaagtttctggatgacatcaagaagctacaggaaaacctcaagaagaccctggacaatgtggccattgtagaggaggagaagatggaagcagtgcccgacgtagagcgcaaggaggacaagcccgaggggcagtcacctgtgaaggctgagtggcccagcgaaaccccggtgctgtgccagcagtgtggcggcaagcctggcgtcaccttcaccagcgccaagggcgaggtcttctccgtactggagtttgcaccctcaaatcattcttttaagaaaattgagttccagcctccagaagccaagaagttcttcagcacagtgcggaaggagatggcgctgctggctacctcactgcctgagggcatcatggtcaagacttttgaagatagaatggacctcttctcagctctcatcaagggccccactcgaaccccctacgaggatggcctctacttgtttgacatccagctccccaacatctacccagccgtgcccccccacttctgctacctctcccaatgcagtggccgcctgaaccccaacctgtatgacaatgggaaggtgtgtgtcagcctcctgggcacctggattggaaaggggacagagaggtggacaagcaagtccagccttctccaggtgctcatctccatccaaggtctgatcctggtaaatgaaccatactacaacgaagccggcttcgacagtgaccgaggcctgcaggaaggctatgaaaacagtcgctgttacaatgagatggcgctgatccgcgtggtgcagtccatgacccagctggtgcggcggccccccgaggtctttgagcaggagatcaggcaacactttagcactggtggctggcggctggtgaaccgtatcgagtcctggctggaaacccatgccctgctggagaaggcccaggcactgcccaacggggtgcccaaggccagcagctcgccagagcccccagctgtagccgagctgtcagactccggccaacaagaacctgaggatggagggccagccccaggagaggcctcccagggctcagactcagagggcggtgcccagggcctggcctcagctagcagggaccacacagaccagacttcggagaccgcaccagacgcatcggtgccacccagtgtgaaaccaaagaagcggagaaagagctaccggagcttcttacctgagaagagtggctaccctgacatcggcttccccctcttcccactttccaagggtttcatcaagagcatccggggtgtcctgacgcagttccgggctgccctgctagaggcaggcatgccggagtgcacagaggacaagtagctgccaggcacagaggaaagagcatcaccgtgggagaggccagccgccgcctgctcactcccccccggaatcacccctcttcccatgcccctctgtccccactgcaaacccactgccctcttctccccaaggtgagtttgatgctgaagtgcaagaagtgtgttgagatgctgccgtttctattttgaagcgagctttcaacaggcgggtcccctgtggcaaagaaaatcggaaccctgttgccgattttccatttgtcaccccagcagaatgtccggcacttgctcccttgctgccccttctcaggtcagaggcgggtgttccagggcctgccgcggggctctctgggccggttccctgcagacccgcaggagagcacatgtgccttgcatgaagtgtgggttgcgccaacaattcccctggtccctttcaacctgtttagttcaactcaagcctccctgtgtcccagaccctcctgctgccaccaccacccaggtcctccctagtcctccagcgtcaacactatcccttgggagttgtagctgctgtcactgactcccggctatacatggcctgtcgaccacgttatagccctcaggcctgttgaacttgctctctaagagaggttgggaccaggctaggttccgggtgacgcccaggagaggtggtggccttcacacatgcacatggagttgaggaccagggagctgcagggaaagcaacagctataggtgccttgctcttctgtcggaggctgctgggggcaagagcagctgcacaaggccagggcaagtgctagggcccctcccccatcacatggtcacactgggacaggcgtgcagctcactgaactccaagcgagccagccctctcttggactagaaggcctactgtcagcccttcgcttacaaactgcaggctcaatccgaaggggacggccggcgggggctctcctagtgcccagagacaggcccagaggtttacaagttttctaagcttttgataatgtgaagctccaggccgagaggatgctgttgagcacattgcagctatgtaatttttggtgtatgtatgtaatatttaaggttggaaaaaaaactcaaaagcaaagatattaactcttattagaaaaaaagacaaaaaaaaagccaaagcatgatgcgtcttgtcagccttaagtgggctccacacctgtgctgtgctgtgaccgcccagccagcagagctgcgggaggatggagccggaccacacaccgtggcatttggaaccgagtcggtatcttgtttgagaaacacccggagtgactggtggggctgtgcttcccagtgcattgtacatgtggagatgtgaatgcctactgcttacgatatctgtataaagtgctgtgtgattaaacttttttttacttgc

SEQ ID NO: 8054 - DNA, 3210 bp, Homo sapiens
gcggcggcggcggcggcggagcccggagcgcaggccggaggctcccggcccgccggccccggagcggagcggagcggaggatgcagcagccgcagccgcaggggcagcagcagccggggccggggcagcagctggggggccagggggcggcgccgggggccgggggcggcccaggggggggcccggggccggggccctgcctgaggcgagagctgaagctgctcgagtccatcttccaccgcggccacgagcgcttccgcattgccagcgcctgcctggacgagctgagctgcgagttcctgctggctggggccggaggggccggggcgggggccgcgcccggaccgcatctccccccacgggggtcggtgcctggggatcctgtccgcatccactgcaacatcacggagtcataccctgctgtgccccccatctggtcggtggagtctgatgaccctaacttggctgctgtcttggagaggctggtggacataaagaaagggaatactctgctattgcagcatctgaagaggatcatctccgacctgtgtaaactctataacctccctcagcatccagatgtggagatgctggatcaacccttgccagcagagcagtgcacacaggaagacgtgtcttcagaagatgaagatgaggagatgcctgaggacacagaagacttagatcactatgaaatgaaagaggaagagccagctgagggcaagaaatctgaagatgatggcattggaaaagaaaacttggccatcctagagaaaattaaaaagaaccagaggcaagattacttaaatggtgcagtgtctggctcggtgcaggccactgaccggctgatgaaggagctcagggatatataccgatcacagagtttcaaaggcggaaactatgcagtcgaactcgtgaatgacagtctgtatgattggaatgtcaaactcctcaaagttgaccaggacagcgctttgcacaacgatctccagatcctcaaagagaaagaaggagccgacttcattctacttaacttttcctttaaagataactttccctttgacccaccatttgtcagggttgtgtctccagtcctctctggagggtatgttctgggcggaggggccatctgcatggaacttctcaccaaacagggctggagcagtgcctactccatagagtcagtgatcatgcagatcagtgccacactggtgaaggggaaagcacgagtgcagtttggagccaacaaatctcaatacagtctgacaagagcacagcagtcctacaagtccttggtgcagatccacgaaaaaaacggctggtacacacccccaaaagaagacggctaaccctggagtatcacccttcctccctccccaggcaccactggaccaattacctttgaatgctgtatttggatctcacgctgcctctgtggttccctccctcatttttcctggacgtgatagctctgcctattgcaggacaatgatggctattctaaacgctaaggaaaaaaaacaaacacagaactgtttcaagtactcaagactgacttacagaccaaccaaccaccttgctggaacccttgctagcaggcattcttataaaagaaactttcgagcctccttatattgctggaaactcagctgtgctccagactagagcctccttacctatgctatggatttttaatttattttctcttatttcatgtacactgctttttttggttacagtgtatgatggatgtgtatgaaaaaaatgtatctttgggaaaacaattacagtttgttaatttgaagatgctggtcttgactcatctttatttttattcgcacatcccaccccatcccctgaactacttgggaggtggggaggggtacgagtccactgttgctttggtagagatgagaggccgcattttgctgctaaagcaagagaaacttggagctgaagcacacacctggtctgcccctagatttctcctcaaggcctctggagcaaccagcacttgcccccttggaatgcagagcctggcctgccaaactacaatgtggtaggctgaaacgatggtgttaattcttaggactacttttctagtcacagatgttttcaaatttctaagaaaaagaaaatgaggctcaagaggctgcttcgtagaattccttttgaatgaattgagtggggatggggacacagtctccaagtgtgtatgtggtcttttctgatctcagctgtgtggctgcaactcttcgctgttcattggttcctctcctggaaagtggcttctaaccagcactggatggtgatcattggtaagctttgctcacctccctctctcttgcttcatttggctttatcaaaaagaacagacctagctctgaatttgtttggcttgggaaattatggattctttcaagccactcccacaaggtgggtcctactagaaagggttagcattttaaggggggttgttctatacacctgtgtccttaccccaggctcaggaactgccagggagggaagatgaggtggggagtctgtactgagatggaactgtcagtgctgtgttgtatgtacttgctgttgtaaaagtttgggcatgactttgcatctagcgggtgctgcctgcatctctttgtctgtaagcttgctctgggactcagcctcttaggacctacgatgccagcagctctcattaacagtgaaatgacagaggccaaagatggccaagtgaagacccaagtctcagaaaacccagacttgggacaactgcctgggaactaggatgctagagcagttctgtaatgctttgagacacagcaattttcacattggccattctttcccctcccctaccccttttcttttgagggacttttaatgtttgctgctttaggtggatggagagtccaccagtcccactcaatgctgctctaactctacccacacccacctaattaggggtgctaataaaacatgctgaggttgagataaagacgggacataaggggaaaattcattccatagagctgaaatctggttttcaaggcctctgtggctttcttctgaacttaccaccagccctggctggaatgtagattgtgtttttagtaatgtgtactgtgagctgtcttctgtataatgtattttgtaatgtatttttctcatctaccaaaggatgaaacaaataaaattatttaaata

SEQ ID NO: 8055 - DNA, 4317 bp, Homo sapiens
gcagcagcagcagcaccccgggggcgcgggcgacgccagcccgggacccggcaagggaaagggcaagcgcgcggcggagctggccccgcgcgacaaggcgccggcggctgcggcggcggcggcggcggctgcggcgggggccgggggcccccgcgagagggcagcgggcgccagggcggggccgggcccggcggtggcggcggcggcgggcggcagcctggtccccgcggcgcgccagcaacactgcacgcaggtgcgcagccggcggctcatgaaggagctgcaggacatcgcgcgccttagcgaccgcttcatctccgtggagctggtggacgagagcctgttcgactggaacgtgaagctgcaccaggtggacaaggactcggtgctgtggcaggacatgaaggagaccaacaccgagttcatcctgctcaacctcaccttccccgacaacttccccttctcgccgcccttcatgcgggtgctcagcccgcgcctggagaacggctacgtgctggacggcggcgccatctgcatggagctgctcacgccgcgcggctggtccagcgcctacaccgtggaggccgtcatgcgccagttcgcagccagcctggtcaagggccagggacggatctgtagaaaagctggcaaatcaaaaaagtccttcagtcgcaaggaagctgaagctacctttaagagtttggtgaagacgcatgaaaaatatggttgggtcaccccgcccgtgtccgacggctgatgtctgccacgtgcagtagacgctcgagcgcctgtccacacacacaccagtaccctgacatctcctcaatgctgtgcatcctccacccgtttttactccagccagaactgcatcctgaatgcccaggagacgtttaagttatttatgaaaagatgtgtgtacagagaggaagagggagcaaatgccgttcggattatgtttcgattataaatgaatgatcacctcgaagtcactttagaacacatgttgagatggtgacatttcccagcctgcctgcccctctgcccaccccggtcacattgccctgagcttctttccatgacagcagctccgacgagccggcaggaaactcaatgcccctgctggctccatttccatgtaaatggcgccgttcatatttcacagggacgccgtgcatctccgccgtgcgtccccggcacgtgtttgctgtgctctgtatctctgtttttcttcctggaaggtcaacataacttgaaaatgtgtctttctgtggcccatggtccgctgtgatgacatttagacctcatttgtgctatgacctttggctcatgaaaacacaaatttaacattgccaggttctagtgatttaaaaccacaactgcccacttggtgaaaacgtgctctcgatgctgatttgtggtgtgctgctgtccacagataaaccagtgccattagatggaaggcagaggatactgcgaccacccctggcagacggtggcgtagacaccaggtgcgccctctggggctcagagcaacggatggtcagctgcgaacagtctcgtccgatgttaggaaatggtcctacggccgcgcctttgtgttcctgtcttctctccaccaccaaaagcaaaagatgatttcccattcactgcagtcatctgactcattttaatatctgtgctagtgacaatgaatgtcagaactgccaaaggataccaagtgatcatacgatgatttgcatgatcgggtctatttcacccaatagtcacttgtgtgtcccccgaaattgggatgggtgagcacccttgctgtggtgtaaacttcctgttatttaatctcccccacggtttcatttttctcttctgttaatacttagaactttctaagaaactccatgaaatgaggaaatactgtttctaataatatgaggaaagaagtaaaaatgttcattccaagtggcaagtcttattggacacattttaaataaaatcatgcatacctgatacactgcctcaaggatccagtcattgtgggctatccttccatttaaaatatttcagatattcttaaattttttaaatattgcaaatactacaacatgtaattccagagcagcgttctaagtcaggtaccagaaatgagtcttaggaacccatagtctttgcaaaaattcagtagattgaaatagtccccagaagcagccaaggagctgaagggatgattcgatcaagttcagatgttgccaattgtatcttactgctgtgaaggaggaaaagtcttccgggataatgtattcaattcttcaggcagttttgtctacttggggacctgcccattggttcaaggttttcagagatccaagaggccttgcctcaaagaacaaggattggcgcctttcagcagggctgcccattcaccaaacttattgttacttttgtttttctttaccactttcttatttgcccccaagtgcacacaggcagctctgccagaccaaaatgacagtgtattaagaatgcagggcctgctcagcttccctgtgagtcataatagtcgtgaaacttgatgacagtgaacttacgatgttcattcatccaaccctctatggtggcattctccatcctggaaacctgacatttggctgacggtctttggaccctggagctagtggtcatcatggaattacactgtggagatgaaagacctaggacagaaacatcttgctagggaaagcacctgagtttattcctttctaaatattttcctcttctaatgaaaactaaaagcagctttactttagggggaaaaatatatccaaaggcaggtcatttcagtagtgtttattagctgattgaaaaacaggttcacggtgctctctgagaactgcaccaaggggtgcagccaagagactggtctgaccccgggttgggctgggtggcagccggcgacagagcagagagacactcagctcagtgtcgctccttccatacactcagagtttgatttttcttgcatggcatttccattaggtttgttagaaacttatagaagaaatcaattctttagtgaacgaaataccatttttcactcaattggtaagaatttttcattttaaaagcagtaggaagtgatgtaaaactctaccattgcttggactgttaggagtgcggactccctttctggtagactcccttcgtaggcaagcacggtggtgcccagccatggaggcacccttaggacactgagcacaggcctggctgcctgtgccttggccacagcctccttccaccccactgaagtggacacctgcctctggagcccagggtgagaaggagaggcctgaagcctggggccacgttcccacacaagccaaggaacctattcctctttggacagacagcgagggaataatcagacagtgggtgcaaatgttcatgtcccgatagctccacacacccatgtatctgtgggaactcaaaccaagccagagcccacagagccaaacaaacagaaaatcacaaacccatctgtcctcttctcaatgcagaactccttcccgtccaataattttcctgaaccaatcacccttgttattgggtatcttctccactgctgggtaaggcctgcacatggtctgtctgtaactttctagaagactgagaactgcttatgccttagggagttctatgtgagcagcaaggttattccccctagttacacacacacgcacatgtgccaatactcctgcaaagacttgctgtttctaaaatccactactcagaaaaaccagggtgtcggcttaaagttttcagctccatctatcaaaatttgacctttttttaagagaaaaatatgtagatgagtgaaaaagacctaggattgaaagacaaaaagccatgtgtccatgtaaccctggccagtcactccacctgcctgagccttggtttcctcagctgtgagctcctaccaggtcagtgtgggaattggccaaaatgacgcagcagaagtgctttggagactaaagattgtcaacgaaatgtaagtgtcattttcgtagtattaggacgtttacattacagcaggctttaattagaacccacttagatatcgactcagaatgatcaattacagtggttaaaatacacatacctggtaatcatatacttgctttctgtccccagttcttacattaagtcaaccaactgacccaaaaatcaaccaataactaactggccatctctccactcactcagcattctcctcttaaatgcagggcatgcagaagattaaggtacagccccttccctggataggaactc

SEQ ID NO: 8056 - DNA, 1136 bp, Homo sapiens
ccgcagatgaggaagtgcccaagtcttccttcgggaagttctcgtttagaggagtcaggagaaaaagtcattgttatatcccaactttagaagccgcttatcttggtaccgttctgaggttctagaaagcaagtaacttatatcagtttactaagtgtgggaaagtgacccataacttcaaacatctgcctcagagtaaacctgaggcatttggggacaagtgtcagaccctccgctgcctatcatgcacggcagagcttacctcttgctgcacagagacttctgtgatctcaaggagaacaattataagggtatcactgctaagcctgtaagtgaagatatgatggaatgggaagttgaaattgaaggtctacagaattcagtttggcagggtttagtcttccaactgacaatacattttacatcggagtacaactatgctcctccagttgtgaaatttataacaattccgtttcatccaaatgtagacccacacactggtcagccctgtatagactttttggacaaccctgagaagtggaatacaaactatacattgagcagcatcttacttgccctacaggttatgctttctaatccagtgctagagaatccagtgaatttggaagcagccagaatactggttaaagatgaatctctgtacagaacaattctaagacttttcaacaggccattacaaatgaaagatgacagccaggagttacctaaagacccacgtaaatgtatcagaccaattaaaacaacctcatttagtgattactaccagacatggtccagaatagctacatcaaaagccacagaatactacagaactccattgctcaaagttccaaatttcattggacagtattacaaatggaagaaaatggatctacagcatcagaaagaatggaatttaaaatgaaaaatctttctttggaagcagcataggggaagagcatgagcttcagagtcaaacagatgttggagaaattcttaaccactctgaacttgtttttttatctgttaaatggagataaccttacctatcttgcaaagttgttttgcatttgacgcttattattttatatatatgatttcattcgagatataaataaaaattatataaaaatgtg

SEQ ID NO: 8057 - DNA, 1550 bp, Homo sapiens
gatttgcttcctccggtgcgtggctgcggggttgcacctgtgaagcgaagacaacctgctaggaccctgataggcgtacacctctcactcccactcacgcgccgacgacatgggcttgtctccgttactcatccaagtttgtcttgagactgggctgtgagccggcactgcagtgaaacgccgcagatgaggaagtgcccaagtcttccttcgggaagttctcgtttagaggagtcaggagaaaaagtcattgttatatcccaactttagaagccgcttatcttggtaccgttctgaggttctagaaagcaagtaacttatatcagtttactaagtgtgggaaagtgacccataacttcaaacatctgcctcagagtaaacctgaggcatttggggacaagtgtcagaccctccgctgcctatcatgcacggcagagcttacctcttgctgcacagagacttctgtgatctcaaggagaacaattataagggtatcactgctaagcctgtaagtgaagatatgatggaatgggaagttgaaattgaaggtctacagaattcagtttggcagggtttagtcttccaactgacaatacattttacatcggagtacaactatgctcctccagttgtgaaatttataacaattccgtttcatccaaatgtagacccacacactggtcagccctgtatagactttttggacaaccctgagaagtggaatacaaactatacattgagcagcatcttacttgccctacaggttatgctttctaatccagtgctagagaatccagtgaatttggaagcagccagaatactggttaaagatgaatctctgtacagaacaattctaagacttttcaacaggccattacaaatgaaagatgacagccaggagttacctaaagacccacgtaaatgtatcagaccaattaaaacaacctcatttagtgattactaccagacatggtccagaatagctacatcaaaagccacagaatactacagaactccattgctcaaagttccaaatttcattggacagtattacaaatggaagaaaatggatctacagcatcagaaagaatggaatttaaagtattccgttatcaagtgttggcttgctagaaaaagaatgcctcatgaagtcactcactcaatggaagaaattaagctctgcccaactctaattcccaccacagatgaaatttttcttgagtcaccaactgcaataaatagcatcacagacatttatgaaacagaagaggaggggtggaagagtgacacttcattatatgaaaatgacacagatgagcccagggaagaggaagtggaagatctgatctcctggaccaatactctcaatacaaatacttcagaagattaagcagaacattatcagattcaaaaaataaacagcctccgccatagcccagcgttgtggagcaattttggaagactctcagaacttggatttcattttttttaagttgttctcacccactcactgcaagtacaaattagaaatataagtacaaatcagtaaa

SEQ ID NO: 8058 - DNA, 1114 bp, Homo sapiens
accctttgtgccttatgcggtgattttaatgataggtgtcatatataggacggagtaatctgtttacattctgttcttctcgatgcactcacaagcgggtaactaggtgacaagaaaacaaagatcttattcaaaagaggtcttacagcaacccaacgtctcatcttcccatagtaaagatgacggcgccttgaggtaagctacaggcaacaccacttccgcgtttctcttgcgccctggtccaagatggcggatgaagccacgcgacgtgttgtgtctgagatcccggtgctgaagactaacgccggaccccgagatcgtgagttgtgggtgcagcgactgaaggaggaatatcagtcccttatccggtatgtggagaacaacaagaatgctgacaacgattggttccgactggagtccaacaaggaaggaactcggtggtttggaaaatgctggtatatccatgacctcctgaaatatgagtttgacatcgagtttgacattcctatcacatatcctactactgccccagaaattgcagttcctgagctggatggaaagacagcaaagatgtacaggggtggcaaaatatgcctgacggatcatttcaaacctttgtgggccaggaatgtgcccaaatttggactagctcatctcatggctctggggctgggtccatggctggcagtggaaatccctgatctgattcagaagggcgtcatccaacacaaagagaaatgcaaccaatgaagaatcaagccactgaggcagggcagagggacctttgataggctacgatactattttcctgtgcatcacacttaactcatctaactgcttccccggacaccctccacctctagttgttactaagtagctgcagtaggcattgctggggaagaaacaaacacacaccaaacagtactgctacttagtttctaaggctgcacagggaagggaaagactgggctttggacaatctagaggtaatttatatccgcccccaggtggagcaacatgcgattctggaggcacgggggtaactgaaagtgagtacatatagtctttctggtttctggagataacccatcaataaaagctgcttcctctggta

SEQ ID NO: 8059 - DNA, 3559 bp, Homo sapiens
ggctcggctgtaaggaggtggcagggacaaccacaaccacaacggccgggggaggagaaggcggcagcggcgattctaggcggcccaggcggcggggaggaggagaaggaggagggtggcggccgggcttggcttcggctccttgaggagttggcggcggcgcgacccggggaaccggcattgatgtccagctcgccgctgtccaagaaacgtcgcgtgtccgggcctgatccaaagccgggttctaactgctcccctgcccagtccgtgttgtccgaagtgccctcggtgccaaccaacggaatggccaagaacggcagtgaagcagacatagacgagggcctttactcccggcagctgtatgtgttgggccatgaggcaatgaagcggctccagacatccagtgtcctggtatcaggcctgcggggcctgggcgtggagatcgctaagaacatcatccttggtggggtcaaggctgttaccctacatgaccagggcactgcccagtgggctgatctttcctcccagttctacctgcgggaggaggacatcggtaaaaaccgggccgaggtatcacagccccgcctcgctgagctcaacagctatgtgcctgtcactgcctacactggacccctcgttgaggacttccttagtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgggtccttatacctttagcatctgtgacacctccaacttctccgactacatccgtggaggcatcgtcagtcaggtcaaagtacctaagaagattagctttaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcagtgggctcgggatgagtttgaaggcctcttcaagcagccagcagaaaatgtcaaccagtacctcacagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccagctcacaagctcaggagcgccgttctggtctgggcccaaacgctgtccacacccgctcacctttgatgtcaacaatcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttgatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaagacagagcacaaattagagatcaccatgctgtcccagggcgtgtccatgctctattccttcttcatgccagctgccaagctcaaggaacggttggatcagccgatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataactccca

SEQ ID NO: 8060 - DNA, 2497 bp, Homo sapiens
ctaattgaagtttttattttttatggaggcataacatatctagaataaggtacacagatttttttttttttttttttgaggtggagttttgctcatgttgcccaggttggagtgcagtggcgcagtctcggctcactgcagcctccgcctcccaggttcaagcgattctcctgcctcagccttccaaagtgctgggaatacaggcgtgagccacctcgcctggcactcagatcttaatacatttttaggctgggcatggcggctgacacctataatctcagcactcaggaggccaaggagtgaggtttgtttgagcccaggagttcaagaccagcctaggcaacatagcaagaccctgtctctacaacaaatcttaaaaattagccgggtgtggtggcatgtgcctgctgtcccagctattcgggaggctgaggtgggaggatcgtttcaacctgggaggtcaaggctgctgtgagccgtgattgcatcgctgcactccagctcgggtgacagtgtgagactttgtctcaaacaacaaaacaaaacagttttccacatacacagcactattgtaaccactgcccaaatcaacttcattgatttttctttttttgagacagtcttcctctgtcacccaggctggagtgcaatggcatgatctcggctcactgcaacctccgcctcccgggttcaagagatttcctgcctcagcctcctgagtagctgggattacaggcatctgccaccacgcccagctactttttgtatttttagtagagatggggtttcaccatgttggtcaggctggtctcgaacccttgacctcaggtgatccatctgccttagcctcccaaagtgctgggattacaggtgtgagctactgtgcctggcctggtttttcaattgaggtgggggaatggggaaggctagagggcttccccacttccagagtagctgtgcgccttgtacttgctttattcactgatggtccttctaataatgcctgcggaaacccattttgtcaactgtggccacatgtaatctgtttgctctgtctgcagtgggctcgggatgagtttgaaggcctcttcaagcagccagcagaaaatgtcaaccagtacctcacagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccagctcacaagctcaggagcgccgttctggtctgggcccaaacgctgtccacacccgctcacctttgatgtcaacaatcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttgatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaagacagagcacaaattagagatcaccatgctgtcccagggcgtgtccatgctctattccttcttcatgccagctgccaagctcaaggaacggttggatcagccgatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataactcc

SEQ ID NO: 8061 - DNA, 3466 bp, Homo sapiens
cttgtacgacagaggtggtttgctcttccgttgccccgtggcttcagctcatctttggcaggaaggcgaggcttccgcccggcacaggggatgtccagctcgccgctgtccaagaaacgtcgcgtgtccgggcctgatccaaagccgggttctaactgctcccctgcccagtccgtgttgtccgaagtgccctcggtgccaaccaacggaatggccaagaacggcagtgaagcagacatagacgagggcctttactcccggcagctgtatgtgttgggccatgaggcaatgaagcggctccagacatccagtgtcctggtatcaggcctgcggggcctgggcgtggagatcgctaagaacatcatccttggtggggtcaaggctgttaccctacatgaccagggcactgcccagtgggctgatctttcctcccagttctacctgcgggaggaggacatcggtaaaaaccgggccgaggtatcacagccccgcctcgctgagctcaacagctatgtgcctgtcactgcctacactggacccctcgttgaggacttccttagtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgggtccttatacctttagcatctgtgacacctccaacttctccgactacatccgtggaggcatcgtcagtcaggtcaaagtacctaagaagattagctttaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcagtgggctcgggatgagtttgaaggcctcttcaagcagccagcagaaaatgtcaaccagtacctcacagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccagctcacaagctcaggagcgccgttctggtctgggcccaaacgctgtccacacccgctcacctttgatgtcaacaatcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttgatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaagacagagcacaaattagagatcaccatgctgtcccagggcgtgtccatgctctattccttcttcatgccagctgccaagctcaaggaacggttggatcagccgatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataactccca

SEQ ID NO: 8062 - DNA, 1148 bp, Homo sapiens
ggtcctccccgcgcctggaggctcaggactgcgagactggacacgtcgggggcccagatgtttctagggagaggagcctcccagctcaggctagggaagggacaccggagcccagctcttcctgagctgacgaggcgccacccggcctttattcattattcataataaggtggggctgtggtaggcggcagtttttttgcctctttcgcacctggtccgctgaaggttctcggcttgtgaattattcacgaggggcggatcagcgtgccgaagggacgtgctgaaggggcgttctgaagtctgccgcgcaaacgagttcattgatgattcgcaaaaatgtccagctcgccgctgtccaagaaacgtcgcgtgtccgggcctgatccaaagccgggttctaactgctcccctgcccagtccgtgttgtccgaagtgccctcggtgccaaccaacggaatggccaagaacggcagtgaagcagacatagacgagggcctttactcccggcagctgtatgtgttgggccatgaggcaatgaagcggctccagacatccagtgtcctggtatcaggcctgcggggcctgggcgtggagatcgctaagaacatcatccttggtggggtcaaggctgttaccctacatgaccagggcactgcccagtgggctgatctttcctcccagttctacctgcgggaggaggacatcggtaaaaaccgggccgaggtatcacagccccgcctcgctgagctcaacagctatgtgcctgtcactgcctacactggacccctcgttgaggacttccttagtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctggg

SEQ ID NO: 8063 - DNA, 671 bp, Homo sapiens
aggactgcgagactggacacgtcgggggcccagatgtttctagggagaggagcctcccagctcaggctagggaagggacaccggagcccagctcttcctgagctgacgaggcgccacccggcctttattcattattcataataaggttctatgctctgtgttatttatcatctcgataaccccgtggggaagatgtccagctcgccgctgtccaagaaacgtcgcgtgtccgggcctgatccaaagccgggttctaactgctcccctgcccagtccgtgttgtccgaagtgccctcggtgccaaccaacggaatggccaagaacggcagtgaagcagacatagacgagggcctttactcccggcagctgtatgtgttgggccatgaggcaatgaagcggctccagacatccagtgtcctggtatcaggcctgcggggcctgggcgtggagatcgctaagaacatcatccttggtggggtcaaggctgttaccctacatgaccagggcactgcccagtgggctgatctttcctcccagttctacctgcgggaggaggacatcggtaaaaaccgggccgaggtatcacagccccgcctcgctgagctcaacagctatgtgcctgtcactgcctacactggacccctcgttgaggacttccttagtggtttcca

SEQ ID NO: 8064 - DNA, 1054 bp, Homo sapiens
atcttgtgtcggcggctcggctgtaaggaggtggcagggacaaccacaaccacaacggccgggggaggagaaggcggcagcggcgattctaggcggcccaggcggcggggaggaggagaaggaggagggtggcggccgggcttggcttcggctccttgaggagttggcggcggcgcgacccggggaaccggcattggttctatgctctgtgttatttatcatctcgataaccccgtggggaagatgtccagctcgccgctgtccaagaaacgtcgcgtgtccgggcctgatccaaagccgggttctaactgctcccctgcccagtccgtgttgtccgaagtgccctcggtgccaaccaacggaatggccaagaacggcagtgaagcagacatagacgagggcctttactcccggcagctgtatgtgttgggccatgaggcaatgaagcggctccagacatccagtgtcctggtatcaggcctgcggggcctgggcgtggagatcgctaagaacatcatccttggtggggtcaaggctgttaccctacatgaccagggcactgcccagtgggctgatctttcctcccagttctacctgcgggaggaggacatcggtaaaaaccgggccgaggtatcacagccccgcctcgctgagctcaacagctatgtgcctgtcactgcctacactggacccctcgttgaggacttccttagtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgg

SEQ ID NO: 8065 - DNA, 1706 bp, Homo sapiens
tgggccctgagcccaggggcatttggcaaacagtcccccaccagctgcatgcctctgggcgagtgaatggggttctctaagcctttcttttcccatttgtgatttgggcatagggttatctgggtcatggggattgttaagattagacaaagccctttcctctttgattgacacacagtatgctcttggtagatagtagggagctcttgtcattgtggttggtgctagtgacaagtgccaagatggaatcttaggtacattgggatacttagtgtcataaaagtctcagtgtgggaggacttgtgtgaacagaagactcagtgcctagaggagcacttggggtgaggggaagtgacgctgggtcctcccatctccagcatgtggacccagtcacccccaccaccagatttcacttccacagcaggctttattgttctgtctctgggacctagcaggtgaccctgggcaagttacttctcatttgtccggcaaggacactaaactctgccttgctgggtcagggtcatggaggggatgaaacgtgataacacgaggaagcagcctgggcttcagagtcagcagatcctggtctggtcccagctcagtgtgtgggaaccttggtcaccgaacgtccctgagtgaatttttttccatcactttaaagttgggggtattattgatagcagtccaaaccccacaggagtaccctgaggacagagtgagacgaggtttagagaagtgcttactatggcatctggcacaaggaggactcctgatcaatctaatactcatttatcattgtggttaacctgtttaagggactccgcatgcagatgaggcttgggatgtgtttgttttctatctttttgcaacctcttttattggtctgtgtcggttttcccctcccaaagctgggggcagggttgggctttataaaacttgagcccctctggggactgggttctcagcaagttaccgctcctgccatcatgccaccctgatggatgtccaagcctcacttccctcctgcactccccgctcccgccgccatccctgggattaagggagaggagaatggctgcttgttactgcctacctactctgtgccaggttctatgctctgtgttatttatcatctcgataaccccgtggggaagatgtccagctcgccgctgtccaagaaacgtcgcgtgtccgggcctgatccaaagccgggttctaactgctcccctgcccagtccgtgttgtccgaagtgccctcggtgccaaccaacggaatggccaagaacggcagtgaagcagacatagacgagggcctttactcccggcagctgtatgtgttgggccatgaggcaatgaagcggctccagacatccagtgtcctggtatcaggcctgcggggcctgggcgtggagatcgctaagaacatcatccttggtggggtcaaggctgttaccctacatgaccagggcactgcccagtgggctgatctttcctcccagttctacctgcgggaggaggacatcggtaaaaaccgggccgaggtatcacagccccgcctcgctgagctcaacagctatgtgcctgtcactgcctacactggacccctcgttgaggacttccttagtggtttccaggtggtggtgctcaccaacacccccctggaggaccagctgcgagtgggtgagttctgtcacaaccgtggc

SEQ ID NO: 8066 - DNA, 809 bp, Homo sapiens
tcggcggctcggctgtaaggaggtggcagggacaaccacaaccacaacggccgggggaggagaaggcggcagcggcgattctaggcggcccaggcggcggggaggaggagaaggaggagggtggcggccgggcttggcttcggctccttgaggagttggcggcggcgcgacccggggaaccggcattgcaagttaccgctcctgccatcatgccaccctgatggatgtccaagcctcacttccctcctgcactccccgctcccgccgccatccctgggattaagggagaggagaatggctgcttgttactgcctacctactctgtgccaggttctatgctctgtgttatttatcatctcgataaccccgtggggaagatgtccagctcgccgctgtccaagaaacgtcgcgtgtccgggcctgatccaaagccgggttctaactgctcccctgcccagtccgtgttgtccgaagtgccctcggtgccaaccaacggaatggccaagaacggcagtgaagcagacatagacgagggcctttactcccggcagctgtatgtgttgggccatgaggcaatgaagcggctccagacatccagtgtcctggtatcaggcctgcggggcctgggcgtggagatcgctaagaacatcatccttggtggggtcaaggctgttaccctacatgaccagggcactgcccagtgggctgatctttcctcccagttctacctgcgggaggaggacatcggtaaaaaccgggccgaggtatcacagccccgcctcgctgagctcaacagctatgtgcctgtc

SEQ ID NO: 8067 - DNA, 5571 bp, Homo sapiens
gggagaccagggttgtttaccagcaggacagagcccgggcgcaggcggcggatggagcggaacggctaggggtcttgagaagcaatggccacagaagcccctgtgaatatagcaccacctgagtgtagcactgttgtcagcacagcagttgacagcctcatttggcagccaaactcactaaatatgcacatgataaggcccaagtccgccaagggacggacaagaccgagtctgcagaaatcccagggcgtggaggtgtgcgctcatcatataccatctccgcctccagccattccctatgagttgccaagcagccaaaaaccaggagcctgtgcacccaaatctccaaaccagggagcttctgatgagatccctgagctgcagcagcaagtacccactggggcttcctcttctctcaataagtatccagtccttccttccatcaacagaaagaacctggaggaggaggctgtggaaaccgttgccaaaaaggccagctcactgcaactgagcagtatccgggctctttaccaagacgagacgggcaccatgaagacaagtgaagaagattccagagctcgagcttgtgccgtggagaggaaattcatcgtccgaaccaagaaacagggctcttccagggctggaaatctggaggaaccatcggaccaagaaccaaggttgctgcttgctgttagatcaccaacaggccaaaggtttgtacgccatttccggccaacagatgatttgcaaaccattgttgctgtggccgaacagaaaaacaaaacctcctaccgacactgcagcattgaaacaatggaggtgcccaggaggcgattttctgacctcaccaaatctctgcaagagtgcagaatcccccacaagtctgtgctgggcatctcactggaagatggggaagggtggccctgagtccacagccacccagctgaggtcctgggtctctgagcaaaggagcatgcttgggcgttgtggcctcttaggcagcctgtttcaagtgccatgtggacctggtgcagctgggaagcttgggactctcgtctgcactgcgtgtcctctgaagcagtgaagtctgtgcctatgccgagcgcgctaagaagtctcccttccagctgttccattctctccaccaccagcgtaactggcaagttaccaaggttgttcctgaaacagcagtgatcatgacttctcctttccagagttttgggtccttctgaattaatggtccttttcgaacaccggcttgcctttacagtgaactgtgattctctcgaagccaatgctttcctgtctgtatttgatgcaggattaaacacttcccagagaggattctagtctggtaaataaccacagtgtaggaactatctaactggcatttgtgtttcttgcgagtattttgaagaaacaggccgttgaccccatctttggaagtagccctttaccatgcatggtcagtttcttagggatttactatttgtgtgaggtggcatctaagggaagaatgggttttcttccccaaaacatcagcatttctaaaatagtcctaaagcttgaaagtaagttgcttccatgagcatggattacccagtagctactttttaatagagactgactaggtttacaacttctgggagctactctgtgggctgaattcttccaaaaccgagaaaagccagtgcagtctgatttcttttgcttttgtcagtaatggaatcttttgtttttaaaatgtacaaacctataagtttaaacaggtttgtactgacaacctccttggcttatttgggggtggagcaattgttttattccccagtttcagtgcgttgcccacttcaaacatggtgtgtcctttggagctgtgacagaggtgcctgttctgacttagaacctctggaggaggaggggggtgccttggtctcgtgttactttgctgtgcctgtgctgagagaccatgtgcccgagcatctggttgaccggcatgaagtacatcagcctgtcttagcctgagctgctttgaagaccatggggtcttgtgtttccaacttcgaagtgctgatgtggacagtttgccaatgttctcttctattgcaagttcagccagactccatgactcatctgatcccttttatggccaaatcatccttcagagtagggaacactcagacattctgtgcatgttgttcccccaaagcatggtcatcacaaagtcctgagttctggtgtgtgctcccgcctcctgggtatacagagagaaggcaggaatcaggagttccagaagcatatacatgtggctaccccagcaacaagcgcatcctgtgctcagataagctgcatggttgggagtgttttttctcgcacgttgaggcttagtggagatgggcaccactgccatttgctcagaagaaggctggtctggtcctaactgcatcccacactgcccagatcattctagaataggttatttctgaatgttttatagaatttcttaataccatcctggtttggtcagccattcctttgattggaaaggtcagctggggccagtggtgcctcaggcaggcccacacaactggccacctcttcccgttaatgaccacagcagacagaatttgagcccagcacctaaaagtacaggaatttcacttcccaccaggacttgagcacataactctatgtctgatctaggaggctgggggaagagcctcccataaaatcacacctactctgtggtaagaataaaatcccacccacctgggacttggtaatttctccagacaggaaagctttagaaaacttgagtgaaatggagcaagcttgaaggagttagaatcttctgtgcttagggtttgctgctgctggtgagcttagaattttggggttgggaaaaagtggaaggcataagcatagaaatattttaggatattttaggatatgtgaataaagctagactcaaaccatcataataaacattttttttttggacaaaagatgatacgataaaaaccaacttgtgtgaaactgagtcagtggagaagtgcatctcgtattttaacctaaggcttcagctcccacacacgactggacagaggggtgtgttagcctgatcttcagttttctcattgggaaagcacttgttccactgttagaaccaagtcctcctccccggacacttctgatgcccactgcagaagcgacggggctcctgctctcagcttctgtcacagcacttagcttgtctggataagagtcacctgaatttttcctaaacatcattccaagtactctgattttggggattggcaagaacaaactaaatcagaattcagagttcctgatggctccacatgttgcattgcagctgaggccccctgtcctaaatgggctcaaccggcctagcacactcctcttggtggctttgggtgggtcagccttgcccagtttggggtcatagacctcagttattcatttaaccgatggccattgagggcttacccagtgccacactttgagacaagcatgggtgtcctgaaaagaaagtgttggcaagaaaacatgaacccaccattggactctcaactcaaaccttactgaagtcagtggctatagctttatctgcaaaggaccccaaagtgaggatcccacattgttactgctggctcttcatcccaccctctggagatgctaaggaagctcttgcccaccttttctagtgatggagtaggaactttgcataggacaaaccttcatgataggttactctagtatattccctcataaagtccaataggtaaattagtcttggcagcagaaggaacagcaggagaagtaagtgattcatcatctagaatccagaaaatttgcaccaacagatggcaggtggttataacacaacagatcttgccctgagaatatctggggacccagccaacagccttcaaggcagggcactcctgcggaagagatggcttgtgaacatgactgtggacccagagtcaccccagagctcccatataaaatgcttcacagagaaactaagagcagccttggggcattcattccaattaataaccttaaagactagagccagatccacctgcattacaaaagcaggcattcgaggaactaaactttgcttttgttcatgctcttacctgccgttttaaatgggtttctaatgtcaaataaagccaccctgcctcttgggacaaagatgtttctctttacttagttttaaaaataaaatcctcataataagttcggataaaagagacttttacatggtaagaggatctacttttctaccttttaaacggaataaagaagacagctatattattttgctttagcattagtttagaagtcattccaagaattaagcaggaacatctgttttctcagtccattaaggcaacaccccacagtaaagttaaaagttcacgagcctattgactctcatccagaaaccagaaccaaccaaaccccaccatataacagggaaggcctgaggtcgcttcggaggagttagcaatcaaaggagaacagacttttggtgactcagttaccaacacacaacactcataaaactaaaattaggtgttttattttttgtctacacgggtggcgtgccactttcctttcctgattagggaagcttctcccagccctttctgacgttcatctgtgtgcctttatgttcaaacagtttaggaagcagcagccctcctaacagtcgacgcggaagcacaaatctctggaggtatttttggacacacttaaatcctatcccaagagactgaacgactgtggtgacaaatgcccacgggtaaaactgagcaagcctcattcagactgtcctgctcagaggcgccctctggctgccgtgttgaggggctggggtggaagatggaagacttgagtgctggaggtatgaaggtgaccagagagaggtgatggtggttcgggccagggtggtagccagagatgtcatgagaggtggccagattctggacatataatccattttcttaaggagaaaaaaaaggatagtttgacaagttgggattcacccaggtggacttagcttgaccaatatcgccaacgtggattgtttctgcaaaaacaaacaagcaaacaaccaccacggcagcaaagcacatggcaggcaggggaaagacactgaccagcaggaacattcccatcaaggaaatgcacgagtgtttttggacaaagtgtacagagaaaatcaaagctattcattgttttaattaagagataaaactaaggtcactgtttcacttaatgttgagatataagttaaaagtatcatctacctctaggggtatgatatgactgctgaccaaggttacttaataagaaatccttgttctagttaaatacactgtttatctctatctcctgtccttcatccctccctttcttgccacccttccctccatttattccagtccagcagctgactggggatgcatttcttcttgggaaggcaaacaaagccatcattctggggcttaattaataaagctcctagtttcatag

SEQ ID NO: 8068 - DNA, 2493 bp, Homo sapiens
gaacctcagtgtgtgaagtaaagggattaaaggctagtctcaggctggggatggctcctgtctatttcttctctctcagagactgcagatggcttttccctgccgcaggtccctgactgccaagactctggcctgcctcctggtgggcgtgagtttcttagcactgcagcagtggttcctccaggcgccaaggtccccgcgggaggagaggtccccgcaggaggagacgccagagggtcccaccgacgctcccgcggctgacgagccgccctcggagctcgtccccgggcccccgtgcgtggcgaacgcctcggcgaacgccacggccgacttcgagcagctgcccgcgcgcatccaggacttcctgcggtaccgccactgccgccacttcccgctgctttgggacgcaccggccaagtgcgccggcggccgaggcgtgttcctgctcctggcggtgaagtcggcgcctgagcactacgagcgacgcgagctcatccggcgcacgtgggggcaagagcgcagctacggcgggcggccagtgcgccgcctctttctattgggcaccccgggccccgaggacgaggcgcgcgcggagcggctggcggagctggtggcgctggaggcgcgcgagcacggcgacgtgctgcagtgggccttcgcggacaccttcctcaacctcacgctcaagcacctgcacttgctcgactggctggctgcacgctgcccgcacgcgcgctttctgctcagcggcgacgacgacgtgttcgtgcacaccgccaacgtagtccgcttcctgcaggcgcagccacccggccgccacctgttctccggccagctcatggagggctccgtgcccatccgcgacagctggagcaagtacttcgtgccgccgcagctcttccccgggtccgcttacccggtgtactgcagcggcggcggcttcctcctgtccggccccacggcccgggccctgcgcgcggccgcccgccacaccccgctcttccccatcgacgacgcctacatgggcatgtgtttggagcgcgccggcctggcgcccagcggccacgagggcatctggcccttcggcgtgcagttgcctggcgcacagcagtcctccttcgacccctgcatgtaccgcgagttgctgctagtgcaccgcttcgcgccctacgagatgctgctcatgtggaaggcgctgcacagccccgcgctcagctgtgaccggggacaccgggtctcctgaggccagttgggcggcttcagccccgggcctccaaccatgtccatgctgagaaggcagctttcccgctctgggtaccttacgtcctgcccagctctgtgcacctgaaccccagctgcgcactgaaatcagctggggtggggggtgtggaaaatgcctacatcctggctccatctcccgaagtttcgatttgattagtctggggtggacccagacatgttaagtattttttaagttcctccagtgatgcgaatgtgcagctaggcctgaggaccactcggctagactatctcttcatcctcgcaaagccagctccaccgccctctctgcaagaattccgggcccctcgctcccacactcgggtcctcttgagcagtggagcaagggagacctgggagcgtgggagccaggatcagcgccccctgccatgtgcctacaaatgtcagttgtgatttccactgtttacaagtgagtggagctggagctgggctgacagtatcaggtggatcccgcttccccctcccccaagaagtcagccaacacgcagctgaggcgcatgtggtggccttcttcccaccactaccccagtacaccgtgaggtagaaatcttcaccgtgcaaagtggaaaccagaggcccggtcagacagtgactaatccagggccgtggcattcccagacagcacaccactgtggtcccctccacactcaccccaaccaaagctaatggcctagttgggtcctgcccgccaataatcacccccacgggtcagagacaggctccttgccggggtctgggcctcaggctcagtgggccttggacaacccagcagggagttccggggagtccgaagtggagaaaggctggtgggaacatggaggccagtgttggggagcctgtggaggcaggtgtgtagaattgtgttcgggaggtgggggatctgagaccgaagtggacagtggttaagattgtggggccgggcgaggtggctcacgcctgtaatcccagcactttgggaggctgaggaggtcggatcatgaggtcaagagttcgagaccagcctggccaatatggtgaaaccccgtctctattgggagtacaaaaattagccggccatagtggctcgtgcctgtaatctcagctatttgggaggctgaggcaggagaatcacttgaacctgggaggcggaggttgcagtgagccgagatcgtgccactgcactccagcctgggcgacagagcaagactgcatctc

SEQ ID NO: 8069 - DNA, 792 bp, Homo sapiens
atggcttttccctgccgcaggtccctgactgccaagactctggcctgcctcctggtgggcgtgagtttcttagcactgcagcagaggagacgccagagggtcccaccgacgctcccgcggcctgcccgcgcgcatccaggacttcctgcggtaccgcaagagcgcagctacggcgggcggccagtgcgccgcctctttctattgggcaccccgggccccgaggacgaggcgcgcgcggagcggctggcggagctggtggcgctggaggcgcgcgagcacggcgacgtgctgcagtgggccttcgcggacaccttcctcaacctcacgctcaagcacctgcacttgctcgactggctggctgcacgctgcccgcacgcgcgctttctgctcagcggcgacgacgacgtgttcgtgcacaccgccaacgtagtccgcttcctgcaggcgcagccacccggccgccacctgttctccggccagctcatggagggctccgtgcccatccgcgacagctggagcaagtacttcgtgccgccgcagctcttccccgggtccgcttacccggtgtactgcagcggcggcggcttcctcctgtccggcctggcgcccagcggccacgagggcatcccttcggcgtgcagcttgcctggcgcacagcagtcctccttcgacccctgcatgtaccgcgagttgctgctagtgcaccgcttcgcgccctacgagatgctgctcatgtggaaggcgctgcacagccccgcgctcagctgtgaccggggacaccgggtctcctga

SEQ ID NO: 8070 - DNA, 568 bp, Homo sapiens
agtgtgtgaagtaaagggattaaaggctagtctcaggctggggatggctcctgtctatttcttctctctcagagactgcagctgcgggaggggagaggtcggccgagagcaagatggtgtgtagagacaccaagcaggacgctacttcatgtgaggcgggaatgttagtttggatcaacctgttgatagagggaatgaaagcagatggcttttccctgccgcaggtccctgactgccaagactctggcctgcctcctggtgggcgtgagtttcttagcactgcagcagtggttcctccaggcgccaaggtccccgcgggaggagaggtccccgcaggaggagacgccagagggtcccaccgacgctcccgcggctgacgagccgccctcggagctcgtccccgggcccccgtgcgtggcgaacgcctcggcgaacgccacggccgacttcgagcagctgcccgcgcgcatccaggacttcctgcggtaccgccactgccgccacttcccgctgctttgggacgcaccggccaagtgcgccggcggccgaggcgtgttcctgctcctgg

SEQ ID NO: 8071 - DNA, 2639 bp, Homo sapiens
gatgtcatggattggtcagattcaagagaactgaaccacaggcctgcgtggaacctcagtgtgtgaagtaaagggattaaaggctagtctcaggctggggatggctcctgtctatttcttctctctcagagactgcagatggcttttccctgccgcaggtccctgactgccaagactctggcctgcctcctggtgggcgtgagtttcttagcactgcagcagtggttcctccaggcgccaaggtccccgcgggaggagaggtccccgcaggaggagacgccagagggtcccaccgacgctcccgcggctgacgagccgccctcggagctcgtccccgggcccccgtgcgtggcgaacgcctcggcgaacgccacggccgacttcgagcagctgcccgcgcgcatccaggacttcctgcggtaccgccactgccgccacttcccgctgctttgggacgcaccggccaagtgcgccggcggccgaggcgtgttcctgctcctggcggtgaagtcggcgcctgagcactacgagcgacgcgagctcatccggcgcacgtgggggcaagagcgcagctacggcgggcggccagtgcgccgcctctttctattgggcaccccgggccccgaggacgaggcgcgcgcggagcggctggcggagctggtggcgctggaggcgcgcgagcacggcgacgtgctgcagtgggccttcgcggacaccttcctcaacctcacgctcaagcacctgcacttgctcgactggctggctgcacgctgcccgcacgcgcgctttctgctcagcggcgacgacgacgtgttcgtgcacaccgccaacgtagtccgcttcctgcaggcgcagccacccggccgccacctgttctccggccagctcatggagggctccgtgcccatccgcgacagctggagcaagtacttcgtgccgccgcagctcttccccgggtccgcttacccggtgtactgcagcggcggcggcttcctcctgtccggccccacggcccgggccctgcgcgcggccgcccgccacaccccgctcttccccatcgacgacgcctacatgggcatgtgtcttggagcgcgccggcctggcgcccagcggccacgagggcatcctggcccttcggcgtgcagcttgcctggcgcacagcagtcctccttcgacccctgcatgtaccgcgagttgctgctagtgcaccgcttcgcgccctacgagatgctgctcatgtggaaggcgctgcacagccccgcgctcagctgtgaccggggacaccgggtctcctgaggccagttgggcggcttcagccccgggcctccaaccatgtccatgctgagaaggcagctttcccgctctgggtaccttacgtcctgcccagctctgtgcacctgaaccccagctgcgcactgaaatcagctggggtggggggtgtggaaaatgcctacatcctggctccatctcccgaagtttcgatttgattagtctggggtggacccagacatgttaagtattttttaagttcctccagtgatgcgaatgtgcagctaggcctgaggaccactcggctagactatctcttcatcctcgcaaagccagctccaccgccctctctgcaagaattccgggcccctcgctcccacactcgggtcctcttgagcagtggagcaagggagacctgggagcgtgggagccaggatcagcgccccctgccatgtgcctacaaatgtcagttgtgatttccactgtttacaagtgagtggagctggagctgggctgacagtatcaggtggatcccgcttccccctcccccaagaagtcagccaacacgcagctgaggcgcatgtggtggccttcttcccaccactaccccagtacaccgtgaggtagaaatcttcaccgtgcaaagtggaaaccagaggcccggtcagacagtgactaatccagggccgtggcattcccagacagcacaccactgtggtcccctccacactcaccccaaccaaagctaatggcctagttgggtcctgcccgccaataatcacccccacgggtcagagacaggctccttgccggggtctgggcctcaggctcagtgggccttggacaacccagcagggagttccggggagtccgaagtggagaaaggctggtgggaacatggaggccagtgttggggagcctgtggaggcaggtgtgtagaattgtgttcgggaggtgggggatctgagaccgaagtggacagtggttaagattgtggggccgggcgaggtggctcacgcctgtaatcccagcactttgggaggctgaggaggtcggatcatgaggtcaagagttcgagaccagcctggccaatatggtgaaaccccgtctctattgggagtacaaaaattagccggccatagtggctcgtgcctgtaatctcagctatttgggaggctgaggcaggagaatcacttgaacctgggaggcggaggttgcagtgagccgagatcgtgccactgcactccagcctgggcgacagagcaagactgcatctcaaaaaaaaaaaaaaaaaggagagtttgcaagggtgggtgggaacttggtgcctggggctctgagaaccaggctgtggtcctgacctccagcag

SEQ ID NO: 8072 - DNA, 1378 bp, Homo sapiens
gccgaagcggcgggatgagcggagccggcgtgggcggggcgtccgaggagagccaggccatgcaggcccacgtgtctattatcctcccagtccacaacgctgaaccgtggctggacgaatgtttgaggtctgttttgcaacaggactttgaaggtaccatggagctgtctgttttcaatgatgccagtaaggacaagtctggggctatcattgaaaaatggagagtgaagctggaagattctggtgtccacgtgatcattggggggcacgattctccctctcctagaggcgtcggatacgctaaaaatcaagcagttgcccagagctcagggtcttacctttgctttttggattcggatgacgtcatgatgccccagcgggtgaggctgcaacacgaggctgccgttcagcacccgtcgagcatcattggttgcagagtgaggagagatccccctaactccaccgaacgatacacacgttggatcaaccagctgacgccggagcagctcctaacccaggttttcacctcaaatggccccacggtgatcatgcccacctggttctgctcgcgagcgtggttctcccacgtgggcccctttaacgagggaggtcagggcgtcccggaggacctgctgttcttctacgagcacctcaggaagggcggcggcgtcatccgcgtggaccagagtctcctgctgtatcgccaccacccacaggcggccacgcactgcgtcctcgagacgaccatctggacccaccgcgtccgcttcctggaagagcaggccctgccccgctgggcggccttcaccatctggaacgctggcaagcaggggcgccggctgtaccgcagcttgactgccggcagccagcgcaaggtggtggcattctgtgacgtggacgagaacaagatcaggaaaggcttctattgccacgaggactctcaggaaagacccaagccccgaatccccatcctgcacttccgagccgcccggccacccttcgtcatctgcgtgaagctggacctcacagggggcgcctttgaggacaacctgaggtcactgcacttgcaggagggccaggacttccttcacttcagctgacggacccatggcagctgctcccagtgcatcccaggccagcaggagctttgtgagctgcaggcatggcgatggtgcgcctgttccacacccagcaggcgcaaccagagtctcgtgtgtgccgaccacaggagccaagccttttccactgtgtggactcatgtggccaaggctaggcctggtcacccaggaccctcaccacgtgaccccagccaatcgggacagttcaaggaggaggagacccctattacacaggttggaataaaatatttaaatctcgt

SEQ ID NO: 8073 - DNA, 2410 bp, Homo sapiens
atggcggtggccaggaagatccgaactttgctgacggtgaacatcctggtgttcgtgggcatcgtcctgttctccgtgtactgccgcctgcagggccgctcccaggagctcgtgcgcatcgtgagcggcgaccgccgggtgcgcagccgacacgccaaggtgggcacgctgggggaccgtgaggccatcctgcagcgcctggaccacctggaggaggtggtctacaaccagctcaacggccttgccaagcccatcggcctggtggaggggccaggaggcctgggccagggtggcttggcggccaccctgcgtgatgacggccaggaggcggaaggcaagtatgaggagtacggctacaacgctcagctcagcgaccgcatctccctcgatcggagcatccccgactaccggcccagaaagtgcagacagatgagctacgcccaggacctgccccaggtctccgtggtcttcatcttcgtcaatgaggcgctgtcggtcatcctgcgctccgtgcacagcgtggtcaaccacacgccctcccagctcctcaaggaggtcatcctggtggacgacaacagtgacaacgtggaactcaagttcaatctggaccagtacgtcaacaagcggtacccaggcctcgtgaagattgtccgcaacagccggcgggaaggactgatccgcgcgcggctgcagggctggaaggcggccaccgccccagtcgtcggcttctttgatgcccacgtcgagttcaacacgggctgggccgagcccgcactgtcgcggatccgagaggaccggcgtcgcatcgtgctgccagccatcgacaacatcaagtacagcacgtttgaggtgcagcagtatgcgaacgccgcccatggctacaactggggcctctggtgcatgtacatcatccccccgcaggactggctggaccgcggcgacgagtcagcacccatcaggaccccagccatgatcggctgctccttcgtagtggaccgcgagtacttcggagacattgggctgctggaccccggcatggaggtgtatggcggcgagaacgtagaactgggcatgagggtgtggcagtgtggcggcagcatggaggtgctgccctgctcccgcgtggcccacatcgagcgcaccaggaagccctacaacaacgacattgactactatgccaagcgcaacgccctgcgcgccgccgaggtgtggatggatgacttcaagtcccacgtgtacatggcctggaacatccccatgtcgaacccaggggtggacttcggggacgtgtctgagaggctggccctgcgtcagaggctgaagtgtcgcagcttcaagtggtacctggagaacgtgtacccggagatgagggtctacaacaacaccctcacgtacggagaggtgagaaacagcaaagccagtgcctactgtctggaccagggagcggaggacggcgaccgggcgatcctctacccctgccacgggatgtcctcccagctggtgcggtacagcgctgatggactgctgcagctggggcctctgggctccacagccttcttgcctgactccaagtgtctggtggatgacggcacgggccgcatgcccaccctgaagaagtgtgaggatgtggcgcggccaacacagcggctgtgggacttcacccagagtggccccattgtgagccgggccacgggccgctgcctggaggtggagatgtccaaagatgccaactttgggctccggctggtggtacagaggtgctcggggcagaagtggatgatcagaaactggatcaaacacgcacggcactgaccccacctccgcccggacccccacagacctcgggaaggcgctgggccgagccagtgtggctgagtgaccggggtgtgcccggcagacacagcaggacagggctctatgtgcggccaggacagcagaggctgaggggccggggtgtggctgagtgaccagggtgtcacccactgcatctggagtacagcttctcctaggacaggcggctctacccgagggagggcgtctggggacagtgatgccaactcaaacacgtgccttctccacggtatctcctggccaggctgctgggacagccgccgcctctgcatgtaccacagccccccacgccccatagggaggccaagccccggaccatgcaccaggctgcaccctggtgtcttccacccgcaggcctcccatgctccaagcagcctcccccagcacttgcggccgctcagccctccaaccaagacctaagtcacacatcataatgcagctccttgtggtctggtaagaggggtgctggaggacatggacagcgacaaacctgaggccgtgtctaggaggctggcacgactgcttcagcagagaccaaataaagagaggattaggcagc

SEQ ID NO: 8074 - DNA, 1720 bp, Homo sapiens
ggcgcttctgaagacgggtgggcagacgatggaggacgaggctctgtcccgcccctgcagagcttccttcgttccggccccttccagcgaagggcagggctccgagcagagacaacagacagaaacccagaaaccacctgccacgatgtgaacctgatgcagaaacgcggttcgctccctcgggatgcaaaggccaacttcagcctggcacggcggcgccgcggactccaccatcccggggaaggagccggacccctgtgtggcagtgtggcggcagcatggaggtgctgccctgctcccgcgtggcccacatcgagcgcaccaggaagccctacaacaacgacattgactactatgccaagcgcaacgccctgcgcgccgccgaggtgtggatggatgacttcaagtcccacgtgtacatggcctggaacatccccatgtcgaacccaggggtggacttcggggacgtgtctgagaggctggccctgcgtcagaggctgaagtgtcgcagcttcaagtggtacctggagaacgtgtacccggagatgagggtctacaacaacaccctcacgtacggagaggtgagaaacagcaaagccagtgcctactgtctggaccagggagcggaggacggcgaccgggcgatcctctacccctgccacgggatgtcctcccagctggtgcggtacagcgctgatggactgctgcagctggggcctctgggctccacagccttcttgcctgactccaagtgtctggtggatgacggcacgggccgcatgcccaccctgaagaagtgtgaggatgtggcgcggccaacacagcggctgtgggacttcacccagagtggccccattgtgagccgggccacgggccgctgcctggaggtggagatgtccaaagatgccaactttgggctccggctggtggtacagaggtgctcggggcagaagtggatgatcagaaactggatcaaacacgcacggcactgaccccacctccgcccggacccccacagacctcgggaaggcgctgggccgagccagtgtggctgagtgaccggggtgtgcccggcagacacagcaggacagggctctatgtgcggccaggacagcagaggctgaggggccggggtgtggctgagtgaccagggtgtcacccactgcatctggagtacagcttctcctaggacaggcggctctacccgagggagggcgtctggggacagtgatgccaactcaaacacgtgccttctccacggtatctcctggccaggctgctgggacagccgccgcctctgcatgtaccacagccccccacgccccatagggaggccaagccccggaccatgcaccaggctgcaccctggtgtcttccacccgcaggcctcccatgctccaagcagcctcccccagcacttgcggccgctcagccctccaaccaagacctaagtcacacatcataatgcagctccttgtggtctggtaagaggggtgctggaggacatggacagcgacaaacctgaggccgtgtctaggaggctggcacgactgcttcagcagagaccaaataaagagaggattaggcagcagcactgtgtgtgtcttcctgggagccgagctgggggttggggcccggtcccacctctttcccaggcacctgggccctgccgcagcccagccccttgcctgttttaataaatacagttttattggcgccc

SEQ ID NO: 8075 - DNA, 1727 bp, Homo sapiens
catcatccccccgcaggactggctggaccgcggcgacgagtcagcacccatcaggaccccagccatgatcggctgctccttcgtagtggaccgcgagtacttcggagacattgggctgctggaccccggcatggaggtgtatggcggcgagaacgtagaactgggcatgagggaaacagaagggttccagcaagataaggtaaattataaacagaataaaagaggaagaaaaacacggcagagagtgaagaggagcaggtccgaggcccatagagcacagccgagccccggggccacgcacggagcccacagccgagccccggggccacgcacggagcccacagctgagccctggggccacgccaggcccacagcagcactgccagcgactggagtgtggcagtgtggcggcagcatggaggtgctgccctgctcccgcgtggcccacatcgagcgcaccaggaagccctacaacaacgacattgactactatgccaagcgcaacgccctgcgcgccgccgaggtgtggatggatgacttcaagtcccacgtgtacatggcctggaacatccccatgtcgaacccaggggtggacttcggggacgtgtctgagaggctggccctgcgtcagaggctgaagtgtcgcagcttcaagtggtacctggagaacgtgtacccggagatgagggtctacaacaacaccctcacgtacggagaggtgagaaacagcaaagccagtgcctactgtctggaccagggagcggaggacggcgaccgggcgatcctctacccctgccacgggatgtcctcccagctggtgcggtacagcgctgatggactgctgcagctggggcctctgggctccacagccttcttgcctgactccaagtgtctggtggatgacggcacgggccgcatgcccaccctgaagaagtgtgaggatgtggcgcggccaacacagcggctgtgggacttcacccagagtggccccattgtgagccgggccacgggccgctgcctggaggtggagatgtccaaagatgccaactttgggctccggctggtggtacagaggtgctcggggcagaagtggatgatcagaaactggatcaaacacgcacggcactgaccccacctccgcccggacccccacagacctcgggaaggcgctgggccgagccagtgtggctgagtgaccggggtgtgcccggcagacacagcaggacagggctctatgtgcggccaggacagcagaggctgaggggccggggtgtggctgagtgaccagggtgtcacccactgcatctggagtacagcttctcctaggacaggcggctctacccgagggagggcgtctggggacagtgatgccaactcaaacacgtgccttctccacggtatctcctggccaggctgctgggacagccgccgcctctgcatgtaccacagccccccacgccccatagggaggccaagccccggaccatgcaccaggctgcaccctggtgtcttccacccgcaggcctcccatgctccaagcagcctcccccagcacttgcggccgctcagccctccaaccaagacctaagtcacacatcataatgcagctccttgtggtctggtaagaggggtgctggaggacatggacagcgacaaacctgaggccgtgtctaggaggctggcacgactgcttcagcagagaccaaataaagagaggattaggcagc

SEQ ID NO: 8076 - DNA, 897 bp, Homo sapiens
gtgttccccagcgtgaggcccgaggacaggattctgtggtgggtggggggaccgagtcaccgtggcctctgtactgggggtagacaaggaggctgaaactgctggaggtcgtcccagaggccagtgtgccaggcgcttctgaagacgggtgggcagacgatggaggacgaggctctgtcccgcccctgcagagcttccttcgttccggccccttccagcgaagggcagggctccgagcagagacaacagacagaaacccagaaaccacctgccacgatgtgaacctgatgcagaaacgcggttcgctccctcgggatgcaaaggccaacttcagcctggcacggcggcgccgcggactccaccatcccggggaaggagccggacccctgtgggtgacgtgggactgtggggcgggggtgtccccggctgggctgagctgagcagcgaggaggctctgggttgccggaccggggtcagggagcctggcgttagctgcgtgctgtgtggtcatctcggcgaggagggagcggctccctcctgccccggactctggatctgtcctgcggtgggcggtgtcggagcagccgtgtggcagtgtggcggcagcatggaggtgctgccctgctcccgcgtggcccacatcgagcgcaccaggaagccctacaacaacgacattgactactatgccaagcgcaacgccctgcgcgccgccgaggtgtggatggatgacttcaagtcccacgtgtacatggcctggaacatccccatgtcgaacccaggggtggacttcggggacgtgtctgagaggctggccctgcgtcagaggctgaagtgtcgcagcttcaagtggtacctggagaacgtgtacccggagatgagggtctacaacaacaccct

SEQ ID NO: 8077 - DNA, 1001 bp, Homo sapiens
cctagtctggaaggcagaaaggaagccccggctcagggggctggaaaaccccaggcttttctcaggcaggttgtcccacagcagagacaacagacagaaacccagaaaccacctgccacgatgtgaacctgatgcagaaacgcggttcgctccctcgggatgcaaaggccaacttcagcctggcacggcggcgccgcggactccaccatcccggggaaggagccggacccctgtgtggcagtgtggcggcagcatggaggtgctgccctgctcccgcgtggcccacatcgagcgcaccaggaagccctacaacaacgacattgactactatgccaagcgcaacgccctgcgcgccgccgaggtgtggatggatgacttcaagtcccacgtgtacatggcctggaacatccccatgtcgaacccaggggtggacttcggggacgtgtctgagaggctggccctgcgtcagaggctgaagtgtcgcagcttcaagtggtacctggagaacgtgtacccggagatgagggtctacaacaacaccctcacgtacggagaggtgagaaacagcaaagccagtgcctactgtctggaccagggagcggaggacggcgaccgggcgatcctctacccctgccacgggatgtcctcccagctggtgcggtacagcgctgatggactgctgcagctggggcctctgggctccacagccttcttgcctgactccaagtgtctggtggatgacggcacgggccgcatgcccaccctgaagaagtgtgaggatgtggcgcggccaacacagcggctgtgggacttcacccagagtggccccattgtgagccgggccacgggccgctgcctggaggtggagatgtccaaagatgccaactttgggctccggctggtggtacagaggtgctcggggcagaagtggatgatcagaaactggatcaaacacgcacggcactgaccccacctccgcccggacccccacagacctcggg

SEQ ID NO: 8078 - DNA, 624 bp, Homo sapiens
aaatcccgaccctagtctggaaggcagaaaggaagccccggctcagggggctggaaaaccccaggcttttctcaggcaggttgtcccacagcagagacaacagacagaaacccagaaaccacctgccacgatgtgaacctgatgcagaaacgcggttcgctccctcgggatgcaaaggccaacttcagcctggcacggcggcgccgcggactccaccatcccggggaaggagccggacccctgtgggtgacgtgggactgtggggcgggggtgtccccggctgggctgagctgagcagcgaggaggctctgggttgccggaccggggtcagggagcctggcgttagctgcgtgctgtgtggtcatctcggcgaggagggagcggctccctcctgccccggactctggatctgtcctgcggtgggcggtgtcggagcagccgtgtggcagtgtggcggcagcatggaggtgctgccctgctcccgcgtggcccacatcgagcgcaccaggaagccctacaacaacgacattgactactatgccaagcgcaacgccctgcgcgccgccgaggtgtggatggatgacttcaagtcccacgtgtacatggcctggaacatccccatgt

SEQ ID NO: 8079 - DNA, 1720 bp, Homo sapiens; identical to SEQ ID NO: 8074

SEQ ID NO: 8080 - DNA, 2410 bp, Homo sapiens; identical to SEQ ID NO: 8073

SEQ ID NO: 8081 - DNA, 3201 bp, Homo sapiens
gtaccgtgtggggctgcccagccggaagaccctgtaccagctgcaggcggagcggattcggcgggtggagcagctggccggtgagcgccacgggacccgctgcaccgtcccctggtgtgtcctgcctgccctacctcggcccggaggtacccttccccacgcccccccacatccccgctccagacgcgagccccaaccccggcacagaccgggacattgcccagaaccggcccaaaatggggcctggccccagccccaactggacactggaccccgaaccccgatgccggctctggtccgagccccgtctgcctgcagggccaggcgtactcgcggccggctcaccgcgcctcccttgcaggtacgtcatgaccagcgagttcactctggggcccacggccgagttcttcagggagcacaacttcttccacctggaccccgccaacgtggtcatgtttgagcagcgcctgctgcctgctgtgacctttgatggcaaggttatcctggagcggaaagacaaagttgccatggccccagacggcaacgggggcctctactgcgcgctggaggaccacaagatcctggaggacatggagcgccggggagtggagtttgtgcacgtgtactgtgtggacaacatcctggtgcggctggcggaccctgtcttcatcggcttctgtgtgttgcagggcgcagactgtggcgccaaggtggtggaaaaggcataccccgaggagcccgtgggcgtggtgtgccaggtggacggtgtcccccaggtggtggagtacagcgagatcagtcctgagaccgcacagctacgtgcctccgacgggagcctgctgtacaatgcaggcaacatctgcaaccacttcttcacccgaggcttccttaaggcggtcaccagggagtttgagcctttgctgaagccacacgtggctgtgaagaaggtcccgtatgtggatgaggaggggaatctggtaaagccgctaaaaccgaacgggataaagatggagaagtttgtgtttgatgtgttccggtttgctaagaactttgctgccttggaagtgctgcgggaggaggaattttccccactgaagaacgcagagccagccgacagggacagtccccgcaccgctcgccaggccctgctcacccagcactaccggtgggctctgcgggccggggcccgcttcctggatgcccatggggcctggctcccagagctgcccagcttgcccccaaatggagaccctccggccatctgtgagatatcgcccttggtgtcttactctggagagggtttagaagtgtacctgcaaggccgggagttccagtccccgctcatcctggatgaagaccaggccagggagccgcagctgcaggagtcctgacccgcccagactgtccccagactcccccgagacctgccagccccggcatcctggaagtcccgactccccccagacctgccagccccggcgtcctggagctgggggctacagcccagcctgagctctgggtgggaaagcagcctgccccatgcttccagcctgcagaacacagaatgaaacatgctggtagactccacgagggcagggcctctcctgtcgcctctggacacaagtggcgacagcctgctgggggctctgtggctccattcctggctgtggggtctagtcaagaggcagagggacttgggacctgggagaatggggctgagaggaggcttcgggttggggcccaagggaggtgtggtgtcatctggggagaacaggagggcatgtccctttgggagcccgccttgtggatccaccacaccccaccgagcactagaagctgcataagctacacaggatgtgcttctgcagcctacagatgcagaaccagaatgagggggacaattccacccactcgagggctgccccctcttccttagcagacgaaccagtaatgggggcaaggctggggcatcccagcccacacaccctggatgcccagcaaggccacagaaagagcctgatgtccatgatccaggtggctctgagaagcttggcctggacacctgagcctgcggccggtactcctgccttctccccatctatccccaaggcctctgcctctcagcctcttccatggtcggtttaggctgctgagttttctgtgcttccccaagaaccagtgggatcaatgccggcggcctctgtgatggttgctgactaatccgggatttcatgagtcagaggcaccacccctcaccccagctgcctgctgcttctgacggatcttggtgctcaggctgcctggctctccgagtgaggacgcagcctccatatttggtgcactcaggcatggctgggacaagccagctgccccagggttcttcccctggtgattctcgcctgctttctcatctcaggggaggcagtggcacctccctctccctgctgacatgaagagagctatgatatgccactgctgccaactcatcctctgcccccacctcgaaacccacagtccccagtggagggccactactcatccccattggtttcccaggggaggggtgttgtctggaagggcaggttcagatgcagccttccagatttagaggcactgggaggacagtggctgagtggaggcgcccagacctgggcaggcagcaggctcaggcccacaccttgtgatttttgaaaccaaagcccagaagatgatgtttacttctctctccctggctctgcccttcttactgcaaaccatgctgtgccttagggcccttctcatagctgttcctcatggccatgactggaacagggatgcaacctctttctacacaagcacagttagttgggtgaagtctttttttttgtttgttttagacggagtttcactcttgttgcccaggctggagtgaagtggcgtgaccttggctcactgcaacctccaggccagcctcagcctccctagtagctgggactacaggcacccactaccacgcctggctaattctttgtatttttagtagagatggggtttgaccgtgttagccaggatggtctcgatctcctgacctcgtgatccacccacctcggcctcccaaagtgctgggattataggtgtgagccaccgcgccgggccggttgctggcatcttaatgttctgtaggtggaatatttccaataaacacaaggtgccgtaattgac

SEQ ID NO: 8082 - DNA, 3365 bp, Homo sapiens
cgagtgccgacttgacagacggcagcggcgacatggcttcggagcaggacgtgcgcgcccggctgcagcgcgctggccaggagcacctcctgcgcttctgggccgagctggcgccggagccacgagccgcgctgctggcggagctggcgctgctggagcccgaggcgctgcgcgagcactgccggcgggcggcggaggcctgcgcgcgcccccacggcccgccgcccgacttggccgcgcgcctgcggcccctgcccccagagcgcgtgggcagggccagccgcagcgaccccgagacacggcggcgctgggaggaggaaggtttccgtcagatttctctgaacaaggtggccgtcctgctgctggctggggggcagggcactcgcctgggcgtgacctaccccaagggtatgtaccgtgtggggctgcccagccggaagaccctgtaccagctgcaggcggagcggattcggcgggtggagcagctggccggtgagcgccacgggacccgctgcaccgtcccctggtacgtcatgaccagcgagttcactctggggcccacggccgagttcttcagggagcacaacttcttccacctggaccccgccaacgtggtcatgtttgagcagcgcctgctgcctgctgtgacctttgatggcaaggttatcctggagcggaaagacaaagttgccatggccccagacggcaacgggggcctctactgcgcgctggaggaccacaagatcctggaggacatggagcgccggggagtggagtttgtgcacgtgtactgtgtggacaacatcctggtgcggctggcggaccctgtcttcatcggcttctgtgtgttgcagggcgcagactgtggcgccaaggtggtggaaaaggcataccccgaggagcccgtgggcgtggtgtgccaggtggacggtgtcccccaggtggtggagtacagcgagatcagtcctgagaccgcacagctacgtgcctccgacgggagcctgctgtacaatgcaggcaacatctgcaaccacttcttcacccgaggcttccttaaggcggtcaccagggagtttgagcctttgctgaagccacacgtggctgtgaagaaggtcccgtatgtggatgaggaggggaatctggtaaagccgctaaaaccgaacgggataaagatggagaagtttgtgtttgatgtgttccggtttgctaagaactttgctgccttggaagtgctgcgggaggaggaattttccccactgaagaacgcagagccagccgacagggacagtccccgcaccgctcgccaggccctgctcacccagcactaccggtgggctctgcgggccggggcccgcttcctggatgcccatggggcctggctcccagagctgcccagcttgcccccaaatggagaccctccggccatctgtgagatatcgcccttggtgtcttactctggagagggtttagaagtgtacctgcaaggccgggagttccagtccccgctcatcctggatgaagaccaggccagggagccgcagctgcaggagtcctgacccgcccagactgtccccagactcccccgagacctgccagccccggcatcctggaagtcccgactccccccagacctgccagccccggcgtcctggagctgggggctacagcccagcctgagctctgggtgggaaagcagcctgccccatgcttccagcctgcagaacacagaatgaaacatgctggtagactccacgagggcagggcctctcctgtcgcctctggacacaagtggcgacagcctgctgggggctctgtggctccattcctggctgtggggtctagtcaagaggcagagggacttgggacctgggagaatggggctgagaggaggcttcgggttggggcccaagggaggtgtggtgtcatctggggagaacaggagggcatgtccctttgggagcccgccttgtggatccaccacaccccaccgagcactagaagctgcataagctacacaggatgtgcttctgcagcctacagatgcagaaccagaatgagggggacaattccacccactcgagggctgccccctcttccttagcagacgaaccagtaatgggggcaaggctggggcatcccagcccacacaccctggatgcccagcaaggccacagaaagagcctgatgtccatgatccaggtggctctgagaagcttggcctggacacctgagcctgcggccggtactcctgccttctccccatctatccccaaggcctctgcctctcagcctcttccatggtcggtttaggctgctgagttttctgtgcttccccaagaaccagtgggatcaatgccggcggcctctgtgatggttgctgactaatccgggatttcatgagtcagaggcaccacccctcaccccagctgcctgctgcttctgacggatcttggtgctcaggctgcctggctctccgagtgaggacgcagcctccatatttggtgcactcaggcatggctgggacaagccagctgccccagggttcttcccctggtgattctcgcctgctttctcatctcaggggaggcagtggcacctccctctccctgctgacatgaagagagctatgatatgccactgctgccaactcatcctctgcccccacctcgaaacccacagtccccagtggagggccactactcatccccattggtttcccaggggaggggtgttgtctggaagggcaggttcagatgcagccttccagatttagaggcactgggaggacagtggctgagtggaggcgcccagacctgggcaggcagcaggctcaggcccacaccttgtgatttttgaaaccaaagcccagaagatgatgtttacttctctctccctggctctgcccttcttactgcaaaccatgctgtgccttagggcccttctcatagctgttcctcatggccatgactggaacagggatgcaacctctttctacacaagcacagttagttgggtgaagtctttttttttgtttgttttagacggagtttcactcttgttgcccaggctggagtgaagtggcgtgaccttggctcactgcaacctccaggccagcctcagcctccctagtagctgggactacaggcacccactaccacgcctggctaattctttgtatttttagtagagatggggtttgaccgtgttagccaggatggtctcgatctcctgacctcgtgatccacccacctcggcctcccaaagtgctgggattataggtgtgagccaccgcgccgggccggttgctggcatcttaatgttctgtaggtggaatatttccaataaacacaaggtgccgtaattga

SEQ ID NO: 8083 - DNA, 9570 bp, Homo sapiens
atcgtggcggagcgccaggcgcccaaagaggggcgagaaagcgccatggcggcggcggcggctgtgtccggtgctcacgccgcggcgaggtgaggggaccgcctcttctccacaactgaggaggccacagctgccggcccacccgccttccacgcgggccgcggctccggcatggccgggatcattaagaagcagatcctgaaacacctgtcccggttcactaagaatctttccccagacaaaatcaacctgagcaccctgaaaggggagggtcagctgaccaacctggagctggatgaagaggttctacagaatgtactggagctgcccacctggttagccatcactcgggtctactgcaacagggcctccatccggatccagtggacaaagttgaagacacaccctatttgcttgtgtctggataaggtagaggtggagatgaagacatgtgaggatcctcggccccccaatggacagtctcccattgcccttgcttcaggacagagtgaatatggctttgccgaaaaggtggtggaagggatgttcatcattgtcaattctatcaccatcaagattcactccaaggccttccacgcttcttttgaattgtggcagctccagggctatagtgtcaaccccaactggcagcagagtgaccttcgccttacccgcatcactgacccctgccgaggagaggttttaacatttaaggaaataacttggcaaacactccgaattgaggcagatgctacagacaatggtgatcaggacccagtcaccactccattgaggcttattacgaaccaaggcaggatccaaatagccctcaaaagaagaaccaaagattgcaatgtgatatcctccaagctgatgttcctgttggatgacctgctctgggtgctgactgactcacagctcaaggctatgatgaagtatgcagagtcactgagtgaagccatggagaagtcagcccatcaaagaaagagcctggcccctgaacctgtgcagatcactccaccagcccccagtgcccagcagtcctgggcccaggcatttggtggcagccagggcaacagcaacagcagcagcagccgcctcagccagtactttgagaaatttgatgtgaaagagtcctcctaccatctgctcatctcccgcctggacctgcacatttgtgatgatagccagtcccgagagccaggtgtctctgccaacagactcatgggtggtgccatgcagcttaccttccgcaagatggcgtttgactattaccctttccattgggcaggtgatagctgcaaacattgggtacgccactgtgaggccatggagacccgaggccagtgggcccagaagctggtgatggaatttcagagcaaaatggagaagtggcatgaagagacgggtctgaaaccaccctggcaccttggagtagactctctctttcggagaaaagcagattctctttccagtcctcgaaagaaccctcttgagagaagcccctctcagggcagacagcctgcctttcagcctccagcatggaaccgcttacgctctagctgcatggtggtacgggtggatgacctggacatccaccaggtttccaccgctggacagccaagtaaaaagccatctacactcctttcctgcagtcggaaacttcacaacctccctacccaggtctctgccattcatattgagttcacagagtattacttcccagataatcaggagcttccagttccttgtcctaatctctacattcagttaaatggtctgacatttactatggatcctgtcagtttgctctggggaaacctcttttgcctggatttataccgcagcttggagcagttcaaagctatctacaagctggaagattcaagtcagaaagatgaacacttggacatccgactagatgcattctggttgaaggtgagctttccactggaaaagagagagcgggcagagttgcatcgtccccaggcccttgtcttctctgcgtcaggcatgattgccaccaatacacgtcatgctccacattgtagttgttcagacctccagagtctcttccggggttttgctgctgctgagttctttcattccaattatgatcactttcctaaggttccaggtggctttagccttctgcacatgctttttttgcatcatgcctttcagatggattcctgcctgcctcagcctaataccctccctccccagagacctaaggcttcctgggatctctggtctgtccactttacccagatctccttggactttgagggaacagaaaacttcaaaggccataccttgaattttgtagcccccttccccctgtccatttgggcctgcctacccctccgctggcagcaagcccaggcacggaagcttcttttggcctcagaggggaggctgaaaccatcagccagttttggaagtcctgtccagtctgaggctcttgcccctgactctatgtcccatccgcggtcaaagactgaacatgacttgaaaagcttatcaggacttacagaagtcatggaaattctgaaagaaggcagtagtggtatggacaacaaagggcctctgacagagctggaggatgtagcagatgttcatatgcttgtacattccccggcccatgtccgcgtgaggcttgaccactaccagtacttggctctgcttcgcctgaaggaggtgctgcagaggcttcaggagcagctgactaaggatacagagtcaatgactgggtctcccctgcagaatcagacagcttgcattggagttctctttcccagtgctgaagtggctctgcttatgcatcctgcacccggtgctgtcgatgctgactctgcaggctcagatagcactagcctcgtagattcagagctatctccttcagaggatcgggaactgaagtctgatgcctcatcagaccagggcccagcaagccctgagaaggtcttggaggaaagtagcattgaaaatcaggatgtatcccaggagaggccacatagcaatggagaactgcaggactcaggtccacttgcccagcagctggcagggaagggccatgaggcagtagagtccctacaggccaagaaactgagcagaacccaagcctccagctcaccagctgcattgaagcccccagctggcagggagactgctgtgaatggacagggtgagctcatccccttgaagaacattgagggagaattgtcaagtgctattcacatgaccaaggatgccaccaaggaggctctacatgccaccatggacctcaccaaggaagctgtgtccctgactaaggatgccttcagtttgggcagagatcgaatgacctccaccatgcacaagatgttgtccctgcccccagccaaggagcccatggccaagacagatgagggggtggcagccccagtgagtggaggtgctgcacgactccgatttttctccatgaagaggacggtatctcaacagtcatttgatggtgtctcattggatagcagtggccctgaagaccggatttcagtggacagtgatggcagtgatagctttgtgatgctcttggagtctgagtctggtccagaatctgttccaccaggatctctttcaaatgtctcagataatgctggtgttcaagggagccctcttgtgaataattatggccaggggtcaccagcagccaacagttcagtttcacccagtggagaagacctcatctttcacccggtctcagttctggtcctgaaggtgaatgaggtgtcttttgggattgaggtacgtggtgaggacctgactgtggccctgcaagcagaggaactgaccctccagcagctgggcaccgtgggactctggcagttcctgcatggacagtgcccaggtacatgctttcaggaatcctcaactttgaagactggccacatcaggccagctgtgggccttcgctttgaggtggggcctggagcagctgttcattcccccctggcctcacaaaatggcttcctacatttattgcttcatggctgtgacctcgagctgctcacttcagtgctcagtggcctggggcccttcttggaggatgaggagatcccggtggtagtccccatgcagattgagcttctgaactccagcatcaccctaaaggatgatatcccccccatctatccaacatctccaggccccatccccatcactctggccatggaacatgttgtgctgaagaggagtgatgatggtgtgttccacataggcgctgctgctcaggacaaaccatcagctgaagtacttaaaagtgagaagagacagcccccaaaagaacaggtgtttttggtgcccacaggagaggtttttgaacagcaggtgaaagaactgcctatcctacaaaaagaacttatagaaactaaacaagccttggccaatgccaaccaggataaagaaaaacttcttcaggagattaggaaatataaccccttctttgagctctgaaaccagtggctcagccatctgtgccaaggagagaggctatcaccagcaatagcaccacctaggacagagggcactgtccagtgctgaataagtcactacggatgccagagggactggggagcactcacttcacttgtgtgggtgtgctttccactagctgttcttacttggactgaggacaagggcaaagcatgattgtatcccaggaaactggggcttgccctgtgtgtggcacaagcatcatgtcttgcctgtataaagccttttggtcctctgtgtactaggtggaatcttctcaacactgtagggccatttcacctcatggtttcatggcagggacatttgcttccttcacaggcctgtgtgaacaagcaaaagtacccacctcctcggtcacccacagagccaccaaagattccatgtcccagagcttcccatagcagacctgaaaagtccatgacctgagctttggccatggtagtggagtggaacaggaaatagtccagcagaggagtgtgggggaagggggcaggagaggcacaagaataagggagacctggactctgcctttttgggaaaaggaaccaagctcatagcaatttggctgataacacaatcagatttttccaggttaagcttcctttctgttatactttcatcattgtgatgctgtggtagaaagtaaataacagtagtggctcagtcatttaatctttcccctctataatacaacttacttgaaatttaaatcaagaaaaaatttctgacgctgagctaggttggtggcatgatatgccaggggtcagtgggggagcttgcttctgagccccctgttgtccgcctggagtcctgcttgtctttcccagctgtgctgagtggctcttctgtctccctggggtccctggcacatctgctttcccagctctgtgaccttaccagttctctcctcagcccttggtggtttgggagctgaatatatgttttaaacttttacataaacaactcaacctgttgcctctcacttccctccatcactgtggcttttaaaactcatgtattttgactcaagtgaaaaaaacacaaaaatccctcatcccagctaggttttgccccctgccctataagagagctatttccccctttctttcctttgaattcttctccaacaccatcccttcattcatactgccctgtgatacacttgaagctgtgttgattggacagacgttcatcagctaacttacctttacttggcaagatggtaaaatagtaacttagtgatgttactaaagtctcgaccattcacctttccatactgaaggaaaggtaaaaaggtttcttctatgggaaattatgcttgacttgcatactctagtttgatgaggataaaaagaaacatgtaattgcagtggtgtttacaactaattgatcacaaccaatcatagatttctttgttccttctccactctcaacacttcatttgactagaaaaaaaaaatgtattcaccaaggaacaggacccaatttgttcagacttttgttaagtttctttactaaggcaatttttgaaacaccagttactatgggatggtgggaatttttcatgcttaagaaatagagacttaggaacaaagaaacatctttctggagaagatgctaatgggaagttacctaaggcttgatgcttggttcaaccttatttaaaatttttataaatgacctgaaagtaggattttacagtgaaatcaaatgtcactacttccaggcagtgaaaggtaatctagaagaggtttaaaaaacacaaaaccggtcgggcacagcggctcacgcctgtaatcccagcactttgggaggccgaggcggggagatcacgagttcaggagatcgagaccatcctggccaacatggtgaaactttgtttccactaaaaatacaaaaattagctgggtgtggtggtgggtgcctgtagttccagccactcgggaggctgaagcaggagaatcgcttgaacccgggaggcagaggttgcagtgagccgagatagcgccattgcactccagcctgtcaacagagtgagactccgtctcacaacaaacaaacaaacacaaaaccacagaagggttactaataagcagggctgagaatactcagaaaactgacaggtgaggttcaacataatataaggaaatgtatttatggaagaattatcaactgatatgcctgaacactgttagaactcaggaaagaaacaagcattgctgagggggaggagagatcaatgtgctgctgtggccaaaagcctaattgccctgtgggcatcatcaggaagggcttttggagataacagagaacagcactttatacaaaaccatggatatgtcttgatcggattatctgtgtttctagtgaccttatttacaagatatatgataaagggaggaaaggtccagagaacagccaaaattatcaggggatggaggtatatccatatgaggacacatttttaaaatatagactctatcctgcaaagatgaaagcagaggggagttagatcaaatatccaatcaagagcaaggacccggtcctgtactactagctctagggctctatctcatagccttagtaaagaaagcacttctcatagcaaatcagaaatgtaaggagctcattgtctaagaagggatgccaccagaaactatacatgggtgcaggtttatgaggaatccttgcatgacggccttctacaaggaattatagaaaagtagggctacttggtaatatacaactgagagggtaactgtgtccctcaacaaactactccttagtgcctctttcaaaggcagaatgttgatctgaatggatcactggtcaagtatggcatctctaatgttcttgaagggggaggaaggagatctggtagctggaaaatataattattccacgttaggctcacctgaattggtttaaaatcatattctgattctcttctcatcccttcctcccctcacccaccatatacctctggcatccctccatgcaaagaaatgtcgaataggcatttcttggtataatttacctacacttgtgcttgtggggtgggagtaaaaacatatccagtaagtaccaaggctaacctcctaatggctggagctcagttaggtctctgggctctctaaaggagtccagagctcttgtccatgtcacaaatggagccttagaatttctgtctttccttatgtggcagctttggccattgtgtcttgaaattctccctcaggaaatgtgataggggatattatcccatgggattttagtaaaaatcagcttgcctaatttcatattcgtgttcataatgaagaaatgcgaagtggtggtagtcctcaggattaagtgtaaaggaaaatatgcaaggaaaaagtagcagtgtcagcccttttggactgcttatgatttctgccttagagctacaagacttggaacaagaaataacaatacctcaagaaaatgtctggagagatagcaccactgtccctcaaagacttcagccactgcacattaccaattcagctgtgaagcatttacaactgtattatctgtgattgtctgcatttcctgtttacatgcatgtgctggggatatgctttagtgtgtatggactagagtttaaatcctgtctttaactgggctgcaaggatggctatcaatcccaaattctgttttcaactcactggaataattaatctggtgttcctgatataaaacaggtgggttctattcacatgatggctgctctttaccatatatttcacctgaccctcattttgccatgggcctcaacctttatgtgtgctttttatggctctgaaaggactggctcccgtgtgtggaatatacaaggtataaacaccacccctcacatacccctgtaacttaaatgcttccatttaactcacttagattactttccccttagtggtaaacgggttgggggatgggtggtagtgcaaagaaggtagtttgaaatattgccatagtaatatgggaactttttattccaaccctttaccctggcttttttttctctcaatatttgcctaaaattctaaaatgagttatagtaaaatcataaaactatggaaacaactgaactttggtacacaagttagttcgatgacatcttgttatttgagaacagtaaaaggtgtgtcattgcctcatgatttatcatagtcattactaagggtttcagagagaatctggtgtgaagcactatcctttcagacactaaggcctttacctagttgctcccctaccttctgtcggaataggattattcccatgcacctctgggtaggtataggtagtagctattgaacggggattattttccccatggcacaaggggaaacactcttggataaccttcaacaatgaggctttgctaagtggccagacttgggatttgatcttcctcacttgttatttattaagtttaagccttattcagtatctctaattgcaatagatatagttcctgtgacttctaaaaaaaattcctgttaatgctgagacagtatcttttttgtcagtttattaatttttggtcaagatttagcctgagtcttaaagcatttatttgtggaatgccccactgaagtgtcttctccattggctaagtacatgtttaaagccatgggttttaatgtaagatactttcagtatctaattctgtttcccccactgagggtgctaaagagaattagaatctttactaagacatgctcaggaaagcttcacgagagaacagcttcaaaatcctccctatgacactgaatggtagtgaggaaagaattcttggggatgccagttacatacaatagccttattactgctaatcactgtcaataaaaggtcacttcattcacctctatttgaggaaaacaatgagaatgtatctgatgaactagaatccttgtcagtattgggaaattttaatgttgcaatatctagtcaaactttgagtgtactggttctgtgaaccacctgaaaaaacaaattaaatgtattaaaccataa

SEQ ID NO: 8084 - DNA, 4535 bp, Homo sapiens
ctccacaactgaggaggccacagctgccggcccacccgccttccacgcgggccgcggctccggcatggccgggatcattaagaagcagatcctgaaacacctgtcccggttcactaagaatctttccccagacaaaatcaacctgagcaccctgaaaggggagggtcagctgaccaacctggagctggatgaagaggttctacagaatgtactggagctgcccacctggttagccatcactcgggtctactgcaacagggcctccatccggatccagtggacaaagttgaagacacaccctatttgcttgtgtctggataaggtagaggtggagatgaagacatgtgaggatcctcggccccccaatggacagtctcccattgcccttgcttcaggacagagtgaatatggctttgccgaaaaggtggtggaagggatgttcatcattgtcaattctatcaccatcaagattcactccaaggccttccacgcttcttttgaattgtggcagctccagggctatagtgtcaaccccaactggcagcagagtgaccttcgccttacccgcatcactgacccctgccgaggagaggttttaacatttaaggaaataacttggcaaacactccgaattgaggcagatgctacagacaatggtgatcaggacccagtcaccactccattgaggcttattacgaaccaaggcaggatccaaatagccctcaaaagaagaaccaaagattgcaatgtgatatcctccaagctgatgttcctgttggatgacctgctctgggtgctgactgactcacagctcaaggctatgatgaagtatgcagagtcactgagtgaagccatggagaagtcagcccatcaaagaaagagcctggcccctgaacctgtgcagatcactccaccagcccccagtgcccagcagtcctgggcccaggcatttggtggcagccagggcaacagcaacagcagcagcagccgcctcagccagtactttgagaaatttgatgtgaaagagtcctcctaccatctgctcatctcccgcctggacctgcacatttgtgatgatagccagtcccgagagccaggtgtctctgccaacagactcatgggtggtgccatgcagcttaccttccgcaagatggcgtttgactattaccctttccattgggcaggtgatagctgcaaacattgggtacgccactgtgaggccatggagacccgaggccagtgggcccagaagctggtgatggaatttcagagcaaaatggagaagtggcatgaagagacgggtctgaaaccaccctggcaccttggagtagactctctctttcggagaaaagcagattctctttccagtcctcgaaagaaccctcttgagagaagcccctctcagggcagacagcctgcctttcagcctccagcatggaaccgcttacgctctagctgcatggtggtacgggtggatgacctggacatccaccaggtttccaccgctggacagccaagtaaaaagccatctacactcctttcctgcagtcggaaacttcacaacctccctacccaggtctctgccattcatattgagttcacagagtattacttcccagataatcaggagcttccagttccttgtcctaatctctacattcagttaaatggtctgacatttactatggatcctgtcagtttgctctggggaaacctcttttgcctggatttataccgcagcttggagcagttcaaagctatctacaagctggaagattcaagtcagaaagatgaacacttggacatccgactagatgcattctggttgaaggtgagctttccactggaaaagagagagcgggcagagttgcatcgtccccaggcccttgtcttctctgcgtcaggcatgattgccaccaatacacgtcatgctccacattgtagttgttcagacctccagagtctcttccggggttttgctgctgctgagttctttcattccaattatgatcactttcctaaggttccaggtggctttagccttctgcacatgctttttttgcatcatgcctttcagatggattcctgcctgcctcagcctaataccctccctccccagagacctaaggcttcctgggatctctggtctgtccactttacccagatctccttggactttgagggaacagaaaacttcaaaggccataccttgaattttgtagcccccttccccctgtccatttgggcctgcctacccctccgctggcagcaagcccaggcacggaagcttcttttggcctcagaggggaggctgaaaccatcagccagttttggaagtcctgtccagtctgaggctcttgcccctgactctatgtcccatccgcggtcaaagactgaacatgacttgaaaagcttatcaggacttacagaagtcatggaaattctgaaagaaggcagtagtggtatggacaacaaagggcctctgacagagctggaggatgtagcagatgttcatatgcttgtacattccccggcccatgtccgcgtgaggcttgaccactaccagtacttggctctgcttcgcctgaaggaggtgctgcagaggcttcaggagcagctgactaaggatacagagtcaatgactgggtctcccctgcagaatcagacagcttgcattggagttctctttcccagtgctgaagtggctctgcttatgcatcctgcacccggtgctgtcgatgctgactctgcaggctcagatagcactagcctcgtagattcagagctatctccttcagaggatcgggaactgaagtctgatgcctcatcagaccagggcccagcaagccctgagaaggtcttggaggaaagtagcattgaaaatcaggatgtatcccaggagaggccacatagcaatggagaactgcaggactcaggtccacttgcccagcagctggcagggaagggccatgaggcagtagagtccctacaggccaagaaactgagcagaacccaagcctccagctcaccagctgcattgaagcccccagctggcagggagactgctgtgaatggacagggtgagctcatccccttgaagaacattgagggagaattgtcaagtgctattcacatgaccaaggatgccaccaaggaggctctacatgccaccatggacctcaccaaggaagctgtgtccctgactaaggatgccttcagtttgggcagagatcgaatgacctccaccatgcacaagatgttgtccctgcccccagccaaggagcccatggccaagacagatgagggggtggcagccccagtgagtggaggtgctgcacgactccgatttttctccatgaagaggacggtatctcaacagtcatttgatggtgtctcattggatagcagtggccctgaagaccggatttcagtggacagtgatggcagtgatagctttgtgatgctcttggagtctgagtctggtccagaatctgttccaccaggatctctttcaaatgtctcagataatgctggtgttcaagggagccctcttgtgaataattatggccaggggtcaccagcagccaacagttcagtttcacccagtggagaagacctcatctttcacccggtctcagttctggtcctgaaggtgaatgaggtgtcttttgggattgaggtacgtggtgaggacctgactgtggccctgcaagcagaggaactgaccctccagcagctgggcaccgtgggactctggcagttcctgcatggacagtgcccaggtacatgctttcaggaatcctcaactttgaagactggccacatcaggccagctgtgggccttcgctttgaggtggggcctggagcagctgttcattcccccctggcctcacaaaatggcttcctacatttattgcttcatggctgtgacctcgagctgctcacttcagtgctcagtggcctggggcccttcttggaggatgaggagatcccggtggtagtccccatgcagattgagcttctgaactccagcatcaccctaaaggatgatatcccccccatctatccaacatctccaggccccatccccatcactctggccatggaacatgttgtgctgaagaggagtgatgatggtgtgttccacataggcgctgctgctcaggacaaaccatcagctgaagtacttaaaagtgagaagagacagcccccaaaagaacaggtgtttttggtgcccacaggagaggtttttgaacagcagacatagcaataacaacattctgagacacagaggtgccagtgatggactggatcagcttgaaagaagcacaaagactccgtgatcacaatagtcaaagactggctttggaacacagtaccaagtaattcacagaaaaagttttttggctgcaggattaagtaatgatgagtcttccctttcaactgttgttaaatctgagacatcctgactctcgagctgggaagatgaaagaaactctattatatatttggcctactttccaggcttgggcaaa

SEQ ID NO: 8085 - DNA, 5168 bp, Homo sapiens
agatggcgcccgcggcggccgtggcggcctgagcgtgatgctccgggttctcggcggcggctgtggccttggccggggccttgggtctctcccggtcgtgagcgatcagcgcctctccgccggccgggctagccgggacagagaggagacggccacgaagagaggaggcagtgagcaacaggacgagaccgcggcgtctccagcctcggtaccatggccgggatcatcaagaaacaaatcttgaagcacctctccagatttaccaaaaatttatctcctgacaagataaatctaagtacccttaaaggagaaggtgaactgaagaatttggagttggatgaagaagtactccagaatatgttggatttgccaacatggcttgctatcaacaaagttttttgtaataaagcgtccattaggatcccatggacaaaactgaaaacacatcccatctgtttgtccctggataaagtaataatggaaatgagtacatgtgaagaaccaagaagccctaatggcccatcaccaattgcaactgcttcaggacaaagtgaatacggctttgctgaaaaagtagttgagggaatttctgtttctgtaaattctatagtcatcagaattggagcaaaagccttcaatgcatcatttgaactttctcagcttcggatctatagtgtaaatgcacactgggaacatggagatttgagatttactcgtattcaggatccacagagaggagaggttttgacttttaaagaaataaattggcagatgataagaatagaggcagatgccacccaaagttcacatcttgaaattatgtgtgctcctgttcgattaataaccaaccaatcaaaaatcagagtcacacttaaaagaaggttaaaggactgcaatgtcatagcaacaaagttagttctaatattggatgacttattatgggttttgactgattcccagttgaaagctatggtacaatatgcaaagtctcttagtgaagcaatagaaaaatcaacagaacaaaggaagagtatggctcctgaacctacacagagctctacagtagtcgcatctgcccagcaagtgaagacaacgcaaacttcaaatgctcctgatgtaaatgatgcaattgtgaaactattcaatgattttgatgttaaggaaacctcccatcatttagtgatttctcatctagatctacacatatgtgatgacattcatgctaaagaaaaagagtcaaacagacgtattactggaggggcaatgcaactctcttttacacagctaactatagattattatccttatcataaagcaggagatagttgtaatcattggatgtattttagtgatgcaaccaaaacaaaaaatggatgggccaatgagttattgcatgaatttgagtgcaacgttgaaatgcttaaacaggctgtgaaggatcataatgtaggttcacctcctaaatccccaacacatgcctctccccagcacacacaaacagagaaggactaccctctgaaagggacatgcagaacaccttcagtattatctcaacaatcaaaagctaagctaatgtctagttctgttgtggttagacttgcagatttcaatatataccaggtctctacagcggaacaatgtcgttcttcccccaaaagcatgatttgctgcaataaaaaatccctatatcttccacaagaaatgtcagctgtctatatagaattcacagaatattactatccagatggaaaggattttccaattccatctcccaacctctatagccagctgaatgcactacagtttactgtggatgaaagaagcattctatggttaaatcaatttctgttggatttaaaacagagtcttaatcagttcatggctgtgtacaagttgaatgacaattcaaaatctgacgagcatgttgatgttcgagttgatggcttaatgctaaagtttgtcattccttctgaagtgaaatctgaatgtcatcaagatcagccacgtgcaatttctattcagagttctgaaatgattgccacaaatacaaggcactgtccaaactgtcgacattctgacctagaagctttgtttcaagactttaaagattgtgatttttttagtaaaacatataccagcttccccaaatcttgtgacaattttaatcttctacatccaattttccagagacatgctcatgaacaagataccaaaatgcatgaaatttataaaggaaatattactccccaattgaataaaaacactcttaaaacttctgctgccacggatgtttgggctgtgtacttttctcaattttggatagattatgaagggatgaaaagtggaaaaggacggccaataagttttgtagactcattccctctttccatttggatttgtcaaccaacaagatatgcagagtcacaaaaagagccgcagacttgtaatcaggtatctctaaatacatcacaaagtgaatctagtgatctggctggccgattgaagcggaagaagctcttgaaggagtattatagtacagagtctgagcctttgacaaatggtggtcagaagccttcttcatcagatacatttttcagattttccccttcctcgtcagaggcagatattcatctcctagttcatgttcataaacatgtcagtatgcagattaatcactaccagtatctgcttctacttttcctgcatgagtcacttatcctgctttcagagaacttaaggaaagatgtagaagctgtaactggcagtcctgctagtcagacatccatttgtattggaattttacttagaagtgcagaactggctcttttgctccatccagtggatcaagcaaatactcttaagtctcctgtttctgaaagtgtgagcccagtggtacctgattatttgcctacagaaaatggggattttttgtcttcaaaaagaaaacaaattagtagggatataaatagaattagaagtgtaactgttaatcatatgtcagacaacagatctatgagtgttgaccttagccatatccctttaaaggatcctttgctttttaaatcagctagtgatacaaatctgcaaaaaggcatttcttttatggactatttatcagataaacatttagggaaaataagtgaagatgaaagtagtggacttgtttacaaaagtggctcaggagaaattggatcagaaacaagtgacaaaaaggattcattttatacagattcaagtagtatcttaaactacagagaagattcgaatatactttcatttgatagtgatggtaatcaaaacatactttcaagtactttaactagtaaaggaaatgaaaccatagagtccatctttaaagctgaagatttgcttccagaagcagcttcactctctgaaaacctggatatcagtaaagaagagacccccccagttagaacacttaaatcacagtcatctttaagtggaaagcctaaggaacgttgcccacccaacctggctcctctctgtgtttcttataagaatatgaaaagaagctcttcacaaatgtcattggataccatttcacttgacagcatgatattggaagaacagttattagaaagtgatggaagtgatagccatatgtttttggaaaaaggaaataaaaagaactcaactacaaattacaggggcacagcagaaagtgtgaatgctggtgcaaacctacagaattatggtgaaacttctccagatgccatcagtacaaattcagagggtgctcaggaaaatcatgatgacctgatgtccgttgtggtatttaaaattactggtgttaatggggaaattgacatccgaggggaagatacagaaatctgtcttcaagtgaaccaggtgacaccagaccaattaggcaatatcagccttcggcattacctttgtaatcgtccagttggttccgatcagaaagctgtaattcattccaaatcctctcctgagatttctctgagatttgaaagtgggcctggtgctgtaatacactctttacttgcagaaaaaaatggatttctgcagtgccacatagaaaacttcagcactgagtttcttacatcttctcttatgaatattcaacattttttggaagatgaaactgttgcaacagtaatgccaatgaagatacaagtttctaacacgaaaataaatttaaaagatgatagtccccggagtagtacagtatcccttgaaccagctcctgtaactgtacatattgatcatcttgtggtagagagaagtgacgatggctcttttcatatcagagattctcacatgcttaacactggaaatgatttgaaagaaaatgtcaaaagcgattcagtgctgctgaccagtggaaagtatgatctgaagaaacaacgcagtgtcacgcaagccactcagacaagcccaggggttccttggccttctcagtcagctaactttcctgagttctcctttgacttcactagggaacagctcatggaagagaatgaatctcttaaacaggaactggctaaagctaaaatggctcttgcagaggctcacttggaaaaagatgctcttcttcatcatataaagaagatgacagttgaatagcaggagtggcagtcaaaactgaaattatagctctggagtaggaaggttatatttataatgtggatgttaccagttaggggaagacttttattttcatgaaaagacaataaaacaaaatggaatgtgatgaagtggtgactatttcaaagccagtttagaaagtattagtacgggcattacaatcttttggttgttttgtgttttggggcttaaccctcttttaagctgttgtgatctagggaagtcaacacatagtgtaaaataattacatgcctaatgaaaagaagatgtcatttcctaattttgatatctcattttcggcattttttaaaatgtaaaaggaaaacctcttgtgttcacacagattgctgaattgatttctccatatttgttaataatttactattatttacaaagattcaaatgcttttatgactaatgtaaaatgaaaagaggcttacattttaaatgttattaaaattatgtacttaaatctataattatttaattattgtaaaaagtccaagcagatcaataaactatataattaatgggtttgg

SEQ ID NO: 8086 - DNA, 2023 bp, Homo sapiens
gatggcgcccgcggcggccgtggcggcctgagcgtgatgctccgggttctcggcggcggctgtggccttggccggggccttgggtctctcccggtcgtgagcgatcagcgcctctccgccggccgggctagccgggacagagaggagacggccacgaagagaggaggcagtgagcaacaggacgagaccgcggcgtctccagcctcggtaccatggccgggatcatcaagaaacaaatcttgaagcacctctccagatttaccaaaaatttatctcctgacaagataaatctaagtacccttaaaggagaaggtgaactgaagaatttggagttggatgaagaagtactccagaatatgttggatttgccaacatggcttgctatcaacaaagttttttgtaataaagcgtccattaggatcccatggacaaaactgaaaacacatcccatctgtttgtccctggataaagtaataatggaaatgagtacatgtgaagaaccaagaagccctaatggcccatcaccaattgcaactgcttcaggacaaagtgaatacggctttgctgaaaaagtagttgagggaatttctgtttctgtaaattctatagtcatcagaattggagcaaaagccttcaatgcatcatttgaactttctcagcttcggatctatagtgtaaatgcacactgggaacatggagatttgagatttactcgtattcaggatccacagagaggagaggttttgacttttaaagaaataaattggcagatgataagaatagaggcagatgccacccaaagttcacatcttgaaattatgtgtgctcctgttcgattaataaccaaccaatcaaaaatcagagtcacacttaaaagaaggttaaaggactgcaatgtcatagcaacaaagttagttctaatattggatgacttattatgggttttgactgattcccagttgaaagctatggtacaatatgcaaagtctcttagtgaagcaatagaaaaatcaacagaacaaaggaagagtatggctcctgaacctacacagagctctacagtagtcgcatctgcccagcaagtgaagacaacgcaaacttcaaatgctcctgatgtaaatgatgcaattgtgaaactattcaatgattttgatgttaaggaaacctcccatcatttagtgatttctcatctagatctacacatatgtgatgacattcatgctaaagaaaaagagtcaaacagacgtattactggaggggcaatgcaactctcttttacacagctaactatagattattatccttatcataaagcaggagatagttgtaatcattggatgtattttagtgatgcaaccaaaacaaaaaatggatgggccaatgagttattgcatgaatttgagtgcaacgttgaaatgcttaaacaggctgtgaaggatcataatgtaggttcacctcctaaatccccaacacatgcctctccccagcacacacaaacagagaaggactaccctctgaaagggacatgcagaacaccttcagtattatctcaacaatcaaaagctaagctaatgtctagttctgttgtggttagacttgcagatttcaatatataccaggtctctacagcggaacaatgtcgttcttcccccaaaagcatgatttgctgcaataaaaaatccctatatcttccacaagaaatgtcagctgtctatatagaattcacagaatattactatccagatggaaaggattttccaactgccttcctaagcagatgagaaaactcaagatagatgaaggaagacatctgctctgcatctcatagggagtaaaatggcacagttgaaactcaagcattgtcttgtaaatctaaattcattgttttttctccactgtattacactgctcccctttgcccctgtattcaccacggccattgtctgttattgcataatcatagtattccagccatgcccccataattgtttttcttaaataaaatatatcattgaacaagtaa

SEQ ID NO: 8087 - DNA, 4404 bp, Homo sapiens
accgcgctgtggaggcggcggccatcttggcggcggagcgatgagcgggtctaacccgaaggctgcggccgcggcgtcggcggctgggcccggggggctggtggctggcaaggaggagaagaagaaggcgggcggcggcgtcctgaaccgcctgaaggcgcggcggcaggcgccccaccacgcggccgacgacggcgtcggggcagcggtcacggagcaggagctgctggcgctggacaccatccggcccgagcacgtcctgcgcctcagccgggtcaccgagaattatttatgtaaacccgaagacaacatctacagtattgatttcacccgcttcaaaattcgagatttggagacagggacagtactttttgagattgccaaaccttgcgtttcagaccaggaggaggatgaggaggagggaggtggagacgtggacatcagcgcaggacgttttgtccgctatcagttcacaccggcatttctccgcctccggacagtcggggctacggtggagttcacagtgggagacaaacctgtttcaaacttccggatgatcgaacggcactatttccgggaacacttgctgaaaaactttgactttgattttggcttctgcatccccagcagtaggaacacttgtgaacatatctatgagtttccccagctttcggaggatgtcattcgtctaatgattgaaaatccttacgagacccgctctgacagcttctactttgttgacaacaagctgataatgcacaacaaggctgattatgcctataatggaggccagtaagtgctgcaagagtagataggggaggtgctttgccgcggccacaagatcctggcacacggagatgatcgaagctgcagtttgtcaacacacatctggaacctggccccaggaagccaaggctggggtggcagtttcctgcgcgccaaaggagctgccaaacagtgctgtgttttcttccccagtattttttcttccctttttttcctgccccgtaggttgcagaggtactatagtaaagtaaaaggttaggataagggtcctggaatccagataaaaaagtttattttccgtagttctggctgcctgttggttgtcttgacgaccaggcatagctgtgcctggtgagaaggctctggccaggcccaccagcaggtcagcagctcttaaggttcctgggtgctgtgggaagctgaaaggtaggcctcttccaggtagctcctcctctcacctccggcattgccatcagcgcagtctgccctcggtctgtgtgaagtcttaaaccaactggaagacacttgaaagggtggggagggagggaggtgccaagagtggaggcaccaaggaatgggtgatgctgccaagctgaagggtctgctttgtggagaggctgctgctctgtctgacttccagggtctcagccagccctcctgggaatagaccaagttttcagcctggcagtgccttctgttcccattttggaggacagacaagcttgctccacatctcctggctcctcccttctgagtctcatgaaatagaatgagtcagctctgctcatggaacagtagtatctcttgaggccagagcaggtcttgtattttgtttttttatttccagacttctttcggggaggttttataaaatgacagtggtgttcccagcatatgtgatatgtggttagacttctgatagtatcagcttccaggggctaatctggcttatgttgggaggatatgcttacgaatcagcagcagctttctaaaggagagatttgacttttctctgcactgcacagcctggaggattggcttttgatggggatttgcctccgaagctctttgtacatttcttgtttaggagggttttcctatctacctttctactgaagtagtttctggaactttcctggtggatcagagttacgtaatgcagtctgagccttcagactgctagttagaattgttttaggtgttcagaaagggcaaaataggctgatgtggcctgtcagagtgatgtgttctcaaaaaagttcacttgcacatctgtgggctgcttttgtcctcagacccttagtggacagactccacaaaccctctgatgagacgattgatgtggccagggtccagttagcatcagtagaaggatgtcactaggaaaggcccaggtatctggtaagtgactgtgaggtgtcacagtacctgtgacaggagagtgtcctgatgtgcttgggagaaaggccgtatgggggccagggatggaagagacagtgtgtggccacagaaattcctgtccatccaccaccagtgctgctccctgtgtgggctttagggcgagtggccccgaaccttggcccagtgctttgtcccaggccagagtcttggcaatgccacatgctggcagctttctcactgagaaggtcctagcttacccctgtgtgctggccttggattcagccccgagagaggggagagaccattcctcctgtggagtgggttccttatcaccagaccggccactctcagaactggcgtccactgtaaatccaggtgccttacgtgtggctctgtcccttatgctgcaggggaaagctgcattgccattgttcccacctcctcactggcagaaagatgccagggctgttagcactgtctcctcaccttctgtttctcattgtggctcctcaaatgggatttgcatgttcctgtcaagcgtaacaacaatcccttctctctttgacagaggcccaggtgggacagtttctactatttgatatttgagtattatctgggatgtggttctggagctgcccagagctgtgcttagtagagtgtgtcttggaaacatgcccctgggcacactgtatctgctacattagtgggctatctcttatctgcagtgttcgcttttgctagaaagaggatgtggaggaaggaggaggtgggcaatctggcttgagttgtgctgtatcctcttccttgttagcttgccttagtctcactggagaccatttgcggatagtgcttggtccatgcccagcaggacagggctttgctgcttctgaaagtctggtgttctgtatctggggctgtgggttcctgtgtctagctgctcaggaaatcttgagaagcattccactctggggtgtaaaccagtatgagtttgaaattcaagcgtttgtacctgagttggggagagaattgcaaggcatactttctctgaaagtaacagaaccattcaggctgccatgttattaaggaatctgaactgttgatagcagttaccttgtgggtgatacaatgggaggcggcaaaaaaactacctgcataggagaccctgccctttgtcaagagctgggagcacatttcatcagagtagcaggcccacctggtgccagagggcctgcccctcctgcttctgttcctttgccttgcagtctcctggagagagcctctcttttcctgtacagcctttgggccaaaatgcccttctagcttctccaaagaagatccgagtttatttcattctatgttttaagaggtaaaaggacataacaagtgaaagaagttttgggctaaagtaggctatgtctccttatgtattactcaatactgttttgcagagaaaacatttttcaagcatgtgcttcctgaagacacctcagtctttgggccatttgatttccaatacatagggtggaagaatgtgattttggggctgaccataaactggaaatttgtgaaatggcagtgattgggcaatcttcagtttattttttcagttgaagtggaactcatttctggaatggatttaataggctgtgtctaatgtacaaactgggtgagtcctgccttagtgtgtcctgccccaccggtacgcttccaggatactcttttcccctctgtaaagtcactttcttctgatggccagtgtcactatgatgtcagtgaggtctggggatgaggacagtgtgtcctgaaattcacaggactgactcctcaccccagtgcacgaggattcctgtggcatcaggtgctgctgtacctggtgtaggagcctaatcattgaaccattgtgttactcacattccatgtcacagaacatatcagcctcaagaaggatttggtggaggtggatttaccactggttttacaaaggaccgtgtaaagtcattgaagttgtgaaagtctattttttttcctgtaaatctattttttacagaatataagaaacatcaatgacctgatctgtccttcctcctccttcccgcttcccccaaaatcacattccagtttttattgtctttgtgtccaaagtaaactaggtgacttatttgtataaaatgttattttgccacatgagacagtaataaaagaaagattttcacagta

SEQ ID NO: 8088 - DNA, 2816 bp, Homo sapiens
atcttggcggcggagcgatgagcgggtctaacccgaaggctgcggccgcggcgtcggcggctgggcccggggggctggtggctggcaaggaggagaagaagaaggcgggcggcggcgtcctgaaccgcctgaaggcgcggcggcaggcgccccaccacgcggccgacgacggcgtcggggcagcggtcacggagcaggagctgctggcgctggacaccatccggcccgagcacgtcctgcgcctcagccgggtcaccgagaattatttatgtaaacccgaagacaacatctacagtattgatttcacccgcttcaaaattcgagatttggagacagggacagtactttttgagattgccaaaccttgcgtttcagaccaggaggaggatgaggaggagggaggtggagacgtggacatcagcgcaggacgttttgtccgctatcagttcacaccggcatttctccgcctccggacagtcggggctacggtggagttcacagtgggagacaaacctgtttcaaacttccggatgatcgaacggcactatttccgggaacacttgctgaaaaactttgactttgattttggcttctgcatccccagcagtaggaacacttgtgaacatatctatgagtttccccagctttcggaggatgtcattcgtctaatgattgaaaatccttacgagacccgctctgacagcttctactttgttgacaacaagctgataatgcacaacaaggctgattatgcctataatggaggccagtaagtgctgcaagagtagataggggaggtgctttgccgcggccacaagatcctggcacacggagatgatcgaagctgcagtttgtcaacacacatctggaacctggccccaggaagccaaggctggggtggcagtttcctgcgcgccaaaggagctgccaaacagtgctgtgttttcttccccagtattttttcttccctttttttcctgccccgtaggttgcagaggtactatagtaaagtaaaaggttaggataagggtcctggaatccagataaaaaagtttattttccgtagttctggctgcctgttggttgtcttgacgaccaggcatagctgtgcctggtgagaaggctctggccaggcccaccagcaggtcagcagctcttaaggttcctgggtgctgtgggaagctgaaaggtaggcctcttccaggtagctcctcctctcacctccggcattgccatcagcgcagtctgccctcggtctgtgtgaagtcttaaaccaactggaagacacttgaaagggtggggagggagggaggtgccaagagtggaggcaccaaggaatgggtgatgctgccaagctgaagggtctgctttgtggagaggctgctgctctgtctgacttccagggtctcagccagccctcctgggaatagaccaagttttcagcctggcagtgccttctgttcccattttggaggacagacaagcttgctccacatctcctggctcctcccttctgagtctcatgaaatagaatgagtcagctctgctcatggaacagtagtatctcttgaggccagagcaggtcttgtattttgtttttttatttccagacttctttcggggaggttttataaaatgacagtggtgttcccagcatatgtgatatgtggttagacttctgatagtatcagcttccaggggctaatctggcttatgttgggaggatatgcttacgaatcagcagcagctttctaaaggagagatttgacttttctctgcactgcacagcctggaggattggcttttgatggggatttgcctccgaagctctttgtacatttcttgtttaggagggttttcctatctacctttctactgaagtagtttctggaactttcctggtggatcagagttacgtaatgcagtctgagccttcagactgctagttagaattgttttaggtgttcagaaagggcaaaataggctgatgtggcctgtcagagtgatgtgttctcaaaaaagttcacttgcacatctgtgggctgcttttgtcctcagacccttagtggacagactccacaaaccctctgatgagacgattgatgtggccagggtccagttagcatcagtagaaggatgtcactaggaaaggcccaggtatctggtaagtgactgtgaggtgtcacagtacctgtgacaggagagtgtcctgatgtgcttgggagaaaggccgtatgggggccagggatggaagagacagtgtgtggccacagaaattcctgtccatccaccaccagtgctgctccctgtgtgggctttagggcgagtggccccgaaccttggcccagtgctttgtcccaggccagagtcttggcaatgccacatgctggcagctttctcactgagaaggtcctagcttacccctgtgtgctggccttggattcagccccgagagaggggagagaccattcctcctgtggagtgggttccttatcaccagaccggccactctcagaactggcgtccactgtaaatccaggtgccttacgtgtggctctgtcccttatgctgcaggggaaagctgcattgccattgttcccacctcctcactggcagaaagatgccagggctgttagcactgtctcctcaccttctgtttctcattgtggctcctcaaatgggatttgcatgttcctgtcaagcgtaacaacaatcccttctctctttgacagaggcccaggtgggacagtttctactatttgtataaaatgttattttgccacatgagacagtaataaaagaaagattttcacagt

SEQ ID NO: 8089 - DNA, 4613 bp, Homo sapiens
atagagggatggtgggccgaccactatgactgttactccagcacttcccgccccagtctctggcctgtgggctcgtccaaaggcagggcgtgatgccctttgggtggagggaggggccctcgtggtctctcacttccgggccccagccaacaggaacggaaactgcacagccagtcggcttcctgagcttcttccggcgttctgtgtgctgccgtggaaaccgtatggacgaatccaaacctggaggggcgtcgcctccgtaaggctggtcggcttcttccgcgcgttccgctttgcttcactgctttctcccccattcttgggcctgtggacctgtcctgaggcagaggccgagatgcgcgcaaccgcgggagcagccaagtggactggactcttttcttgacttagctaccaggagctagagatgctgttattctattgtatgtgagaagtcggcccagagatggaaaactttattctgtatgaggagatcggaagaggaagcaagactgttgtctataaagggcgacggaagggaacaatcaattttgtagccattctttgtactgataagtgcaaaaggcctgaaataaccaactgggtccgtctcacccgtgaaataaaacacaagaatattgtaacttttcatgaatggtatgaaacaagcaaccacctctggctagtggtggaactctgcacaggtggttccttaaaaacagttattgctcaagatgaaaacctcccagaagatgttgtgagagaatttggaattgacctgattagtggattacatcatcttcataaacttggcattctcttttgtgacatttctcctaggaagatactcttggaagggcctggcacactgaagtttagcaacttttgcttggcaaaagtggaaggtgaaaatttggaagagttctttgctttggtggcagcagaggaaggaggaggtgataatggggaaaatgtcctgaagaaaagcatgaaaagtagagtcaaaggatctcctgtatatacagcaccagaagttgtgaggggtgctgacttttccatctccagtgacctctggtctttgggctgtctgctttatgaaatgttttcaggaaaacctccattcttctcagaaagtatttcagaattaactgaaaagatcttatgtgaagatcctttgccacctattccgaaagattcttctcgtcctaaagcttcttcagattttattaatttgcttgatgggttacttcaaagagatcctcagaaaagattgacttggacaaggctactgcagcattcattttggaagaaagcttttgctggagcagatcaggaatcaagcgtcgaagatctcagtctcagcagaaacactatggagtgttctgggccacaagattccaaggagcttttgcagaactctcagagtagacaagcaaaagggcacaagagtggtcaaccactaggtcactctttcagactagaaaatccaactgagtttcggcctaagagtactcttgagggtcaattgaatgaatccatgtttcttctcagttctcgtcctactcccagaactagcactgcagtggaagtaagtcctggtgaggatatgactcactgttcaccacagaagacttctcctctgaccaagattacaagtggacacctgagtcagcaggacctggaatcccagatgagagagcttatctacacggactcagatcttgttgtcacccccattatcgacaatccaaagataatgaaacagccaccagttaaatttgatgcaaaaatattgcatctaccaacatattcagtggataagttattatttctgaaagatcaagattggaatgactttttgcaacaagtgtgctcgcagatcgactccactgagaagagcatgggggcctcccgagccaagctgaatctcctttgctatttgtgcgtggtggctggtcaccaggaggtggccaccaggctcctccattcccccctgttccaattgctaatccagcatttgcggatagctccaaactgggatatacgggccaaggttgctcacgtaattggtttactggcttcgcacacagctgagctccaggaaaatacacctgttgttgaggcaattgttctcttaactgaattaattagggaaaacttcaggaacagcaaattaaaacagtgccttttaccaacccttggggagctgatctatcttgtagccacccaggaagaaaaaaaaaagaaccctagagagtgctgggctgttcccttggctgcatacacagtgctaatgaggtgccttcgggaaggggaagagcgtgttgtgaatcacatggcagcaaaaattattgaaaatgtctgtaccaccttttctgctcagtcccagggctttattacaggagaaataggacccattttgtggtacctattcagacactccactgctgattctcttaggataacagcagtatcggccttgtgtagaatcactcgccattctcctactgccttccagaatgttattgaaaaggtgggactgaactcagtaataaactccctggcctctgccatctgcaaagttcagcagtacatgttgaccttattcgctgccatgttgtcctgtgggattcatcttcaaagactaatccaagaaaagggttttgtctccacaattatccgtttacttgacagcccctcaacatgcattagagcaaaagccttcctggttcttctatatattttgatttataaccgtgagatgttgctgctcagttgccaagcaagactggtgatgtacatcgagagagacagcagaaagaccactccaggcaaggagcagcaaagtggcaatgaatacctgtccaaatgcctggatcttctcatctgtcacattgtgcaggagctgccacgaatcctgggtgacattcttaactccttggctaatgtttctggacgtaaacacccatcaacagttcaagtgaaacagctgaagttgtgtctccccctgatgcctgtagtgcttcacctcgtaacttcacaggtatttcgacctcaagttgtgacagaagagtttcttttcagctatggaactattcttagtcatattaaatctgtagactcaggagaaacgaacatagatggagccataggactgacagcatcagaagaatttatcaagatcacattgtcagcttttgaagcaataatacagtatcctattttattgaaagactatcgctccacggttgttgactatatactgccacccttggtgtccttggttcaaagccaaaatgtggagtggagactctttagcttgcggttgctctcagaaaccacatctctactcgtgaaccaggagtttggggatggcaaggagaaggccagtgttgattctgacagcaatcttctggctctcattcgagatgtcttacttccccagtatgagcacattcttttagaacctgacccagtaccagcatatgctctgaaactgctagtcgcgatgactgaacacaacccaactttcacaagacttgtggaagaaagcaaactgatcccactcatttttgaagtaactctggaacatcaggagagcattctgggtaataccatgcaaagtgtgattgcattactcagcaatctagttgcctgcaaagattcgaatatggaactactttatgaacaaggacttgtcagtcacatctgtaacctgctcactgaaactgccacactgtgcttggatgtggacaataaaaacaacaatgagatggcagctccactgctcttttccctgcttgatattttgcacagcatgctgacctatacctccggtattgtacggctggctttgcaggcccagaagtctggctcaggagaggaccctcaggctgcagaagacctgctgctgctcaacagacctctgacagacctgattagcctgctcattccactgcttcctaatgaagatcctgagatttttgatgtttcatccaagtgcctgtctatactggttcagctgtatggaggggaaaacccggacagcctctctcctgaaaatgtggaaatttttgctcatttactgacatccaaggaggacccaaaggagcagaagcttctgttaaggattctcagaagaatgatcacctccaatgagaagcacttggagagcctcaagaatgcaggcagcctcctgcgggctctggagcggctggcccctgggagtggttcatttgccgacagtgcggtggctcccttggccctggaaatcctccaagccgttgggcactaggcaagaaggtgcttagcacaagcccgccctgtggccccagccctcggatgcataagcaaggtcagctcccagacacctttgccacatcccctcacagctgtctttggacctaataaagtcagcttaacccagaacctggtggcccaagtgctcactaaccccagggcctagaaaactgactcagaatggacttccttggttcctgtggaatgcatctgggaagcccaggtttgttagctgttctcagaaatgttctttccctctctgtgtgggccaggtgggctaaggttagcactgcctgtggtaataaagcagtggatgc

SEQ ID NO: 8090 - DNA, 773 bp, Homo sapiens
atgcaaaaatattgcatctaccagcattttcagttccaattgctaatccagcatttgtggatagctgcaaactgcgatatatgggccaaggttgctcgggtgattggtttactggcttcgcacaaaactgatctccaggaaaatacacctgttgttgaggccttccctaacagtcccagaactcctacattgcctggtgtgctgacctaaagccctcattaagaccagtaacaaatcaagcctatcttatcaactgacaacacattctggaaccatggcgtgtccatggataagacatgaagtccttctttcaagacttggttttctggtactggaaaataccaatatggataaaagaccttcaaagctgctacgatgggtaaggaacaatgcacacagtataccattaaggcaaagaagatagtcttaatcctgtatgaaatgccaatgaagatgtaattaatgaatagacatttcattgaaatgaaatcaaaagacattttccttctctgacataacagagtagaactctctagtaagaacacaaaactgaccagcctgaccaatgtgataaaaccccctgtctctactaaaaagacaaaaattagccatgcatggtagcagatgcttgtaatcccagctactcaagaggctcaggcatgagaatctcttgaacccaaaaggtggaggctgcagtgagtcgagatcgcacaactgcacttcaccctgggcgacaaagcaagactttgttttttaaaaaaaagaagaagaag

SEQ ID NO: 8091 - DNA, 773 bp, Homo sapiens
atgcaaaaatattgcatctaccagcattttcagttccaattgctaatccagcatttgtggatagctgcaaactgcgatatatgggccaaggttgctcgggtgattggtttactggcttcgcacaaaactgatctccaggaaaatacacctgttgttgaggccttccctaacagtcccagaactcctacattgcctggtgtgctgacctaaagccctcattaagaccagtaacaaatcaagcctatcttatcaactgacaacacattctggaaccatggcgtgtccatggataagacatgaagtccttctttcaagacttggttttctggtcctggaaaataccaatatggataaaagaccttcaaagctgctacgatgggtaaggaacaatgcacacagtataccattaaggcaaagaagatagtcttaatcctgtatgaaatgccaatgaagatgtaattaatgaatagacatttcattgaaatgaaatcaaaagacattttccttctctgacataacagagtagaactctctagtaagaacacaaaactgaccagcctgaccaatgtgataaaaccccctgtctctactaaaaagacaaaaattagccatgcatggtagcagatgcttgtaatcccagctactcaagaggctcaggcatgagaatctcttgaacccaaaaggtggaggctgcagtgagtcgagatcgcacaactgcacttcaccctgggcgacaaagcaagactttgttttttaaaaaaaagaagaagaag

SEQ ID NO: 8092 - DNA, 8400 bp, Homo sapiens
atttttgctcgtcggctgggagccgggcgtcgggtcgctgggagtttgcctcttgtggcagcatcctgcttagtccagcgaattgtgacacattattaaatgtatcagaatataagaactgtgtcactactacgtcaccagatggccatttccacgaattcatgtttccgttcggcggccggcgtccctcgggtggtcgcatgcaatgagtgcatctttctcgagaacaactcttccgcggaaagtcattgctgacagtcctggcattccggtggctgcttcttggcagtgagcacttgtctatcttgcttccaagatccggtacttgcaggaatatcataaccgggttctccacaacatttatcctgtaccatcaggaacagatattgcaaacaccttgaaatacttttctcagaccttgttaagcgtcctgcgagatgctccctcagaacgcggcccgcaaagtcgtgatgctcagttgtcagactacccttctttggactaccaaggcctctacgtgactttggtgaccctcctggatctagttcctttactacagcacggccaacacgatcttggacagtcgatattttatacaactacatgtttgctaccttttctcaatgatgatattctgagtactttgccctacacgatgatatcaacgttggctacctttcctccatttctgcacaaggatatcattgaatatcttagcacatcttttctaccaatggctatattgggctcctcaaggagagaaggtgtacctgcccatgttaacctctctgcatcatccatgctaatgattgcaatgcagtacacatccaatccagtgtatcattgtcaattactggaatgcctcatgaaatataaacaagaagtctggaaagatcttttgtatgtgattgcgtatgggccttcacaagtgaagcctccagctgtgcaaatgcttttccactactggcccaatttaaaacctcctggggcaataagcgagtacagggggttgcagtacacagcttggaatcccatccactgccagcacattgaatgccacaatgcaattaacaaaccagctgtgaagatgtgtatagacccttccctgtcagtagcgttgggtgataaaccacccccgttgtatctctgtgaagaatgcagcgagaggattgcaggggaccacagtgagtggctgattgatgttcttctgccacaagctgaaatatctgctatatgtcagaaaaagaactgcagttcccacgttagaagagcagttgtcacctgcttctcagcagggtgctgtggtcgtcacggaaacaggcctgttcggtactgcaagaggtgccactcaaatcatcacagtaatgaagtgggggccgctgcggagactcacctctatcagacctctcctccgcccatcaacacgcgggaatgcggcgctgaggagctggtctgcgccgtggaagccgtgatcagcttgttgaaagaagccgagttccatgctgagcagcgagaacatgagctgaaccggcggcggcagctgggcctctcctcttcccaccattccctggataatgctgactttgataacaaggacgatgataaacacgatcagaggctgctcagtcaattcggaatatggttcttagtgagcctctgcacacccagtgagaacacgcctacagaaagcttggcccggctggtggccatggtgtttcagtggtttcactccactgcgtatatgatggatgatgaagtgggaagtctggtggaaaagctgaagcctcagtttgtcaccaaatggctgaagaccgtatgtgatgttcgcttcgatgtcatggtcatgtgccttcttcctaaacccatggaatttgccagggttggtggctactgggataagtcctgtagcacagtgactcagctgaaggaaggtctcaaccgaatcctctgcctgatcccctataatgtgatcaatcaatctgtctgggagtgtattatgccggaatggctggaagccatcagaacagaagtcccagataatcagttaaaagaattcagggaagtattaagcaaaatgtttgacattgaactctgtcctctgcctttctcaatggaggagatgtttggttttattagttgtcggtttacaggatacccctcctctgtgcaggagcaagctttactgtggcttcatgtattatcggagttagatatcatggttccacttcaactactaataagtatgttttctgatggagttaattcagtcaaagagctggcaaatcaaagaaaatcaagagtcagtgaactggcagggaaccttgcatctcgaagggtgagtgttgcctctgatcctggccgacgagttcagcacaatatgcttagtccatttcatagtcctttccagagtccgtttcggagtcctttgcgtagtccgtttcgtagccctttcaagaattttggacacccaggaggaaggactattgactttgattgtgaagatgatgaaatgaatctaaattgtttcatcctcatgtttgatcttctcctgaagcagatggagttacaagatgatggaatcacgatgggtttagagcacagcttatcaaaggacattatttctattataaacaatgtcttccaagccccctgggggggatcccacacctgccagaaggacgaaaaagcaatcgagtgcaacttatgtcagtctagtatcctctgctatcagcttgcttgtgaactcctggagagactagctcctaaagaagaaagccggctggtggagcccacagacagcctggaggatagcctcctttcttccagaccagagtttatcataggccctgaaggggaggaggaggagaatcctgcaagcaagcatggggagaacccaggcaactgcaccgagcccgtggaacatgctgcagtaaagaatgataccgaaagaaaattttgctaccaacagcttccggtaacattgagactaatatataccattttccaggaaatggctaagtttgaagagccagacattctttttaatatgctcaattgcctgaagattctctgtctgcatggagaatgtttatacattgccagaaaagatcaccctcaatttttagcctacattcaggaccacatgttgattgcaagcctgtggagggtcgtcaaatccgagttctctcagctgtcttccctggcagtccctcttctcctccatgccctgtcacttcctcatggtgctgacatcttctggacaatcataaatggcaatttcaacagcaaagactggaagatgaggtttgaagcagtggaaaaagttgctgtaatttgtagatttctggatattcactcagtaaccaaaaaccacctgctgaagtactccctggcacatgccttctgctgcttcctgacagcagtggaggatgtcaaccccgcagtggctaccagagctggtctcctgcttgacaccataaagaggccagcattgcagggtctatgtctttgtcttgacttccagtttgatactgtggttaaagacagacccacaattttgagcaagcttttactcttgcactttcttaagcaggatattcctgctctgagctgggagttctttgtcaatagatttgagacgctttctttggaagcccagctacatttggattgtaacaaggaatttccttttcctacaaccatcactgctgtgaggaccaatgttgctaacctcagcgatgcagccttatggaagatcaagagagctcgctttgcaagaaaccgccagaagagtgtacgttccctgagggacagcgtgaaagggcctgtggaatccaagagggcgctctccctccctgagaccctgacctccaaaattcgacaacaatctcctgagaatgacaacaccatcaaggacctgctcccagaagacgctgggatcgaccaccagacagttcaccagctgattacagtgctcatgaagttcatggccaaggatgaaagcagcgctgagtcagacatcagcagtgcaaaggccttcaacacggtcaagcgacacctgtacgtcttactcggctatgaccagcaggaaggttgcttcatgattgcacctcaaaaaatgcgcctgtcaacttgctttaatgcattcattgcaggaattgcccaagttatggactataacattaacttgggaaaacaccttctccccttagtggttcaggtgctcaaatactgctcttgtcctcaactccggcattatttccaacagccgcctcgttgctccctctggtccctaaagcctcacatccggcagatgtggttgaaggccttgcttgtcatcctttacaagtatccataccgagactgtgatatcagcaagatcctgctgcatctgattcacataacagtcaatacactcaatgcgcagtatcatagctgcaagccccatgccacggcaggacctttgtacagtgacaacagtaacataagcagatacagcgaaaaagaaaaaggtgaaatagaactggctgaatatagagagacgggtgcattacaagacagccttctccactgtgtgagagaagaaagcattccgaaaaaaaagctacgctctttcaaacaaaaatctcttgatatagggaatgcagactcgcttttgtttacattagacgaacatcgtaggaagtcgtgcatagatcggtgtgacatagagaagcctccgacccaagctgcgtatatcgcacaaagaccaaacgaccctggacgttctagacagaactctgctacgaggcctgacaatagtgaaatccccgagaacccagctatggaagggtttccagatgctcgaaggcctgtcataccagaggttaggttaaactgtatggagactttcgaggtgaaagttgactcgccggtaaagcctgctcctaaagaggatttagatctgatagatctatcctcagattcaacctcggggcctgaaaaacactctatactctcaacctccgacagcgactctcttgtatttgagcctcttccccctctcagaatagtcgagagtgacgaagaagaggagacgatgaaccaaggcgatgacggcccctccggtaaaaatgctgcctcttctccctccgtccccagccatccctccgtcctcagcctgagcacagctccgcttgtacaagtaagtgtggaggattgttccaaagacttttcttctaaggactcaggaaataatcagtcagcagggaacactgactctgccctcatcactctggaagaccctatggacgccgaaggatcctcaaagccagaggagctgccagagttctcctgcggtagcccactgacgctgaagcaaaaacgagacctccttcagaagtcgtttgctctccccgagatgtcgctggatgatcaccctgacccgggcactgagggggagaagcctggggagctgatgccaagttcaggggcaaaaaccgtcctcctcaaagttcccgaagatgcagagaaccccacagaaagtgagaagcctgataccagtgcagaatctgatacagaacagaatcctgaaaggaaggtggaagaggatggagctgaggaatccgaatttaagattcagattgttcccaggcagaggaagcagaggaagattgctgtcagtgctatccagagagagtacctcgacatctccttcaacattctggacaaactgggagaacagaaagatccagatccttctactaaaggactttcaactttggaaatgccacgagaatcttcatctgcccctacgttagatgcaggtgtgccggaaacaagtagccattcctcaatatcaactcagtataggcagatgaaaaggggatccctgggagttctgacaatgagccagttaatgaagcggcagctggagcatcagtctagcgccccccataacatcagcaactgggacactgaacagatacagcctgggaaacgccagtgtaacgtgccaacgtgcctaaaccctgacctggagggacagccattgaggatgagaggtgccaccaaatccagcctgctatcagcaccaagcatagtcagtatgtttgtgcctgcacctgaagagttcactgacgagcagccgacggtgatgacggacaaatgccatgactgtggggccattcttgaagaatacgatgaagagacacttgggctagccatcgtggtcctctccacattcattcacttaagcccagacctggcagccccgctgctgctggatatcatgcagtctgtgggaagattggcatccagtactaccttttctaatcaagcagaaagcatgatggttcccggcaatgcggcgggggtggccaagcagttcctgcgctgcatcttccatcagttggcccccaacggcatcttcccgcagctgttccaaagcacgatcaaagatgggacttttttacggaccttagcctcgtctctgatggacttcaatgagctgagctccatcgcagctctcagtcagctcctagagggtctaaataacaaaaagaatttaccagcagggggtgctatgattcgctgtttggaaaacattgcaaccttcatggaagctttgcctatggattctcctagtagcctctggaccacaattagcaaccagtttcagacattttttgccaagctgccttgtgttttacctctgaagtgttctttagattccagtttaagaattatgatttgcctcttgaagatcccttctaccaatgctacaaggagtttgttggaaccattttcaaaactgctcagctttgtaattcagaatgccgtcttcactctggcctacctggtggagctgtgtggcttatgttaccgagctttcactaaggaacgagataaattctacttgtctcgtagtgttgttctagaacttctgcaggccctaaagctcaaatctcctttaccagatacaaaccttcttctgcttgttcagtttatttgtgcagatgctggaaccaaactagctgagtcaacaatcctgagcaagcagatgatagcctctgtacctggatgtgggactgcagcgatggagtgtgtgaggcagtacatcaacgaagtgctggatttcatggcagacatgcacacgctgaccaaactgaagagccacatgaagacatgttcccagcctctgcatgaagatacctttgggggacatctcaaagtggggctggcccagattgcagccatggacatctcacggggcaaccacagagataacaaagctgtgatccgctatctgccttggctttatcatcccccctctgcaatgcagcaaggacctaaagaattcattgagtgtgtctcccatatccgactgttgtcctggctgctgctgggttccctcactcacaatgcagtgtgcccaaatgcctcctctccctgcctgcccattcctctggatgcaggctcccacgttgcagaccatcttattgttatcctgattggatttccagagcaatcaaagacctccgtgctgcacatgtgctccctcttccacgcgttcatctttgctcagctgtggacagtttattgcgagcaaagtgccgtcgctacaaatctccaaaatcagaatgaattcagcttcacggcgatactgacagcactagaattttggagtagggtgacacccagcatccttcagctaatggcccataacaaagtgatggtagaaatggtgtgtctccatgtgattagtttaatggaggcattgcaggaatgcaattcgaccatttttgtcaagctgatacctatgtggttgccaatgattcagtcaaatatcaagcacttatctgcgggactccagcttcgcctccaggctattcagaaccacgtgaaccaccacagcctaaggacgctgccgggctcgggccagagcagtgctggcctggcagccctccgaaagtggttgcagtgcactcagttcaaaatggcccaggtggagatccagtcctcggaagcagcctctcaattttatcctctatgagtggactcctcggcgctcagtgtcaacactctggtttagcaataatgggtttaaaaacaaacaatttgatccaagcaggttggggaacatattggtactgtacattctctttctagtttagtaaaagatgtgcaaaggccagagagggccgaaaatgaagctttcttgctacacatatttctgatgactccttgggctatctgattaagtgtttccttacattattttttaaaaaccaaatcatttttctttaactaacttctattttttttaagaaaaaaaaatagactggtgggtactcacagaaaagttgtataagtccccctgttgctatttttgatgatagagaataaatagggtttttgaaa

SEQ ID NO: 8093 - DNA, 7908 bp, Homo sapiens
atgtccaccaaagcggagcagtttgcttccaagatccggtacttgcaggaatatcataaccgggttctccacaacatttatcctgtaccatcaggaacagatattgcaaacaccttgaaatacttttctcagaccttgttaagcattttgtcccgcacagggaagaaggaaaaccaagatgcctccaatttgacagtgcccatgaccatgtgtctttttcctgtgccattcccactcaccccatctctaagaccgcaggtcagttccatcaaccctactgttactcgctccctcctttacagcgtcctgcgagatgctccctcagaacgcggcccgcaaagtcgtgatgctcagttgtcagactacccttctttggactaccaaggcctctacgtgactttggtgaccctcctggatctagttcctttactacagcacggccaacacgatcttggacagtcgatattttatacaactacatgtttgctaccttttctcaatgatgatattctgagtactttgccctacacgatgatatcaacgttggctacctttcctccatttctgcacaaggatatcattgaatatcttagcacatcttttctaccaatggctatattgggctcctcaaggagagaaggtgtacctgcccatgttaacctctctgcatcatccatgctaatgattgcaatgcagtacacatccaatccagtgtatcattgtcaattactggaatgcctcatgaaatataaacaagaagtctggaaagatcttttgtatgtgattgcgtatgggccttcacaagtgaagcctccagctgtgcaaatgcttttccactactggcccaatttaaaacctcctggggcaataagcgagtacagggggttgcagtacacagcttggaatcccatccactgccagcacattgaatgccacaatgcaattaacaaaccagctgtgaagatgtgtatagacccttccctgtcagtagcgttgggtgataaaccacccccgttgtatctctgtgaagaatgcagcgagaggattgcaggggaccacagtgagtggctgattgatgttcttctgccacaagctgaaatatctgctatatgtcagaaaaagaactgcagttcccacgttagaagagcagttgtcacctgcttctcagcagggtgctgtggtcgtcacggaaacaggcctgttcggtactgcaagaggtgccactcaaatcatcacagtaatgaagtgggggccgctgcggagactcacctctatcagacctctcctccgcccatcaacacgcgggaatgcggcgctgaggagctggtctgcgccgtggaagccgtgatcagcttgttgaaagaagccgagttccatgctgagcagcgagaacatgagctgaaccggcggcggcagctgggcctctcctcttcccaccattccctggataatgctgactttgataacaaggacgatgataaacacgatcagaggctgctcagtcaattcggaatatggttcttagtgagcctctgcacacccagtgagaacacgcctacagaaagcttggcccggctggtggccatggtgtttcagtggtttcactccactgcgtatatgatggatgatgaagtgggaagtctggtggaaaagctgaagcctcagtttgtcaccaaatggctgaagaccgtatgtgatgttcgcttcgatgtcatggtcatgtgccttcttcctaaacccatggaatttgccagggttggtggctactgggataagtcctgtagcacagtgactcagctgaaggaaggtctcaaccgaatcctctgcctgatcccctataatgtgatcaatcaatctgtctgggagtgtattatgccggaatggctggaagccatcagaacagaagtcccagataatcagttaaaagaattcagggaagtattaagcaaaatgtttgacattgaactctgtcctctgcctttctcaatggaggagatgtttggttttattagttgtcggtttacaggatacccctcctctgtgcaggagcaagctttactgtggcttcatgtattatcggagttagatatcatggttccacttcaactactaataagtatgttttctgatggagttaattcagtcaaagagctggcaaatcaaagaaaatcaagagtcagtgaactggcagggaaccttgcatctcgaagggtgagtgttgcctctgatcctggccgacgagttcagcacaatatgcttagtccatttcatagtcctttccagagtccgtttcggagtcctttgcgtagtccgtttcgtagccctttcaagaattttggacacccaggaggaaggactattgactttgattgtgaagatgatgaaatgaatctaaattgtttcatcctcatgtttgatcttctcctgaagcagatggagttacaagatgatggaatcacgatgggtttagagcacagcttatcaaaggacattatttctattataaacaatgtcttccaagccccctgggggggatcccacacctgccagaaggacgaaaaagcaatcgagtgcaacttatgtcagtctagtatcctctgctatcagcttgcttgtgaactcctggagagactagctcctaaagaagaaagccggctggtggagcccacagacagcctggaggatagcctcctttcttccagaccagagtttatcataggccctgaaggggaggaggaggagaatcctgcaagcaagcatggggagaacccaggcaactgcaccgagcccgtggaacatgctgcagtaaagaatgataccgaaagaaaattttgctaccaacagcttccggtaacattgagactaatatataccattttccaggaaatggctaagtttgaagagccagacattctttttaatatgctcaattgcctgaagattctctgtctgcatggagaatgtttatacattgccagaaaagatcaccctcaatttttagcctacattcaggaccacatgttgattgcaagcctgtggagggtcgtcaaatccgagttctctcagctgtcttccctggcagtccctcttctcctccatgccctgtcacttcctcatggtgctgacatcttctggacaatcataaatggcaatttcaacagcaaagactggaagatgaggtttgaagcagtggaaaaagttgctgtaatttgtagatttctggatattcactcagtaaccaaaaaccacctgctgaagtactccctggcacatgccttctgctgcttcctgacagcagtggaggatgtcaaccccgcagtggctaccagagctggtctcctgcttgacaccataaagaggccagcattgcagggtctatgtctttgtcttgacttccagtttgatactgtggttaaagacagacccacaattttgagcaagcttttactcttgcactttcttaagcaggatattcctgctctgagctgggagttctttgtcaatagatttgagacgctttctttggaagcccagctacatttggattgtaacaaggaatttccttttcctacaaccatcactgctgtgaggaccaatgttgctaacctcagcgatgcagccttatggaagatcaagagagctcgctttgcaagaaaccgccagaagagtgtacgttccctgagggacagcgtgaaagggcctgtggaatccaagagggcgctctccctccctgagaccctgacctccaaaattcgacaacaatctcctgagaatgacaacaccatcaaggacctgctcccagaagacgctgggatcgaccaccagacagttcaccagctgattacagtgctcatgaagttcatggccaaggatgaaagcagcgctgagtcagacatcagcagtgcaaaggccttcaacacggtcaagcgacacctgtacgtcttactcggctatgaccagcaggaaggttgcttcatgattgcacctcaaaaaatgcgcctgtcaacttgctttaatgcattcattgcaggaattgcccaagttatggactataacattaacttgggaaaacaccttctccccttagtggttcaggtgctcaaatactgctcttgtcctcaactccggcattatttccaacagccgcctcgttgctccctctggtccctaaagcctcacatccggcagatgtggttgaaggccttgcttgtcatcctttacaagtatccataccgagactgtgatatcagcaagatcctgctgcatctgattcacataacagtcaatacactcaatgcgcagtatcatagctgcaagccccatgccacggcaggacctttgtacagtgacaacagtaacataagcagatacagcgaaaaagaaaaaggtgaaatagaactggctgaatatagagagacgggtgcattacaagacagccttctccactgtgtgagagaagaaagcattccgaaaaaaaagctacgctctttcaaacaaaaatctcttgatatagggaatgcagactcgcttttgtttacattagacgaacatcgtaggaagtcgtgcatagatcggtgtgacatagagaagcctccgacccaagctgcgtatatcgcacaaagaccaaacgaccctggacgttctagacagaactctgctacgaggcctgacaatagtgaaatccccgagaacccagctatggaagggtttccagatgctcgaaggcctgtcataccagaggttaggttaaactgtatggagactttcgaggtgaaagttgactcgccggtaaagcctgctcctaaagaggatttagatctgatagatctatcctcagattcaacctcggggcctgaaaaacactctatactctcaacctccgacagcgactctcttgtatttgagcctcttccccctctcagaatagtcgagagtgacgaagaagaggagacgatgaaccaaggcgatgacggcccctccggtaaaaatgctgcctcttctccctccgtccccagccatccctccgtcctcagcctgagcacagctccgcttgtacaagtaagtgtggaggattgttccaaagacttttcttctaaggactcaggaaataatcagtcagcagggaacactgactctgccctcatcactctggaagaccctatggacgccgaaggatcctcaaagccagaggagctgccagagttctcctgcggtagcccactgacgctgaagcaaaaacgagacctccttcagaagtcgtttgctctccccgagatgtcgctggatgatcaccctgacccgggcactgagggggagaagcctggggagctgatgccaagttcaggggcaaaaaccgtcctcctcaaagttcccgaagatgcagagaaccccacagaaagtgagaagcctgataccagtgcagaatctgatacagaacagaatcctgaaaggaaggtggaagaggatggagctgaggaatccgaatttaagattcagattgttcccaggcagaggaagcagaggaagattgctgtcagtgctatccagagagagtacctcgacatctccttcaacattctggacaaactgggagaacagaaagatccagatccttctactaaaggactttcaactttggaaatgccacgagaatcttcatctgcccctacgttagatgcaggtgtgccggaaacaagtagccattcctcaatatcaactcagtataggcagatgaaaaggggatccctgggagttctgacaatgagccagttaatgaagcggcagctggagcatcagtctagcgccccccataacatcagcaactgggacactgaacagatacagcctgggaaacgccagtgtaacgtgccaacgtgcctaaaccctgacctggagggacagccattgaggatgagaggtgccaccaaatccagcctgctatcagcaccaagcatagtcagtatgtttgtgcctgcacctgaagagttcactgacgagcagccgacggtgatgacggacaaatgccatgactgtggggccattcttgaagaatacgatgaagagacacttgggctagccatcgtggtcctctccacattcattcacttaagcccagacctggcagccccgctgctgctggatatcatgcagtctgtgggaagattggcatccagtactaccttttctaatcaagcagaaagcatgatggttcccggcaatgcggcgggggtggccaagcagttcctgcgctgcatcttccatcagttggcccccaacggcatcttcccgcagctgttccaaagcacgatcaaagatgggacttttttacggaccttagcctcgtctctgatggacttcaatgagctgagctccatcgcagctctcagtcagctcctagagggtctaaataacaaaaagaatttaccagcagggggtgctatgattcgctgtttggaaaacattgcaaccttcatggaagctttgcctatggattctcctagtagcctctggaccacaattagcaaccagtttcagacattttttgccaagctgccttgtgttttacctctgaagtgttctttagattccagtttaagaattatgatttgcctcttgaagatcccttctaccaatgctacaaggagtttgttggaaccattttcaaaactgctcagctttgtaattcagaatgccgtcttcactctggcctacctggtggagctgtgtggcttatgttaccgagctttcactaaggaacgagataaattctacttgtctcgtagtgttgttctagaacttctgcaggccctaaagctcaaatctcctttaccagatacaaaccttcttctgcttgttcagtttatttgtgcagatgctggaaccaaactagctgagtcaacaatcctgagcaagcagatgatagcctctgtacctggatgtgggactgcagcgatggagtgtgtgaggcagtacatcaacgaagtgctggatttcatggcagacatgcacacgctgaccaaactgaagagccacatgaagacatgttcccagcctctgcatgaagatacctttgggggacatctcaaagtggggctggcccagattgcagccatggacatctcacggggcaaccacagagataacaaagctgtgatccgctatctgccttggctttatcatcccccctctgcaatgcagcaaggacctaaagaattcattgagtgtgtctcccatatccgactgttgtcctggctgctgctgggttccctcactcacaatgcagtgtgcccaaatgcctcctctccctgcctgcccattcctctggatgcaggctcccacgttgcagaccatcttattgttatcctgattggatttccagagcaatcaaagacctccgtgctgcacatgtgctccctcttccacgcgttcatctttgctcagctgtggacagtttattgcgagcaaagtgccgtcgctacaaatctccaaaatcagaatgaattcagcttcacggcgatactgacagcactagaattttggagtagggtgacacccagcatccttcagctaatggcccataacaaagtgatggtagaaatggtgtgtctccatgtgattagtttaatggaggcattgcaggaatgcaattcgaccatttttgtcaagctgatacctatgtggttgccaatgattcagtcaaatatcaagcacttatctgcgggactccagcttcgcctccaggctattcagaaccacgtgaaccaccacagcctaaggacgctgccgggctcgggccagagcagtgctggcctggcagccctccgaaagtggttgcagtgcactcagttcaaaatggcccaggtggagatccagtcctcggaagcagcctctcaattttatcctctatga

SEQ ID NO: 8094 - DNA, 8413 bp, Homo sapiens
atgaattctaagcgccacaaaattgcttccaagatccggtacttgcaggaatatcataaccgggttctccacaacatttatcctgtaccatcaggaacagatattgcaaacaccttgaaatacttttctcagaccttgttaagcattttgtcccgcacagggaagaaggaaaaccaagatgcctccaatttgacagtgcccatgaccatgtgtctttttcctgtgccattcccactcaccccatctctaagaccgcaggtcagttccatcaaccctactgttactcgctccctcctttacagcgtcctgcgagatgctccctcagaacgcggcccgcaaagtcgtgatgctcagttgtcagactacccttctttggactaccaaggcctctacgtgactttggtgaccctcctggatctagttcctttactacagcacggccaacacgatcttggacagtcgatattttatacaactacatgtttgctaccttttctcaatgatgatattctgagtactttgccctacacgatgatatcaacgttggctacctttcctccatttctgcacaaggatatcattgaatatcttagcacatcttttctaccaatggctatattgggctcctcaaggagagaaggtgtacctgcccatgttaacctctctgcatcatccatgctaatgattgcaatgcagtacacatccaatccagtgtatcattgtcaattactggaatgcctcatgaaatataaacaagaagtctggaaagatcttttgtatgtgattgcgtatgggccttcacaagtgaagcctccagctgtgcaaatgcttttccactactggcccaatttaaaacctcctggggcaataagcgagtacagggggttgcagtacacagcttggaatcccatccactgccagcacattgaatgccacaatgcaattaacaaaccagctgtgaagatgtgtatagacccttccctgtcagtagcgttgggtgataaaccacccccgttgtatctctgtgaagaatgcagcgagaggattgcaggggaccacagtgagtggctgattgatgttcttctgccacaagctgaaatatctgctatatgtcagaaaaagaactgcagttcccacgttagaagagcagttgtcacctgcttctcagcagggtgctgtggtcgtcacggaaacaggcctgttcggtactgcaagaggtgccactcaaatcatcacagtaatgaagtgggggccgctgcggagactcacctctatcagacctctcctccgcccatcaacacgcgggaatgcggcgctgaggagctggtctgcgccgtggaagccgtgatcagcttgttgaaagaagccgagttccatgctgagcagcgagaacatgagctgaaccggcggcggcagctgggcctctcctcttcccaccattccctggataatgctgactttgataacaaggacgatgataaacacgatcagaggctgctcagtcaattcggaatatggttcttagtgagcctctgcacacccagtgagaacacgcctacagaaagcttggcccggctggtggccatggtgtttcagtggtttcactccactgcgtatatgatggatgatgaagtgggaagtctggtggaaaagctgaagcctcagtttgtcaccaaatggctgaagaccgtatgtgatgttcgcttcgatgtcatggtcatgtgccttcttcctaaacccatggaatttgccagggttggtggctactgggataagtcctgtagcacagtgactcagctgaaggaaggtctcaaccgaatcctctgcctgatcccctataatgtgatcaatcaatctgtctgggagtgtattatgccggaatggctggaagccatcagaacagaagtcccagataatcagttaaaagaattcagggaagtattaagcaaaatgtttgacattgaactctgtcctctgcctttctcaatggaggagatgtttggttttattagttgtcggtttacaggatacccctcctctgtgcaggagcaagctttactgtggcttcatgtattatcggagttagatatcatggttccacttcaactactaataagtatgttttctgatggagttaattcagtcaaagagctggcaaatcaaagaaaatcaagagtcagtgaactggcagggaaccttgcatctcgaagggtgagtgttgcctctgatcctggccgacgagttcagcacaatatgcttagtccatttcatagtcctttccagagtccgtttcggagtcctttgcgtagtccgtttcgtagccctttcaagaattttggacacccaggaggaaggactattgactttgattgtgaagatgatgaaatgaatctaaattgtttcatcctcatgtttgatcttctcctgaagcagatggagttacaagatgatggaatcacgatgggtttagagcacagcttatcaaaggacattatttctattataaacaatgtcttccaagccccctgggggggatcccacacctgccagaaggacgaaaaagcaatcgagtgcaacttatgtcagtctagtatcctctgctatcagcttgcttgtgaactcctggagagactagctcctaaagaagaaagccggctggtggagcccacagacagcctggaggatagcctcctttcttccagaccagagtttatcataggccctgaaggggaggaggaggagaatcctgcaagcaagcatggggagaacccaggcaactgcaccgagcccgtggaacatgctgcagtaaagaatgataccgaaagaaaattttgctaccaacagcttccggtaacattgagactaatatataccattttccaggaaatggctaagtttgaagagccagacattctttttaatatgctcaattgcctgaagattctctgtctgcatggagaatgtttatacattgccagaaaagatcaccctcaatttttagcctacattcaggaccacatgttgattgcaagcctgtggagggtcgtcaaatccgagttctctcagctgtcttccctggcagtccctcttctcctccatgccctgtcacttcctcatggtgctgacatcttctggacaatcataaatggcaatttcaacagcaaagactggaagatgaggtttgaagcagtggaaaaagttgctgtaatttgtagatttctggatattcactcagtaaccaaaaaccacctgctgaagtactccctggcacatgccttctgctgcttcctgacagcagtggaggatgtcaaccccgcagtggctaccagagctggtctcctgcttgacaccataaagaggccagcattgcagggtctatgtctttgtcttgacttccagtttgatactgtggttaaagacagacccacaattttgagcaagcttttactcttgcactttcttaagcaggatattcctgctctgagctgggagttctttgtcaatagatttgagacgctttctttggaagcccagctacatttggattgtaacaaggaatttccttttcctacaaccatcactgctgtgaggaccaatgttgctaacctcagcgatgcagccttatggaagatcaagagagctcgctttgcaagaaaccgccagaagagtgtacgttccctgagggacagcgtgaaagggcctgtggaatccaagagggcgctctccctccctgagaccctgacctccaaaattcctatgaggttgaccaggcatgagcagtctgctccagctctcggtgggacacccgaacagacgccaggacaacaatctcctgagaatgacaacaccatcaaggacctgctcccagaagacgctgggatcgaccaccagacagttcaccagctgattacagtgctcatgaagttcatggccaaggatgaaagcagcgctgagtcagacatcagcagtgcaaaggccttcaacacggtcaagcgacacctgtacgtcttactcggctatgaccagcaggaaggttgcttcatgattgcacctcaaaaaatgcgcctgtcaacttgctttaatgcattcattgcaggaattgcccaagttatggactataacattaacttgggaaaacaccttctccccttagtggttcaggtgctcaaatactgctcttgtcctcaactccggcattatttccaacagccgcctcgttgctccctctggtccctaaagcctcacatccggcagatgtggttgaaggccttgcttgtcatcctttacaagtatccataccgagactgtgatatcagcaagatcctgctgcatctgattcacataacagtcaatacactcaatgcgcagtatcatagctgcaagccccatgccacggcaggacctttgtacagtgacaacagtaacataagcagatacagcgaaaaagaaaaaggtgaaatagaactggctgaatatagagagacgggtgcattacaagacagccttctccactgtgtgagagaagaaagcattccgaaaaaaaagctacgctctttcaaacaaaaatctcttgatatagggaatgcagactcgcttttgtttacattagacgaacatcgtaggaagtcgtgcatagatcggtgtgacatagagaagcctccgacccaagctgcgtatatcgcacaaagaccaaacgaccctggacgttctagacagaactctgctacgaggcctgacaatagtgaaatccccgagaacccagctatggaagggtttccagatgctcgaaggcctgtcataccagaggttaggttaaactgtatggagactttcgaggtgaaagttgactcgccggtaaagcctgctcctaaagaggatttagatctgatagatctatcctcagattcaacctcggggcctgaaaaacactctatactctcaacctccgacagcgactctcttgtatttgagcctcttccccctctcagaatagtcgagagtgacgaagaagaggagacgatgaaccaaggcgatgacggcccctccggtaaaaatgctgcctcttctccctccgtccccagccatccctccgtcctcagcctgagcacagctccgcttgtacaagtaagtgtggaggattgttccaaagacttttcttctaaggactcaggaaataatcagtcagcagggaacactgactctgccctcatcactctggaagaccctatggacgccgaaggatcctcaaagccagaggagctgccagagttctcctgcggtagcccactgacgctgaagcaaaaacgagacctccttcagaagtcgtttgctctccccgagatgtcgctggatgatcaccctgacccgggcactgagggggagaagcctggggagctgatgccaagttcaggggcaaaaaccgtcctcctcaaagttcccgaagatgcagagaaccccacagaaagtgagaagcctgataccagtgcagaatctgatacagaacagaatcctgaaaggaaggtggaagaggatggagctgaggaatccgaatttaagattcagattgttcccaggcagaggaagcagaggaagattgctgtcagtgctatccagagagagtacctcgacatctccttcaacattctggacaaactgggagaacagaaagatccagatccttctactaaaggactttcaactttggaaatgccacgagaatcttcatctgcccctacgttagatgcaggtgtgccggaaacaagtagccattcctcaatatcaactcagtataggcagatgaaaaggggatccctgggagttctgacaatgagccagttaatgaagcggcagctggagcatcagtctagcgccccccataacatcagcaactgggacactgaacagatacagcctgggaaacgccagtgtaacgtgccaacgtgcctaaaccctgacctggagggacagccattgaggatgagaggtgccaccaaatccagcctgctatcagcaccaagcatagtcagtatgtttgtgcctgcacctgaagagttcactgacgagcagccgacggtgatgacggacaaatgccatgactgtggggccattcttgaagaatacgatgaagagacacttgggctagccatcgtggtcctctccacattcattcacttaagcccagacctggcagccccgctgctgctggatatcatgcagtctgtgggaagattggcatccagtactaccttttctaatcaagcagaaagcatgatggttcccggcaatgcggcgggggtggccaagcagttcctgcgctgcatcttccatcagttggcccccaacggcatcttcccgcagctgttccaaagcacgatcaaagatgggacttttttacggaccttagcctcgtctctgatggacttcaatgagctgagctccatcgcagctctcagtcagctcctagagggtctaaataacaaaaagaatttaccagcagggggtgctatgattcgctgtttggaaaacattgcaaccttcatggaagctttgcctatggattctcctagtagcctctggaccacaattagcaaccagtttcagacattttttgccaagctgccttgtgttttacctctgaagtgttctttagattccagtttaagaattatgatttgcctcttgaagatcccttctaccaatgctacaaggagtttgttggaaccattttcaaaactgctcagctttgtaattcagaatgccgtcttcactctggcctacctggtggagctgtgtggcttatgttaccgagctttcactaaggaacgagataaattctacttgtctcgtagtgttgttctagaacttctgcaggccctaaagctcaaatctcctttaccagatacaaaccttcttctgcttgttcagtttatttgtgcagatgctggaaccaaactagctgagtcaacaatcctgagcaagcagatgatagcctctgtacctggatgtgggactgcagcgatggagtgtgtgaggcagtacatcaacgaagtgctggatttcatggcagacatgcacacgctgaccaaactgaagagccacatgaagacatgttcccagcctctgcatgaagatacctttgggggacatctcaaagtggggctggcccagattgcagccatggacatctcacggggcaaccacagagataacaaagctgtgatccgctatctgccttggctttatcatcccccctctgcaatgcagcaaggacctaaagaattcattgagtgtgtctcccatatccgactgttgtcctggctgctgctgggttccctcactcacaatgcagtgtgcccaaatgcctcctctccctgcctgcccattcctctggatgcaggctcccacgttgcagaccatcttattgttatcctgattggatttccagagcaatcaaagacctccgtgctgcacatgtgctccctcttccacgcgttcatctttgctcagctgtggacagtttattgcgagcaaagtgccgtcgctacaaatctccaaaatcagaatgaattcagcttcacggcgatactgacagcactagaattttggagtagggtgacacccagcatccttcagctaatggcccataacaaagtgatggtagaaatggtgtgtctccatgtgattagtttaatggaggcattgcaggaatgcaattcgaccatttttgtcaagctgatacctatgtggttgccaatgattcagtcaaatatcaagcacttatctgcgggactccagcttcgcctccaggctattcagaaccacgtgaaccaccacagcctaaggacgctgccgggctcgggccagagcagtgctggcctggcagccctccgaaagtggttgcagtgcactcagttcaaaatggcccaggtggagatccagtcctcggaagcagcctctcaattttatcctctatgagtggactcctcggcgctcagtgtcaacactctggtttagcaataatgggtttaaaaacaaacaatttgatccaagcaggttggggaacatattggtactgtacattctctttctagtttagtaaaagatgtgcaaaggccagagagggccgaaaatgaagctttcttgctacacatatttctgatgactccttgggctatctgattaagtgtttccttacattattttttaaaaaccaaatcatttttctttaactaacttctattttttttaagaaaaaaaaatagactggtgggtactcacagaaaagttgtataagtccccctgttgctatttttgatgatagagaataaatagggtttttgaaacctttgtagtgttttttcttaaaatccactcttggcaatgcaataaaaaaaaccgtcaccataagccagtg

SEQ ID NO: 8095 - DNA, 9100 bp, Homo sapiens
gtccgaatggtagcgacacgggcctaagggagggggaaagcgagggggtggggggtggggggtatgcactcttttcctcgcaacatcgctggcggagcgagggagctcacacgacacagattttggggcaaagcctttccaactggacagcaccatgtccaccaaagcggagcagtttgcttccaagatccggtacttgcaggaatatcataaccgggttctccacaacatttatcctgtaccatcaggaacagatattgcaaacaccttgaaatacttttctcagaccttgttaagcattttgtcccgcacagggaagaaggaaaaccaagatgcctccaatttgacagtgcccatgaccatgtgtctttttcctgtgccattcccactcaccccatctctaagaccgcaggtcagttccatcaaccctactgttactcgctccctcctttacagcgtcctgcgagatgctccctcagaacgcggcccgcaaagtcgtgatgctcagttgtcagactacccttctttggactaccaaggcctctacgtgactttggtgaccctcctggatctagttcctttactacagcacggccaacacgatcttggacagtcgatattttatacaactacatgtttgctaccttttctcaatgatgatattctgagtactttgccctacacgatgatatcaacgttggctacctttcctccatttctgcacaaggatatcattgaatatcttagcacatcttttctaccaatggctatattgggctcctcaaggagagaaggtgtacctgcccatgttaacctctctgcatcatccatgctaatgattgcaatgcagtacacatccaatccagtgtatcattgtcaattactggaatgcctcatgaaatataaacaagaagtctggaaagatcttttgtatgtgattgcgtatgggccttcacaagtgaagcctccagctgtgcaaatgcttttccactactggcccaatttaaaacctcctggggcaataagcgagtacagggggttgcagtacacagcttggaatcccatccactgccagcacattgaatgccacaatgcaattaacaaaccagctgtgaagatgtgtatagacccttccctgtcagtagcgttgggtgataaaccacccccgttgtatctctgtgaagaatgcagcgagaggattgcaggggaccacagtgagtggctgattgatgttcttctgccacaagctgaaatatctgctatatgtcagaaaaagaactgcagttcccacgttagaagagcagttgtcacctgcttctcagcagggtgctgtggtcgtcacggaaacaggcctgttcggtactgcaagaggtgccactcaaatcatcacagtaatgaagtgggggccgctgcggagactcacctctatcagacctctcctccgcccatcaacacgcgggaatgcggcgctgaggagctggtctgcgccgtggaagccgtgatcagcttgttgaaagaagccgagttccatgctgagcagcgagaacatgagctgaaccggcggcggcagctgggcctctcctcttcccaccattccctggataatgctgactttgataacaaggacgatgataaacacgatcagaggctgctcagtcaattcggaatatggttcttagtgagcctctgcacacccagtgagaacacgcctacagaaagcttggcccggctggtggccatggtgtttcagtggtttcactccactgcgtatatgatggatgatgaagtgggaagtctggtggaaaagctgaagcctcagtttgtcaccaaatggctgaagaccgtatgtgatgttcgcttcgatgtcatggtcatgtgccttcttcctaaacccatggaatttgccagggttggtggctactgggataagtcctgtagcacagtgactcagctgaaggaaggtctcaaccgaatcctctgcctgatcccctataatgtgatcaatcaatctgtctgggagtgtattatgccggaatggctggaagccatcagaacagaagtcccagataatcagttaaaagaattcagggaagtattaagcaaaatgtttgacattgaactctgtcctctgcctttctcaatggaggagatgtttggttttattagttgtcggtttacaggatacccctcctctgtgcaggagcaagctttactgtggcttcatgtattatcggagttagatatcatggttccacttcaactactaataagtatgttttctgatggagttaattcagtcaaagagctggcaaatcaaagaaaatcaagagtcagtgaactggcagggaaccttgcatctcgaagggtgagtgttgcctctgatcctggccgacgagttcagcacaatatgcttagtccatttcatagtcctttccagagtccgtttcggagtcctttgcgtagtccgtttcgtagccctttcaagaattttggacacccaggaggaaggactattgactttgattgtgaagatgatgaaatgaatctaaattgtttcatcctcatgtttgatcttctcctgaagcagatggagttacaagatgatggaatcacgatgggtttagagcacagcttatcaaaggacattatttctattataaacaatgtcttccaagccccctgggggggatcccacacctgccagaaggacgaaaaagcaatcgagtgcaacttatgtcagtctagtatcctctgctatcagcttgcttgtgaactcctggagagactagctcctaaagaagaaagccggctggtggagcccacagacagcctggaggatagcctcctttcttccagaccagagtttatcataggccctgaaggggaggaggaggagaatcctgcaagcaagcatggggagaacccaggcaactgcaccgagcccgtggaacatgctgcagtaaagaatgataccgaaagaaaattttgctaccaacagcttccggtaacattgagactaatatataccattttccaggaaatggctaagtttgaagagccagacattctttttaatatgctcaattgcctgaagattctctgtctgcatggagaatgtttatacattgccagaaaagatcaccctcaatttttagcctacattcaggaccacatgttgattgcaagcctgtggagggtcgtcaaatccgagttctctcagctgtcttccctggcagtccctcttctcctccatgccctgtcacttcctcatggtgctgacatcttctggacaatcataaatggcaatttcaacagcaaagactggaagatgaggtttgaagcagtggaaaaagttgctgtaatttgtagatttctggatattcactcagtaaccaaaaaccacctgctgaagtactccctggcacatgccttctgctgcttcctgacagcagtggaggatgtcaaccccgcagtggctaccagagctggtctcctgcttgacaccataaagaggccagcattgcagggtctatgtctttgtcttgacttccagtttgatactgtggttaaagacagacccacaattttgagcaagcttttactcttgcactttcttaagcaggatattcctgctctgagctgggagttctttgtcaatagatttgagacgctttctttggaagcccagctacatttggattgtaacaaggaatttccttttcctacaaccatcactgctgtgaggaccaatgttgctaacctcagcgatgcagccttatggaagatcaagagagctcgctttgcaagaaaccgccagaagagtgtacgttccctgagggacagcgtgaaagggcctgtggaatccaagagggcgctctccctccctgagaccctgacctccaaaattcctatgaggttgaccaggcatgagcagtctgctccagctctcggtgggacacccgaacagacgccaggacaacaatctcctgagaatgacaacaccatcaaggacctgctcccagaagacgctgggatcgaccaccagacagttcaccagctgattacagtgctcatgaagttcatggccaaggatgaaagcagcgctgagtcagacatcagcagtgcaaaggccttcaacacggtcaagcgacacctgtacgtcttactcggctatgaccagcaggaaggttgcttcatgattgcacctcaaaaaatgcgcctgtcaacttgctttaatgcattcattgcaggaattgcccaagttatggactataacattaacttgggaaaacaccttctccccttagtggttcaggtgctcaaatactgctcttgtcctcaactccggcattatttccaacagccgcctcgttgctccctctggtccctaaagcctcacatccggcagatgtggttgaaggccttgcttgtcatcctttacaagtatccataccgagactgtgatatcagcaagatcctgctgcatctgattcacataacagtcaatacactcaatgcgcagtatcatagctgcaagccccatgccacggcaggacctttgtacagtgacaacagtaacataagcagatacagcgaaaaagaaaaaggtgaaatagaactggctgaatatagagagacgggtgcattacaagacagccttctccactgtgtgagagaagaaagcattccgaaaaaaaagctacgctctttcaaacaaaaatctcttgatatagggaatgcagactcgcttttgtttacattagacgaacatcgtaggaagtcgtgcatagatcggtgtgacatagagaagcctccgacccaagctgcgtatatcgcacaaagaccaaacgaccctggacgttctagacagaactctgctacgaggcctgacaatagtgaaatccccgagaacccagctatggaagggtttccagatgctcgaaggcctgtcataccagaggttaggttaaactgtatggagactttcgaggtgaaagttgactcgccggtaaagcctgctcctaaagaggatttagatctgatagatctatcctcagattcaacctcggggcctgaaaaacactctatactctcaacctccgacagcgactctcttgtatttgagcctcttccccctctcagaatagtcgagagtgacgaagaagaggagacgatgaaccaaggcgatgacggcccctccggtaaaaatgctgcctcttctccctccgtccccagccatccctccgtcctcagcctgagcacagctccgcttgtacaagtaagtgtggaggattgttccaaagacttttcttctaaggactcaggaaataatcagtcagcagggaacactgactctgccctcatcactctggaagaccctatggacgccgaaggatcctcaaagccagaggagctgccagagttctcctgcggtagcccactgacgctgaagcaaaaacgagacctccttcagaagtcgtttgctctccccgagatgtcgctggatgatcaccctgacccgggcactgagggggagaagcctggggagctgatgccaagttcaggggcaaaaaccgtcctcctcaaagttcccgaagatgcagagaaccccacagaaagtgagaagcctgataccagtgcagaatctgatacagaacagaatcctgaaaggaaggtggaagaggatggagctgaggaatccgaatttaagattcagattgttcccaggcagaggaagcagaggaagattgctgtcagtgctatccagagagagtacctcgacatctccttcaacattctggacaaactgggagaacagaaagatccagatccttctactaaaggactttcaactttggaaatgccacgagaatcttcatctgcccctacgttagatgcaggtgtgccggaaacaagtagccattcctcaatatcaactcagtataggcagatgaaaaggggatccctgggagttctgacaatgagccagttaatgaagcggcagctggagcatcagtctagcgccccccataacatcagcaactgggacactgaacagatacagcctgggaaacgccagtgtaacgtgccaacgtgcctaaaccctgacctggagggacagccattgaggatgagaggtgccaccaaatccagcctgctatcagcaccaagcatagtcagtatgtttgtgcctgcacctgaagagttcactgacgagcagccgacggtgatgacggacaaatgccatgactgtggggccattcttgaagaatacgatgaagagacacttgggctagccatcgtggtcctctccacattcattcacttaagcccagacctggcagccccgctgctgctggatatcatgcagtctgtgggaagattggcatccagtactaccttttctaatcaagcagaaagcatgatggttcccggcaatgcggcgggggtggccaagcagttcctgcgctgcatcttccatcagttggcccccaacggcatcttcccgcagctgttccaaagcacgatcaaagatgggacttttttacggaccttagcctcgtctctgatggacttcaatgagctgagctccatcgcagctctcagtcagctcctagagggtctaaataacaaaaagaatttaccagcagggggtgctatgattcgctgtttggaaaacattgcaaccttcatggaagctttgcctatggattctcctagtagcctctggaccacaattagcaaccagtttcagacattttttgccaagctgccttgtgttttacctctgaagtgttctttagattccagtttaagaattatgatttgcctcttgaagatcccttctaccaatgctacaaggagtttgttggaaccattttcaaaactgctcagctttgtaattcagaatgccgtcttcactctggcctacctggtggagctgtgtggcttatgttaccgagctttcactaaggaacgagataaattctacttgtctcgtagtgttgttctagaacttctgcaggccctaaagctcaaatctcctttaccagatacaaaccttcttctgcttgttcagtttatttgtgcagatgctggaaccaaactagctgagtcaacaatcctgagcaagcagatgatagcctctgtacctggatgtgggactgcagcgatggagtgtgtgaggcagtacatcaacgaagtgctggatttcatggcagacatgcacacgctgaccaaactgaagagccacatgaagacatgttcccagcctctgcatgaagatacctttgggggacatctcaaagtggggctggcccagattgcagccatggacatctcacggggcaaccacagagataacaaagctgtgatccgctatctgccttggctttatcatcccccctctgcaatgcagcaaggacctaaagaattcattgagtgtgtctcccatatccgactgttgtcctggctgctgctgggttccctcactcacaatgcagtgtgcccaaatgcctcctctccctgcctgcccattcctctggatgcaggctcccacgttgcagaccatcttattgttatcctgattggatttccagagcaatcaaagacctccgtgctgcacatgtgctccctcttccacgcgttcatctttgctcagctgtggacagtttattgcgagcaaagtgccgtcgctacaaatctccaaaatcagaatgaattcagcttcacggcgatactgacagcactagaattttggagtagggtgacacccagcatccttcagctaatggcccataacaaagtgatggtagaaatggtgtgtctccatgtgattagtttaatggaggcattgcaggaatgcaattcgaccatttttgtcaagctgatacctatgtggttgccaatgattcagtcaaatatcaagcacttatctgcgggactccagcttcgcctccaggctattcagaaccacgtgaaccaccacagcctaaggacgctgccgggctcgggccagagcagtgctggcctggcagccctccgaaagtggttgcagtgcactcagttcaaaatggcccaggtggagatccagtcctcggaagcagcctctcaattttatcctctatgagtggactcctcggcgctcagtgtcaacactctggtttagcaataatgggtttaaaaacaaacaatttgatccaagcaggttggggaacatattggtactgtacattctctttctagtttagtaaaagatgtgcaaaggccagagagggccgaaaatgaagctttcttgctacacatatttctgatgactccttgggctatctgattaagtgtttccttacattattttttaaaaaccaaatcatttttctttaactaacttctattttttttaagaaaaaaaaatagactggtgggtactcacagaaaagttgtataagtccccctgttgctatttttgatgatagagaataaatagggtttttgaaacctttgtagtgttttttcttaaaatccactcttggcaatgcaataaaaaaaaccgtcaccataagccagtgacacctgactgaagctttttgtctttatcctgggaaaagtggcagcttgcaaggaacattacaaagtgcacttagaaattaggtggttaaactgtgccaattgttttcgttgttttataatatcattttccaaaactgtccagtaagttttattatttttaaaactagtttttcaactcattagttctaggctgtactctcttgtaagctttatgataaccactttagttttgtgaataataaattttattcttttgttaatacttgtatacaatttaattgaaaactgtagcttgcacactggaccagatgagtccctcactggcacagtgccctgcacctggagtgatgtttcataaaacggaattttaatagtgtaagagcaccaagatttctctgcacctatacctagcgttggactgtgcattccaaatgaaattcctcctctttatccctgtaatgcactgactaacagaagacttactacacatttaaactgtatattgacatgctattaaatgcgttttttatta

SEQ ID NO: 8096 - DNA, 651 bp, Homo sapiens
acccgctctccagcctgcgcctggggttggaggtgcccagcgcgccgcctcttaactcgggggtgacgctgcccgtttcccaggttgaagaagcctcagcggaggcgatacggcctcctcgccaacactgaggaccccacggagatggcctcgctggacagcgacgaggagacggtgtttgagtcccggaatctgagatgatgctgagccagggaggcggcccttccagcagccatgagggaaggacaggagatggggcccaccccagtgcccagcaaccccctgctccaccgctcattcccctgctggccccggggctggtctcacccagtgccaacccgagagctccttttggaacctgcacagcccgccgacctgttgccacctgcacccaccgctggaccatgcagcctcgcctcctggatgctgtcccagcctggccgagggtcccaggtgaagactggagggaccccaacagccaccgcccaggacgctgaggctcccttgcctgactgtgacttgtgcctctctcctgcccccgtggggacatggcagcccagagccaaggctgggtgggcaggtgacccaaggaacctttctgggaacaccttctcgccgggctgggaacaataaatgcagccatgtctctgc

SEQ ID NO: 8097 - DNA, 3057 bp, Homo sapiens
agacaagaaggatggtgctgtggccgagatctgtagatgcacacggctggtaacagagcaaccgggaccaagggacaacaagagctcaggagaaggggagagacaggtcgcccagagagtagacaatccagggcttgaggaggctggctgtgcggtttattttttctctccacaaagacacacactgtctaaactgtgtggctggttgttactaagaagctgctgcgagagggaaaaatgtatttaataaaaggccctgtgtttgtggtcttcttgggcttgctgtgagctctggaaatcttgaggtgtgaccagatttcagccttcaaaaccaagatggactgcccttgagaaggggtggtcagagggaaacatgttcacgctctccctcctgagccggggccacgggaagctgggccaggacaaacagaagttagaagtctactttgaaccagaggattacttgaactggaggtccccagaagactatgttcctgtcagcaaacctcaagataagaacaatgccagtcagcactcctggagcctctttctccctaaaactttcagtactagaaagggtgccctgatcctgtactcagaaggttttgccatttcggcatggacacccaaagagaggagaaaaggcccctactgccccagaggtccctggaggaagctggatcttgaactgcacacacttcaagacctcaaagaagccatcctggcatatggaaggcagcagttgaatttgccaatgggagacgctggaaagagattggagagggagaagaagaggaagaccacagtatttctcccttcccactctgcctcaagtgaaaagaagcatctgcattacctctgtgatacagctctcaacagacaggcccactatgacccccagctcctccagggagagcaggacagagcctggcaaccatacctccacttccgaagccagctggagagccaggcccaacggcagatccagccagggcattcagccaagagatacctccgaggcctcctgcggacttggcccccagacgccatgtataggctctggtgcgcaggatacatcaaggattctgtgctactccaggacagtcaacttaatgtaccaaagaagctcaggccacaacaagatctttcaggtgtacccccaaaataccatctcctgcctgtcttcccttcattttggattcaacaaggaaaatcttttgaacaacgtcaacagggcctggatgaaggggaagctggagctgctggacacgtggaccagggccctctagccaagaaccatggcagtcaggggactcgcttgccaccacgcaggaagcagccctggcaggaagatgaaacgcaggcagaggacacgtcaatagagaatcacctttgtttatatgcttcaaaggagagctacaatgaaaagacacagcaaacctccaggaaggcctttgggcatggccgcatcgatcactcttggctcccaagtgacaaatcccacattacattctgtggaggcgccttccctaataggaaggcagatctcagcgataaacaaaggaacgtgaaactccacaaggccagaagcagccacttgttacaggtgcttcctgctgaaagaagcctcttccctcctgtagcatctgccactggctccagaataatcacccctggggaagtgaagaagaaaaaggcaccaaaggctttgaaattacctcctatctcagaagaaccacccagagtcttggagcccctgaagagccaatttaaagccaatgagcccccaacagagctcttcatcttaccggtggagattcattaccacaccaaacaacccccaaaagagaaagcccacagaagaggtgctccacaccctgagtcagaaccagaaagcagcgaagaatccacacctgtgtggagacctcccctgaagcatgcgtccttagaaacaccatgggagttaacagtgcatctcccagtggacgcgagcagggacacactctcacctcaaggtagctcctccctccctccagcatccctcgggaacctcactctgaagggaagcaaggcaagacacacaagggtccacagccaaggaaaaggagtctggaagggagatgatgatgccccacctcacgatgtggccccaccattggatcttctacccccgattaaaggaaaaaaaagtcctgagagccagaagggcgtggacagccctaggacatcagaccacaacagccccccaagtctcccgaacatgagagtgcccaggagggcactgccagcagctcaagaagattccagcgaccctacactgggacacttcttgctgggtccagatggagaaaaagtctgcctgtccctcccagggcatacccaaaccgaggcgcttccatcgggtaaagcctatgaatctgtcaattcaaatatcagccatgaagaggaagggcctagtagtcagcatttcctaaaagacatggctgctgctgcttcagaccaagggaaggatgatgacctggagactttctctcctaaaaatagtctttgattaacagagaaatcaaacactgaacctagagccaatcttcacatgaacctttatgaaacctcaccgttgacccaaacaacagagaagcagggagcccagcagtccttggaggcagcagctcagaagacaggagagcctcaaagttgtataaataaagcgctgatatgttcaaacagaaaagaattttacacgcgcaagctgcacatcgacatgacgccgttcctgaaggtgatctcacactgagaagacgaggggttttatagacacaaacacaggaattccagttaatacacttctgcatggtacaaaaacagcttcagaagtccctcagagctcctgcattatcagaagggacagaaaataggcagtttgtagcagatgaagaaagaacaaattaggacagtaatcacagccagccatcggggacaaatcagtcgggtgtctggtttgggtggtgggggacagggaacagagaggagaaagagtaactttaaaccacctcataa

SEQ ID NO: 8098 - DNA, 1588 bp, Homo sapiens
attgtgggggaggggccggccagccagggcaggcaggggcggcctctctgacgagaaggaggccactgggctgaggccaatgaatgggaaagagccagccatgtggtgagctgggagagggcatcccaggccgtgcgacctgcgcttgcaaaggccctggggccggacagttcttggcagagtctgagggcttgagtctgggggagcctggctgcccagaggtggcagatgacatgaagaaataaccatgtaagggctggctgtgtatgagagcaagcattgggaaggatgaatgccaactatgttccaggaacttccactgttctcacacacccaggtgagtggtgttcaggtgggtggcacccaggtgagtgacatcccagttgagtggcacccaggtgagtagcatccaggtgagtgacacctaggtgagtgacattcaggttagtggcgtctgtgtgagtggcatcatccaggtgagtagcttccaggtgagtggcacccaggtgagtggcattcgggtgagtggcattatccaggtgacacctgggtgagtggcatccaggtgagtgatatcatccaggtaagtggcacctaggtgacatccaggtgagtgacgacatccaggtgagtgacatcatccaggtaaatggcacccaggtgagtagcattcaggtgagtgacacccaggcgagtggcatccacgtgactagcattgtccaggtgcataacacccaggtgagtggcacccagttgagtggtgcccaagtgagtcacatccaggtaagtggggtccaggtggtggcacccaggcgagtggtgcccaggtgagtgacagccaggtgaatggtgtccaggtgagtggcatcacccaggtgaatggtgtccaggtgagtggcatccaggtaagtggtgtccaggtggtggcacccaggtgagtggtgtccaggtgaggggcatcacccaggtgaatggtgtccaggtgagtggcatccaggtgggtggtaccgtcgacgtgacaatagctaaaaattattgggctcattgtggacaggcactgtgccgagcttgacatcactgaactcagttcatcctcgccaggagcttgtgggccgtccctagatcagaatccgaggagaaaggacttccacacggcagccagcgagctggagggcggcctcctgccaccaccaggctccctaacccagtcctggatatctgtgaaagaatgagtggatccccacaggccagctatccccaaacacactcgtttacactgaagcaccaggagatcagaaccttctggaatcttaatatgcgaggactcggtggagaaggcggcactgaagaagagtcgtccctaggccaggctggagggaaactcaagacggcggcctggccctcctgggtggcggaagtgggagcagcaggagccctggcggatccgggaggccagaagagcggaagcttcctcccctctcagcagctacagtgcattccaggccctggtctctatgcgggagaagccagcaaagaccctgtcctcaggaagcttccatttcagtgcgggaggacccacaatccatga

SEQ ID NO: 8099 - DNA, 1799 bp, Homo sapiens
ggaatcccagcttcaccctgtcaactgcttaggaatccgggcttttgctgatatgcatgcatgtaccgaccttctgaacaaggccaacacctatgcaggtggagaagccgaggacgggctcagggaaccggagacggagaaggcgctgtcctcttcactgcacgcgccctggaccagtgctggccttgatcatgcagctcttccaggcccactgcttcttcctgtccactaggccacagctgccctccaggcccactatgcacacatcttcccctccaaggtttgttctgcccctgccctgactcccagccctgcgggggtcctgaccccacctcacctggctcagactctgatgctgccctggctgccccaccactgcctctgcccgagagtcacgtgaggctgagagtaggggcaggggcagcagtggtgccagttggggggcggtccagtgggaggagcctcagcctcgtgggctgttccgtgggactgatgactgcatgatcttctgggcacctcacggatcttcaactgcaggtgaaacggatgctggtggtgggtgcagggccactgggagccgctgcatggtcccagaggctggactggggcaggtgccaactgaagctgctggggcagcatgggcaggatgttctgcacacaaaccttggagaagaaaatgtgtgcatagcgggtccactgctgctgccctgccctgactcccagccctgcctgaccccacctcaccctgctcaggctctggtgcaactctgggtgccttgcccctgcctctgccccagagttggggcctcgacagcctggctggaaggggacaccccagccctgcctcaacacctgggtccctccataactaccacaggcagatgggcgaccccaaagaagatcccaggactcacagtaccccctgagaacatggacagtatgtgggggtagccatggaggtcaggatggttatcttctcccgggtaaagccatttaatcctttcagtttgggatggaataaggcctgctttttttaatttttttttgagacggagtcttgctctgtcgcccaggctggagtgcagtggtgcgatcttggctcactgcaaccttttcctgcctggttcacgcaattctcctgcctcagccttccgggtagctgagattacaggtacacgctaccacgtccggctaatttttgtatttttagtacagacggggcttcaccatcttggccaggctgatttcgatctcctgacatcgtgatccgcctgcctccacctcccaaagtgctgggattacaggtgtgagccaccaggcctggccaaggcctgctcctcttatatatacccactatccctgcagctgtaccgggggaaagcttggcagtttccctcctccgagcccctgtacatatcatgaagtgtgggaccttcagagcttttcacttttcggaaaatagctcctgctggggctacaggatggagtgtgaagagggccttgggccacagggaggtgcctgtcgactatggggagttcatgcaccccttctttccccagaggggctggactcaggtgagtatgggggtggaagctcctgcacttcgacacaggcagcgggagggttttctccccattccctctgctatcccaacttgagttgtactttttaagaaagtgattcaccctgcctttgcccccttccccagaacagaacacgttgatcacggggatattttttattgtgccagaaagttgccatgaccgtcattaaacctgtttaacaccaaataataagg

SEQ ID NO: 8100 - DNA, 1269 bp, Homo sapiens
ccgccgtgaccacgccgccaccgttatcaccgccgtgaccacgccgccaccgttatcaccgccgtgaccacgccgccaccgttatcaccgccgtgaccacgccgccaccattatgctacatcctgatgatgcctccacctcccctcctttgcctttatgacttacccttggcccccacaaccctctctccgctcccttggtcctattctggttggaaatgctccagaatagtaatgcttgctcaattatttaactcctacctgttttcttccagagctggcctgtcctccccgcagcaattacgagctctgcggctcctcctgtcctagctcttgtgccgagcctgccctgcccgacagctgcctgacaccatgccaggatggctgccagtgtgacccaggctttgtgctcagtggcatggactgcgtgcccccaatccagtgcagctgctccatggggggcaggtaccaccacccggctggggaggccttctggactggggagcgctgtgagcaattctgccactgccaggcctccacccacgccgtgtgctgctccccgtcctcctgtgggccggggcagagatgtgagaccctcaggggcatctttgggtgccacccactctcccctggcatttatcaagcaaccatgcactcacacgtcgcctcctttgaccggaagagtgttgagtttccaggcacttgcgcttctgcttttaccaagtcctgtggctcctccagctcattgcgccttttcaaggtggaaattgggaaggagaaacaagtccagcagtcccattgtgttcatttcaaagatgtaggttcatgggacccaggtttgtctgcagagagagccccgacctgatgaggtaagcactcattggcatctagagactcttgaaccgattgaagctaaaagaaatacattggctcaaactaagtaaaaatcatgtgatagcctagtgaaagtgtagagattctgggtccacagaagttccctatataccactttggctgttttggttacagaaagcctcataaaaggtaactcaaaccagtcacagactgtgttttatgatttttagactaattacataactgaaaattccagagggagatcaggcatggtttgatcagggtgctaactcagtttttcagcatttctcttggtctgtgtttctctatagcattagctttgtcctcaggctggcttttcttgtgatggcaaaataactgccaattttccagtcattaaatgtgtattccccat

SEQ ID NO: 8101 - DNA, 2392 bp, Homo sapiens
agatgccctgatcacaaacacctgcctgcattgctgaccacaggcctggcctggagaaacccacagcctcttcagggaagcgagcaaggggcttggaagtgcctgaagccagtgggctggggactcacggccgggacactcagggcaggtagggcgggcatggggccccagcatggcacagggccagacccaccccctctttgtcactgcccacatactgcggggggaggggctggaggaactggggcacctgcatttggcctgcagggaatctgggtcccgctggctgtgggtgaccgcagagggccatgtgggcagggtgcatccatgggcgccccaggccaacctcgtcagggtgggagggggaagggccaggaagcctcagcccagaccaggtatggtgggaacagtccacacgggaggggccagaaccgtctagaaggccctggcgtacaggtctgctgcaacagagccaggagggcacgggggtgcccacatccagggcagaggcaccacgtggtgctcagtcagtggtcagggtcaggcctggttggtggcattgaggacactgcagacttggccccacctccaggagctgggctttctccacttgctcacagcaaaggcagggaccagaggggtggggggctgcacccaccctctcctcgctgctcccctcccccttaccaccccgtccagcgatgtccacgcagatgggagagttgtgagggtcgtccacacctggcctgcagtggctgcccagcttcctgctagggagatggggccggtgctgatggggaacagctgttgtgggggcagccagaggaaaccacgttcccgtggggtgagctcatggtttacacgttccctgccagatccataacatcctggaggcagaagcgcagaggctgagcccgcccccgcccccgctgagcctcccctgctctgacaccagggcggctcagccatcctcgcttagcctgcacctcctgtcctgaagccccttcctccctccacttgctccctctgtcatttactccccagccccgacccaccctgctcacccctgaagcttctctgggtcctggactccgttctgcaggctggacgccttctcaactgtccgtggagcctgcctggtctctgggggtgttgagtgaggggtgacccaggaagaacgtgtcagagacagtggacagggaagcgtttctcaccccttaactcacagcagccccaccgggcggacacaaccatcaacccagccgcaggtgtagaaactgaggcacacagacgcgatgtggctgcccgtctggtaactagcagccgggattggagcctgggtccaagctgcctgttctttctttcctaggccgtgcgccgtttctcctggaataactggaggtgatttcatggaacctggaggctgggcttcaggctggggggagaggctccagactgggtcttctccgtggctctgccccccgctctccttgcttgagtggtgggggccctgcatcctctcatgcccacccccacctttctcgccaaattgtcggaggcttttgtcacctggagacactgttcctgccagctccggtcttggaaaacatggcctctcctctcctgccctggccccggcccctcctgccagctggacgtgggcatttctgcacccagtagaaccccacagccaggaaagatgcctggaaggctagagaagaggcgcttctcagctatgcctggtgtgacccccagggtcttggtcggcatgaggccacagagctcacgtgcacttcccgcagctgcttccacggtatagatgagaggttcccatggagctcacatgacctctagagacttgcagacccctatgctgtcagacagaggaggctgaggctcagagaggcacagtcaccttcttgaagatgcacagccgtgagtgaagaagctgggatttctcctggtctctctgaccctggaacacgtggcctctgggtgtgcccagtaagagacgttaaagaagggcctcccccatgagccctgactgaggcggggcgctaggcaccccatcgatgtgcttcgtggttcacaggggagaggcagagggcctgtcggggggcagcgatggggcagccagagggggcggtcctggcctgtgtgagcctccttgaggggagggtgccaggaactaccccatgatcttctattctcatgtaagccacaagaccccaacccagatccccacagcaaaggcgaagtcaccaactcaacaaggcgcgtggccaggcgtggggctcacgcctgcaatcccagcaccatgggaggctgagcaggaggatggctcgaagccaggagttcgaaaccagcctgtgcaacacagcgagaccgctct

SEQ ID NO: 8102 - DNA, 1101 bp, Homo sapiens
aaatacgagcgccgcgcggggccggagccggctccgtcctgggaccaaccctgcgtgccggccgtgaagaactgcgttcctgagccctacctacttttcctcggagcgccggcaccgtggagcagcggcatgcaacgcgggccgctgtcgcccagtcccagtgacggtcttggcgcgctcggaactacgtatcccggcgtgcaccgcggacagagcatggcgggactacgagtcccagcgttcaacgcaggcctgcgtgccattaccccatcacgcgctgagacccagcatcccgagactacgagttccggcatgcaccgcgagccgctctcctccactcccatcgcgcactgggaaggcgcccagtccccaggagcacaatctgtcctggccatgcttgtccaccgaactgcagcttacactctgcaggtcctggagcccaagaaagaccccgggagggagctcccggccacgcccaggtcctgggccccggcgaggcagccatcaccacttcacagcatccgacagacaatgccggcaaaacccagcctggtaaagagggagagaaggaaccaggctttggcaagagaggcgccgtggtttccccagagaacacagtggaagacttccgaagggccaggttcctcctcagggcggagggggcggcgctgaccgggctgagaccgggcttggaaggagcaggtggggctggaggccctgcagggtctcggctgggtccgcagttttaaatcagaacgggagctccgggcctgtcatcgtcctcatgggcggaatgaacccacacaacgtgatccgtcctacagtggaatattcagctttggacaaggaaggaaaatctgactcaggctataccatggatgaatcttggggacatcatgcccagtaaagacaatcacgttcgggacagcagacaccagcgtggcagagctgggttctcctcctgggggcccaggccgtgaggagcagccggccaaacttccttcaggcaaaacacatgcttttttctttttttccttttttttggcatcaaacttaccaagaaatatctctacccaactttactgaaactttaaagcttgt

SEQ ID NO: 8103 - DNA, 2121 bp, Homo sapiens
ccctatctcgggccgccgcgcctaggcccgtgagcagcctgtggtggggcatggcggcacagccaccggcgtgcccgcgaggcctcgggacccagaccaggatttccatcagctcccctggctcgcaggccttctgacttctgactcaccatcagctctcctggatccagcttgccaatggcagatcgtgggactccttgccctctaatcgcatgaaacaatgcccacagggcaggtctcactatgttgcccattctggtcttgaactcttggactcaagcaatcctcccacctcggacttccaaagtgctggaatcacaggcttgagataccatgcccagccaatttattgtgatggtgagctccttagagggaagtatagtacatatttcctccatgtctccagtacccaacacagtgcctgacgttgagagggctcttaataagtgtttgtgaaagactggtagagcaatgccctatgaaacaagaagctggataacactgcttaggactcagaggagagaggagtgtggtctacactgcacatctctgccaagcctggcacgggatttgaagttccacaccactgagccaaacacatccagaccctcttccaacgatctgagaaacaggaagttgtgtttggctgcggacaaactctctcagtgcccctgggacttacaagatgtttggaatgaggaacggcagctctcccaatgcgagctcagcggaggcccccagaaaaacgtggggaggagagttttccccataagacagactgtccttcagccccggccaccaaagaggagtaacccgggcctgctgttctctgggactgaatgcggctgcatccttcccttcctctgcttcctgtcccggtacttactgacggtgcacatgcggggcttggggaagctgagtgtctaaccgcggtgcagctacggatgggaaattctgggcagggacgagcctgtcttcacctgaggaattccctcccacatcacacagggcagagtgggagtggaggagggcagaggacacgtctcagggccagtaacctaggcttatagaagacgtcatcaccgtcctcatgatgttcaccccgtctcctgttttttggggccatgtgttccgaaatgtagcttcaactcatcataggggcaaaaagaagtgatgagtctgtggcagcagaaatctgggaatccaagggtcgtgctacatttttcgagaaaccattttgaattcccaaacagcaaaggaaatgctgcaggttcctggagggacctggtgatctggggcagagcacacggagtcgagattgctgcggggttcacgagcctcccctcctgggaccaggggcacctgggcagggtagtctgcaccacgcaggaaagcccagtacacgcagctgctcaacgctgcagacgccatagcgcagggctgacaaggcctccctctttatctgccctggaccacaagtggaaaatatcaagacaaagcaaaagccagtatcccttaagaactttccaattgttcttgtcatttgtagttttgttttttggggggtgtggggagggaggggtggtttgaaacaactccggagcacactccagaggaaaacaggaagggtgacatgtttggacaccagaaaagaggaagagtcctcactaagagggtgacttggttaaaaagttcaagcacaaaggatgtagaagcaggtggatgtcatcagagaacagatgcggatctagtgagatgggtcctaccacccctggaatatgttcctgggagaggggtggtctgctagagtggactgggaatagtaatattgcatacttttgtaaattcacaaaaccctctgatctgtgatagaggaataaagggcagaggataaaccccagataaagattcacttatcttaaaaatgaaaggttggaaattaactttatgctactgtaccaccttcgaagtatttctggcaggtgcctggaggattcagattaatgaccaaattacctgccaagtcagggcctcccattagaagagagtaccagtttccattaggagcactagctggaaaacacaatctttcagcagaggaaatacagtcttctctccttc

SEQ ID NO: 8104 - DNA, 1154 bp, Homo sapiens
agatgattatcccggggctcctctgagaaaagtaggagtagattgctggaattaccatgggttaaaatgaaagaggatgacctggctggacaaaggcgtatggactcaggaagacgagaactcctgctccttctctgaatcggattttcctggctgtagagaccagatcaacccttccattccatcgatttggaccgcagtttcgggaatgatgatttcgctggaagtgcggtggtggataaaggggaagcagggttacgtaatttcactgggtcacgctctgtcacctaggctggagtgcagtggaacattctcagctcactgcatcctcggcctcccagggggctcaagctatcctcccgcctcagtctcccaagtagttgggaccacagctttgtatctggtggaggaggcttgggccgaagctggtaaaatgagaagttaggggaggatgtcctcagagagctggaagatcacagtcctcattgtcacaaccgatacagtgttgatagggacaacatatgccttggaatgtttcaaatactttgccacaattaagggacactgaacaggaactcagttttggaaaacaaagtggaatttctggaaactgctagcataaaagctttgacagggtcacatgcagattagcataattttattacattttctattttagtcctgtgagatactaatttggatttcattgtgcccattgagcggcttttgttctttggctgtgagtttaattatttagttatttatgagtgcatctgggcataagtgccacagttttatttcggtgacaaatttatggtcagtgaattttagtaattaatgaataaattatttctcctccataaatgcccctgcaatttctgattttcataacaattcataatacttaagaaaaattctttattagttgaaaaagccaatgctaatggaatcaggaaaaggagatttcaaattgctttaattaactgtattaattaatatccaatatgtgtaagatattgaattggctttggttgtctctcttagcatttagttgcctaaaatctgtttaacatatgaatatactgtgttaaaataaattctaattcttttgtgaagtaaatggcaagaataaaaggatctcctttataatcttt

SEQ ID NO: 8105 - DNA, 2967 bp, Homo sapiens
actcgccgctgagcccatctccctgcaacactgcaggtagcggagtctagagacaacacagacagcggctgccgacggctgggactgggagaggatggctatggggcacgtttccttccagggtgataaaggcattcattccaagatagactgtgatgatggctgcacgctctgtagatgacatctcaatcaagctgcttcatgagaaaggcccagccactgaccacggggtgaacgtcctgccatccacagtccctggccgagaagaaggtatgactgacaggaagcactggttttctttcgggacacaaccgaacgtgccaggactgcaggagccgctggattacagagcagcaaaccaggcatggcaggcggtgctcgcggaggtaccacggggcggaccagggtgtgcagcgttacgtgacttgggaagatgtggggggcccgatgtatctaccaggagacagtggagacctctaccctttagctgtcctctgtcccacacaacccagcccccactgggcggccactgcaggggaagctcagctggaaggttccatgggagagaccagaccagtcctggcactgtccagcagctgccttcggcccatgttctgaaaccgggatgcacacagcatggagatctcagccctgggcaggcctcgccccctccagcagctgccctcggcccatctcccaaagcctggacgcatacactggggagacctcagctctgggcaggcctgggttcccatcgcttcggcgtccctgggcccgggacacggaacacacttgctgcgtgctgtgtacaagaatgaacgaatcggcctgcctagcaccccttggccggctccaggcctccacttgctgtgtcaagtgaggctcccacgtgctgaggggacagagggtccctgtgacctgcaatgctcccactctcacccacgcagctgctcacctacacagccggtttctccagggctaacaggccacccagatgcaagccagtctcagcccctgaccacactggttttcaaatgaactgtggactctcatgacagagaagcggctgggagtcccagcgtgggatgtggtgggacggggctggggtgtgcagagacgatgatggaggagctcctgggggcacacagacctagtgtcgctctcagggctgggtccgcaggccactctccctccctcaacaacactcacgcctgctgcagccccaggaagggtcaggactcacagatgccaacaagcaagcagcccgtgctggaagcatcaccaccaccggccccagcaaaggcttcctggtgtgtgcggctgaccatcggccactcgggtagacagaagtgtgggtgggctgtgtgcatgccagggcagacggacagcccggggtctcaggccaatggaaacaggaagtttccggctccatttgaatactggtggaaatgccgggccctcatgctgaataggacactccatccaagcttgccgcctcctcggaggcttgggccagtcaccgggcccggctgtgctttcacagctgcttttcttatgggagagcaagatctcctgggattcaagaccctaccaggagtagaagacaagggtcatgggaaggctgtgtgagccctcaaggggcaccatggaccccgagcaccagcgatttgcgctcctggttccgagagcccagcgctgaatcctggcagatggggaagctgagctctgtctgacctgctctggaaaacaactggtccagagaaggacgaagatgtcacttaattctgagttgctgaggataagccaggggccctggaggtgactgtgctgcccacagcatcccaagggatgccacatccccacaggggcagcccaggtcccccagaggattgtgtgccccccaccaccaaggtccttgcccactggtctgtgcctcaataggacagcctccttctcacactattttgaaatataaaaataacactcatcacccatcacccagtcactcagaatcacaccagcgggggcacagaggcgacggcatgtagttctccagcctgtttgtgagcacgggtgtacatgtacacacacacacacacacacacacacaaatgcacatgcacggacacatgcacacacacatacacgtgcacacacagacatgcacacacacgtacacacatgcacacacacacacgtacgcacatgcggggtcagggagctgatgctgtgcgaggctgtcgagggcttcttcactcagcggcacttgggaagcgctgctctgtgggaggcccctcatccatgtcctcgttattggcagcacaaatctccaagtgaggaggggccatgtttaccagccgtccttccagcccacgtctcctacggttccttattttcacaggtactgttttgcagacacagagcccccaagcagcccacacgtcttagccgggtgaagctttgctttatgaagtgctgcctggacccctgatggtcggccctccccgtcgagacagtggcaggcaggcgggggtgctcagggctgtctgcagggggcagccaggacctcactgaggtggccgactgggtccacgccctcctcagcctgcactgctggacaggccccaagaagtcgtgctcggcgtggcccaagaacgggaagcggcagcgtcctggcgtcctaggtgagacttcaagacggctccctgctcccacctgggctaaaggtggaaccccaggtgtaaagagccccctggggtacaggggaggctggatcagcagacgccggctctgggagggccctgaggggctgtggagggaaggtgaccccgcagtggcagcggcagcggaagcaggacggcgcggtgcccgacacctgaggccactctccctggacggggggcgggcggcactgagaggcggccataaaaaccggagtttatttaataaaacaagagcccacgcggc

SEQ ID NO: 8106 - DNA, 1798 bp, Homo sapiens
tggtggcgcatgtctgtaatcccagctactcgggaagctgaggcaggagaatcgcttgaacccaggaagcggaggttgcagtgagccgagatcgcgccactgcactccaacctgggcaacaatacaagactccatctgaaaaaaaaaagatcacacaggaaaacagaagttcgattttacgtcgtacactgctgtaatttcagcacatgtggactcgtgtaaccaacaccataaccttccatcacccctgaaactccctcccgccagccctttagggttgcccctccccccgaaccccaccagcccctggtgaccactgatctgtcctccaacccatagtgtttttccgggaatgtcacaaaaacagaagccgaccatgggtcacctttctggcgcctttctccccgcacaaagtctttgtccttgtgaagttgtcacgtgccaaacgcttgtccctttttcctgctgggtaatactcccggtgccgcccttgctgttcgtcgatgcacatctggctgcttttcgctggctgcgagcggagctgctagggacatggccacggggctgtgagagcggagtttcctctctccggtgaccctgagctgcgcctttctcagccgcctcccgaggccccaggcgctctgcgggggctctggcggggttggtgggggtgggcgttctcgttgtttcagcggcgctgccccaggccctgcgggagggaccgtgggacccgagacatccccgcctggcctccgctccccacccgggagtggggctcgcacccccccaacctcgggtaaagacgcttctggaaggaagggcgccccgcggaccccgcccaaccctgcccagcccagcccagcccagcccagcccttcccggggcggcggcgcgggaagcaggcggcggcgcacgggcgtcgtcatggcaaccccaccggctccgggggccgggaccgctgccccctccgcccctcgacccccgcccccccgcccttcctggctgcggctggacccggctgcgcggggcgcgaggctgcctttcccgggatcaccagggaccacccggcgcgctccccgggaatccgcacccctggccccagcgctccggagcgacccgggtcagcccctggctgcctgcaatgggcccccgggcgaaccccgggcggacccaggagtgagcacccggtgcgcggcaacgatgatcccgcaagggaagctcacgggaggcaggagctgtggcagccgccccaggatggggcgcggggagcgcgctgagctgtcctttcccgcagcggccccgcggttgaagcgtgggcttgggttttggtttttcttctgtggcaacagttctgttgagatattactcgcctgccatacaactcacccattttaaaagtacacctcaggggtcctgcgtgtattgacaaacccgccgccgtcaccacagccaatttcagaacattttcatctcttcaaaagaaaccctgtacccttcagctgtcaccctcctggtccccatccggtcctcgtcccgccctcagcagccacgcactgcctgtaaagtcccctgtcctgccctgtaggtggaatctataccttggggtctgttctgacgttcacctaacagcctttccaggctcagctgtgctattgtatggaccagggggttgttttgtttttgttgtttgttgattgtgtgtgtgtgtgtgtgtgtgtgtgtgtgtgtgtgtgtgagcctggcgtggttgcgggcgcctataatcccagctgctcaggaggctgaggcaggaggatca

SEQ ID NO: 8107 - DNA, 2328 bp, Homo sapiens
gagctttgaactttctttgttttagaaaattgcattgatatagtgttactctcttgtgatattgtgttgatatgacattactctcttaggagacagtaattttctaaaacaaagtcatattctctcaagttttcctcccctaacttggacaatccctacctaatctccagggatagactcctatcatatttccaaactattaattatagcagaaactagatgtcttttgggattagccttttaaaaatagagcattccaacccttacaggtcaaaagccctggatttcaagaatctgtctctgctatgagtctcaagagcctattttgtaactcagaagccaaggacaacaaatgctaccatacttattctgagtcttcctggtcagaaaccaagaagatagtcattgcaacaaaaatacacagctttcagacattctcttcctgctactcagattgtcacgggatacttggggtgttgcttcaccagctggaaacctctgtggctggtggtaccttctgcctgagtattgctcatgcctggtgggctcgctttgcccactcatcctggaaggctgcactcggctcatgctatcagcctggattccatacctgccaagggcaagccaggctcggatcagtgaggggtgtgtgggcaagtgagcatggggttcagccacagcgcacaggcaggcacactggctgctgcggcagggtgggcagcttcaggcactgcagctgaaccagatgtactacatgcagcttctgttgtgggcacccatgcctggacaaggggaatgcagtggtgcctggaaacttggagatgccaggaaccacagagcctcaaagacagtatcatcatagccctaacttggggagcccctaggtctgggcttccctaagggcggcaactcttttctccttcccgtcgctcacaacatggtgagtggcaggtcatgtttcagccctgtttgtgttatagccctttcagtcctgccattcagcaggtcctgagttcttgtcccacatccaggaagaatgaggtacatggacaactggagggtaaacaaggtggagagaagcttcattgagtgacaggacagctttcaatagacccaaagtgggtagctcctttccgcaggcaggttgcagccctcagcggagagaccaagcatgggtagctgccatctgcaggcaagttgtcccaacatctctgtgagtatggctgagtggtggatggggcggaatggagagagagtcctttatgggcttcagaaggaaggaagtgcattgtgcatgctgattagtccatgggcagccataggcaggcctggaaaaagcaccataagttcttactccaagccatggactccagccagaactgacagcccagaccccatactttaggtcatctctggcttgaaggtggggcttcactgtgcacccacccttttctatgcagaagtctgtcttcctcctgctgctatcatattgtccatagtgcccacgctgctcatgctgaggagtgcctgcaggcccgacaagctgccgtcaaccctgcctcagcctccctcccatgctgatcagtgcataaagtccaagggggccaagggccagggtttggcatgtcagcgtcaccccaaacatgcgcacccacaggcaggtcagaagagcacccgggcttgccctcaactttgctctgaaatcagagtgggcaccaggcacagggagaagccaggcagtgggagtaggcacttctgagcccgcgaggctgagggggctcagaggtccccaggagcacagggtgcccacgtccgcagctgtggctgggtagctgcagcagtgcctcggagggcagggctcccaccctgccaattcagaagggggcagggctccccctgttcccagccctagctgcacctccccaacttcagcccatgtcttcacagcagccactcccaacgggctgccactgccaacaagatgacctattttgccaatattcatcaactagaacatatttcacaccacagtgttgataaaggaatatgccaataagatggatgctttcatttatgatgaaaataattattacagagaagagtctgtataatggcagctataacaactggatctacttgacaaggtggatgtaacatttcaaactattgaaaaggatgctttgaattaatataaaataaagaatggggctggaaataacccatctaccattttactgaatgaaaaaatcattactattctgtatatactgtgaagctagtaaattgagacataaaatattttttgtgaattaaaaaataagtcaaatc

SEQ ID NO: 8108 - DNA, 2820 bp, Homo sapiens
ctcaaccatcaggttcggcagccggcggcgccgcctggcagctcctcctcttctccgccccgctggccgcgggcgcgggggacgtcagcgctgccagcgtggaaagagctgcggggcgcgggaggaggaagtagagcccgggaccgccgggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccagagatattccaggcccactccagggcagtggacaagatatggtgagcatcctccagttagttcagaatctgatgcatggagatgaagatgaggagccccagagccccagaatccaaaatattggagaacaaggtcatgtggctgtgttgggacatagtctgggagcttatattttgactctggacgaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcaatatgaagacttcgtagtggatggcttcagtgggttatataacaagaagcctgtcatatatcttagtgctgctgctagacctggcctgggccaatacctttgtaatcagctcggcttgcccttcccctgcttgtgccgtgtaccctgtaacactatgtttggatcccagcatcagatggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgaccctgccttgactttagttgctggtcttatatcaaataagcccacagacaaactccgtgccctgcctctgtggttatctttacaatacttgggacttgatgggtttgtggagaggatcaagcatgcctgtcaactgagtcaatggttgcaggaaagtttgaagaaagtgaattacatcaaaatcttggtggaagatgagctcagctccccagtggtggtgttcagatttttccaagaattaccaggctcagatccagtgtttaaagccgtcccagtgcccaacatgacaccttcagcagtcggccgggagaggcactcgtgtgatgcgctgaatctctggctgggagaacagctgaagcagctggtgcctgcgagcggcctcacagtcatggatctggaagctgagggcacgtgtttgcggttcagccctttgatgaccgcagcaggtatgatctcgtgaaaccttgagagaaactgaatgaggaatgaaactattgttcctgtttcacacagaagaaaactgaggttggcactcatgatgagcccctgttctcattctgcaaatggtgaagctctctatcgtcctgaccccacagttcctgtcccatgaccagggcccgctcaccaaggagctgcagcagcacgtaaagtcagtgacatgcccatgcgagtacctgaggaaggtgaccttgaggaaccctgggagctcaggaaggaaggagcgcccagaagcagggacagggagctggttggggaggaccagaaatcaggtgcccaacagcccccttctcctcctttcccttcccttacttccccccttcccctccccttcccctccccctccccaactcagatctggccccggtcccatccccttccctcccccctgccctaagccacctccacctctgtcctggctgcctcagggcgccctgaaaggaccaggacatgcgggtgcggtggctgcgcttttggctcctcttctggctcctgctgggatttatcagccatcagcccacccctgttatcaatactctggctgaccatcgtcatcgtgagactgactttggtggaagtccttggataattatcattattgtgtttctgggacgttacaaatttaccattctcttctgcacaatttacctttgtgtgcctttcctgaagactatcttctggtctcgaaatggacatgatagatccagggatgtacagcagagagctaggaggtccaaccgccgtagacaggaaggaattaaaattggcctggaagacatctgtactttatggaaacaggcggaaacaaaagttcaagctaaaatccgtaagatgaaggtcacaaagaaagtcaaccatcattacaaaatcaatggaaagaggaagaccgccaaagaacagaaaatgtttcaacgtgcgcaagagttgcggtggcgggcagaggactaccacaaatgcaaaatcaccccctctgcaagaaagcctctttgcaactgggtaagtttgtttgttttccttgcttttggaagtctgccaggtcaggacatggatacatttttctccctacagctctgtgctcaagccctgcagagggagatggcagagaggaaggctgcctacaagcatcacagtcccatccctgttggtaaccgtgttgtgcaaaaacaccttcatccccacccagtggggcccctgatctaa

SEQ ID NO: 8109 - DNA, 2097 bp, Homo sapiens
gctcgcgatttcccggctttctggacctgcggaattctattcccgcggggatttgatggcgtgcgcgatacagttggcttcctcggaggcgcgagatcgcgcgagaccaagagatagaacatttctgcaaaagcggcagcttggcgctggagtttggttgttgggggaaagaacttccaatactatgttgaattggaatggagagagagggcatccttgtcttgtgctggttttcaaacgaaatatagaagcagattttaaaagcagtttctcttcagaacatttttttttcataccacttgatgactgtaattgcaaagaagagcttgctgtgatatctgatggcagaacaatagtgtgctaccaccattctgtggacatttcatatgagcatacaaaacaaaccctcaatcagattctgtgcatgataatgaagaaacatatgttcaagtgctgaaaactagattggaagataaagatactgatcctggagtgctacaggacctagaagaggtcttttccaagaggcctgggacccgaggccagttagctatgttgtagaactttcatgaacccttatattttacataggtaggattaaggaaaaatgaatgttagaaacagagtttaaaaattaagtttgagaatggaatatatgtagaaattgatcagtattcctgcttgctttttcaaggtaacatggggaagaaaaaaacattatttcaggttgattaaataatgcatttgtcattatttcagctgacagaggagtcaccttctttcattggttataacttccaggtgcctactttccttaagcaaggtggaaacaccctaaagcaagggacttggagattattgtttttattcactatatgcttgttttgttgtgtcgaggaatcagaatccaggtgcaatatttttcttgattcaaaacattccaaacaggtatttacatgaaaaaccattttaggtattaaaaaaagaggcagtactgtactacatgtcaatcccatgggaactcccttctgattatgtaatacacttcccaaagagttacagtatactgatcaaggaaagtatccaccattattgatttttaaaaattcttacataacgtacaaaatgtgaatgctcacaagaaataagaccattttagcaagctcctaaataggctacctttttttgtttttgagacagggtctcactctgtcacccaggatggagtgccgtggtgcaatctcggctctacaacctccacctcccaggttcgagggattcttgcacctcagccacccaagtagttgggattacaggtgcaccccaccacactcagctaatttttgtatttttagtagagactgggtttcaccattttggccagggtggtctggaactcctggcctcgtgtgatccgtctgcctcagcctcccaaagtgctgggattacaggcgtgagccaccatgcctgatctgtaaataggctatcttaatgacaattttgagtctggagaatggagctaatgctaatgtttatcctaaaaattaggctactttcgtgtttctgattctctgtgtatgtttaatataatcattgttccaacatatattccaaatccaggctaggtatatgaattagttcgttcacgctgctataaagatactacctgagactgggtaatttataaagaaaggagagttaattgactcacagttctgcatggctggggaggcctcaggaaacttacaatcatggcagaaggcaaaggggaagcaagtaccttgttcacaaagtgggaggagagagagagagcaaagtgggaactgggaaacacgtttaaaccatcagattttgtgagaactccctgactatcatgagaacagcatgggataaatcatccctttgatccaattacctcccaccaggtccctcccttgatttgggtgggaacatagagccaaatcatattggtatatttatcccaaagtaattccagtgtcatctctaatctaacttagttctgaataccattgcttttttactgtgtgatctgaataatttttcatttttttaaataaaaataccttccatttattg

SEQ ID NO: 8110 - DNA, 2253 bp, Homo sapiens
ccctaagctcacccctgaccatacaccctctgcaggcgctatcttctctggcctcccactctcctcaggcacctctctcttccctgatcatgccccctctggagacccaatcttccctagccccaccctctctgcagacacctcctgcttccctgaccacaccccctctggagaacctaccttctctagccccgcctcctctgcagacagcttctgctcccctgaccacaccccatctggagactccaccttgtccagccccatgccctctgcaagcaccaccttcgccattgaccacgccccctccggagacgccctcttccatagccacgcctcctccacaggccccacctgctctggcctcaccccctttgcagggcctgccctctccccctctgtctcctttggccacgccccctccacaggccccacctgccctggccttgcctcctctgcaggcccctccctctccccctgcctcaccccctctgtctcctttggccacaccctctccacaggccccaaatgctctggcagtgcaccttctgcaggcccctttctctccccctccctcacccccagtgcaggcccctttctctccccctgcctcacccccagtgtctccttcggccacgcccccttcacaggccccaccctctctagccgcacctcctctgcaggtcccaccctctccccctgcctctcccccaatgtctccttcagccacgccccctccacaggccccaccccctctcgctgcgcctcctctgcaggtcccaccctctccccctgcctctcccccaatgtctccttcggccacgccccctccacgggtcccaccccttcttgccgctcctcctctgcaggtcccgccctctccccctgcctcactcccaatgtctcctttggctaagccccctccacaggccccacctgctctggccacacctcctctgcaggcccttccctctccgcctgcctcattccctgggcaggcccctttctcaccctctgcctcactcccaatgtctcctttggccacgcctcctccacaggccccacctgttctggcagcgccccttctgcaggtccctccctctccccctgcctcacccaccctgcaggccccacgccgccccccgaccccgggtccggatacctccgtctcgggcccacggctgaccctggcgttggcccccggcccgccgccgccgccctcgcgcagcccgtccagcacgctgagcggcccagacctggccggccacagcagcagcgccacgagcacgccagaggagctgcgtggctacgacagcgggcccgagggcggtgccgcagcctccccgccccccgacgcagagctcgccgcttgccacccggctgcctggagtcgaggccccgctccgccgctggctttccgcggagccccaggtgcgcccctgccgtggcctcccgctaccggaccgggctctgctgacggtctgtgcaccatctacgagactgaagggcccgagtcggcgacccccgcccctggcgcactggatccggggcccagtcccggcacgagcggtgggaaggcggcggctggggccggggccggggcgtcctcgcggagcccgaagcaggcgcgcctgggcgagctgccactgggggcgctgcaggcgagcgtcgtgcagcacctgctgagccggacgctgctgctggcggctgccgagggtgccgcgggcggcagcggcgggggcccaggaggtgcggagggtggtggcgtcacagggggcgcccgggctgcactcagcgacgccgaactcggccgctgggccgaactactgtctcccctggacgagtcccgtgccagcatcacctcggtcaccagcttctctccggacgacgtggcctccccgcagggtgactggaccgtggtggaggtggagaccttccactgagccagaccacagccccgcctgctacaccccacccctgccttaggatccgcccctccgggtacgccgtttgttttagaccccgcctccactgccctggagccccgctgggtggattagtcttagctccctagagcctgagcctttggcctcggaggctcgggacctacccacagctttgacctaggcccgcccctcgagctccgcccctttggcctaggacacgccccgtttccccgagtcccgccccgtgtgcagtgtattgcccaccccgcacagcctgagtttgcaataaaactgggacactgggacttgc

SEQ ID NO: 8111 - DNA, 549 bp, Homo sapiens
atgttttgttgcttaggatatgaatggctgagcggaggctgtaaaacctggcactctgcttgggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaagttcgagctaaaatctgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaacgggaaattggatatgaaagaaatacacacctacatgtga

SEQ ID NO: 8112 - DNA, 1747 bp, Homo sapiens
agacgcagaggcgaggccgccagtcgaggacgaggaggagataacatcaagatgccgaagactgaggaaactgtgctccagaatgatcccagtgtagcagagaatggggcccctgagcctaaaacaccagggcagagccagaaaagcaagagtttctgtttagatgaccagtctcctgacctgatgtcttttctgtcacagatctgatagagacagttaatgaagtttccaagctgagcatttcacatgaaattgtagtaaaccaagatttctatgtggaagagaccattttgcctccaaacagtgtagaaggcaggtttgcggaggcaatgtacaatgctttttggaaccatctgaaagaacagctattgagtactcctcctgacttcacttgtgcccttgaacttctaaaagatgttaaggagaaccgcctaagaaatgagatagaagaagctctggacacagatctcctcaagcaggaagcagaacatggggccctggatgtccctcatctttctaactacattctcaatttgatggctctgctatgtgcaccggttcgagatgaagcgatacagaaactagagaccataagagatccagtgcagttactgaggggcatcctccgtgttctgggcctaatgaaaatggacatggtgaactataccatccagagctttcgaccctacctgcaggaacattccatccagtatgaacaagctaaattccaggaactccttgataaacagcccagtctcctcgattataccacaaaatggctaaccaaagcagccacagacatcactacactatgtccgagttctcctgactcacctagctcctcctgcagcatggcgtgttcacttccaagcggggcaggtaacaattcagagccccccagtccaacaatggtgctataccaaggctacctgaacctcctcctctgggatcttgaaaacgtagaattcccagagactctgctgatggacagaatccggctccaggaactggcattccagttgcaccagttaactgtcctggcctcagtcttgctagtggccagaagcttctctggtgaagttttattcagatcacctgaatttgtggatagactgaaatgcaccaccaaggccctaactgaggaatttatctccaggcctgaagagactatgctgagtgtgagtgaacaggtgtctcaggaagtccatcaaggccttaaggacatgggcctcactactctgagcagtgaaaacacagcatctcttctaggccaactccagaacatcaccaagaaagagaactgcattcgtagcattgttgatcagtggatccgtttttttctcaaatgctgtttgcttcatggcatgcaggagtctctgctacactttcctggaggcctcattctcattgaaaaggagttggcagaactgggctggaagtttctcaatctgatgcatcataatcagcaggtatttggcccatactatgctgagatcctaaaacacatcatccatccagctcaagcacaagaaacagatgtggagcctaactgatagtgctggaccccagctatggcaacagggactcaggagagagaggtcagcatgtttctgggaggacatcacctgtggttagtcgaacagtcagccctcttcctcgctatagccaggacacagggatgcaggggtcaagcatgtaagcaccaactggcccaatccccttcactaataaacctctgagctgcaag

SEQ ID NO: 8113 - DNA, 846 bp, Homo sapiens
gcatttgacactcgacatcctcgtgcttcttaaagcacttgcccaacggtgagcaacggcctccaacggtgcccgagggactcgcgctgcccgttaagcagctttgcggtggcggaggctgggctgccgtctctccgacatcccgggacggaggaagagatgaaggctctgcagcccccgccgcccgatttacgcttgagaaagcgaaggcgagagaggtcgtccagcccctgggggcccagccctagagagcggggcgcgggctgcggggcccggcggcctggacggcggagcgttgaaagctcccccagggataggaagtgcagccgaaatcaacgattgagggtctgagcacctccctcatgcagacagagccccggctcccatgttcaccatgctgagaaagacctgcgggggacagcaggaggacagccggggaatgggcccgcacttgcccagagtccctgatggtgtcgtcttgggagtggaggaacctgagggaaaagcccagggacgagtcaggggagagctctgccctggtgctcttgcacgtatccacatgggccacagctgcacccggctctcagcagagggcatcgccatgctcctgggcacagccgggccctctcgcctccctgcggctcctgatgcctcccaggctccgctgaggtcaccttgggcacttagcgtggctgcagctctttgcagccccgtgtcctgtcatccatgtggccgtcatgtggtcacttttgggcattgccctgcgcaaggtccatggggactgggcacctttggccattctttctttggttgtctgtgcaagtaataaactaaatctgaaaaggt

SEQ ID NO: 8114 - DNA, 1970 bp, Homo sapiens
gtagcgctgccctgggcgggcttgcacccccacacccaagtgagcggcctgctcactcctcagctgcaggagccagacgtgtggagtcccagcagaggccaacctgtgtctcttcatctccgtgagaaaggtgcccccgaagtgaaagagatggcctggtggaaagcctgggactcaggaattctcccactccggaatgccttgctgctggggtgaccaggtcttcacttgtgaaacaggagtcggccacctcagccctgcgcctggcctggtggaacatgggtcaccgccccaacctggggcagccgccccatcccaacgcagttgctgccgctctccatgcctccctgtgcccagctaactgggggacttgtcccctgggaaaacctgggtacccaggctgcctttggtttcagcccctactcctcttcccgggctgcctttgctccccggacggcccctttccccgggctgtgttcacatcggctgggaagggtcccttgcagacagatcttggacgaggtcgcgtcccccctcgtgaccagcaaactcctaaaagccgcccttgccccagagcccctgtagcctccaaccggcagtcaggaggcagcgccgtctcagcgccgcttagtggcgccaggcgtgcctggaaatccgctttcgcagcgccccctcgtagccgcctccgcccgcagaaaggcgttccctggacagagaagcgggcgcgcgggggcgggcgcgcggggccttgccggagaacctgactctccgcagcagcagtggaagccagagtgacgcgttgtgttgaacaccagttttctggagcgctgtgtgttctcatagctgagcagtctgtttctccaatcaggtttcaaagccacttcaactgcactggcccctgtgggtcactgctgcaccgccctggcccatgtgggtccctgaggagcgacctgccggggccacctggctggacgaaaaagacacaccttggacttaagccgtgagaaaaaaaaaacttcatcagtaagaaacaagtcaatagacaagtaaaagactaggagaaaatatgcataaaacataaaaaagtgacttgattcctgattctggagtatttaagaattcctataactcaacaaaaagttcagttttttaaaatgagcaaaaggcttgggtaaactattcacaaaggaacatagacaaatgccagtacacacatgagaagcgcatacacatccacaaacttcaaacaagcccacctcatgtatttctagtgagtaaggaaaagaacgcaaacacttttgaaaattgtttggttgtttcttgtaaatttaaacaaataccctattatattatccagcgagtccatccttaggtttttatccaaggataaagaggtgaaaactcatatctaacaaatagacttctgaaaagatgaaaatagaagctttattcataaaagacaaaaactagaaataacccaaatattcattcacaggagaatgaataaacagactaggttgaatccatacaatggaatggtagcagacaataaaaagaaaatgaactattgatgccccctactgcacagcagaagctctgaatcgtgttcctgaatgaaagaagtcaggtatgaaagaataaacattgtatgattccatttatatgaaaatgaatctgtgatttaaaaatcagactagtattaggttggtgcaaaagtaattgcggtttttgccttttttttttttttttttaaatagttgctttggggtttatggatggagtggcatggtagaggttagctgaagggggcatgaaataactttttgggggtgctagagtgttgtaaatcttacagtgggggagggacaggagtgcaggcatttgacaaaacacattgaattgtgaaatttaagatttttgaatttctttgtatgtaaattacctgccaataaaaacatgacgaatagagc

SEQ ID NO: 8115 - DNA, 1032 bp, Homo sapiens
aaccggggactcgggagactcaaggcatctccagagtcacagcctgaagacagaaccccatgctctcctggacataaaagccatgcggtccctggtagacaggatcccctccaagcattttccaaagcccgaggggctgcttacaagactctgcccatcacccccaacctggctgatctgggaccacatcagcacctggcctgactcttctaccaggatgccctccaagaccaacactgatgccttagtcaccctcaccagggaggctgggggtgcccccacatggctgctgcacctgatgttggaaacggaggctccaaaaacgtgagaaaaccgaggcccggaaagtgtcaacccaaatcacgacactccttgccccaaacccagaagcctgaggaagtaaggaagtgcggtgggatctgtcttcccgtgtgtcttcaggatcctggggcctgcccctcctggcttcctcttgaggaaggcctcagaagacccgcctttggtcacaggacagaagctgggccaagaggcaaaggttttggccgccacaggggaaactctgggctcagagctgccgaagtgactcacgggccctgctgggaagcagctgacgttccttgtctgcgccttacaaaaccacacgggctgcgagtgacagctggctgctctgagtggcggaggaatgttgttgccagacaggttcctgaggcatctgctgagctgtgctccagaaaccagccctgggcagctgccacaccaggcagcctccacccctccccacaaccaggagtcttggagggcacccccaccaacctcaacagaactctcccctcagggatccgtggaagtcagccactgccacagggacagccaccccttccaggcaggagctcatgggaaaccaagaccagggaacccatcccacccccagtaagacttgaggccagggaggttggaggggtctccctgtgaccaaatctgtggccatcacaaccgaccttgaaccataatactaagaatgataacaataat

SEQ ID NO: 8116 - DNA, 1513 bp, Homo sapiens
agtgttctacagcagttacacacaggcagtggtatctgtgagcagctctgtggactcaaaggttttctccctgagaggcatgacccaggccagctgattcatcagaatcaggatggacgtggtagaggtcgcgggtagttggtgggcacaagagcgagaggacatcattatgaaatacgaaaagggacaccgagctgggctgccagaggacaaggggcctaagccttttggaagctacaacaacaacatcgatcactttgggatgcagcatgagacggagctgcctcctctgactgcgcgggaggtgaagcaaattcggcgggagatcagccgaaagagcaagtgggtgaaaatgctgggagaatgggacacctacaaaaacagcagaaagctcatagatcgagcgtaccagggaattcccatgaacatccggggcccgatgtggtcagtcctcctgaacattgaggaaatcaagttgaaaaaccccggaagataccagatcatgaaggagaagggcaagaggtcatctgaacacatccagcagatggacctggacgcagcgggaactactttacatcctcctggcgtatgaggagtataacccggaggtgggctactgcagggacctgagccacatcgccgccttgttcctcctttatcttcctgaggaggatgcattctgggcactggtgcagctgctggccagtgagaggcactccctgcagggatttcacagcccaaatggcgggaccgtccaggggctccaagaccaacaggagcatgtggtagccacgtcactacccaagaccatgtggcattaggacaagaaagatctatgtgggcagtgttcgtccttaggctgcctcatccggatattgattgatgggatctctctcgggctcaccctgcgcctctgggacgtgtatctggtagaaggcgaacaggcgttcatgccgataacaaaatcgcctttaaggttcagcagaagcgcctcacgaagacgtccaggtgtggcccgtgggcacgtttttggaaccggttcgttgatgcctgggccagggatgatgacactgtgctcaagcatcttagggcctctatgaagaaactaacaagaaagcagggggacctgccacccccagccaaacccgagcaagggtcgtcggcatccaggcctgtgccggcttcacggggcgggaagaccctctgcaagggggacaggcaggcccctccaggcccaccagcccggttcccatggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtaggggacccttggttccgccgttatgatttcagacagagctgctgggtccgtgccatatcccag

SEQ ID NO: 8117 - DNA, 4540 bp, Homo sapiens
cagggagtcccagtgaggtacagccccgtggtggaggccggctcggacatggtcttccggtggaccatcaacgacaagcagtccctgaccttccagaacgtggtcttcaatgtcatttatcagagcgcggcggtcttcaagctctcacccgaggacgctgccatggctgtgctgacggcctccaaccacgtgagcaacgtcaccgtgaactacaacatcaccgtggagcggatgaacaggatgcagggcctgcgggtctctacagtgccagccgtgctgtcccccaatgccacgctggcactgacggcgggcgtgctggtggactcggccgtggaggtggccttcctgtggacctttggggatggggagcaggccctccaccagttccagcctccgtacaacgagtccttcccggttccagacccctcggtggcccaggtgctggtggagcacaatgtcacccacacctacgctgccccaggtgctgatccgcagtggccgggtgcccattgtgtccttggagtgtgtgtcctgcaaggcacaggccgtgtacgaagtgagccgcagctcctacgtgtacctggagggccgctgcctcaattgcagcagcggctccaagcgagggcggtgggctgcacgtacgttcagcaacaagacgctggtgctggatgagaccaccacatccacgggcagcgcaggcatgtgactggtgctgcggcggggcgtgctgcgggacggcgagggatacaccttcacgctgacggtgctgggccgctctggcaaggaggagggctgcgcctccatccccctgtcccccaaccgcccgccgctggggggctcttgccgcctcttcccactgggcgctgtgcacgctctcaccaccaaggtgcacttcgaatgcatgggctggcatgacgcggaggatgctggcgccccgctggtgtacgccctgctgctgcagcgctgtcgccagggccactgcgaggagttctgtgtctacaagggcagcctctccggctacggagccgtgctgcccccgggtttcaggccacacttcgaggtgggcctggccgtggtggtgcaggaccagctgggagccgctgtggtcgccctcaacaggtctctggccatcaccctcccagagcccaacggcagcgcaatggggctcacagtctggctgcacgggctcaccgctagtgtgctcccggggctgctgcggcaggccgatccccagcacgtcatcgagtactcgctggccctggtcactgtgctgaacgagtacgagcgggccctggacgtggcggcagagcccaagcacgagcggcagcgccgagcccagatacgcaagaacatcacggagactctggtgtccctgagggtccacactgtggatgacatccagcagatcgctgctgcgctggcccagtgcatggggcccagcagggagctcgtatgccgctcgtgcctgaagcagacgctgcacaagctggaggccatgatgcgcatcctgcaggcagagaccaccgcgggcaccgtgacgcccaccgccatcggagacagcatcctcaacatcacaggagacctcatccacctggccagctcagacgtgcgggcaccgcagcgctcagagctgggagccgagtcaccattgcggatggtggcgtcccaggcctacaacctgacctctgccctcatgcgcatcctcacgcgctcccgcgtgctcaacgaggagcccgtgacgctggcgggcgaggagatcatggcccagggcaagcgctcggacccgcggagcctgctgtgctatggcggcgccccagggcctggctgccacctctccatcccctaggctttcagcagggcccccgccaacctcagtgacgtggtgcagctcgtctttctggtggactccaatccctttctctttggctatatcagcaactacaccgtctccaccaaggtggcctcgatggcgttccagacacaggccggcgcccagatccccatcgagcggctggcctcagagcgcgccatcaccgtgcaggccgctacctgtctgaggaacccgagccctacctggcagtctacctgcactcggagccccggcccaatgagcgcaactgctcggctagcaggaggatccgcccagagtccctccagggtgccgaccaccggccctacaccttcttcatttccccggggaccagagacccagtggggagttaccgtctgaacctctccagccacttccgctggtcggcgctggaggtgtccgtgggcttgtacacgtccctgtgccagtacttcagcgaggaggatgtggtgtggcggacagaggggctgctgcccctggaggagacctcgccccgccaggccgtctgcctcacccgccacctcaccgccttcggcgccagcctcttcatgcccccaagccatgtacgctttgtgtttcctgagccgacagcggatgtaaactacatcgtcatgctgacatgtgctgtgtgcctggtgacctacatggtcatggccgccatcctgcacaagctggaccagttggatgccagccggggctgcgccatccccttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagtctggacatcttccggatcgccaccccgcacagcctgggtagcgtgtggaagatccgagtgtggcacgacaacaaagggctcagccctgcctggttcctgcagcacatcatcgtcagggacctgcagacggcacgcagcaccttcttcctggtcaatgactggctttcggtggagacggaggccaacgggggcctggtggagaaggaggtgctggctgcgagtcacgcagccctgttgcgcttccggcgcctgctggtggctgagctgcagcgtggcttctttgacaagcacatctggctctccatatgggaccggccacctcgtagctgtttcactcgcatccagagggccacctgctgcgttctcctcatctgcctcttcctgggcgccaacgccgtgtggtacggggctgttggtgactctgcctacagcacggggcatgtgtccaggctgagcccgctgagcgtcgacacagtcgctgttggcctggtgtccagcgtggttgtctatcccgtctacctggccatcctctttctcttccggatgtcccggagcaaggtggctgggagcctgagccccacacctgccgggcagtaggtgctggacatcgacagctgcctggactcgtccgtgctggacagctccttcctcacgttctcaggcctccacgctgaggtgagggctctactgggggtcctgggctgggctgggggtcctgccgccttggcgcagcttggactccagacactgtgcacctctcagcaggcctttgctggacaggtgaagagtgacttgtttctggatgattctaagagtgaccttgaggaaccctgggagctcaggaaggaaggagcgcccagaagcagggacagggagctggttggggaggaccagaagtcaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccatctcaaaatggacatgatggatccacggatgtacagcagagagccaggaggtccaaccgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaaggaagaataaataaataat

SEQ ID NO: 8118 - DNA, 1899 bp, Homo sapiens
agtcacacagctgcctggaaggtgactggaggccttgatcggttctcattgcgattttgctgctgtggccccaaccctgcctccctccccaccctgcgatggcagaagaaactcaacacaacaaattggctgcagccaagaaaaagttaaaagaatattggcagaaaaacagccctagagttccagcaggagcgaacaggaacaggaaaacaaatggcagtatccctcagacagccacttctggtggttgccagccacctggggattcagcaacaggttttcacagggaaggccctacatcatctgctaccctgaaagatctggagagcccgtgccaagaacgagcagtagtcctggattcaaggtccgtagaaatcagtcaactgaagaacaccatcaaatctttgaaacaacagaagaaacaagtggaacatcagctggaagaagtaacgtgatttcgtttccttgcaacatgactgctggaagaaggctcacccttcagattccaccccatccccacagggccccgataacctggtcccatgggtgggcctgtcctggggcattggtggcattctgggggcatgtctcttgctgtgccatctctgcctccccctggtaagagctctgtcttcctcttcctacaggaaaagaaagcaaacaacaagaaacagaaagccaaaagggtgctagaggttcaactccagacattgaacatacagaaagaggaactaaatacggacctgtaccacatgaaacgttctctcagatactttgaagaaaagtccaaggatctggctgtccgcctgcaacattcattgcagcgtaaaggagagttagagagtgttctctctgatgtcatggccacacagaagaagaaggcaaaccagttgtccagccccagtaaagcaggtacggagtggaagttagagcagtccatgcgggaggaggcactactgaaagtgcagctgacacagttgaaggagtcatttcaacaagtccaattagaaagagatgagtattctgaacatctaaaaggagagagggcccggtggcagcagaggatgagaaaaatgtcgcaggagatttgcacattaaagaaagagaagcagcaagatatgcgtcgggtagagaagctggagaggagcttgtccaaactcaaaaaccagatggctgaacccttgcccccggagcccccagcagtgccctctgaggtggagctgcagcacctgaggaaggaactagagagagtggcaggagagctccaggcccaggtcaaaaacaatcagcgcataagtctcctgaaccagcgacaagaagagaggattcgggagcaggaagagaggcttcggaagcaggaggagaggattcaggagcagcacaagagccttcagcagctggccaagccacagagcgtcttcgaggagccgaacaatgagaacaagagcacactgcagttggagcagcaagtaaaggagctacaggagaagcttggcgaggtgaaggagtcggaaacctccaccccatccaagaagggctgggaggcgggcagcagcctctggggaggggaggtaccaggccagaggcagcttccagcctgggggctggtgaccacagcaccccccagggcagtcctgtttcttgcttcctgcctctgacttttaaaggtgggtagccctgggctcctctcaggtctggacatcatcatcctagctagaggcatggagcccccaatcacaggggaagagacagtgctataacaggctccttatgccaggtgcagtggctcatgcctataatcccagcactttgggaggctgaggcaggagaatcacttgaggtcgggagtttgagatcagcctggccaatgtggtaaaacctcatctctactaaaattac

SEQ ID NO: 8119 - DNA, 1859 bp, Homo sapiens
gattagggatctcctgcccttggtcctaagtgccactatctgtgctgagtttttcaaaggtcagagcagattgaaccattgtggtttcattttccctgattttgatttttcttatggggaacctgtgtggctgcattcaaggtgactcgaagaagccttccaaaaagcgtgtgaaaaggaagccctactctactaccaaggtgacttcagggagcacattcaatgagaatacaagaagatatgctgtgcacaccaaccagtgtaggagacctcatggctcccgggtaaagaagaagaggtacccacaagaagatgacttccatcatacagtcttcagcaaccttgaaagattggacaagcttcagcccactcttgaagcctctgaggagtctctagttcacaaggacagaggagatggagagaggccagtcaacgtgagggtggtgcaggtggcccctctgaggcgtgaatctagagccattgacactggagaatgatacctaccctgaaataactcacttcctgagaaaaaagcgccatctctagggtacagaaacctgattctgggctccttttgggaaggaggatttggggtctggtgagagcaaatgattttgcaagtataaaaccatgtccagagaggctgtagggatatctgtgagcccagaggaaacaccaggggatcctgtgcgaagcaccatggcttcagctagggtgggaggagtgggtgggcctctctctaatgacttatcctggtgtttgtgtttctaaagatttgattgtggagagcatatctgatgatggggatttgtaggtaggtaactactttccacgtaagatccaattggagagagttcccaggggccttcggggtatccatgctgcttgggaggttaagggagggggcatgaaatcaaaacaaaacaggaaatatgtgtcatattggacttggtcttttccgggtttattggcataatagttagaactgtctctctgggctatgagggtgctgtgttatttaaaggtggtctttcccagaacacctggccttttcttttctgcctctgccaaacatcacagcctttgggttggattagtcagcaccccttgggattgtgcagaagaggtttggggttgcatcgagtgtcacctgtggtgaacagaatctgagggacacaactctctcacaggcacttcctccaacctggagacagaattctcctggtgtgtgcccaggggtggaggagaaattgacagtctgcctctgaactttcaggactttaaaaagcactcatgtttccatcctcactgttgactcctggcttaaagggatctcccggggtgagtgaggaggcgggatcggaccctagcagtctgacggcagcacctgtgttcctctgcactgggccgtggatgacattacacaccttgccactcccacggtcctgtgtgttccggatattttaaaataatggctataaggctgagcacttcaggatatgctgttttgctgtgtgcagatggaggcagtggctggagtgaatgaacggcaacacttgctggcaaccggcagaagctgagagacagggaacaggctctcctccagagcctccaggagccaggcctttggacaccttgaatgtgggcttctgggagaccatgcgtttctgttataagcagcccagtctctggcagtttttacggctgccccggaacactcatctatacctgtctgacaaggtcaagctccaaggaagggattctttacatatctacattgtttgcagattttacaataatcatttattcttgcatggctgatcattgttaaccaatacaaataaaataataaagaaatg

SEQ ID NO: 8120 - DNA, 2676 bp, Homo sapiens
gagatggagtctcgctgtgtcacccaggctggagtgcaatgacgtgatcttggctcactgcaacctccgcctcccaggttcaagtgattcccctgcctcagcctcccgagtagctgggattacaggtgcctgccaccacgcctggctaattttttgtatttttagtagagaaggggtttcaccatattagccacaatggtctcaatctcctgacctcgtgatccatctgccccgccctcccagagtgctgggattacaggcgtcagccaccgtgaccggctcagactgtactcttatagccatctgaaatacgttttctaggtagagatagattgtgtaagggtacagttgtgaggataacagaaacatggcagattatttaaaatcatcctgaaagtggtgctttatctgatgaaagtgattgtaatccataggaaaatgtttcaacgtgcgcaagagttgcggcggcgggcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgtctgctcactccccttccaccctcagcggatgataatctcaagacacctcccgagtgtctgctcactccccttccaccctcagctccaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccttccaccctcagcggatgataatctcaagacaccttccgagcgtcagctcactccccttccaccctcagctccactctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttctgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctga

SEQ ID NO: 8121 - DNA, 2882 bp, Homo sapiens
gttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagtgagtaccttactgtgaaggtgataagcctccacctggtcttccagataggggtgatattcctgcag

SEQ ID NO: 8122 - DNA, 3258 bp, Homo sapiens
acacagctgaaggacctggaaaaccacaggaagttgaatttggtcgacggagcatatgaggagtggtggcgggcatctcaagaggggaagactctcccactgtgttataagctgctaaagtcaaggaagacaatagtcaagcccccagaggttgcgagtcactctagccagaccgtggcagggtggaaaccagcccacagtgcgccggggcgtctggaagatgaagcagcggaactcagagagctctgaagggggacgggggcctgcagctgttttttttgttagctgctttttgttcatgggaaaacttgaacaagcttgattgcttcatggaaggagccaggtgacatggaaaggggaaagatgcagagtaaggggaccgagggacagcgagatggctgcaaaggtggagggaagaagtgagtgggaacggaggagacgtggtgctgccgctcagctgtgccccatggctttgccccgtggcttgctcccctcctcagtactgttctctcccgtgtggcacagccaggcttactcatcatttcatctgcagccctgcccataccagcgtgtgctgaacgatgttgaaccttaggcgacggaggccgactggaaccagggctctgagtgacagagacgcagttatgtctaaggacatacgctagaatggctgatgcagggcgcaagctcgattcctgcagatgtgtgttaatgagcagctccctcatttttgcaaaggtcagcattcctttggcaaactgggaaggagcagtttaaggtgcagctcccaagtgggtcacaccgaccccccaacatccagttcccaactgctgagcgtgcttctcttcgtgggagtgggcgggccagtgccgaggggctcaggacggattctcagaaacgccccaccatgcaggtggcttacgggagggcaaagccaatgccagcctccaggaagtctgcgctttctttccttaggctgccaatcagagtggaccagctggagatgaccaatcacatgacaagactcctgcacaaagggaagaaatgagatgctgcagctgaggagggcggccaacctgggaggcatctggctcccctgacaatgcctgccgatcgccaagctggcttccagacctcctgggacagaactgttcctcccaggacgctggtgtaggttcaagtccagttgatatttactaagcaactgcaatgcccaggcctgttccagtgctgcagagagtaagtgcttatgggtgcttatattcagagtaagtcaatacaccagcttcgtatgacctgcgtcttcggggccagcagggcaggttggtctcctcagcctcacactggagctcctggctggctggtgtctgcggtcaggaccctagtgatgggaggctcagcaaacagaggaggcagaggggctgttctgaaatgaccttgaaacgacctatcaccctcaggggtggtcttactggatgaagtccagcccgccataggcactgaagggctctcatttgctgagcccttgctttgcgccaggcggctcttcctctgccgacactgatcaaaggagggtgcgaggctcagctactgaagccggggtcagacttgtgggcgtgggcttttctaatgccaaacccacgggcgccaaggcttctcaagctcatcctgtcagcccctgaatttctaactggcaaagctccacgctagcggtgggggaagaaggagccagagagacctgaactgcaaggggaccccatgtgggatggttcaggggagcagcaggacagccaggcccctgccagcacctgcctgcggtctctcacctggtcccgactgcaatgcctcctggcaggacagagccgccgacttctgtcccgtaagagctgtgtgcaaggtgggcccttgtccgtgttgccagctgaagactgacccaagactcgggaagagaactgggttggatctgttctcagtgtggtccagatctgccatgttggcaccagctgggagtgtgttagcaatgccgactctcaggccccccaggaactctgtcggggattcgggtgcttgctgtttgaggaccactggattagatatcagcaaggtccttcctgagtcttttctcagctgtccccttctcgagttgccttggcatctctcatcctgggttctgaatcctggactccctactctcaggacaccccatgcctcctactcatgctttgcggcacaggcaaggtctccagaaagagctgcgggtggggcatggccactaactgggaaaccttggccacggacagggattctctctccttctcattctgaaatcctatgatctggtgaactgaggttcatgctcacttttttttttttttttttaagacagagtctcactctgtcacccaggctgaagtgcagtggtaggatcttggttcactgccaacctccacctctggggttcaagcaattctcctgcctcagcctcccgaggagctgggactacaggaacgcaccaccacatccggctaatttttgtagcttttagtacagacagggttttgccatattgctcaggctggtcttgaactcttgacctcaggtgatccgcctgcctcggcctcccaaagtgttgggattacaggcgtgagccaccgcacctggcccatgctcacatttttataagcacaacggcagtaaccaacagagccatttttctgaggccttcctgtgcccagcactgggccaagcccttgacttaatccttattatcccaacaaggttggagtcagcaggcctgggttcttgtctcagctctgacacttactagctgggggaaaaaggggaaggatgtgggtgggcagtggcagaaccttctttaggccccagtttttgcgttttgaaggcagggctttggagggatgaatcacaaatcagtatgctgtgtgaaagcagccagacacgaaagagggcacccggcgcagtttcattcacatgaagttctagatgaggcaaatgagactacgctggaatcagagccggggctgtggtagtttcagaaagggggcagtttggaccgggaaggggcaaaagggggctgcgtggggtgacgggcacgtttcatcttgattgtggtggaggccacaggactgtacatccatttgtcaaaacgcaacaaacggtacatttaaaaaggatggattctactgtaggtaaaatatgcctcagtttaaaacattcttagtaaaatatgggctttgg

SEQ ID NO: 8123 - DNA, 1563 bp, Homo sapiens
agatgcacagggccttgctctgtcccccaggctggagtacagtggctccatcatggatcactgcagcctctaactcctgggctcaagcaatcctcctgtgtcagcctcccagatacctaggattacagatatgtgccccaatgcctgcctaatttttctttgtattttttctggagatggggtttgctacattgcccagactggtctcaaacacctgggttcagttgtcctgcctcggcctcccaaagtgctgggattacaggcatgagccaccacactcgaacacttggggtggttttaagcccccagcaaggtgcaccagcaggaccaggaggtggcctaggcaccccctatcactcccatccatgcaaacctaggcaagtccctgtctctgaatctcagccaccaccacatacaatgcaagtcggaagatgggcaggactgggggtggggcaggcagaggccacctctgtcaggctggggttgcatgggctggaggctgtcttcccatacctgggacatgacctccaaggaccagctgtcagtcatggtgatgggctggctggggttggcagggagcttgctctccttctcggagggccggagcagcgtggggccaaacaccgtgccaaggttgtgcagggacatcttattgactgcctccttctctgccatcctgtagaggaccgaagcagagggtgctgtttcaacgccaccaccaggagagaggcagaggggctgtgccgtgctagagtcctcagggagggagtgacctcgaccctggctgtgctgcaagctgactccagccttggggtcagcagcacccggcgaacagcagcaggaggagccgctagagcagctgctcatgggcagagctgccctcgggcaactcctgccaccaccccctccccagggagcccaaggcaggggaggctcagcatggaatgaaacagcctctgagggcagcagtgcacgtggaggagacgtctcccatgaggccaaggcctccagtgctcaccgatgccctctgcgaagttggggtagaactcgtcagtgaagaggggctcgggcagctcacggaagtacagcttcagcatgcctgcgatggcgttcacgtccatctcgctcatcatcactgacacgtccttgttatctggaaagagcacggaaatgcagcggcctccttgaagatcctgataaatgaagaaaagacacagagaaggatgtgacatgcctgggccatggagcactctgagatctcatcggggacaccactgcccacacctccatcccgtcctgcgcaggccgacactcactgacgttgaagcctgccttcagtgcctggatgtctgcggccaccccagacatgcggtagatgcccacctcctccatgcctcggcgctcgatctcctccatgcactggcgcacgatgtagggcaccttggacctctctctcctgcgggaggagggaatgttctcagtgtcctaacagccctgcttgggccataacacaggagacctgctccctatctgcgcacccggaggtggggtgaggacggtgac

SEQ ID NO: 8124 - DNA, 1374 bp, Homo sapiens
ccagtccctggccccacctcttctgccacaaacgtcagcatggtggtatcagccggccctttgtccagcgagaaggcagagatgaacattctagaaatcaatgagaaattgcacccccagctggcagagaagaaacagcagttcagaaacctcaaagagagatgttttgtaactcaactggccggcttcctggccaaccagcagaagaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttgcgggaagggagagatgcctcccgctcattgaatgagcatctccaggccctccttactccggatgagccggacaagtcccaggggcaggacctccaagaacagctggctgaggggtgtagactggcacagcaccttgtccaaaagctcagcccagaaaatgacaacgatgacgatgaagatgttcaagttgagttggctgagaaagtgcagaaatcgtctgcccccagggagatgcagaaggctgaagaaaaggaagtccctgaggactcacaggaggaatgtgccatcacttattcaaatagccatggcccttatgactccaaccagccacataggaaaaccaaaatcacatttgaggaagacaaagtcgactcaactctgattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtattggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtacct

SEQ ID NO: 8125 - DNA, 11691 bp, Homo sapiens
tccctggccccacctcttctgccacaaacgtcagcatggtggtatcagccggccctttgtccagcgagaaggcagagatgaacattctagaaatcaatgagaaattgcacccccagctggcagagaagaaacagcagttcagaaacctcaaagagagatgttttgtaactcaactggccggcttcctggccaaccagcagaagaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttgcgggaagggagagatgcctcccgctcattgaatgagcatctccaggccctccttactccggatgagccggacaagtcccaggggcaggacctccaagaacagctggctgaggggtgtagactggcacagcaccttgtccaaaagctcagcccagaaaatgacaacgatgacgatgaagatgttcaagttgagttggctgagaaagtgcagaaatcgtctgcccccagggagatgcagaaggctgaagaaaaggaagtccctgaggactcacaggaggaatgtgccatcacttattcaaatagccatggcccttatgactccaaccagccacataggaaaaccaaaatcacatttgaggaagacaaagtcgactcaactctgattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtattggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagaagttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagaagttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatggtgagtacctttctatgaaggtgataaggatccactgagtcttctggttagggtcatattcctactgcaagtggcccttactgagctgagagatgtcattgccacagggaggtcctataggcacatgtaggttgaatgaaactctagttccacttggaagcccagacaagggatgggtcagtgagcaaggctctcttcctagtctcaggccatgcctgtggcgccctaatcctactctcatgacgttggacctgggcagatgtgacaaattcacacaactctgattttgtctcaattttgtagatc

SEQ ID NO: 8126 - DNA, 666 bp, Homo sapiens
gagatgcagaaggctgaagaaaaggaagtccctgaggactcacaggaggaatgtgccatcacttattcaaatagccatggcccttatgactccaaccagccacataggaaaaccaaaatcacatttgaggaagacaaagtcgactcaactctgattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaa

SEQ ID NO: 8127 - DNA, 750 bp, Homo sapiens
gaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatggtgagtacctttctatg

SEQ ID NO: 8128 - DNA, 499 bp, Homo sapiens
atgaggcccaagaccctaaggaacagtgcagccaggagtcggaaggagcctgggtttctgaatcatcacatggaggggagctgtcttcagctgggagagctgtcttcagttggatactggatggagtctcactctgtcacccaggctggagtgcagtggtgcagtttcggctcactgcaacctccgcctcccaggttcaagccattctcctgcctcagcctcccgagtagctgggattacaggaggaagaaagggagctggttaggaagcaaacttgagtttcccatgctctgtggctgagcaagtcacttcaccattctcaggatggaagtggggatggaggtggcatcggcctcatttgaaccacatggactaagaggggctatgggagtattccccaaaggaagactgaggggcgttactagaaaatgggagaatggaagcagagtgggcaaaaccaacagatgttccctatagtaaataaaaaatttggacaatt

SEQ ID NO: 8129 - DNA, 1063 bp, Homo sapiens
ttgaatacagataatcatgaggcccaagaccctaaggaacagtgcagccaggagtcggaaggagcctgggtttctgaatcatcacatggaggggagctgtcttcagctgggagagctgtcttcagttggatactggatggagtctcactctgtcacccaggctggagtgcagtggtgcagtttcggctcactgcaacctccgcctcccaggttcaagccattctcctgcctcagcctcccgagtagctgggattacaggaggaagaaagggagctggttaggaagcaaacttgagtttcccatgctctgtggctgagcaagtcacttcaccattctcaggatggaagtggggatggaggtggcatcggcctcatttgaaccacatggactaagaggggctatgggagtattccccaaaggaagactgaggggcgttactagaaaatgggagaatggaagcagagtgggcaaaaccaacagatgttccctatagtaaataaaaaatttggacaattattagtgagcaagtacttataacatatatggcacatgggattgtgactcaccagtgtgttagcacaatatggtcaaaaacctctgatccaattcaacctactcatcttaacgattttatcagcatttaataagtttgttttggccatcatgtgttatagttttgtttgtggttttgacacctcattagaggtttcatcagtgtaaggagccaacctaagagctcttctcacaagtttcccaagagagaaattgcccctccaaatgtgaggagtctcactttatatagatagcatccacacttcttgcagtggaaaacaaaccttataaaatgtaatacgtttggtttcctaactttttcatgaccctggggtggtagaaggaagtgcaagttttatcacttggatttagagacaaggaaattgaaatggagagagaattgggctcacatgcaggcagcatgtctagctgcctccatcgtgtgatctgaggcaccccatgaggcctatgattactgtaaacctctaaaataaataaaaaataaaacaat

SEQ ID NO: 8130 - DNA, 715 bp, Homo sapiens
ttgaatacagataatcatgaggcccaagaccctaaggaacagtgcagccaggagtcggaaggagcctgggtttctgaatcatcacatggaggggagctgtcttcagctgggagagctgtcttcagttggatactggtggccgtttgggcatcctgggccagcccaaggacatcttccagtggccgtttgggcatcctgggtggtagcaggtatctccattgcactctatttgccacctcaccctgaaggaaggtacgagggccccttcaaacgccatacaaagaccttccggagtgcccagtgtgcagattgcctgacatgcgctctggaaccgtgagccatttgggaggtgcaagaggattccaggaaatggcagcaaggccttagaggagtttaagtatgtacttggccaggacaaaagtctgtcttcatctaggctctaggtgctgacttctgtaacaggggagctgttaacttcttcctgggaatccaccttctaccccacacccagaagcagagcaccatccactcaggcctccaagtgctccaggccttgtattccacctctgcctactttgagccagcaactgatttcagcaggaattcactgagactgacatcctctatgctcagcactgtgtgccaatagtatggccacacaagtagattttttcctatttctcttttcttaggctaatggttcagctctaaagat

SEQ ID NO: 8131 - DNA, 2044 bp, Homo sapiens
gtaccatgcacctttgagggaccaaggacccaagacttgaggtagacactattcccagctggatactctcaatgttgaggatatagatgcacaaaccaatgcagggaggcctccaggagccactggagaagaaatcttcagatcctaccaggcccatagctgttgcctttgtgggctcctgggttaatttccacacatcagtggcccaccttatgatatcctccctgcatgccacactcccggccatgctctgtggacagccattatttccagtaattgctaatgggagccagtctccaaagagtaatgaatcagaggtgttccttggaatgtgttacactaggacttcgccgatctcacaggctcctttccagatgagctgactgtaatctctgggaagctggatctggaggaacaatgggatgggatttgcggtgacccttcctgcccttcttgagcagcttgtgaaccagaagatgtgcctggagagaaagcctcatttggggaagtgcagtagtcgaagttctttattttgaaaatggagaacaacccttctcacaatcctgtctccccttccccctttccaactagaatatcagctcccctgaacatgagtcagtcacatttcagggaaaactggctgatgttgaagaaatcacttgagggcaaactttgtccttcaagctgtgggtctctgaagtgtagagccagcagatcccccagtgtagggactgggccttccttgcccattgaatgctttctatacatgaagacttggagctctttacagatgacagtagccagtgaggaagataaaagaagagaaaagacccaaaatgcgggtttgccactcttttttgccagcaccgtggggacagtcactctgccttctttccaccacctccaacttcacactcacacgcacactctggtcccacagagcctgtttggtacttgcctgacagcccaccttgaaaccagatggtcatgaacctgtcaccaagtcatctgaagatcttccactgcaacctgtatggcatctgccacagggaccatgggacatgattgaagaaccactccagtgcagttgatgaaggggtgggtctgcactggagttaggtgcaccagggcctgggccaagggtgggctgggtccatcttgtgtgtggtggtcttcttcagagtagcagctgattcagagggattccatagaactgcacaggctaggtctagtcagatatcttggacattttctatttctagattagagaatatagcatacgctgattttaatataactgtgtatgtgactttttcagtgagaaaaattttaagtgatgttctaaacaatttttggcatgtagacagaatagtcaaatatctgtttaactagcaacatagttactcgtgcatatttaaaatactacatgagtatggcctggcacagtggctcatgcctgtaatcctagcactctgggaggccgaggtgagcatattgcctgagttcagtttgagaccactttggacaacatggtgaaaccctgactctataaaaatacaaaaatgtagccaggtgtggtggtgcgtgcctgtagtcccggctacttgggaagctgaggtgcaagaattgcctgaacctgagaggcagaggttgcagtgacctgagattgtgtcactgcactccagcctaggtgacagagcaagactacatctcaaaaaataaaacaaaataaaataggccctgtgccgtggctcacgcctgtaattccagcattttgggcagctgaggcgggcagaccacctgaggtcaggagttcaagaccagcctgaccgacatggtgaaaccccatctatactaaatacaaaaaattagccaggtatggtgatgcatgcctgtagtccaagctacttgggaggctgaggcaggagagaatggcttcaacctgggaggcagaggttgcagtgagccgagattgcgccactgcactccagcctgggtgatagagcaagacttcgtctcaaacaataaaataataaaataaaat

SEQ ID NO: 8132 - DNA, 1970 bp, Homo sapiens
gtggcgctgccctgggcgggcttgcacccccacacccaagtgagcggcctgctcactcctcagctgcaggagccagacgtgtggagtcccagcagaggccaacctgtgtctcttcatctccctgggaaaggtgcccccgaggtgaaagagatggcctggtggaaatcctgggactcaggaattctcccactccggaatgccttgctgctggggtgaccaggtcttcacttgtgaaacaggagtcggccacctcagccctgcgcctggcctggtggaacatgggtcaccgccccaacctggggcagccgccccatcccaacgcagttgctgccgctctccatgcctccctgtgcccagctaaccgggggacttgtcccctgggaaaacctgggtacccaggctgcctttggtttcagcccctactcctcttcccgggctgcctttgctccccggacggcccctttccccgggctgtgttcacatcggctgggaagggtcccttgcagacagatcttggacgaggtcgcgtcccccctcgtgaccagcaaactcctaaaagccgcccttgccccagagcccctgtagcctccaaccggcagtcaggaggcagcgccgtctcagcgccgcttagtggcgccaggcgtgcctggaaatccgctttcgcagcgccccctcgtagccgcctccgcccgcagaaaggcgttccctggacagagaagcgggcgcgcgggggcgggcgcgcggggccttgccggagaacctgactctccgcagcagcagtggaagccagagtgacgcgttgtgttgaacaccagttttctggagcgctgtgtgttctcatagctgagcagtctgtttctccaatcaggtttcaaagccacttcaactgcactggcccctgtgggtcactgctgcaccgccctggcccatgtgggtccctgaggagcgacctgccggggccacctggctggacgaaaaagacacaccttggacttaagccgtgagaaaaaaaaaacttcatcagtaagaaacaagtcaatagacaagtaaaagactaggagaaaatatgcataaaacataaaaaagtgacttgattcctgattctggagtatttaagaattcctataactcaacaaaaagttcagttttttaaaatgagcaaaaggcttgggtaaactattcacaaaggaacatagacaaatgccagtacacacatgagaagcgcatacacatccacaaacttcaaacaagcccacctcatgtatttctagtgagtaaggaaaagaacgcaaacacttttgaaaattgtttggttgtttcttgtaaatttaaacaaataccctattatattatccagcgagtccatccttaggtttttatccaaggataaagaggtgaaaactcatatctaacaaatagacttctgaaaagatgaaaatagaagctttattcataaaagacaaaaactagaaataacccaaatattcattcacaggagaatgaataaacagactaggttgaatccatacaatggaatggtagcagacaataaaaagaaaatgaactattgatgccccctactgcacagcagaagctctgaatcgtgttcctgaatgaaagaagtcaggtatgaaagaataaacattgtatgattccatttatatgaaaatgaatctgtgatttaaaaatcagactagtattaggttggtgcaaaagtaattgcggtttttgccttttttttttttttttttaaatagttgctttggggtttatggatggagtggcatggtagaggttagctgaagggggcatgaaataactttttgggggtgctagagtgttgtaaatcttacagtgggggagggacaggagtgcaggcatttgacaaaacacattgaattgtgaaatttaagatttttgaatttctttgtatgtaaattacctgccaataaaaacatgacgaatagagc

SEQ ID NO: 8133 - DNA, 2937 bp, Homo sapiens
ggtttcaccatgatggtcaggctggtcaagatctcctgacctcaagtgatctgcccgcctcggcctcccaaagtgctgggattacagacatgaaccacaacacctgccgagcccaggtgttttgaatccagcacgggcaatggcaagaccctgtcccaacaaacaaaaaaacactggtgcctgaggcccaccccgagagattctgattgagttgatttggatttgaattatctttaaaattttggatgtgaattttttttttttttcttggaatggagtttcactcttgttccccaggctggagtgcaacgggacgatcttggctcaccgcaacctccgcctactgggttcaagccattctcctgcctcagcttcccaagtagctgggattacaggcatgtgctaccatgcccagctaattttgtatttttagtagagacagggtttctccatgttgctcaggctggtcttgaactcctgacctcaggtgatccgcccgcctcggactcccaaagtgctgggattacaggcatgagccaccatgcctggccggatgtgaattatcttaaaaattttcaggtaattctaatgggccaaggttgagaacccctgctctgggcccatccgagcaccaggctgtcacaaacgcatgcatgcactcacgcccgtgggcttggggggcttcggaaatgtgcttctgcttttttgagatggggtctttctgttgcccatcccggagcacagtggcacgatcacagctcactgcagcctcgacctcctgggctcaggtgatcctcccgcctcagcctcctgagtgtctgcttctggttttcatgatgacctggggcccaggcatactacacttgtgctgttcaggggccagtcctgcaccaggagcccatcagccacagctccgccgagaagcactgatatgcagagctaagcagctttgtttccacgtggatcctgcgtaggttttcttggtccatccgtagacaccgcactcctgcagaggatcttctcgggatgccccactgtctctgttttccctcttcactgaacactcagtcggggctcgccatgatgcctctgtgtctgctggcttctcccccattggaacagccttcttggcacgccacactgctagctgctgggcactgtgctttctgcctttaccgttctgccgtgatgttgccaaaatagcagcaacaacaacaacaacaaaggctgggcacctggctcatgcctgtattcccagcagttcgagatcagcctgggcaacatggtgagaccctatctctacaaaaataaaaaatgaaatgagctgggtggggtggcgcatgcatgcctgtggtcccagctacttgggaggctgaggtcggaagatcgctggagcttaaccttgaggtcaaggttgcagtgagccgagattacatcactgcactccagcgtgggagacagagaccctgtattaacaaacaaaaacacaaaccacaaagggcaggtctgaaactgccatttaaaaaaaaatttaataaacttaaaaaaatatatatccacagatgcaggtgaagaacctgttgtcttcctcaagcctctttttcacccatgggtggaaatggtgccctggacacccaggcccacgaggtctttgcgtggggtccctacacagggctttagcttacactgtgctgccctcctgtcccccgagttcccagtctgtcaaaatccaacctggtctcccaggcccagggcaaatgccacctcctccatgaagcctgccacatcctttgcacacccttgggcgctgaccttgttctcccagcgcacaggcacgggtacagtttgcccctgtagtagtaactcaggcacaaaacgaactcttgctgaggctcggccgcgcagagctgagggttgccgcttccaggttcaagtgcattttgagtttcattcccagcttccttctttttctggtctttaatttcttctccggattaggtcccactcaatgctttccttctcaatttccaaaagagtatggtcagagccagcagcacaccaccttccccatgggtgggggggggccagcctgtggcgggggtgcgggtcccatcttttcgaaggaattgacccacagtgggcgggtccacctttgaccttgccccagggagcgcagacagaaaaaagatccttgcttagtttgaggggccgctggggtgctcggtttgtcttcagaggcctgtctgtaacaccaatgccaacccggtggcactgactggtcaccctgaaggccacggccagtgtcctaggaagggactcaatttctagctgtgccacctgagattctggggttaggctggttgtgcttctgaagttccactgtgctcaaagtgcttggtgaaagttagcgaaggtgattttacaaaaatagatgcataaaatgtctaggaaacacaaaaaatcctcattactcttctctccaaatattttttaagccccaactggaccctaggcaaaagtgagtggcactcctctgccaggactccaggcaagccccggcatcttcttgctgccgtcccagacaacagaagttaccagatgaacagacttggatgggccacgggggtggagagctggaaagcttggctgtgcctctcgatgatgattaagatttcaatatttacagcaaaaccacaaagcaaatgatagaataaagcaaaacaatggaaaatctgagttcactcgtgagagaggtacgtatgtgagctctgaggaaattacagagggaacgcatgcagcgggacagctctcccaatcgcagcgtgcaaagtagacatccatagtgtcttttgaaaaatgaaaaacacattactttgaacagccaagaaaaaaattgcaatttattaagattcaataaagcgttgtactttcgaaagc

SEQ ID NO: 8134 - DNA, 1825 bp, Homo sapiens
atttcagttaggctgctggggctgtgggtgccatcttgtcaccttggaggaagagcccacctgagaacgacatcaactcagagggaagtcagcagagccaagaggccgggagaggtgattcccggtgacatcatctggctcctgggtgcagccatggtagagttggcctcgaacgttgtccctggcatggaggtgaccagaggtcaccctcacatgtcagcagacacctccagctgtgtcattcttgcttcttgttggcaaagtttgtaggggtagtattctcagttggcattcctagctgagatgtgtagctgggaggtcaccacgccgcagggccttgggaccagttctgcctccgaggagtcccttactgatgatcataggctcctcaaggtcatcagccagggcagctttgcagaagtcaaggcagctggcccagcacattctcactgggaccaagatggctgtggaggtcaccccaacagggcagcagggctcctgcagcccccaggatctgtactgcagggtccatatgatgaaggcccttaatcacccgaagatcatcagacccacgtggctggcaccgagaacaggctgttcctagtcatggattaagccagctcgggagagctatccgacttcaccctccaattctccttgaagggggaagaggcctgaggcaagttccagcaaataggatattccatgcagtgaggcttccagaaggaaattatccacagggatctgaagccagagaacttccctgaggaggctcagcacgacatggaaacaacagactctggctttgataccagattcaccgtaggctgaaagctgatccccttcggtgggagctcctcttacgcagcctcggaactgttcccggaggcaaaagtacgatggactccggtgggcgtgtggagcctgggagtcactgtctacaccatggtggccgaggactgccatctgttgggcagacttttgtggggctgaggaggacactaatactctgtgaacgatgacaggagatcccgtttctcatttccatagaactagaacgcctcataaacacaattctggcccttgactccagggagaggccctcactagaccacatcatggggcgcccatgcgttaacatgggtcaggaggagacataaataaggccatactgggagctgctccccgatcacccggcgtctggaaagctctcgtggtgtccccgggagatgaggccaaccacgtcccatccttgtaggaacaaaaatgtaggaacaaaaatttttagtagagacggggtttctccattttggtcagggtggtctcgaactcctgaccacaggtgatccactcgcctcggcctcccaaagtgctgggattacaggcgtgaaccactgcgcccggcccacaacatggatttttcttactataaacatcaagctacacttgccacagtcttttaccgctgtggtctcatttgtctccaccagagggagaaaggagactcaataaaaactgcatggttctcggccgggcatggtgcctcacgcctgtaatcccagcactttgggaggccgaggcgggtggatcactgacgtcaggagttcgagaccagaccagcctggccaacatggtgaaaccctgtctctacaactactactactaataataataatacaaaaattagctggacgtggtggtgtgcacctgtgatcccagctactcgggaggctgaggcaggagaatcacttgaacccgggaggcaaaggttacagtgatccgaaatcacaccattacactccagccttgggcaacactccatctc

SEQ ID NO: 8135 - DNA, 1551 bp, Homo sapiens
ggagcttccacaaaccagatagaggttctccagcttttctttgattgtctctgctttagcgtctctaaatccggtcaccatgtcggaccccgaaggcgagaccttgcgaagcacctttccctcttatatggccgaaggcgagcggctctacctgtgcggggaattttctaaagccgcgcagagcttcagcaacgctctttaccttcaggatggagacaagaactgcctggttgctcgctcaaagtgcttcctgaagatgggagacttggagagatccctgaaggatgctgaggcttcgctccagagtgacccagctttctgtaaggggattttgcaaaaggctgagacactgtacaccatgggagactttgagtttgccttggtattctatcatcgaggctacaagctgaggcctgatcgggaattcagagttggcattcagaaagcccaggaagccatcaacaactcagtgggaagtccttcttccattaagctggagaacaaaggggacctctccttcttaagcaagcaggctgagaatataaaagcccagcagaagcctcagcccatgaaacacctcttacaccccaccaagggagagcccaagtggaaggcctcgctcaagagtgagaagactgtccgccagcttctgggggagctctacgtggacaaagagtatttggagaagctcctattggatgaagtgaccttcctgatgcaaaatcgagagcccttgacaacattggcagagtttttgccagagttgggaaattccagcaagccattgacacgtgagtgaccaagaattgcctcttccccacctccatggccttggacgatgccaacaagggtatcatcagagaactgaggaaaaccaactacgtggagaatctcaaagaaaaaagcgagggagaagcttcactgtatgaagatagaataataacaagagagaaggacatgaggagagtgagagatgagcccgagaaggtggtgaagcagtgggaccatagtgaggatgagaaagagacagatgaggacgatgaggcttttggggaagctctgcagagcccagcaagcggaaagcagagtgtggaagcaggaaaagccagaagcgatttgggagcagttgccaagggcctgtcaggagaattaggcacaagatcaggagaaacaggcaggaagctactagaagctggcagaagagagtcaagagaaatttataggaggccttcgggagaattagagcaaagactctcaggagaattcagcagacaggaaccagaagaactaaagaaactttcagaagtgggcagaagagagccagaagaactgggaaaaacacaatttggagaaataggagaaacgaaaaaaacaggaaatgagatggaaaaggaatatgaatgaagccatcggtagagatgaggatcaggaagctggtgttcagagggatcatgggattttattaaactggattttcaagcgatttgtctgttataggaaaaatgagggttttacttctgctgctttccatcactattttgccattaaata

SEQ ID NO: 8136 - DNA, 1932 bp, Homo sapiens
gtacactccttctctaagccttagtttccacgcctgaaaagtgctgggactgaggagctacctcacagagttcttagtgttaagtgaggtaatgaatgcgaagtctccagcgcttaagaagcaggtcctcggttaccaagagccccctttcctcctcttgccatcagcaaagagacttgaatcggccttttctctaagccccgttagaactgaaagcctggctcctgactgcccatagcactgtggcccacactcctcacaagcccaagccaaggatgccccactcctttcatatcagccacctcattttatccctgatttcatcctcctcctgaatgggatggcacctttcctcccagttcaaaaccctgcccctcctctcaggcccatctcacagccatcatttcctcatcctccacaaaccgctggtccttttattcaacacacattttatcaaatgcctttctctgcaaggaacttggtggtgtttctctctcttctcagtctccaaagccctttgtcagcaacttctcctattgcacccaattgattctgttttatttctcagtcacgggtgtccttggatctcttctccactagatggtaaacttcattgaaatctcatttttacagagctctacctgttgtagtgtttcccacagcatccaggcccttccctggctccatggtgtgtttcatcttcatctctgtgcctttgagttgtctgccagatcacagagcaagcactcaatagatatttggtgacctaaagaaaggaataaagaggtagcagcaaatgcagagaagtggcatcttccctatttctgacttgaaaggtgtctttttatccctgtttaggttgtatgctagtagacatggaaatgttcagaatttatgtattcccttgaactcaaggagcactttgtgctgtttttctcttgggtctcatatagtcagaggaactgaagtctccggaagggtcttggtcaccctgagaagcacccacttatgcaaaccttgcacttgcacagttcctttcccctggggtcagcctccatcccatgctgacttccaagctcagatctactctgcagactctgcagggcctaggcctcacatctagttgccttttagacatcttctcttccgtgtccacacacatcagaaatttaccttgcctgaatctgaccttggcttcctcctgcctgcagagaattcagattatgcagggagcaggaaggaagagaaatagggggagagcggagaaacaaaaggcatgtgctatctcctttcaagttgatttcagcaagcttcacattttgggggcaggcaggggaagaattctagaagagaaacagggtattctagtgagacaagccaatgctgactgtttaagagatttaggattgaaatctgcttttgaactcgcattccggcggtcctctttggtgttctcaccaagggcaaaaggactcaaatcctcagcggaggacagaaggtggcctctcttctggcaaaacatggtaagtatttttggagcacgatgcaaagcctcatctgcacagacgtcatgctgaggaagccaccccagcccggcccccgcatgccaccaacctccttctgaaaatggtgattaaaagctaatcatggggccgggcgcggtggctcacacctgtaatcccagcactttggaaggccgaggcaggcggatcacctcaggtcaggaggtcgagaccagcctggccaacatggtgaaaccccaactctaccaaaaacacaaaaattagccaggcgtggtggcgggcacttgtaatcccagctacttgggaggctgaggcaggagaattgcttgaacccaagaggtggaggctgcagtgagctgagatcatgccactgcactccagcctgggcaacagagcaagactccatctc

SEQ ID NO: 8137 - DNA, 3849 bp, Homo sapiens
agctgatccggttcttgcggcggtgcgtgctggcgccggagagttccgcgcgtgtcctcgggctgtccgcggggaagctggtccgggagtgggcgcccgcccgcctgcctcgcgccttgcgcccccggcaccgcttccagaagggaaagtcgccgccgctcgcggtagacccgggcagcgcttccattccgcggagctggaaatagggatccagccatccgtgggtcaggaggaatggagactgtaccttccacatagattcacaagctgccctgcagtggccttggcttcaggaaaggagcattcagacgcttccgtcagcctcccaggatggcagcccctgacctggcccacggaggtcatgtttctagggactcagtctgccttcatgaagaacagacacaggcagcagggatggtggctggctggctgataaattgttaccaggacatcacctgttccaacccagtgtgatctattggctggagcaggaagaggagttgagggcagggcggagagcagttctccaagaatggcgacttaaaaccaaagggccagcacttcggcaggatagatcttggttcagagcatcaaatgagacacagacgggtacattttcatcctggggtcttgctgtgggggctagaccgtccctctcaggctagatcattcctaaagatggtaaacaacttgctggaaacatgcactgcatatacaaatcaactcactgcatatgcacatcaactcactgcatatgcaactcaactcacaccgtatatgcaactcaactcacaccgtgtatgcaaatcaactcgcactgcgtatgcaactcaactcgcactgcgtatgcaactcaactcgcactgcgtatgcgaatccactcactgcctatgcaactcagctcgctctgcgtatgcaactgagctcgctctgcgtatgcaacccagctcgctctgcgtatgcaactcaagtcgcactgcgtatgcaactcagctcgctctgcgtatgcaactcagctcgcactgcgtatgcaactcagctcgcactgcgtatgcaagtcagctcgctctgcgtatgcaactcagctcgctctgcgtatgcaactcagctcgcactgcgtatgcaactcagctcgcactgcgtatgcaactcagctcgctctgcgtatgcaactcagctcgctctgcgtatgcaactcagctcgctctgcgtatgcaactcagctcgcactgcgtatgcaactcgcactgcgtatgcaactcaactcgcactgcgtatgcaactcaactcgcactgcgtgtgcaactcaactcgcactgcgtgtgcaactcaactcacactgcgtatgcaactcagcttgctctgtgtatgcaactcaactcgcactgcgtatgcaaatcaactcactgcatatgcaactcagctcgcactgcatatgcaacgcaactcaactcatactgcatatgcaactcaactcacactgtatgcaactcagctcgctctgcatatgcaattcaactcgcactgcgtatgcaaatcaacttactgcatatgcaactcaactcactgcgtatgcaactcaactcgcactgcatatgcaactcaactcgcactgcgtatgcaactcaactcgcactgcgtatgcaactcagctcgcactgcgtatgcaactcaactgttgcaagtacttatttccggccacttcctttttctaactaccacaccaagccagtatttctcctccctgaagtcagcccaggatgaggcactagacagcaggacatgctgtatgcccttgggcctgctggaagtatgcagactagccagccccagacttcatcctgccctgtcctgcctttcctgtgaaaaccctgtggcctctgcctcccctggctctgacttctgcctcctgcccagctctgcagctccccttgggccctgcctggagtgatgtgccgccttctcttgacactgtgagtgataaactttccatgtcaggaacctgtgtgtgtcactcactcaccttgacgagtccgcgtctaggccccaccagtggtgtggttttcctcatagtctctctacctaagcacatgtctgtgacaaggtcttacccagcccagggattcttgaactatctgtaggaactgccatgttgactcctgggcagttttattctttctctctactcgttcaaccttcttagggagtgacgttttttccaaagtggttgtgaaacagcatctccttggggtgttggtttgcacttctcttcattactgatagtatgaacatggttttgcttacgctggctattttcctttttggatgaagtacctggtcttgttttttcctggtttgtttgatctttgttcttttttagaaatagtgaggctgttgtgaggtgagtcaccacttgtgacttagaagattgcagtggtttccacttcacctgtttccacttttgtgatgatgccttaaggaaaaagattgtgccaggtgtggtggctcaggcctgtaatcccaacactttgggaggccgaggtgggtggatcacaaggtcaggagatcaagaccatcctggccaacatggtgaaacgccatctctactaaaaatagaaaaattggctagatgtggtggtgcacgcctgtaatcccagctccttgggaggctgaggcaggagaattgcttgaagatgggaagcacagattgcagtgaaccgagatcgcgccactgcactccagcctggcaacagagtgagactctgtctcaaaaaaaaaggaaaaatatttcttaattttggcatactcaaatttatacaacctttcctttatcttcatcagaaatttcttttctcctaaggccttaaatatgctgtactattttggcttccacagtttctatgttttatcccaagttgcttaatccatttggagttgatttttgttgaccgtatctgtagagtgtaatgtcatttttcccactatggacataaaaatttttgcaaggcctcttttttttaatgaagaaaagaggtttattttgttcacaattctgaaggcctggagggtcccagaagcttggcaccagcacccactaggctccagatcggggcctcatgctgacttccgttttcacacaacgagtgggaaacaggtgtcctaacactgtgagagaaaaaatccgaaagtttagtttttcccattcgcttgccctggcctccaggcagtcctgcagcagcaaacacatcatcagccttaggagctggcctgtgaggttgaccactctgtaggtggacgagcctcgcccgagaagagacatgagcagttctgcgtaggctttaagacagaatcaacatggaaagcacgacccacatggtttcaatagaacttgcctcctgaacctgactaggttactcgcctgatgaaccagtatctccatcacccgtgggactgacagacccagagtgtcataacctaaaattcagaagtgtagactataatcttaaattattcagcatatgtgcaacagccttggggagcagtgttatgataccaaatggctaacattcatgacctcagtatcctggaagaaaaggagaaagtgtgatgtagtaaaaccacttgaaaaaataatgatgaaacatttctcatatttggtgtaagataaaaacttaagtttgaagaggttccatgagccccagacaggataaacctaaagaaaaccaagcccaggccgggggcggtggctcacacctgtaatcccagcactttgggaggccgaggtgggcggatcacaaggtcaggagatcatgaccatcctggccaacacagtgaaacctcgtctctagt

SEQ ID NO: 8138 - DNA, 916 bp, Homo sapiens
gggggagaggtagagatgagacaagaggtagaggggagaggtagaggtagccacgagctgataattacagacaagagatgcggagtatgtgggggctcattatcctgcatagtctatctttgtatatctttgaacttttcaagaataaaaaagcttaaaaagtatacatggcctggtcctaccagagactcacccaatgccagcctccagccagggagagccaagtttgcattttcacacgcatctcacactcctctgcactctcaacttggagcgctccaaacagggaaaccccaagccttgctggcttctgccaaccccctgagcagaagcatgggtccccctgatcaccacctcaccaccctcatcctgatctcactggagactccctttcccggtctgctaagtagcgggtgttttccttgacactaacgctacagctagaccacggtgggcttggcaacaggtgtcttcccagatgctggcgttaccgctagaccaaggagccctctggtggccctgtccgggcataacagaaagcttgcactcttgtcttctggtcactcctcactgtcccctcagctcccatctctgtatggcctggtttttcctaggttatgattgtagagcgaggattattataatattggaataaagaataattactacaaactaatgattaatgattcatatataatcatatctcagatctatatctagtataactattcttattttatatattttattatactggaacagctcgtgccctcggtctcttgcctcggcacctgggtggcttgctgcccacatccaccaagtgcactttgggaggctgaggctggaggactgctggaggccaggagttcaataccagcctgggcaacatagggagacccccccccccaccatctcc

SEQ ID NO: 8139 - DNA, 1005 bp, Homo sapiens
atgcagctgttggggctcctcggcctcctctggatgctcaaggcctccccgtgggccacaggaactttatccacggccacatccatctctcaagtgcctttccccagagcagaagcagccagcgctgtgctcagcaattctccacactccagagacctggctgggtggccacttggtgtcccccagctcgcctctcctgctcctggccacagggaaaatgcacctatgacactcactacctccccccatgacacactcatctctgaaacattgctcaactctccagtcagttccaacacctcaaccaccccgacgtccaagtttgccttcaaggttgaaaccactccacccaccgtgttggtctattcagccaccactgagtgcgtgtatccaacgagctttataatcaccatctcccaccccacctccatctgtgtgaccacgacgcaggtggccttcaccagctcttacacctcgactcccgtgacacagaagccagtgaccaccgtcaccagtacttactctatgaccactactgagaaaggaacgtcagccatgacatcttctccctctaccaccactgcaagggaaactcccatagtgacagtgacaccctcctctgtgtcagccacagacacaaccttccacactacaatctcatctacaactagaaccacagaaaggactcccctgcccactggaagcatccatacaaccacgtccccaaccccagtatttactactctcaaaacagcagtgacttccacttcccccatcacttcttcaatcacttccacaaatacagtgacttctatgacaacgaccgcctcccagcccacagccactaatacattgtcatcacccactaggaccattttatcttccacacctgtcctgagcacagaaacaatcaccagtggtatcacaaacaccacccccctatccaccttggtgaccacactccccactaccatcagcaggtctacacctacatctgagaccacc

SEQ ID NO: 8140 - DNA, 1875 bp, Homo sapiens
gctttccgcgtcgcacagcgcacccgcccggcttggagaatcacagtggtaacgcctactgcacggggaggaactgagcatggtttcagtagcttagctgatgcgtctccagaaaactcgatgtggctcagcagcgagccctccaaacaaacaacagacagaactgccagcattctctgtaatgccaagacctgctgggcagcatgtgtggccttggagaggggaaagaatgcggctacctggggctgcatcttctttattttctaactacttttctctgccttatgtcatttacttgtcaatatcagatctcaatgtagaatgcctgatattctcagtgtttgattctcagcaagtgcatacttcataccagtcaaacggcttacatagaaatggaatgtttcatgattgcttggaagtctctaaacacccctttcttggtctaactctgacgctgtggctgtgtgatctgtcttcctctggcttctacatgagtggacatgaacccctttggaacctgtcacccctctgagaatagaatgagagctgtggactgtcctgccacaattccacagactgggtaatacataaggaatagaagtttttttggctcatgtttctggaggctgggaagtccaagagcatggtgccagcatctggtgagggccttcccctggtggaagtgggtgcaagagacagagagaggctgggtgcggttgctcacgcctctaatcccagcactttgggaggtcgaggcaggcagatcacctgaggtcaggagttcaagacaagtctggccaacatggcaaaaccctgtctctactaaaaatacaaaaattacccaggcgtgttgacacatgcctgtagtcctagctactcaggaggctgaggcagaagaatcgcttgaacctgggaggcagaggttgcagtgagctgagattgcactactgcactactccagcctgggcaacaattgcaaaactccgtctcaaaaaaaaaataaagagagagagagaggaatgggaatgaacttatcaggagccacctccctcgacaacgaatccactcccgacacaaaagcatattccatccacaggggcaaagcctcaggcctaatctcagaaaggccccaacacggttacaagagcaactcagcttccagcacgtgaactccggggcactagcagactccgcgctcagaacattggcacttctcatttgaactctatcttcacacaccctgcgtgaactgggaagcgccctcagcaaatagactcatgtggctacactaagcttgttcactttgcctcccgccttgcaagggttttgcccttccagtttctgtcagcttctgggtgatctctagtgccttcaaactgttgttttaatatctaatacagaagctatcatcgttattagcaggagagttcctccagtacaggcaactctgccgtggccgaaaacagattatgcaaaacaatttcaccctgtggatgtacatgcagattatggactgatacataatcaaaatcagaaatctttacaaattgaggaaaatgttttttcctactattgttataaaatagtttgggccacttctacttcctagtatccctggattacgtaacagtaacagctgcgattcagttccacattctacatgtaaggagcgaggggtgggagcccagccttcctgccttgcatctcccctgtccttgtgcttcatctcagcagcattacgtcatacttgctaataattcacctaagagtgacaaaaataatttttataagcatgtcacaaaaaggaaggaaaagtttcttttccctgctttgatattagaaccaaatggagctctggaagttttcaataaaatg

SEQ ID NO: 8141 - DNA, 2748 bp, Homo sapiens
cagcgatcagcttggctgcccttgcttcgtagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggctgttaagtaggaggttggagaacacacgtttttggtctaaaccgggggcccctctctttgcccactgagcccgcggcctgcgtggtgctgagactgcctctggccgcgtccgcttgggacaaggcctgagcggtggctgatcccacctggatgtcccgggccggctcccacccgaagcccgccatcccgggacgcggtggggagaagctggcactgctccttgccatgcttggcggccgctgctgcccggctgggggtcccgagtcgcacacgccccgcaagccctggccaccgatccggagggaacgccctgggctgcggtccccgaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggccccgcttcttcatcgcacttgcggccccggctgcccggggcctgcgagtttccagccagggcccgggactctggcgcggtccggccgcgaggaaggaaggcgtggcccgggtgggggtagcggcaggcctgcggctccggccacggggcaggggcagaaaaacgaccccggcgctgtccgggcatccagctcggttcccgctgcagccaggagactcccgggagcgctctaggaaccacagagccctggaactcacctggcagcctcgcggcgctaaagccggcggagcctgagacagcgcgcggcgaggcggtcacgctccacccccgcgtggcggcaggactcggatttcgcccctggttttaaaattgtgccggtggagcccgggacgctgggaagagcgttctgcgcccctccagtcgcggtctccgccctaaaccgacttccagagccgcctctgctccctggaggggcgcagtggcggacaccggcgtcccacgaagtcgcaggtcctcagtctgagggctgccccgcacgctcggaatgcaggagggtctccgcctcgctgcgctgcccctgggggcggaggcgtgcgctgcaggcgagagaggcggcccggtatcgatggagaagcacagagggctttgaggtcgcaacgtcccggttgctgagcggagtcaggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaggcgcgagacccggaaaacaaggaagaagcgagctcagcctcaatccccgtccccaccccactttcgggaccgctaagctggagaattgaagggggcggaccccggattaaagccgctcccttcccagcctcgccccgctttcctaatgtccgtgatgatttcgttattggcagggaagagccagactccctgcgctcccaagacggggcgattgggagggggttctggagctcatgcctggggtcggcccggcgggggtgaccccgcgccctcgccggtgcaaggagaacagctggttcccgccggggcagggaagcgtggacggtgtgggctcaggcgcctggcaggcacacggggcctctaaagcttggtcactgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcggggcgcaggaggtgggctcagggttctccagagaatccccatgagctgacccgcagggcggccgggccagtaggcaccgggcccccgcggtgacctgcggccccgaagctggagcagccactgcaaatgctgcgctgaccccaaatgctgtgtcctttaaatgttttaattaagaataattaataggtccgggtgtggaggctcaagccttaatccccagcacctggcgaggccgaggagggaggatcccttgagcccagaggttcgagactagcctgggcaacacagtcagactccatccttcc

SEQ ID NO: 8142 - DNA, 633 bp, Homo sapiens
atgtcccgggccggctcccacccgaagcccgccatcccgggacgcggtggggagaagctggcgctgctccttgccatgcttggcggccgctgctgcccggctgggggtcccgagtcgcacacgccccgcaagccctggccaccgatccggagggaacgccctgggctgcggtccccgaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggccccgcttcttcatcgcacttgcggcccaggctgcccggggcctgcgagtttccagccagggcccgggactctggcgcggtccggccgcgaggaaggaaggcgtggcccgggtgggggtagcggcaggcctgcggctccggccacggggcaggggcagaaaaacgaccccggcgctgtccgggcatccagctcggttcccgctgcagccaggagactcccgggagcgctctaggaaccacagagccctggaactcacctggcagcctcgcggcgctaaagccggcggagcctga

SEQ ID NO: 8143 - DNA, 3831 bp, Homo sapiens
agagaaagaggcaactacattgcctggaggaagcctaaggaacccaggcatccagctgcccacgcctgagtccaagattcttcccaggaacacaaacgtaggagacccacgctcctggaagcaccagcctttatctcttcaccttcaagtcccctttctcaagaatcctctgttctttgccctctaaagtcttggtacatctaggacccaggcatcttgctttccagccacaaagagacagatgaagatgcagaaaggaaatgttctccttatgtttggtctactattgcatttagaagctgcaacaaattccaatgagactagcacctctgccaacactggatccagtgtgatctccagtggagccagcacagccaccaactctgggtccagtgtgacctccagtggggtcagcacagccaccatctcagggtccagcgtgacctccaatggggtcagcatagtcaccaactctgagttccatacaacctccagtgggatcagcacagccaccaactctgagttcagcacagcgtccagtgggatcagcatagccaccaactctgagtccagcacaacctccagtggggccagcacagccaccaactctgagtccagcacaccctccagtggggccagcacagtcaccaactctgggtccagtgtgacctccagtggagccagcactgccaccaactctgagtccagcacagtgtccagtagggccagcactgccaccaactctgagtctagcacactctccagtggggccagcacagccaccaactctgactccagcacaacctccagtggggctagcacagccaccaactctgagtccagcacaacctccagtggggccagcacagccaccaactctgagtccagcacagtgtccagtagggccagcactgccaccaactctgagtccagcacaacctccagtggggccagcacagccaccaactctgagtccagaacgacctccaatggggctggcacagccaccaactctgagtccagcacgacctccagtggggccagcacagccaccaactctgactccagcacagtgtccagtggggccagcactgccaccaactctgagtccagcacgacctccagtggggctagcacagccaccaactctgactccagcacaacctccagtggggccggcacagccaccaactctgagtccagcacgacctccagtggggccagcacagccaccaactctgagtccagcacgacctccagtggggctagcacagccaccaactctgactccagcacaacctccagtggggccggcacagccaccaactctgagtccagcacagtgtccagtgggatcagcacagtcaccaattctgagtccagcacaccctccagtggggccaacacagccaccaactctgagtccagtacgacctccagtggggccaacacagccaccaactctgagtccagcacagtgtccagtggggccagcactgccaccaactctgagtccagcacaacctccagtggggtcagcacagccaccaactctgagtccagcacaacctccagtggggctagcacagccaccaactctgactccagcacaacctccagtgaggccagcacagccaccaactctgagtctagcacagtgtccagtgggatcagcacagtcaccaattctgagtccagcacaacctccagtggggccaacacagccaccaactctgggtccagtgtgacctctgcaggctctggaacagcagctctgactggaatgcacacaacttcccatagtgcatctactgcagtgagtgaggcaaagcctggtgggtccctggtgccgtgggaaatcttcctcatcaccctggtctcggttgtggcggccgtggggctctttgctgggctcttcttctgtgtgagaaacagcctgtccctgagaaacacctttaacacagctgtctaccaccctcatggcctcaaccatggccttggtccaggccctggagggaatcatggagccccccacaggcccaggtggagtcctaactggttctggaggagaccagtatcatcgatagccatggagatgagcgggaggaacagcgggccctgagcagccccggaagcaagtgccgcattcttcaggaaggaagagacctgggcacccaagacctggtttcctttcattcatcccaggagacccctcccagctttgtttgagatcctgaaaatcttgaagaaggtattcctcacctttcttgcctttaccagacactggaaagagaatactatattgctcatttagctaagaaataaatacatctcatctaacacacacgacaaagagaagctgtgcttgccccggggtgggtatctagctctgagatgaactcagttataggagaaaacctccatgctggactccatctggcattcaaaatctccacagtaaaatccaaagacctcattcttatctgtgtgtctgcattttctaatcctttttgccccaggcaaggtccctgtatctctgagacaccccgattggctggagaattgacttgggagagataaggagggagggcgggtgccagcatgctatgggctcctgcgtgaggcctgtggtacacagagattaggttgtgatacatgaagagccaagagcaggatgaggtggaggcgttacaactacctgctctgtgtgtggggggggagtggggaggggggtacgcatattcacttgaagtcgaggttcccagggcatttccatgtgctccaggcctgactacccatcagggtggaggagctggtgacactcatctccctgagtgctccctggtttcccaagggaaagactttctggcctgctgaggtcgaatcttccaagaggctcttgcaaagacccgagattctcataaatccctgcccagaagagctgcacgtatccctttcatgagtccagggaagagggtcctccaggtcttggaagacagaggggagctgctttagaggctaagttgctttgagcccacaaggtaatggagggctcctacttgggacagagccctcagcagagaattagcagtctgttggtgggttcaccccaactcacagcagtagaaactgctccatcttccaccacttattgggtttctccagtgtcagcaaaccaaagaattggatcttaccaatgcggctataggaaaacagcctgttgcatggtaagagtgataccatcttgaagtgaaaccaccacaatggccattttttttttagatggagttttgcagtggtgcaatcatagctcattgcagccttcaattcctgggctcaggcaatcctcctgcctcagcctcctgagtagctgggactacagtttcgtgtgccaccatgcctggctaatttttagaattttttgtagggacagggcctcactctgttgcacaagctggtcttgaactcctggcctccttgaactcctcctgccttcgcctcccaaagtgctgagattacaggtgtgagccactgcacctcgccagatgtccaatgtctgactcctgcataccaaggtgttctgtatcaagggctttaaaacaatgcctgtagcgtaattaacctctcacaaagatgcttatctaacctccccagcagtcatgggtttcagcaagaaagtctgtgatgtgaccagttgcacatgttttcccctaaaagcttactctagaaaggatattttttggagagggagtgtgggaatccaccatcttgtggccacctcagacatcacttctctttggaagactccattaaatatttctctgtgagaaa

SEQ ID NO: 8144 - DNA, 1783 bp, Homo sapiens
aggaggaacacttccactaaaagaaacatcaagattactatgaactattagctgtgactgcacccgggcacttgagctcctcatatcaggagactactaggcaagaacagtcaccattctttgagggataattaatcctgatcatcaggaggaggtacagctgctgttaagcaatggagggaagggaggtatatctttggtactcagttgattcacgtggagacttcttggtattcctttgcccaatttttttttctttttctttttcagaggtggagtctctgtcacccaggctggagtgcagtggcaccatctcggctcactgcaacctctgcctcctgggttcaagctattctcctgcctcagcctcccgagtaactgggattacaggcatgtgccaccatgcccagctgatttttgtatttttagtagagatggagtttcgccatgttggccagactagttttgaacttctggcctcaagcagtccacctgcctcagcttcccaaagtgctgggattacaggcgtgagccactgcgcctggccccttgcccaatatttataaaataattatacaagtgcccagaccgtgacctgagcaggatatgctgacttcaggctcagccccctcagggctgagggtctaaatcatgcctccgtggaagtgacggagaccggaacacgtgctggctgagggtaaggaggatctagaatggatagtagaagagggagatgatgagtatcagttgtggcctcaagaccagtcagtgatggaggttgtagtttgtccaacttactttcctaagtttcccccaggaaaggaggtccaccagaacttaaaccaaaaagtagagctgagcagcacaaatgtgggctgtagtggacaccatcctgtgctgcccagaccccccagccaccatgcttcctgggcctcttcccacagctactgggagtgctctcagccagcagccttcagctgtcagccccctgggaattttcctcaatggaagagttacctcactgacatacccctttcccaggcaggtcagttcaaggttatgaaggcctggccccactgcctcaacttgacaacttggaagggccatctcagcttcaagaccctcccatgagactggctgaggtcttcatacagcatcggagcccaatttatctctctgagcaatcctgcttcctttcctgcccccttcccaagagcaatccctgataaacttcccgcatgctaatctccatctcagagtctactttccaaggaagtgggcctataacatagctcttccagtttttgttaacaattctagaacaggggtcagcaaactttttttttttttcgagacggagtctcactccgtcaccaggctggagtgcagtggcgcgatcttggctcactgcaacctctgcctcccgggttcaagcgattctcctgcctcagcctcccgagtagctgggactaccatgccaccacacccagctaatttttttatttttagagagattgggtttcaccatgttggccaggatggtcttgatctcttgacctcgtgatccgcgctcctcggcctcccaaagtgctgggattatagacatgaatcaccacacccggccagcaaacttttttaaaggaacagatagtaaatattttaagctttgtgagccacatggtctctgtcacaactattcagctctgctattgtaatacaaaagcagctgtggacagtatgtaaatgaatgaatgtggctgtgttccaataaaactttatttac

SEQ ID NO: 8145 - DNA, 1143 bp, Homo sapiens
cgcagcgccccttgcagagtttatcagatcccccattgacgaaggctgcaaggcaaagacccccgctgggccaccatgcctgacctgaagatgcaggaggtgaagaagatctgctatgagttggccctggcttacttccaccacgggcaggctgagattgaggccctggccaccctcaaggtgtgggagttgtgtcacacctatggcaagccagagggccccagagatgcctggagggctgtggcccgggatttctgggacaccgtgggcgaggaggaaggaggtggagctggcagtggtggtggcagcgaggagggaacccgaggggtggaggtggaggacctccaggcccacatctgcaagctcatggggattctgcagcaggtgaagctgcagaacagcagcaaggactgggagctgcaggcgctgcaggaccgcatggtctgcatggagaggatcatccccctggcccaggatcatgaggatgagaatgaagaaggtggtgagttccactgggccccacctgaaggatgagaggaggcagcccccagtgaccacatgccctcagcctggtccccctcaccaccactgtcaagctgggagtgggtgtcgcggctcatagaggaggaccctgccttccatcgaggtcacctttgctggcttaagcaggagcagctacagctgcagggactgcagcgctgtgagggctggagcgggggtgctgcacaggcccccaacccgctttgtaacccctcacgatgcaagctgcgcttccccttcaagagcaatgcccagcactggagtcctggccagggatggggagcggggaggctccagctccaccccttccccctgaggaggtcactccccctccagccacccctgcccgcaggcctccaagtccccgaaggtcccaccatctccgcaggaactccctggaggaagggggccaatcctggggagcgggttctgcacagcctgaaccccagcacttctaggccaaaaagcacaacttacattcagcagccccaactgtacccagcccagcggcccccaagaccccgctactccccatacactactcccccacaaatgagatggcagcgctctgcccctgacctcaaggagagtggggcggctgtg

SEQ ID NO: 8146 - DNA, 1124 bp, Homo sapiens
acaagagctaggacaggaggagccgcagagctcgtaattgctgcggggaggacaggccagctctggaagaaaacagacagggtcttgctctgttgcccaggccaagtgcaatggcatgatctcagctcactgcagcctcccgattgttccgatgaaacttttaaccacgtggtttgttatgcatgtcacacccacaggccacttcaaacttgcagcacacagtgagcaactcggacaatatagggtccagtgctgggaggtggacctgggtcccattaacctggacagacacctccaagatgagcatgagggggctgctggatctgttctcctttcacagctgtatcctgaagaatggcagtgagccggaagagccacaggattcggcaaagacggacacacagctgagtccggctaccctggcgttggagcgcgaggagcacagcagccgccacgtcccttccgtcttgtcaaagaccatgagccgagcgtccgcagagctgacctgcactgcagggcgacagggcccggggccgcctgggtcccacagccaggctccccacatgcttccccagccggagcccctcctggcctgtgctccagccatgtggtgtagacgtgaaccccagcccatcggagggttgcagcccccacatctgcgattgcatctggaatcatgactcaaggactttttttttttaaagacagggtctcgctctgttgcccaggctggagtgtagtggtgtgatcttggctcactgtagccttgacctcccagactcaagaaatcctcctacctcaacctcctgagtagctaggaccacaggcgtgcaccaccacacctgactaatttttttgtttgtttgttttgttttgttttgttttgtagagacgggtcttgctatgttgcccaggctggtcttgaactcctaggctcaagcaatcttcctgcctctgcctcctaaaatgctgggattacaggtgggattacagagcaccatggcactctgccagactcaaggactcaggtcggaccaatcaacagcagccttgaggctgtggccggcccctccgcgaaccaggggaacttcactctccattagaagtcctaagttggctgctca

SEQ ID NO: 8147 - DNA, 2268 bp, Homo sapiens
ttgtttggaattaaacttctagcaatcatttacctttatggttctcttaacttcaggtcacactgttgtttagtcaatgtgagaatctttcagatgttctgcactttgcaaaaggatattcacagccaatgtgtgcggcagtgaaggacacttgttgattccttatttattgtctgctgttccagggaccggggactagaggtgaataaagccttgtttgggctgtctaggatgttgtgatcgacacaggaaacagacatgaaagccaaattggcgcagtgggtgaagtattgtaatactggtctctgtttatgatatatggaagaagtttcctagtagcagggtgggtgagagagtccatcatcattgcagattggtgcctctgtggacatgcaggtatattaggccagaggtggggagtgggagagagagggagagagagagcacgacaaagagagagagagagagtgagcaagagagagggagggagagagacagagagagagagagagagagagagagagtgagcaagagagagggagggagagagacagagagagagagagagagagaggttttgagagcattgatatggggtctacatattccccccggcccccattccctattatcatagaagcatgctgccctccaaggcttttgaatttgccaccgtgaagagcatgcatggaatcttcggctgtggccttgcattgccccctgtcttcgcagcggagcttctttatctgacccgtgcatgtgcctctgatgagcagcccttcatcacagctctgcggcctcctcctaggcccccgccttcagctctccagttcatttcccgccttgttcccattgccacctgcgggcttggagggccacctgacattctgtcctttgggtcccctgtgactccagagctccttcccttctggggcgcccacatctgcgacacgcttgtttgcccagtgcattttctacacttagagttcctctcgtgctctcatatttccatttaaagccctctcgagaggtctgtctcctgccagcagcattccttctagtttactagaactccatttctcatcctgccaggaatccagccgtggagtgagcttcagcaagcctctctgcagtctcttgtctgctccaaaactgtggcctctggttgtgagaaatgggcatcctgagtcagtgagagcagtagttagcttgcagcagcttcccctctccccctgagtgagcctttcttcctcttcctcctctttcattcagcctcatcctgccttgggtccatttgacagataatggcaccttgaggccttgtcttttgcatggcatctgtgcctgactggtcagaaattacttgtgaagcaacatagggggttgttggttgggtccacttttaggatgaagtcagaagggatcgtgagtgatgcttggccaataagaatgtattgatttgatttactaattaatttcatttccagacaccaatatatgcatagccttgtttgaagaaaattaaggagaaccattttgtaaatggcaatgagtgtaagacacttaactatcttcctgctctccctggcgtgggcttccgcgctccctgactctgcttttatttaaggtgtctgggaaggcatttgtccttcggcttcccagctggcttcttgccttctcactcactgcctcccgtagcctgtgggcagaatccctcaccgtgcccaccttgccctgctctcgtctgacctcacctctgtttccaggatttgctatggctgtcccctgccagtcatgctctgtgcttgctactctgagtgtgtccctggtcccactctcttgcagcctctgtgtcttagcacatgctgccctgatggcccaagggcccttcccctttgtttctgtctggggaatgttctgtctcctctttcttgaacctccttatattccctcaagaagacttaaggcaaaaacaaacctgaacttactatgtgtggtatttttgtgttataagtgtaggacctagtcatagtaacacatttcaaaaatatggaaccgtataaagaaaatgagcatcactcataaatcactatttagacacaagcattgtttacgtttctaatattctttctttagtggtgcttttcatgattttatgtgcatttgcattttactgactaaatattactatataaacattttcatatcttgccacttcacctaacaatacagcacaagcagcttctcatggcattaagaattgtttgt

SEQ ID NO: 8148 - DNA, 264 bp, Homo sapiens
atgaggagccaggggcagggtgggcctggggcctggcggaggatggagagctggagtgcagagcctgctggaccagggcagggccgccttgggtccccctgtgaggcagccgagcaagcgagctttgagaagacagtgataggagtggggcaagcacgggcagccctttctgaagaggagcacagagtctgggaggctgcagcgggagttggaggactagagcagtggggctgctgggaagcaggggtcacgagtggctggggc

SEQ ID NO: 8149 - DNA, 1348 bp, Homo sapiens
aagctgggaatgacttagatgtgtcagtgttcagactgggcaacttgtggtggtggctctgcctacagggtggtgcctgagcccctgagtgaagggaggaaggagtaggtgatgtcttcatttgtggtggtgatgggatttctagttgaaatgacaagcagaaaaaagaacaatgtaaaggaagaagagatggagtgtgctgtcacttatctaaggaaaggtggggggatttgctcattttatttttatttttatttattttttatttttatttatttattttttttgagatggagtcttgctctgtcgcccaggctggagtggagtggcgcgatctcagctcattgcaatctccgcctaccaggttcatgccattcttctgcctcagcctcccgagtagctgggactacaggcgcccgccaccacgccctgctaattttttatatttttagtagagatggggtttcaccatggtctcgatctcctcacctcgtggtctgcccaccttggcctcccaaagtgctgggactacaggcgcctgccacaacgcccggctaattttttgtatttttagtagagacggggtttcaccgtgttagccaggatggtctctatctcctgacctcgtgatccacccgccttggcctcccaaagtgctgggattacaggcgtgagccaccgtgcctggcctggtttttgttttttgagacagagtttcactcttgttgcgcaggctggagtgcaatggcacgatctcggctcaccacaacctttgcctcctgggttcaagtgattcttctgcctcagcctcctgagtggctgggattacaggcaagcatcaccatgcctggctaattttgtatttttagtagagatggagtttctccatgttggtcaggctggtctcaaactccaacctcaggtgatcctccagcctcacacctgtaatcccagcacttcgggaggctgaggcaggtggatcatttgaggtcaggagttcaagaccagcctggccaatatggtgaaaccccgtctctactgaaaatataaaaattagctgggtgatagtgacgcacgcctgtaatcccagctactcgagaggctgaggcaggagaattgcttcagcctgggaggcggaaagttgcagtgagccaagatcgcgccactgcactccagtctgggcaacagagtaagactgtgtctcacaaaaagaaaaacccaagggtttaagctggctgtggttatacgcacctgccatcctagctgttccggaggccaaggccataggattgcctgagctcaggagttggagtctagcctgagcaatgtagcaggaccccccaagctg

SEQ ID NO: 8150 - DNA, 772 bp, Homo sapiens
gtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcccgcccgtctattccacaaagccgccattgtcatcctggcccgttctcaatgagctgttgggcacacctcccagacggggtggtggccgggcagaggggctcctcacttcccagtaggggcggccgggcagaggcgcccctcacctcctgggcggggcggctggccgggcggggggctgacccccccacctccctcccggacggggcggctggccggtcggggggctgaccccccacctccctcccggacggggcggctggccaggcagaggggctcctcacttcccagtaggggcggccgggcagaggctcccctcacctcccggacggggcggctggccgggcaggggggctgaccccccccacctccctcccggacggggcggctggccgggcggggggctgacccccccacctccctcgcggacggggcggctggccgggcagaggggctcctcacttcccagtaggggcg

SEQ ID NO: 8151 - DNA, 1582 bp, Homo sapiens
agaaggtctgaaaggaggcggcctgggaaactgtgaggcccagaaggacagggttcgaagaggaaaaggaggagagaagcttcggagggatgaggatccgcacgtctttcttcatgtcggcggctctcgggggccggcctccgcccgcacgcacggagtggactcctctcaccaggagcacccaccccacggcgccacctgccagcctcttcggccgccggggcccgccgcgccgccccctcagttgcttccccgcaagagagccgggacagcgccagctccgcctcctccggcccagcgggctgtggcggcggcggcggcggcggcggcggcggcggcggcggcggcggcggcggggacgacggcacgcggcgagggacacgcgctttcggaacgcgaacgcgctctgcgccggaacagcgctcccgctgtcaggccgccgcagcgcaggcccagggagcctcgcccaccctcctttgggcaccgcgaccccggagacacttgggccaggaatttgaatggcggattccctggtttaaccccgtttattttatagatagggacagaaattccctgttcaaagtcacatagctagagcttggcagtgactcagagcagggatcttctcaccagaccataaactccgggagggcagcgatcagcttgcatggttttcagctgcgtccccacgttattggatagggccgtcagaaaatgcttgatcgagtagggcgactggctcccaggatccggcgctttccactccccaaagcccgtcaccctagttgcttttgcctctgatgcttataaaatacgattataagattcgtttttacgctgtgtgaacaagactcctttctttataaccaaactaagtgactttttttctgtctatgtagtttattttatggcagggttttcggacactcttctttactcaggcttacccagcgtaatgctagacacggaggtggcactcgataataaactctagatgatttttctaacattgccttaattttctcgtgaccctctccatctggaggaatttgttgttacatgcttaatgtttggtacacaatggcaaatatatatatatacatacgcgtgcgaatatatatcacatccctaatacttggcacacagtgggaaatataaaatacataaattaatgaggaagcactatctgtgcataatgtacattttttctatcttaaatattacacaataaacacttaaagggaatgaaatgtgcgtaataccaacttccctttctcctaggagaagtcatgtggtctcttgcagcagttaagagttgctggcaaatttcctgggtttgaatctaggctccacataatagctctgtgatctcgactaagtgcttttatttttacttccctcagccactgttccttcttctgtagcatggaaataatgatgataataccttcctcttgagatggttgtgagtaataaatactataatacttgtcaagcatttggtacagtgccagactcagagcgtgtgctctactgatctcagctatcattattatattaaaaagtcactaaaaagttgtaa

SEQ ID NO: 8152 - DNA, 1977 bp, Homo sapiens
ctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgtctgctcactccccttccaccctcagcggatgataatctcaagacacctcccgagtgtctgctcactccccctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccttccaccctcagcggatgataatctcaagacaccttccgagcgtcagctcactccccttccaccctcagctccactctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttctgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctga

SEQ ID NO: 8153 - DNA, 1459 bp, Homo sapiens
tctggcggccatcattccctgctgggaggccggggcaagcccttccttctctaggcttctgcctcctctggaaaaagggggctaagttcccccgcctgtgcccaacagggtgatgggcatatccaatgagggtgcagggagctctcctgattctgatccccactcccgcctgcggccagggcctgggtgcaggagactcccacagccctgtgggcccccaggatatatggtcccactcagccaggcctcgtgctcctgcgttcctggagctggcccatggctcagatgtggcacctcagttcccccctacccaagcaagcctcatggggcccagaacccaggcccttccccccatctttctgaggagtccacaccaagggcctgacccagggctgaaccttaggcctggctttgaccaaaggttccaggcagccacccggccagccagactccagggcagctcccggggcacatgctcacagcgggaggctgggagcatgggtctgcaggggagctcagggcaaatgtaggggcccctgtctctgggtggaagagcattaaaacactaggtgcatgaactctgtgttcagacagcctggctccaacttcagcttccccatttatcagccgtctgcctcggtaacccatggcctcagtttcttctgtgaagtgagccctcaaatgcttacccctcaagattatcgtgggaagcaacaagggcacagaggatgccctgggtgcatggtggccatggacacatggccggccgtgcttcctgagctccctggcttttggggagaagggagtggaggccaggcttggggtgccaggggtgaacctttgctgcagaaggcaaactgtttgcttgaggctgtgaggctgttcctaaactacaggcccctgggggcagagggaggagaactaacatttggtaagcgcctgctggtgcccactgctgtatcatgtgcctatgattgcgtgagctcatcagccttcctgggtatccagctcctgggagaccccacaaggagccctggccactgctaccgtcaggattttaatggcacactgaggctcagagagggaaaggggcttgtccagagccacacagggactctgtgggcagggccactccaggaagggacccagggccagacctgagtctaggtgataaacaagacagacatgaggctgggtgtggtggcacacacctgtaatcccagcactttggaaggccaaggtaggcatattgcttgagcccaggagttcaagaccagtctgcaacatgatgaaaccccatctctacaaaaaatacaaaaattagctgggtgtggtggcgtgtgcctatagtcccagctactcgagaggctgaggtgagagaatagtttgagccagggaggtcgaggctacagtgagctgtgatcatgccactgctagggacagagtaagaccctgtctc

SEQ ID NO: 8154 - DNA, 1174 bp, Homo sapiens
caatccacaaactgccatctactagtccatttgtgagctggctggtaaattcaccttcctgggcctcagtttcttcatcagtaaaatgggataatgatggtgccttcctagttgggttgtggtgaaggttaaatgagatgccatgtggaagtgcagaggagaagggctgctataaggggctccaggtgggtgctgctgttatgattgggcacctactgcatgctgtgtccctgcatacaggagtcgacctttgagacctgcttattcatggctgtttcacggatgtcgaagtggaggctcagcagggttggaggttcccggagtctcccagctgaaatggaagtgcttggtgaggtttggtgtgtccgagccgaagagcagccaatgacaggcctggggatcgtctggcacagcccacttgacaaggccttggaaacttggtctctgcagcagcaaccggatttcagcctgggcctcggacacctcggcctgggtacggatgcgacttggatgcagtccttccctggcagtggaggggatgcccaggctggcacaggagtctcgggtcctctccggctctaccccaatctgctgtgtgattttgggcccaggcagggacccctctgggctctgttactggagaaaaggcaaatggctggtacgggtgggtccccagccctccttgcctggaggtctgcgagttggagggctctggggtaaagccagagccaggcccggggagagcctaggctcatctctggtgaacagggtaccctctagccaaagcaggggcaaggcgaggcacatgcccctcatatgggagctggggctgaccccctctcctagccctgcacaccttgagcacgtggccttggcccatctgccctgtgggtggacactttccagccctgggtcctgaactctaccaatcagcaggaacctagactcctgaggggtgcagcctggatgggaggtcagggaactgggttcctgagcgcatctctgtgccattcatctctccattggtttcccaaatgtggactgagcacacactgtgagtcaggcctgagctaggttctagggatgctactgtcaacaagacagatgaaggttcctgccctcatggaggggagggagacaataagcaaagaaataaatgcatgatgtaatgtca

SEQ ID NO: 8155 - DNA, 534 bp, Homo sapiens
aggagtcgacctttgagacctgcttattcatggctgtttcacggatgtcgaagtggaggctcagcagggttggaggttcccggagtctcccagctgaaatggaagtgcttggtgaggtttggtgtgtccgagccgaagagcagccaatgacaggcctggggatcgtctggcacagcccacttgacaaggccttggaaacttggtctctgcagcagcaaccggatttcagcctgggcctcggacacctcggcctgggactgtacatcttggcctcttacctactgtgtccgcgtcagcctccctcacagcctgatggcccctgcggcagccccaacccggtttcaggggctaagaaaactacagttgcatgaacgggtggaggtgagtgggaggcagaagcggcggggagaaccagtctgttccgagatctctggaccaaccagtggatcctgatggtcagccttgtctagagccccttccagcgtgcaggccagtcctcctggcattcttctaattacaccgagctgtgagtta

SEQ ID NO: 8156 - DNA, 368 bp, Homo sapiens
tctgtttgaagtctgcataaaggattctgcttggaaatcctttcctacagatgcggatgccttccagcacaccgttacacctcagctggtggaggacaagctcatgctccatggcacctaaaaatgcatatttatttcactgcagagctgttgaaaaggagaaatgcaaaaccaaccttctcgatgagctcgatgcaggcagccaggtccatcccgaagtcgatgaacgtccactcgatgccttccttcttgtactcctcctgctccagcacgaacatgtggtggttgaaaaactgttgcagtttctcattggtgaagttgatgcacagctgctccaggctgttgaactaaataaatagatatgttta

SEQ ID NO: 8157 - DNA, 1926 bp, Homo sapiens
gaccccttccctaatgtctagactgtgagctcaacaatgacagtctttttcatctttgtgcccctgtgactagcagatactaggtactgttgtatgtttgctgaatgaatgagcacacagattctgaacaacacagattccaagtatgtggaatcagcagggtcgtcctggcatcagaaatcagttctctctttttttttttttgacacagagtctcgctctgtcactcaggctggagtgcagtggcgcaatctcggatcactgcaacctccgcctcctgggttcaagtgattcttctgcctcagcctcccgagtagctgggattatagacgtgcgccacatgcctgggcaacatggtgaaaccctgtctctactaaaaatacagaaattagctgggtgtggtggctcgcacctgtactcccagctactcggaaggctgaagtgggaggatggcttgagctcaggaggcagaggttgcagtgagctgagagggcgccattgcgctccaggctgggtgacagcgagattgtgccttaaaaaaaaaaaaaaaagaggagggggaaagacaaaattgtattctgtaggtcttgagttcaacatttggaaggtagacatttggaatgctctagttccactagacctttggttttcacttaagggggaatcaaggaccattgtgttagaatccagtgaggtcaggacgtagggacgctcaggacagatggctgaggatgtgttgaaagataggggtgggttacagaagattgcactctatcacaagacgaggaatgtttcggatgtggcggtgctcaagtggtggtcctgggatggaatatgccaaaccgcctattagcagagttacagtgtcttttagagaaagccaaacatattacctgtggaagtggtaagaaacaagagtaacccacttatgcctactgtttaattattggaacgctaagcctgtgggagttattgatcccctactgctcaaggtcatcgccaaggtctgatttttcacacaaaaaaatttgcaacctctggcataaatgggttaaggacagactggattccttagcatagtggagaggctgagccacccaggagtcgggaggcagttttacactcaggtgcttactgatcatgtctttacatgttttctgcccgtactgatcatgcatggtttgcacctcccctatgatacatacctgcttcaatcttgtgtagatttggagtctcatcttcctgctgggctctaaaagctccaggctatcaagagtttgaatacaatctttctggtcagtggtttcctgatggtgaggatgtttgattagttcatctacaggatttgatcttagcttgaagactattgatgctgatggttcccagggcagttgtttgaaggctgcaggacagaggtccagcaatgccaaagaggggcggtcatcatgacaaactacactactgaactaattgaaactggactcaggagacctcatctaatgtgtagaattctcattgattacaacttttatcagatatctttcatgactagaatacaatttaagctaattattttcctgtttaaacctaggcctgtgatacttgggctgtgatcctctagagccagcttggactcacatcattctatggggttgaagacaactcattccctctgaggagccttgtacatacaagccttttatttataacttattttgtattgaaacttttaaacaatactgaagaaaaaaaaacttttccgacatctgttcttggtcttttgtgacgcaggttgaagggggaggaatagaaaaagacaaactgccttggaggagataaaccaattttatgtctatcatgttatacaaaaatctagaaataatagatttgtacagaaaaaaatgataataaatgagaacacaaaac

SEQ ID NO: 8158 - DNA, 1601 bp, Homo sapiens
cagcaaagggcaacacattctgcgggctcaaagtcaagcagatgatctgcttgatccagaccatcagttactggatcagtcacagtcctccagagaagcagaacccataggttacatatttaaggaactgactcatgagattgacaggtctgaaatccgcagggcaggcagcaggccagagaccccggcaagagctgattggatgaggcctacccacattctccaggataatctcctttccttaaagtccactggctggagttgttatccacatctacacaatgccttcccagccgcacctcagtgcgtgttctgttgaatctccgggtgctgcagccaggttgacacagcgacacctcacaggtgttgctcgtggaggtgggcagaccggtacattccatatggggttactgcccagcagacaagagtgtgctcctgtctcagccttgaccctcacaaccaccatggggcggctatttagtgtgcactggcaaatctgggggccctgttctccctgcatcgtttaccccaaaggtgatagtgaacaatctgcttccaagtcgaaacaggctttcccattgctattgagaaagggaatggaatggcctctgtccgcatggctggaatcctcctcccctgccccctgcatgcctctctggagacgcaactcattctgggaatcccgcccgagtccttgcaggattagggggctttgctccatgagaccccacgggctttgatgtatccacactctccggagtctcctccccaggggccacagacttgcccatttttctagacacctggctggccacttctcagacgctgtccttagcagcatggaagagcagggcctgggaacatggacttcagagccagaaagcgcaatgtcacacacccgtcccattagtgtgcgaccccagccagccacctctccaaaccttagcttcctcatttgtccctacagagtctagcaaacataaatagctaattgaggaatctgtcttaaaatcctataggtaggaaaacagtgaccaaaagcaaccctaaaaatggtagggatcaggcctccttcctcagaggcggctggggaatataattgagggtccagtctacagaactgcaaacctcagtccccacccgcacatgactgtgccctgttcgagaagttgatgccatccccctagaagctgtgacaaattatcaggttaggggaaagtgtgcaagtcacacaaacgatttcaggaagatttgcacacgggcacatatgaccataatctggtttctggcattgatgttgaactatgaaattcaacaaaacaggccaggagccgtggctcacacctgtaatcccagcactttgggaggccgaggtgggcggatcacgaggtcaggagttcgagaccagcctgaccaatatggtgaaaccctgtctctactaaaaatacaaaattatcgaggcatggtgatgtgcacctgtaatcccagctgcttgggaggctgaggcagaagagtcgcttgagcctgggaggcggaggttgcagtgagctgagatagcaccactgcactccagcctgggcgacagagcgagactccgtctc

SEQ ID NO: 8159 - DNA, 261 bp, Homo sapiens
gccgcacggtctctagcccgcagggctctcagagtcgcaggcggtgacgcccggtcggggggcccggtcgcaagggacacacagctgggggcgcaatgtcacccgcattgacgttccctaggcgctggatcgccgaaggtctggttgaaaacttgaacccgcctggagcggatgcctaagaaaatgcaggcccgctgaagcctccccgccgggccctgggccctgaaagcctccggcagtttcccgtgaccccgcggccgc

SEQ ID NO: 8160 - DNA, 270 bp, Homo sapiens
gtgaggaccaggcaggagggcctcgcctcgaggcgagatggccgcacggtctctagcccgcagggctctcagagtcgcaggcggtgacgcccggtcggggggcccggtcgcaagggacacacagctgggggcgcaatggcgctggatcgccgaaggtctggttgaaaacttgaacccgcctggagcggatgcctaagaaaatgcaggcccgctgaagcctccccgccgggccctgggccctgaaagcctccggcagtttcccgtgacccc

SEQ ID NO: 8161 - DNA, 2146 bp, Homo sapiens
gatgacttctaacattctgtgatgcctaattttgcaaaatcacttttcattcacccaataaatttttttcttcttttttccacagagttttgctctgtctcccaggcaggagtgcagtggcgggatcttggctcgctgcaacctctgccttccaggttcaatagagtctcctgcctcagcctcccaagtagctgggattacaggctcatgcctgtaatcccagcactttgggaggccaaggctggcggatcacctgaggtcaggggttcgagattagcctggtcaaaatggcaaaaccctgtctccactaaaaatacaaaaaaaccccaaaactgtccaggcatggtggcacacgcctgtagtcccaactactcgggaggtggaggcaggagaatcacttgaacccaggaggtggaggtcgcagtgagccgagatcgtgccactgcactccagcctgggcgacgagtgaaactccatctcaaaaatatatatatatatcaattaccaactaaaaacataactccagtttggcagtttgcatattataaggagataaatgttaaaacatacttgactactttcagaaatgttctcctggtactttttgcatttctacattcagataaaaagatttgcatgcacctggctaacgccaagggaacttcatttttttcttcactattatgcactttcatggtatagtctttctcagttcttttaatttttgttatttaacatctttaatagcacagcaaacatcttttcagaaattttcagttaaagcctttgaattacttatctttgatttaatttacagccagcattttgccacgttctaaataatatttagctcaactgattcatacgtattaatgaccattctagcaaaggcctacaagtggtgtgggaatcagggaaaggctgcctctttggtatctcaactggtattgattattgctatcaactatttggggagaaaaaatcaaaatgaagccctgtcaaattttagaagtactatctttggtccttcaaacactttgtgatgacaccttaagaaaaataaagttgaagttcaggtcttgccattgccattacagacaaattaggagacttggtttacctgggaacaaatttacttgaatattcagtacctgaaactatgccaaaccaaagagcagctgcagtacattcgttattttaaatgaacaagtttacaaagtttattttcatctatacgtaaggatgatttttttaaaactttttacatattagtggttatgatccaatgtgtcatgagtgaatttaactgtaaggtggtttaaatcaaatatgcaatgtttacttgaattgtatttctattagcagattttgactatgtttacaggacggtttaaattaaggattatcaggcatgtgagatctttcagttatctttaaagtagatgtatattaagggcttagatttaggatctacatattctgggcattgaataggcagtaacttacaaataagttttgcttaccttttgttctagggactagcactgctatcaatggaaagtatttttaactaatctgttattaagaaagtcatatttttgcatttcagccaaaataaagaccgcctgtaataatctgttagaaacagataatacatgtctgaaatccatatgtttcatatgatctaaactgtattttccaatttaaattaaaaatgtaatatagattcagaaaggttcatatttttctaatgacttcattctatattattttgttaggttgcataaagaagcaaggaattgtacttgtattaaaagatgaagaaagctattaggtatatttgtacatgactgcaaatgagtctatgcccgtttaaaagaaaagatggacactattttaaagtgagctttaatatgcttttatataaacaaatttgaagtacagtttagtttggttgtgtttacctaacaagtaccataagccttgtgtttgttcttatttgtataatcctagcctgtgacttaatgttgatgctttgctttgtcttttggctggcctaacctacattgacatgtacacagaacattttaaaactttttttttcaaaagtcataatgaattactttattaataaacaaagtcttgt

SEQ ID NO: 8162 - DNA, 589 bp, Homo sapiens
gctgttgatggagaagggggcggatgacagccgggaccgtggtcatcaccgggggcatcttggcgactgtgattttgctctgcatcatcgctgttctgtgctactgccggctccagtactactgctgcaagaaggacgagtcggaggaggacgaggaggaaccagacttcgccgttcactcgcacctgcccccgctgcactccaaccgcaacctggtgctgaccaacgggccggcgctctaccccaccgcctccacctccttcagccagaagtccccgcaggcccgcgccctctgccgcagctgctcccactgcgagccccccaccttcttcctgcaggagccgccggaggaggaagaggacgtgctgaacggcggggagcgcgtgctctacaagagcgtgagccaggaggacgtggagctgccccggggggctttcgggggcctgcaggcgctcaaccccaaccgcctctcagccatgcgggaggccttcgccaggagccgcagcatcagcaccgacgtgtgacctgggcccgcccccgggatcctggccttgaaggtcctgagacaatggggggattcctttggcac

SEQ ID NO: 8163 - DNA, 1617 bp, Homo sapiens
caccctcaatgagactgtgaacagcatctttgcacagggcgccccaaggagctccctggccgagagcttcttcgtggattatgaggagaacgagggggctggcccttacctgctcaacgggtcctacctggagctgagcagcgacagggttgccaacagctcctccgaggccccattccccaacgttagcaccagcctgctcacctcggccgggaacaggactcacaaggccaggaccaggcccaaggcgcgcaagcaaggcgtgagtcccgcggacatgtaccggtggaagctctcgtcccacgagccctgcagtgccacctgcaccacaggggtcatgtctgcgtacgccatgtgtgtccgctatgatggcgtcgaggtggatgacagctactgtgacgccctgacccgtcccgagcctgtccacgagttctgcgctgggagggagtgccagcccaggtgggagacgagcagctggagcgagtgttcgcgcacctgcggagagggctaccagttccgcgtcgtgcgctgctggaagatgctctcgcccggcttcgacagctccgtgtacagcgacctgtgcgaggcagccgaggccgtgcggcccgaggaacgcaagacctgccggaaccccgcctgcgggccccagtgggagatgtcggagtggtccgagtgcactgccaagtgtggggagcgcagtgtggtgaccagggacatccgctgctcggaggatgagaagctgtgtgaccccaacaccaggcctgtaggggagaagaactgcacgggcccgccctgtgaccggcagtggaccgtctccgactggggaccgtgcagtggaagctgcgggcaaggccgcaccatcaggcacgtgtactgcaagaccagcgacggacgggtagtacctgagtcccagtgccagatggagaccaagcctctggccatccacccctgtggggacaaaaactgtcccgcccactggctggcccaggactgggagcggtgcaacaccacctgcgggcgcggggtcaagaagcggctggtgctctgcatggagctggccaacgggaagccgcagacgcgcagtggccccgagtgcgggctcgccaagaagcctcccgaggagagcacgtgtttcgagaggccctgcttcaagtggtacaccagcccctggtcagagtgcaccaagacctgcggggtgggcgtgaggatgcgagacgtcaagtgctaccaggggaccgacatcgtccgtggttgcgatccgttggtgaagcccgttggcagacaggcctgtgatctgcagccctgccccacggagcccccagatgacagctgccaggaccagccaggcaccaactgtgccctggccatcaaagtgaacctctgcgggcactggtactacagcaaggcgtgctgccgctcctgcaggcccccccactcctaggcccggcagctgcagccccttccagatgaagaccaagcgcccctcctggggctgctgcagcttctggggcctccacagacccccctcctgcggggcacgctggcctaagagacgtggcactgagcctcggctgtcgagaggggacttcccacggcccgtggacctttgtgctcctg

SEQ ID NO: 8164 - DNA, 727 bp, Homo sapiens
cagcggcggtcgtgtagctgagcaggcctggggcttggttctatgtccctgtggctatgtttccagtgtcctctgggtgtttccaagagcaacaagaaacgaataaatctctgccccgcagcgcctccaccccagagacccggaccaagttcacacaggacaatctgtgccacgcccagcgcgagcgcctggactcggccaacctgtgggtgcttgtggactgcatccttcgcgacacctccgaggacctgggactccagtgtgacgccgtgaacctggccttcgggcgccgctgtgaggaactggaggacgtgcggcacaagctgcagcaccacctgcacaagatgctgcgggaaatcacagatcaggaacacaacgtggtggcactgaaggaggccatcaaggacaaggaggaacctctgcacatagcccagacccggctgtacctgctctcacaccggcccaacatgcagctgtgccgcgaagcagcccagttcagcgctgtgggagaagcttctagaaggggagcagtccctttgcaacctcgaggacatccacatgagcctggagaaggatgttaccgccatgaccaacagtctcttcatcgaccgccagaagtgcatggcccatcgtacttgctacacccccatcctgcagctggctggctaccagtgagcagcggcacggtgcttccccccaatcccccaaataaacagtgcattagctt

SEQ ID NO: 8165 - DNA, 1599 bp, Homo sapiens
ccggaagtgcggatcccagcggcggtcgtgtagctgagcagccctggggcttggttctatgtccctgtggctatgtttccagtgtcctctgggtgtttccaagagcaacaagaaacgaataaatctctgccccgcagcgcctccaccccagagacccggaccaagttcacacaggacaatctgtgccacgcccagcgcgagcgcctggactcggccaacctgtgggtgctggtggactgcatccttcgcgacacctccgaggacctgggactccagtgtgacgccgtgaacctggccttcgggcgccgctgtgaggaactggaggacgcgcggcacaagctgcagcaccacctgcacaagatgctgcgggaaatcacagatcaggaacacaacgtggtggcactgaaggaggccatcaaggacaaggaggaacctctgcacatagcccagacccggctgtagctgctctcacaccggcccaacatgcagctgtgccgcgatgcagcccagttcaggtactgcctgggcctctgaggcagtcccaggtgcccccgtccacctcctcgctgcgaccctctccaataaacactccaatctccacacacacatcccccacaggtgctgagaggggagggagactctgcggccacacacaacatgcaagcacgccttaaacacacagatatagacatgacactgggcaggtcatgggtcgggggcctccccgtgccagggacctgtgcccacgtggtctcaccccaccctgtgctacctcatcttcccgggaggaagctccttcagacaaggtgagctcctggaggccacggggccagagaggccagagagggccattccctgctgccctgagggtgctgtccccacctctggtggaaagtatgacctacgcctgggctacaggcatagatgggccgtccttttgtttcccttgttaacggatgcctggtggccccttctgagcctaagtacctttcttccttccctgcccctcagttccttcaaggaactgggtgcctccttccgtcaaatatcaggaatggaaagaactgagcctggtcggctgaggccagtcctgtcctgtcagggtcgagattgcacgcgggtcactcattcccactcaggtccgcgctccctgggaggaccctcgtaatttatgctctgccctagagccgctttcctggtaggatcctttcatggcgtcttcccaggacctcctgccagctcccattgggagttttgggtcccctccaccccagtaggtgcatacttctgccctccccagccccagctcacaccccccaacacccccaagctggtgagtgaggtggaggagctgtacaagtccatcacagcgctgcgggagaagcttctacaagcggagcagtccctgcgcaacctcaaggacatccacatgagcctggagaaggacgtcaccgccatgaccaacagtgtcttcatcgaccgccagaagtgcatggcccatcgtacttgctaccccaccattctgcagctggctggctaccagtgagcagcggcacggtgcttccccccaatcccccaaataaacagtgcgttagcttt

SEQ ID NO: 8166 - DNA, 2365 bp, Homo sapiens
atttacagctggaagggcagacggaggcatcttggtgtatacacagccctgctgggccacatcccgggtctcctccctctgcgatgccatagcaggggcgccttccgaaagccctctggattgaggcagcaggatctatggtggaacctgccccggcgtcgccaacgcccctaggaccccagcacactgactggggagcatccctgtgtcgtttctgcccggagaggagcagaggccaggctgctgctctgggagatgagactttctggtgcacctgcacttccacatgagacttccgggtgcacctgcactcccagatgcagacttcctggtgcacctgcacttcctggtgcagacttcttggttcatctgcaacttcctggtgagaatcccttgggcatctgcacttcctgatgcacctgcacttctagttattttagagaaaacgttccctgaacatgccacatgcagaggatgctgggtatcaggctacctttgctggacagctccaggtaactgcatttgctctgccaatgttggctttttaaaaatagaaaacacatatagacaaatccatcacacacacatgcacagacacacacacacacacacagacaaatccatcacacacacatgcacagacacacacacacagagtcaacgacataggctcacaagtagagctcttcgtctgtttatacttaatgcaattactgatacatctaagtttggagctgctgttttcttttacgtatactgtttgtttgcagattctgtgtataaattctttcctttcttgccgccttttagatgatttcccccagcttaccttgaggactttcgagcaaacagacacgttgaaagaatagacaaggaccacttgcatgcccctcagttagattcaccaactgtcaatattttgcactgtatgtatacacgtacatgtctgtgtatacacatatacacatacagtcacacatcgcccgatggcagggatggttctgaggaaggcgctgttaggcgatttcgtcgctgtgcgagcatcatagtgtgaacttactcaaacctagatggcacagactcatcgcctcccacacgcctgggctgtatggcaggacctcctgctaccgggctacaaacccaggcagggtggtactgtactgaatggtgcaggtgattgtaacacaatggtaagtatttgtgcatgtaaacatacctaaacatagaaacagtgtagtaaaaatatggtataaaagatcaaatacagtacacctgtacaaggtctgctctgttctaatcttatggggccaccactgtatatgccgtctattcttgacagaagtgctttatgtggcacatgactgtacatggaaatacacacacactcacacacatccacacacaagcatatgcatacacacatatatacatgtatatacacgtgcatataacatatgtagatatctgccaattgctatccaacgtgaattccataaatttacactcctaccagcagcatttgggtatctgaggtgtcacacatccttgccagcactggatattatcccggcttggagattttgccagcctggtgggtgtgaagtggatcttgttgtggttttaatttccatttctctaattatgcagaggctgagtgccaggcttcctctcctgggaagagcctgccggcttgcgggctgtcagcgctcactgtgggtgcgggtggcgtgcctgcctgcacggcccttgcctctcttagtctacagggtctccactcctgagttcccggaaacaagatacagatttcagaatggcacctgaacattgtttactgatttccggctggaagtgagggtccgagggattcttctatggaattgtatgactcagcatctttctgattgcaagcagcagcatcgcagcctaaatgaatctattggctttgcttagggttggttccccttcattcttgagctggttgtgggcaactcctgccccctgtggggggactggactgccttagatcacatgtgtgtccctgactctctgtggtcaggggatagaatattcagattggaggggagccagcttctcctaaaccacgtggatctccaaacggaagtcagagcagatgggaagggggagcagacgttgagctcaatcaataaacacccaccttgggagctgcagcctggagggcttggtgactgccacgctggctgctcagagctcctcgcttacttttgggcatatgcctgtgaaccagatggtggcacctcctgaaaatcgggtctgtggataatgggaggattttttaaattatgaaaatgttcattatggaagaataaatgaagaatagcatatg

SEQ ID NO: 8167 - DNA, 2563 bp, Homo sapiens
ccgcccggcctctaccaccgaggaaaggggtaaccggcgcgggggttcccagcgccagcctgcgccaatccccagaaactccgtgaatcacctcgggatagcaaacggattatacaaaggcagtgtcttctggggtccttttcatgcctctaggaccaggacctgcattcaccctctccactgacacattggtctgggcccccggcccggctgtcaccatagaaacggcatctcgcggacaacgcggcggctcacgaaggttccattgttatgctaaacgggaaagtggagaccgcgccggcgttgcctagagaacgcctggactcagagtagcaaaatgggcctctccccaactcccctcctcatcccccagcacaaggcaaagggcaccccttgctgtgagtttgggggcaccggctgtcgggggccgacccagaactttgcggggtcccctgagggacccgtggcgggaccggccccgggttcgtcaaattccgccgatgctttcaggaggctgattaaacaaacgacaagattggagtgggaaatgagaggctcttaaaagtggaagctttttgtttgtccatttacaagaaattggacaatgaatcacttcaggaagatggaggtcatcaacctcaccaccctacctatgataccagtggatgagcacctggctgtctcgcttgtcgcacggaatacaatggtgaagactgtgaggaaggagttagagaacaatccaccctcatgccttattggctccatgcaccaggtgaaccaaaagattgctgacataaatctgcgtaccgagccgtcggccaacagcctggcaattgagagatttgagttggagaagaaggctttaagagagaaaactcgcagcagtccagaagacaaagtcaagagacaaaggaaatctcagtattcctgcaaaggctccgaactcagacatgccagatcttctgttataaaaaggaaaacagcagataaaaatctgctggcagagctgtaccagtattccaacttcaacagctccaagccaaacaagcttccgaatggcgtggacttctgtgacatggtgggcaacgtggtccgggctgagagagactgccttagtggcaagcatttctgttcaggtagagaattagagaagtttctctcttcttcttctccaagagccatctggctggatagcttttggtggatatttcatgagaggtaccagccaaacaaggagctccagaataatctgtttgaccggatagcccagcactatgccttacttttgtttcgtgtacccaagtcccactctgaagaggcgctcttaaaaaggctgccatcacttctcagcaaagccgtgtacaccagcttctgttgctgctttccacagtcctggttcgacacgcacgaattcaagtctgacatctgtaacacaatgagcctgtggatttcagtaggcacctatcctagcccacagagctatgacagctgggactactcggaactagacccagagcgattccgcagagaagaattaatgttgtacagaagaagactgacaaaggggagagagttttctttgtttgctggtaagagagccttctcccagaagccagcccagagcaggaaattctaccaccctcagtcttctagtgcaaattcacccagtgaaaaaacctcttcggccaagcagaactcagaaaaaagcttacgaatgcagaatactgcaaaagagcatcattgtcagaccctggtcttgaagaaacctacgcaagaagtcaagaggatatcagaagcaagagaatgtgagaatatgtttcctaaaaagtcgtgtgctgcctgcaaaagccctgagctgacttcaaacctcttcaacatttatgggaagagccctctgattgtgtactttctccagaactatgccagtctgcagcagcacggcaagaatgtgttgatagtcagaagggaaaagaccacgagcaccccagactgcaccccaacgtatactgatgtcatcagcgagaccctgtgcagcatgaagaagcggaaagacaacctcaatcagttgtaccagcatcattggactgaatggaattattttgacaagcatctaaaggagctgcaagacaacttctccagggaaatgaagaatattgatccaaaagcagcagatacaaaaaaggcaaaccacatgttcatcccaccttcagccgtcaatgaggaatcacctgacaagaaaactaagggaagtctccaaagagaaattgagtttaagggttgttcgaacaaaaaccatgggaaaggtagaagtgtgaacatgaggggaaaggaggagagggaaagagaagagaaacagaagttgaacatttctttccactcacttccaagccctgaggagctccacaacctagaaccaggaagcgcctacagaatccgtgatatttctgctacgaggaccccgcttagacgtccctcatcttgggagccttccctaatataccaggagcaagtgttgctgaaaacccatactctcagcatggaagaagataaattcagatgttaa

SEQ ID NO: 8168 - DNA, 1948 bp, Homo sapiens
agtgttctacggcagttacacacaggcagtggtatctgtgagcagctctgtggactcaaaggttttctccctgagaggcatgacccaggccagctgattcatcagagtcaggatggacgtggtagaggtcgcgggtagttggtgggcacaagagcgagaggacatcattatgaaatacgaaaagggacaccgagctgggctgccagaggacaaggggcctaagtcttttggaagctacaacaacaacgtcgatcatttggggattgtacatgagacggagctgcctcctctgactgcgcgggaggtgaagcaaattcggcgggagatcagccgaaagagcaagtgggtgaaaatgctgggagaatgggacacctacaaaaacagcagaaagctcatagatcgagcgtaccagggaattcccatgaacatccggggcccgatgtggtcagtcctcctgaacattgaggaaatcaagttgaaaaaccccggaagataccagatcatgaaggagaagggcaagaggtcatctgaacacatccagcagatggacctggacgtaagcgggacattaaggaggcatatattcttcagggatcgatacggaaccaagcagcgggaactactttacatcctcctggcgtatgaggagtataacccggaggtgggctactgcagggacctgagccacatcgccgccttgttcctcctttatcttcctgaggaggatgcattctgggcactggtgcagctgctggccagtgagaggcactccctgcagggatttcacagcccaaatggcgggaccgtccaggggctccaagaccaacaggagcatgtggtagccacgtcactacccaacaccatgtggcatcagagcgcctcacgaagacgtccaggtgtggcccgtgggcacgtttttggaaccggttcgttgatgcctgggccagggatgatgacactgtgctcaagcatcttagggcctctatgaagaaactaacaagaaagcagggggacctgccacccccagccaaacccgagcaagggtcgtcggcatccaggcctgtgccagcttcacgtggcgggaagaccctctgcaagggggacaggcaggcccctccaggcccaccagcccggttcccatggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtaggggacccttggttccgccgttatgatttcagacagagctgctgggtccgtgccatatcccaggaggaccagccggccacctgctggcaggctgaacaccctgcggagcgggtgagatcggctttcactgcactgagccacaacgtgggcatggacttcccggccctgcagtgcgcccagcactgattccgaccagggcacccccttcagagctagggacgaacagcagtgtgctcccacctcaggaccttgcctctgcggcctccacttggaaagttctcagttccctccaggcttctagaagcatctgggccagggctcatggctggataatttccctaggcttaacaacccaagcaagcttcgcctcctcgttttattttttgttaaacttatgagaatgtgttaagaaagagtgcagctcgagagacattcagagatggaacacaccagaccccagatcacaaagccaaccatgcccagcccctcccaacacccccagccccacgaccatcgttctgaattctgacgacgccgtgagcctgcctttgtactttaaactcatggaaggataaccaccttcacgttttgaaataaatgtttcctgttg

SEQ ID NO: 8169 - DNA, 1292 bp, Homo sapiens
actatattaccgccggtacacatccgcccgacactgaaacttttccttttgcatggtagccacgaccgcccacagtgaggcggctgtagcccgcttccgcccttacagacaccccaggacgcgaccgagacaggagggctgatgttccttttgaagaagagttcagaaaaaggatggtatcctgtgaaggaaagccgtgacagaggcccaaggagatggagccaaggcctgtcaaggaagaaaaggacttttcccaccaagagttggagaaagaagacaccaggactacttcttcctcttcccagtgggtggcagcacggatctctaagagctggccaggtgctccacctggatggtgctggtggtgacagtgaggcagatgtccttatgatgctccgccgtcttatacggggtcaggtcaaaggaacactggggtggagggttgggattgctgtccccaccacccccaccctggggggctgccccaggagactggaagtgtggtggtggctgttgctgctgctgctgctgctgctgctgctgctgctgctgctgctgtgatgcctgggccactgctgccgctgctgctgctgcctgcacctgttgctgaagatcaggcgggttgtgtttgcgcatatgtttcataagggccctctgctaagatgagccaaggacttgagggtgcagtgacacctgctcctcatcagcgacttcagaaccatctctatgaccaggtgcttttcgggacctctggtataaaatctcaaaaacatcacaggacgtgtctcttatttgtgaggaaagcctgactcctcctcttctcaaagcaagatgtctgatcactttaaggtgagatcatcacatccacaagaagccgggtgagacggtctatggcctgtaagtctggactccagttcaacttgagatagcaccaaagatcatcacttctagttggcaggttcccttcttcctagtcactccagattcacgggataaacactgggcatctttatgaagcataagcgttttcattttctgtttgctgattctctctgaacatttagtacgtgttttcttttgttctctactcctggcatccctcagagccttgcttgttgctgtgggtgtcaccaggctggtgcccagctaatgtctgattttatttcctgttcataattggtgccctaagggctagaggtatggtcttctccactcaaatgcctctgttttggcatcaaggggcaaatcttccaagatgggtacatgagtattttcagggaggaaaattagag

SEQ ID NO: 8170 - DNA, 1870 bp, Homo sapiens
aacgtcttcccacctttttctcccctctccgtcttctcccctccttcttccccactgcggtcttcccgcatcctcttctgccgtctccctactgtcttcttcccgcaccttcttctcccccgcagtttttttttccccttccccaccgttttcttcccctcagtctctcccattcctcgcagcacgggttcctgtggcggcagcttttccttccatctccttctctccacccgctggcttccagtctccaccttcccgcctattcccccagcagcgtcttcccgccgctccctcttctcccctccccctcctcaccgtcttctcccggcctattaccgccaaccgttttcttcctcatcccgcacccttttcttcccatgtctgccttagtcttcttcccaccctcttctcctctccccatcgccttcttcccaccctcttctcctctccccatcgccttcttcccaccctcttctcctctcccaatcgtcttctttcccagcctcttctccattttcttgccgcctccatatccccaccttcttctcgcagcagcgtcttcctgccgcgcttttctctcccctcaccatcttctcttcctcttccccaccgtcctctccccacgccctcttctctcactgtcttctccccgcgccttccccacaaccgttttctcccccgttttcttcccctcacaccgttttcttcccatgtcctcccaccgtctcgcagcagcgtctgtcagtcgcaatcttcttcccactttcttctctccccctcccatcgtcttttttccccagcctcttattctccgccatcttcttcccctccccaccttctcgcagcagcgacttcctgccgcgtttttctctccccgcaccctcttctcccctcttccactccccaccgtcttcgcccccgatcgtcttcttgcccacccccttctcgcgctctccaactgcctttcacctagaagcgctccacgcgtgcgcccgcctgtgtccctgcgcctggtgtgtctgtgcgcccagccagccccatgagctgggcccctgagctccgccccaacagccaacaggagacccaggagagtcgctgccagggccatcacggctgccgccgcccccgcccccgccgctacctcagaactgaacagtgttggctgcgggcgaaaggcagtggggcccggaagactgcggggagagggggaggaggggacggagagggtgggaaagaccttggaaagtgggatggggagaaaggtggggaagaagacagtggggagaaagtgcagggagaagacagtgtggtagagaagacagtggaggaaaacggtgaggagaaaggagggtggaaaagaagacgatgaggacaaggccgggcgcggtggctcacgcctgtaatcccagcactttgggaggctgatgcgggcggatcacaaggtcaggagttcgagacctgcctgaccaacatgctgaaacccagtctctactaaaaatacaaaaattagctgggcgtgatggcgagcgcctgtaatccagctactccagcgcctgaggcaggagaatcgcttgaaccccggaggcggaggttgcagtgagctgagaactcaccattgcactccagcctggatgacagagaaggtcatgggaacatacagagacctacagggaagacggccatgggacaagggaggcagagtctggagttacgctgcctacagtcacggaatgccaaggacagctggaaaccaccagaagctaagaaggagattttacctgaaagcctctcaaagaaatcaatcatactcacacctcctttttgaatttctggcctcgtgaatggtgaaaaaataaatttctgtcgtctt

SEQ ID NO: 8171 - DNA, 1747 bp, Homo sapiens
tccctggccccacctcttctgccacaaacgtcagcatggtggtatcagccggccctttgtccagcgagaaggcagagatgaacattctagaaatcaatgagaaattgcacccccagctggcagagaagaaacagcagttcagaaacctcaaagagagatgttttgtaactcaactggccggcttcctggccaaccagcagaagaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttgcgggaagggagagatgcctcccgctcattgaatgagcatctccaggccctccttactccggatgagccggacaagtcccaggggcaggacctccaagaacagctggctgaggggtgtagactggcacagcaccttgtccaaaagctcagcccagaaaatgacaacgatgacgatgaagatgttcaagttgagttggctgagaaagtgcagaaatcgtctgcccccagggagatgcagaaggctgaagaaaaggaagtccctgaggactcacaggaggaatgtgccatcacttattcaaatagccatggcccttatgactccaaccagccacataggaaaaccaaaatcacatttgaggaagacaaagtcgactcaactctgattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggagaaattgaaaagaaggggaaggggaagaaaagaaggggaagaagatcaaa

SEQ ID NO: 8172 - DNA, 1057 bp, Homo sapiens
actctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaagttcgagctaaaatctgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaacgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagcggagcatcgtcattcttcaggattgccctactggccctacctcacagctgaaactttaaaaaacaggatgggccaccagccacctcctccaactcaacaacattctataattgataactccctgagcctcaagacacctcccgagtgtctgctctatccccttccaccctcagcggatgataatctcaagacacctcccgagtgtctgctcactccccttccaccctcagctctaccctcagcggatgataatctcaagacacctgcggagtgtctgctctatccccttccaccctcagcggatgataatctcaagacacctcccgagtgtctgctcactccccttccaccctcagctccaccctcagtggatgataatctcaagacacctcccgagtgtgtctgctcactccccttccaccctcagcggatgataatctcaagaaactaaggaagaataaataaataat

SEQ ID NO: 8173 - DNA, 1882 bp, Homo sapiens
atccctccgcgccccgctccacacctacgggcccgcgaatctctcgtccccaccctgcacaggaattgggtttgccgccgggcgcgcgcgcgctcgctcccgtcgccggactactttccctcgccgcgcgccccgcctcccgggcccacttcactttcttcggcggaggggcacagctcggcggtgcgtgacgcgtccctctgtgagccgcgtcactattgggcctggcccatggcggaaatgagagcttggcgcccattggtccgaccttccctgcaatgcgtcaaactggggcgagccactgcaaggtggtggtgggtggtcaaggtgaagccccacgacaaggatgccaaaatgaaataccaggagtgcaacaagatcgtgaagcagaaggcctttgagcgggccatcgcaggcgacgagcacaagcgctccgtggtggactcgctggacatcgagagcatgaccatcgagggtgagtacagcggacccaagcttgaggacgacaaagtgacaatcaccttcatgaaggggctcatgcagtggtacaaggaccagaagaaactgcaccagaaatgcgcctaccagggtcttgctctatcacccaggctgaagtgcagtggtacgatcacagctcactgcagcctcaacctcctgggcccacgtgatcctcccacctcagcatcccaagtagctgtgaccgaaggcatgcaccaccacacctggctaatttttttatttttatagagatgggtctccctatgttgcgcaggctgatttcaaactcttggcctcaagcaatcctcccaccttggcctggggattacaggcgtgagccaccatgcccagcctccgtgtctttacatttgagaacaatttgtaggttagctttgtctttgtttttttagagatgggggtcttgctgtgtagcccaggctggactcaaactacagggctcaaggcattcttcatctcagcctcttgagtaggtttgactacagtcatgtgccactgtgcccaactacctttgtccgggttcctaggaattctccagaaggcagaatgagtacaaagaaaacacaggcaagtttctgttaaagagttacctgtggccacagttcctctggaagtttaacatagagttaccatatactatgctatcgccatccccaaattcatatgttgaagtcttaactcccagcacctctgaatgtgactgtatttggagatgggggtctttaaagaggtaattaaggtaaaatgaggccgggtgctttggtggctcacagctgtaatcccagcactttgggaagctgaggcgggcagatacctgaggtcaggagttcgagaccagcctgcccaacatggtgaaaccctatctctactaaaaatacaaaatttgcctggcgtggcggcatatgcctgtgatcccagctccttgggaggctgaggcaggagaactgtttgaactagggaggaggaggttgcagtgagccgagatcatgccattgcactccagcctgggcaacaagagcgaaactttggttcaaaaacaaacaaaaaaaaagtaaaatgaggtcccatgtgtgggcccttaatccaacctgactggtgtctttatgagaaaaggggaccaggacacagccccatgcagagggaagaccatgtgaggatacagggagaagacggccgtctgcacagccaaggagagaggcctcaggagacaccaacctatccaacaccttgattttggacttctggcctccagaattgtgaaaaagttaatttctgtcattgaagccacccattctgtgatagtttgttacagcagtcctcagcgcgtagaatacgatgccatttgtatggcagacagtctcattgt

SEQ ID NO: 8174 - DNA, 827 bp, Homo sapiens
ttaattacatgtaattgtttatttaaaataattttccaagtcttccaatgatttaacaggctttgcttcacttttatcatctcaaacagctataaatcaacacactttttgtattttattttactactatgtatgctattttaataacatttttctttattaatactagaaccaaatatattgaccaataagcagtatagatttaaattatcttcttgggttggtctgaggttgctgatggattcttgggattgatctgatgctagaagctatcttaggccctgtctctaactcactgtatgtttcaggcaaaacatgccacggttctaggtctgttttctcatctgcaaaataaacacccaaattagatgatacttactgttttaactagctataaaattccaatactatattccccatcattttcacttacttttacttaatctttatttgctacttttccacctataaagcgtaattttccatatcaagtaaacataaattcattaaaaaataaacacaaacccaaaatattcttattctaatatatctgcattaatagataaaaaggctttagctttaattttcatttttcatttctacctcttaaagtcaatgataaactcacaagtgtaaaatgaatgcatttaaaaacataaaagatacatttcaatgacaagaaatatgcaatgatcatgaaaatctactgtacactttgccatggtcaaagaatgaaggacaatatggaaaagccaatcttcaaatatatccttaacaaaaactctctcctgcatagtaaaagcatcatctaaacagcagctccaacc

SEQ ID NO: 8175 - DNA, 934 bp, Homo sapiens
aatggggtctcactctgtcgtccaggctgcagtggagtgatgtgatcacagctcactacagcctcaaattcctgggctcaagcaatcctcctgtctcaacctcctgaatagctgagactacaggtgttcacagccatgcccagctaatttttattttttgtagagacgggtctcactacgttgcccagattggtcctgaactcctgggctcaagcaatcctcccgccttggccttccaaagtgctgggattataggcatgagctaccacacccagcctgctatggtttggataaggtttgccccattgaaactcatgctcgaacaatcgattggctaacgaggtcgatgacgccaggcacaagatgctgggcctaccgcggtagcgtgagggaagccgtgcgttctgttccaaggcatctgtgagcccatggagtatacaccatgagcaaagctcaccctcctgagttgaaaaaatttacggacaagaagttttcattgaaattaaatggtggcagacatgtccaaggaatattgcggggatttgatccctttatgaaccttgtgatagatgaatgtgtggagatggcgactagtggacaacagaaaaatattggaatggtggaaatacgaggaaatagtatcatcatgttagaagccttggaatgagtataaataatggctgttcagcagagaaacccatgtcctctctccatagggcctgttttactatgatgtaaaaattaggtcatgtacattttcatattagactttttgttaaataaacttttgtaatagtcaaaaatgttttttcagatgttctgaatatacaatattagctctcattccaattttttctaacatgaattttcctggttgacattgatttcaaagggttttatgtattaaagtgacagaatcttattaaatgtgaaa

SEQ ID NO: 8176 - DNA, 3547 bp, Homo sapiens
gctcagacgtgcagcttctggaatacgaggcgtcagctgctggcctcatccgatccttctctgagcgtttcccagaggatggacccgagttggaggagatcctcacacagctggccacagccgatgcccgattctggaagggccccagtgaggccccatctggccaagcttgaggaagatgtgtggccttgcccccaattccatcagaccaaggctgcaagtggccctccattcgtcaatgaggccaattcgaagtggttggatgcgcactacgacccaatggccaatatccacaccttttctgcctgcctagcgctggcagatttacatggggatggggaatacaagctggtggtaggggaccttggccctggtgggcagcagccccgcctgaaggtgctcaaaggaccactggtgatgaccgaaagcccgctacctgctctgccagctgctgctgccaccttcctcatggagcaacatgagccccggaccccagctctggcacttgcttcaggcccttgtgtctatgtgtataagaatctcagaccctacttcaagttcagcctgccccaattgcctccaaatcctctggaacaagacctttggaaccaggccaaagaggaccgaatcgaccccttaaccctgaaggagatgctggagagcatccgggagacggcagaggagcctttgtccatccagtcactcaggtttctgcagctggagctaagtgaaatggaggcatttgtaaaccaacacaagtccaactccatcaagcggcagacagtcatcaccaccatgaccaccttgaagaagaacctggctgacgaggatgctgtgtcttgcctggtgctgggcaccgagaacaaggagctcctggtgcttgaccccgaggccttcaccattttagccaagatgagccttcccagcgtccccgtcttcctagaggtttctggccagtttgatgttgagttccggcttgccgcggcctgccgcaatggaaacatctatattctgagaagagactccaagcaccccaagtactgcatcgagctgagcgcccagcctgtgggacttatccgggtacacaaggtcctagtggtgggcagcacccaagacagcctgcatggcttcacccacaaggggaagaagctgtggacagtgcagatgcccgcagccatcctgaccatgaacctcctggagcagcattcccggggcctgcaggccgtcatggctgggctggccaatggagaggtccgcatttatcgtgacaaggccctgctcaatgtcatccacaccccggatgcagtgaccagcctttgctttggccggtacgggcgggaggacaacaccctcatcatgaccactcgaggtggtggcctgatcatcaagatcctgaagcgtacagcagtgtttgtagagggaggaagtgaggtgggtcccccaccagcccaggccatgaaactcaatgtgccccgaaagacccggctttacgtggatcagacactgcgagagcgggaggctggcaccgccatgcaccgggccttccagacagacctatacctgctgcgcctacgtgctgcccgcgcctacctgcaggccctcgagtccagcctgagccccctgtccacgacagcccgagagccactcaagctgcacgccgtggttcagggccttggccccacctttaagctcacacttcacctgcagaacacctcaacaacccgtcctgtcctggggctgctggtctgcttcctgtacaacgaggcgctctattccctgccccgggccttcttcaaggtacccttgctggtgccagggctcaactaccccctggagacctttgtggagagtctcagtaacaagggcatctcagacatcatcaaggtgctggtgcttcgagaaggccaaagtgcacccctgctgagtgcccacgtcaacatgcctgggagcgaggggctggcggccgcctgagacctgagctgctgtgaaagcccctgcacaatcagccagggagaactgggcgggtttagtggccccaggcccactcctcatgcagcagtgtgctggggcgacagctcgtctcccctctcttaagcacccgcttcctcaccacccccactgttgggcctatagtagcaggttagtgagtacctagggcggctcaactcctcccacagcaccaacccagcatggtcccactgaagtcctactacgccctcccctccccagccttttccagaaaccatactgggctcagatcagagctccgaagcggtcaaagtgagctgagcaggacaggcccagcctttctccactgccacgtccctcatgcacatcactcatctcctgctgcaggccaaggccaaaattgggctagtcctggccagggaaatcagaagctcttcttgggtgagattgagcctcctgttgctccctggagttccggaggctgggctgcagcccactcagcttgcgggcaaaatacgtgctctcctctctccttgtcagctgagcaaacccagggaatagccctcctctccccaggaaacttctctgaaatcttagacttagccagtcttaggcctacgatgccacacaaaggttgttcagggagaagggggtgcaggaggcagagggtgccccgcagggagctggtggctccagccccactagagctcctaaagatcacacagcagctgctcctgacagggatgctcatgcccagaaagcaagcccaggagaggaaggcagagtgtgacagagcagagccagggccaggcgcaccaggagaggcgtttctggggctccagagaagtgccacgggaggcagaagtccagaactgcccatatagatgcccttctacatcctggagcccaaatcagtcatgtgggtgggaagttcccagggcagtggtcacatcgtgagaattagcaggaaaggcggggcctttcttgtcatagctatttctgaggatgaaatgggagacatatgcccagcacctgatgtaagtttatataatgtaatattatgtacctaccactaagaaatacatgaaccgtgccatgaggacagtaagtgttcataaagcaacatgaagcaagaaacagtgcagggtgcccagtgcacacactagagagaaattgtgaacattaaggacaaggagaattggtgtctttctaaaacatacttatttaaaaacacatacccacttactaatgtggaattacacagtttgtaacaagaaaacagtctctcccattctctagtactgctcccctacccagcagtcacttccagttcattcagctatttttaaaatgtgcttatatgactcttgcttgatatatcaatcttagacattacctgttgactccctgttgtcatacatgaggctttagctctcttttgtcagcaaccctcccccatccctagttattaggttaaaaaatactcagattactatttctattactatgtgaaagttaactgcggagccaagagttggactataattaaattaccttccttgtactttctttttaatgg

SEQ ID NO: 8177 - DNA, 1730 bp, Homo sapiens
tctgaaatatggcattgccctcctcatcttacaggtggaaaaactgaagcttgagagaataagcaacctaaacagtatcacacagctaatgaggagtcaaatgcaggcctgcctgtccccaaagtccagattcttcctttcctagaatgtcagggctagggaagtgctgagaccctctggtctacccccaccccctaattttatgaaagacaaggataaagtcccagggaaacaatgtgttcaaggctacccagtgacgcatgaccccatacaggctctataaggatgttacactcggtcatctctacatgcctggtacctagcacaggatcctggtacattggaggtgcttgagtaactgtgaatacaggaacatagtcatttaatagcaaagctagagccctgtcccccaaggccagcttactgcctcccctccccctcacgcctggcatcccacctggatgtatgcatggttggtcggatgaaactcctccccaacaggattaggacactcgccctcacagcgataggcgttgtactgcttggggtagatgatccaggagccccatccgatcaggttgaagtccacctggaacttgaccttccgacacagttgacttctgtctggcaagtgatgtcgacggtgcctcttgccccactcccaggacagctgtccctcctgggcccgccaggagctctcggcttcccacagcaaggtggacccacccagctgcctctgctcctgcgagaggttggagtagagcataaggagcacattggtggcaggcggtgtggggggccgcggccagcactctccagctaccctggacatctgcttctccagggccccagggtgcttcagccacttggagagaggcctggtcacctccaaaaccatgctgcccaaggaaaaggtgacctgggacaaagtgacagtgaataggtccatctgaaaccgctctaagcagctgtctgaagcctgctctgtgtcgggctttggctggtggaaaatctcaatggcaagtgagccctcagtggggaggtccacagggctggacagctgcagccggagctcagcccatgccagatcctcttgttggctcaggaaggagaagtcaaaagcaaacgtccagttctgcccatccactgccacatctgggtaggagaaaaccaagaaggaaggagggtgagtgagggcctcccccagcctcagtcagtgtcacaaccaccatagctcttgctggaggccttaccttatatagaattaccttcgaattctcaccccaactctatgagttggtaagattttcgagtcccttttagagatgaggaaaactgaggctcagtgtggttaaaagatctgaccaaggtgtcattcttggaaggtggcagagccaagagtaaacctggatttgcccaactgccaagcccagactccgaattactgttcttccagtcccccttccaagataacttgcacagccagaggacagtcagtaaaaatgtgatgagttgcatctccccctcccctgtctcctcccatacatgaagtctgaccaacatggagaaaccctgtctctactaaaaatacaaaattagctgggcgtggtggtttgcgcctgtaatcccagccactcgagaatcatttgaacccgggaggcagaggttgcagtgagccaagacagtgccattgcactccagcctgcacaacaagagtgaaactctgtctc

SEQ ID NO: 8178 - DNA, 735 bp, Homo sapiens
aaagaaggggaagaagatcaaaacccaccatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagaagttattcaactccttcaggttgtcttgaactgactgactcatgccagccctacagaagtgccttttacgtattggagcaacagcgtgttggcttggctgttgacatggatggtgagtacctttctatg

SEQ ID NO: 8179 - DNA, 408 bp, Homo sapiens
agatgttcaagttgaggtggctgagaaagtgcagaaatcgtcttcccccagggagatgcagaaggctgaagaaaaggaagtccctgaggactcactggaggagtgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaaggttggcctcatacca

SEQ ID NO: 8180 - DNA, 927 bp, Homo sapiens
atgcacacacaggtctgtgcacacacatacatacgcatgcacaggcacctgtgtacacacatgcagatacacccacagcatcccatctgtgccacacacagacataggtacatggagacagatgcacacacaggtctgtgcacacacatacgcatgcacaggcacctatgtacacacatgcagatacacccacagcatcccatctgtgccacacacagacataggtacatgaagacagatgcacacacaggtctatgcacacacgtatgcatgcacaggcacctgtgtacacacatgcagatgcacccacagtatcccatctgtgccacacacagacatacgtacatggagacagatgcacatacaggtctatgcacacatgtacacatgcacaggcacctgtgtacacacatgcagatgcacccgcagtatcccatctgtgccatacacagacatacgtacatggagacagatgcacatacaggtctatgcacacatgtacacatgcacaggcacctgtgcacacatatgcagatgcacccgcagtatcccatctgtgccacacacagacatacgtacatggagacagatgtacacacaggtctatgcacacatgtacacatgcacaggcacctgtgtacacacatgcagatgcacccgcagtatcccatctgtgccacacacagacatacgtacatggagacagatgcacacacaggtctatgcacacatgtacacatgcacaggcacctgtgcacacatatgcagatgcacccgcagtatcgcatctgtgccacacagacatacgtacatggagacagatgtacatacaggtctatgcacacatgtacacatgcacaggcacctgggcacaccctatacctccttatctgctcttcccctccctgccgccttctgggcaggtag

SEQ ID NO: 8181 - DNA, 2223 bp, Homo sapiens
gttgtccaaagtcattccggctccaaagggcgaattctcttttcgccatctctcccagccctggaacagcttagggtccctctcgaagagcacagcgccagcccagaccccatacacccaccgtccctggcacccgaacgcgctgcgagccccgggcctcccacaggagcggagacgcgggtccctgcgcctcacgccggaacggacccgtcagagccgccgagccccgcacctggaagctgggaggccgcgaggacggagaatcgaggcggagacccagcccagcgcccgcgcagctcggtgccctcccgccagtgcccgcactcgggtcacaccgcttgctctcgggagaagccccaaggctcgcggtgcaccgagaggcgcccgggctggagcgccccggccgtgttggccacggagttcttcagctgcttgatgaccacgaagagcaggaggaaaagtaagaagagcaggaagaagaagagcgccaggtagagcagcaagttgagttcccactccatgctggaggcgccggcgctcgctggccctgcgcgctcggcgcgggctgcagctggagggcgagcgcgccgcccgcacacccacctcccgcactcccgcccctcgcgagggcgtcccgctatgggcgccgactccggggtccgtgctttgcctcccccggctccgaggaaacgcgccaaggagctgaggaaatccggcgcagactctcccagctggcaccaaagccttccgcttcgccgagatcctctcaggtgctcttgaggacgcgagcgacttccctaggagcgaacttccgcgggcacggacgccagaagaggtaacagctcagtcttccaggggaggtcgggactggtgttttgtaaatgatttaaaagttccacccccaacatccagtagggtccctagctccgctgcgttcccaattaatttatttcgttatatccctccgttcctgctttccgaaaggacaggggatgtcatggcccagagacccaaaagaatgaaaggtggcagtgaagatggggtctgaaaggctatgagatgatttcgtgctatgaggtgtctgagtgaattccagttcgagctgtcttgctcttcagagtagcagatacattcagtgttgagtgtacttttctatggacaacaggtcacttggaaacgcattaagaatacaatgtatttcagaagttatatagcacaaagatttcaaatattggcctcaaattcagtttatttggtgaaaagaggaaaacaagtttactcaaagtgtttcttgagtccctaaagcctttctgtatctggttgacgtgacccaaagcccatatcgcgcagctttaaaagctgttcagtgtatctattactgcagaacaaattacccccaaatttagtggcttcaaacagcataaacattgatcatctctcacagtttctgtgggtccgaaatgtgggagcactggctgggtgattctggtgtcgggttactcatgaggctccgttcagatgtcagccaggtctgccttcagctgaatgcttgtgtagaggtggaggatccacttccagggtggctcactcactgcttgccaggtagggctggttgttggtgggaggcctcagttcccttccatgggtgcttccaatacagctgcgggattcccccagaacaagtgatgaaagaaaacaaagcagaggctgcagtgctctttaccgccagcttcagaagtcacgtgccatcagatctgtaatatcctactggtcacacaggtcagccctattcagggtaggagtccaaggacacgaacgccaaggagtaaggatcactggggctcatcttagagtcggctatgacagctgttaatacagccagctatcattgcccatttgtaggcctaactttattttattctttatttgtgaagatgcagaattgcctcctggactgaattctggggatgagggctgacaacatcccagattgtaataagtggctgctccagggatgacaggggttcaaagagacagggtggtatgaaaacagtctgtgaactgcaagtctcatggacccgattctagtgtcagctctgtcagtggtcacttttgctcagtgactctcagtcccctcatctgtaacatgccttgcttatctttcccttggatttgttgtgaggctcaaaaatgagaaaatgttaaataaaaatgtgttttgct

SEQ ID NO: 8182 - DNA, 1259 bp, Homo sapiens
cccggcggcctttgcgggaacaagatggcagccctcatacctcaagggttctcttgtttatcgagggttttgggctggtggtctcggcagccagttctggtgactcagtccgcagctatagttccagtaagaactaaaaaacgtttcacatctcctatttatcaacctaaatttaaaacagaaaaggagtttatgcaacatgcccggaaagcaggattggttattcctccagaaaaatcggaccgttccatacatctggcctgtacagctggtatatttgatgcctatgttcctcctgagggtgatgcacgcatatcatctctttcaaaggagagatgatagagagaactgatagagagaactgaacgaatgaagaagactatggcatcacaagtgtcaatccggaggataaaagactatgatgccaactttaaaataaaggacttccctgaaaaagctaaggatatctttattgaagctcacctttgtctaaataagttgggcccatgagatgtgtgctctgtatattccggaggtacaatttgccagtgtttccacaatggaaccaattgttttacagtctgttccacatgatcattgtaataagggttagaataggctcagtggctcatgcctatagtcctagcactttgggacgcccaggcaggagtatcacttgagcccagaagtttgaatccagtctggacaacaagcaagaccctgtctctacaaaaaagaataaatttagccaggtgtggggaggcacatgtgtctgtagtcccaactactcaagaggctgcggtgggagggtcccttgagcccagaggtcaaggctgcagtgaaccgtgactgtgccctgcacccccacctgggcaacagagcaagaccctgtctcagaaaagaacagcaagcaaagaaacacaaaacaaaaaagaaagaaagttaatggaccgggtgtggtggttcacacctataatttcagtactttgggaggttgaagtgagaggattgcttgagcccaggagtaccagaccagcctgggcaacattctgagaacccacctctgcaaaaaagaaaaacaattagccgggcatggtggtgctcgcctgtagtccctcccaactactcgagaggctgaggtgggaggatctcttgagcctgggaggtcaaggctgcagtgagctatgattgtgtgactgtactccagcccaggtaacagagtgaaaccctgtttcaaaaaaataaaaaaagttaataag

SEQ ID NO: 8183 - DNA, 2256 bp, Homo sapiens
aatatctcgtcatggactgtgccccgctcgagcctctccacatgcagccggaaggaaagtggagggagctgctcctttccgtagccggggtgcccaccccaaccaggctgcctctgccacccaagacagaggttctctgataataatttgtggggcttgtttccagagaccacacctgaagctgccaactccccggagggaaggtcctgattaatggccgatgaatttctccttaaggccctgaaactgcctactcagaaccaagccagtttttcctgcctgtcctgtttgggcaggcagaggaggcagctagaaacccattatgcaggggatggggaccaaaccaatgcacaactcctacgtactgatggtggtcttacgtttccctaagtttctgccgactaaactgtgcacacgttctcaggacctcctgaagctgcgtcacaggcgctgatcaaagaacacaaccaagagtttggccttttcttcagcactgggaattgtgatccaaagcttttcctgatgaggtacaaagttggagaaacaaaacgcaaactaagcaacaatgaaacagaacagagtgaatctgctgtagctcaagagaggacgtagctgcccccaccccgcatccctgggctcgggtttgccttgctgacctctgctgccacctggtgccgcacagagaaactgaggagaaaccacatcagtctccttcagcctcagcttcacatctgtgggtcaagcaaccctttcagaagctgtataatgtgggaaagctttcctctcaggaaaatgcacacatccaactttgagaagatgcccttgggggtgcttcaaggatcctagataataaccccctttcccgaacatccaagaacctaagtttttttttttttttttgagaaagtctcgctctctctcccattctggagtgcagtggcgtgatcttggctcactgcaagctccacctcccaggttcaagccattctcctgcctcagcctcccaagtagctggggctacaggcacctgccaccacacccggctaatttttttgtatttttagtagagacggggtttcaccgtgttagccagaatcgtcttgatctcctgaccttgtgatccacccgcctcggcctcccaaagtgctgggattacaggtgtgagccaccacacctggtccaagaacccaacttttagatctagagtgatgtcagcatgacattgatttcctgaggcccaggggtgaaggagctgaggacagcagaggggtgaaggaagtcagctacagacagcagcagctgatgcacaggcctcccagcgcctgaagtcacccggaattgggaagtgctcagaagcttacaaagctgcctcgagatggcaccaaaagcgaaggaagctcctgctcctcctaaagccgaagccaaagcgaaggctttaaaggccaagaaggcagtgttgaaaggtgtccgcagccacacgcaaaaaagaagatccgcatgtcactcaccttcaggcggcccaagacactgcgactccggaggcagcccagatatcctcggaagagtacccccacgagaaacaagcttggccactatgctatcatcaagtttccgctggccactgagtcggccgtgaagaagatagaagaaaacaacacgcttgtgttcactgtggatgttaaagccaacaagcaccagatcagacaggctgtgaagaaggtctatgacagtgatgtggccaaggtcaccaccctgatttgtcctgataaagagaagaaggcatatgttcgacttgctcctgattatgatgctttcgatgttgtaacaaaattgggatcacctaaactgagtccagctggctaactctaaatatatgtgtatcttttcagcataaaaaaataatgtttttcataagaatgacaacttaattagaatcaaatctataagctttaagattttatgtttctagtaagtataatattagcttatttgactagaactcaagcagaataggaatttatgcttgttttatattcaataataattttgaagatacagttgttttattacaccaaaaatactatattaatcttatttaactaagttttatccaaatcatgttaacttaagaaacatttgatcagttcctatatttctaggagtttggtgaatatttatttataaatgcttatttttttccaagccaagttagaatagagcacttttagaggatttcataaatgaattttgcaatgc

SEQ ID NO: 8184 - DNA, 1640 bp, Homo sapiens
agttgcacagctgcctggtaggtgactggaggcattgagcagtgctcactggtatttcgctgatgtggccccaaccccgcctccctccccaccccgcgatgtcagaaaaaacacaacaggggaaattggccgcagccaagaaaaagttaaaagcatattggcagaggaagagccctggcattccagcaggagctaacaggaaaaagaaagtcaatggcagtagccctgacacagccacttctggtggttaccactcacctggggattcagcaacaggtatctacggggagggccgtgcatcctctactaccctgcaggatctggagagccagtaccaagaactagcagtggccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggctgaacccctggccccagagcccccagcagggccatctaaggtggagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacatgaacaggaggagaggctacatgaacaggaggagaggctgtgtgaacaggaggagaggctacgtgaacaggaggagaggctacgtgaacaggaggagaggctacgtgaacaggaggagaggctacatgaacaggaggagaggctacatgaacaggaggagaggctgtgtgaacaggaggagaggctacgtgaacaggaggagaggctgtgtgaacaggaggagaggctacgtgaacaggaggagaggctgtgtgaacaggaggagaggctacgtgaacaggaggagaggctgtgtgaacaggaggagaggctatgtgaacaggaggagaggctgtgtgaacaggagaagctgccagggcaggagaggctgctggaagaggtggagaagctgttagaacaggagaggcggcaggaggagcaggagaggctgctggagagggagaggctgctggacgaggtggaggagctcctggagcaggagaggcttcggcaacaggatgagaggctgtggcagcaggagactctgcgggagctggagaggctgcgggagctggagaggctgcgggagctggagaggatgctggagctggggtgggaagccctgtacgagcagcgggccgagccacgcagcggcttcgaggagctgaacaacgagaacaagagcacactgcagttggagcagcaagtaaaggagctggagaagtcgggtggagctgaagagccaagaggctccgagtctgcagcagcagccagaccagtacctggagccccagtcccacaaggagcttggatgtgcggacaagcagggtggactccccaggagcacccaggcttgagtggagaagctgttggtacaggagaggcggcaggaggagcagaagaggctgcatgccattcttttcgggctgcggagaacagggagctaaacatcaccatcatctaagagcgggtc

SEQ ID NO: 8185 - DNA, 1032 bp, Homo sapiens
ttctccccagtccctggccccacctcttctgccacaaacgtcagcatggtggtatcagccggccctttgtccagcgagaaggcagagatgaacattctagaaatcaatgagaaattgcgcccccagctggcagagaagaaacagcagttcagaagcctcaaagagaaatgttttgtaactcaactggccggcttcctggccaagcagcagaacaaatacaaatatgaagagtgcaaagacctcataaaatctatgctgaggaatgagctacagttcaaggaggagaagcttgcagagcagctgaagcaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgatgaagatgaggatgaagatgttcaagttgaggaggatgagaaagtgctggaatcatcttcccccagggagatgcagaaggctgaagaaagcaaagtccctgaggactcactggaggaatgtgccatcacttgttcaaatagccacggcccttgtgactccaaccagcctcacaagaacatcaaaatcacatttgaggaagacaaagtcaactcatctctggttgtagacagagaatcctctcatgatgaatgtcaggatgctctaaacattctcccagtccctggccccacctcttctgccacaaacgtcagcatggtggtatcagccggccctttgtccagcgagaaggcagagatgaacattctagaaatcaatgagaaattgcgcccccagctggcagagaagaaacagcagttcagaagcctcaaagagaaatgttttgtaactcaagtggcctgcttcctggccaagcagcagaacaaatac

SEQ ID NO: 8186 - DNA, 303 bp, Homo sapiens
atggccaagaacaaatttagagggcagaagtccaggaacgtatttcgcatagctagccaaaaaagctttaaggctaaaaacagagtaaaaccaattaccgctaatcttaagaagatacacattatgaatgatgaaaaagtcagcagagtaaacaaagcttttggaagtgtacaagaggaacttccacatttctcaaaaggcctttctcttgatcttctgcagaaagagctgattcctcagcagcgtcatcagagcaaaccagttaatgttgatgaagctacaaaactaatggctcagctgtaa

SEQ ID NO: 8187 - DNA, 1748 bp, Homo sapiens
atatgctgaagagcagaatcagcatgaggagcagacaccccaggagagctatctctgaagggcacaaatcagaaggcaccatgcctcctaataaagaggccagcggtctcagtagttcaccagcggggctcatctgcctccctccaatctctgaggagctacagcttgtgtggacgcaagcagcccagaccagtgagctagacagcaatgaacacctgctcaaaaccttcagctactttccctatcccagcctagcagacattgcccttctctgcctacgttatgggttgcagatggagaaagtcaagacttggtttatggcccagcgcctccgctgtggtattagctggtcatctgaagaaatagaagagactcgagcccgagtagtctaccgtcgggaccaactccatttcaaatcccttctctcttttactcatcatgcgggacggcccccagaggaggtgcctcctcctccagtgccagctccagagcaagttggtattggaataggtcctccaactcttagcaagcctacccagacgaaaggattgaaggtagagcctgaggagccctctcagatgccaccactgccacagagtcaccagaaattaaaggagtccctgatgacacctggcagtggagcattcccctaccaatcagatttttggcaacatcttcaaagcagtggcctctcaaaggagcaggcaggcaggggtcccaaccagtcacatggcataggtactgcttcctggaaccactccacaaccgtcccccagccacaagctcgggataaacccccaccaattgcattaattgccagtagttgtaaggaggagtcagcatctagtgttactccctcttcttcctctacctcttcttctttccaggtactggctaatggagctactgccgcctctaaacccctccagccactaggctgtgtcccacagtcagtgtcacccagtgaacaggcattacccccacatctggaaccagcctggccccaagggctacggcataactcagtaccaggtagagttggccccacagagtacctttccccagatatgcaacgccagcgaaagaccaagcgcaaaaccaaagagcagctggctatccttaaatccttttttttacagtgccagtgggcacggcgtgaggattaccaaaagttagaacagatcactggtttacctcggcctgagatcattcagtggtttggtgacacacgctatgccttgaagcatgggcaactaaagtggtttcgggacaacgcagtacctggtgcccctagtttccaagacccagcaattcctacaccaccaccatcaacccgctccttgaacgaaagggctgagacaccacctctgccgatccctccacccccaccggatatacaacccttggagaggtactgggcagcccaccaacagctacgggaaactgatatccctcaattgagtcaggcatcaaggcttagcacccagcaggtgctggattggtttgactctcgattacctcagccagctgaggtggtagtttgtctagatgaagaagaggaagaggaggaggaagaactgccagaagatgatgaggaagaggaggaggaggaggaggaagatgatgatgatgatgatgatgatgtgatcatacaagactgagtggggagctgggggaggggaggtctgttactgaaagatgaaccaacttagtaactgtttaaacaaagaaaccacatttttaaaatt

SEQ ID NO: 8188 - DNA, 984 bp, Homo sapiens
cacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttggtaaccgtgttgcgcaaaaacaccttcatccccacccagtggggcccccatctaatattctaagtgtcagaggttccatatttgtaatagcaaatgggccctgactgtaaattagtgaagagtgaatgtaacttattacccacagggacaattccaaatgaaggccttaaatgatgctcagctaagctggttcttgtgtggcctctgtaccttcaaaagctgccgagtcctatgattacacgcgatgggacttctacacttgaagtgaaacacagttttaaaacttgctttgtttagaattcccacctcatttttccatggacaaaagtattctttaggtcctagtgcacttacaatttggtattacctgggagtgaaaagaaatattacagccatgcctaactgacttcttgaggtaagattgttctgtcag

SEQ ID NO: 8189 - DNA, 1258 bp, Homo sapiens
gccttttgtcaccttttggtgtcatatcgaaaaatacattgccaaatccaaggtcatgaaattttacctctatgtgatcttctaagagttttatgttttagattatatatttaggtgattgatttcttttaattaatttttgtatgttttcagatggtgatctgacatcattttttaatatggaagtccagttttcttagtaccatttattgaaaagattatctttttactattgaatacccttggaacccatgtcaaaattagtttatctatatatgttaagggtttatatctcaaatataaattctaattcagtggtctatatatttatttctataccagtaacacactctttagataattggacctttttagtaagttttgaaattgggaaatatgaatcttccaactttgttctttttcatgattattcaggctatgtaaggccactttcaattccatatgaacttgagggttagcttatccatttctgcaaaacagttggaattttaataaacatcacattgaatctgtagattgttttgggtagcattgacatttcaatgacttacattttccaatctatgaatgcaagaagtatttctatattttaggtattctttatttttataatttttaatttttatgggtatttagtaggtgtatatatatatggagtacatgatgtgttttgatagaggtatgcaatgtataataatcacatcatggaaaatagagtatccatccccacgagcatttatatttaggtcttctttaattttttcaacaattttgttttccctttctaattttcagagtgtaagtctttcatttcttttgttaaatgtattactatatatttcattctttttgatgctattgtaaaaggaattattttattaattttaataattttcttatataatcttaaatttacaaattattcattgtgattgtatagggatacaacctattttgcatgtcaaacttgtactttgtaacttttctgaatgcatttattaggtagagtagctttttaaattttttttatttttaatttttctgagtacatagtaggtgtatgtatttatatggcacatgagatgttttgatacaggcatataatgtgtaataatcgcatcatggaacatgagatactcatccactcaagaatttatgctttgtgttacaaacaatccaattacactcttttagttattttaaaatatacaatgtaattattgactgtacccactcc

SEQ ID NO: 8190 - DNA, 552 bp, Homo sapiens
atgctgtgtccctgcatacaggagtcgacctttgagacctgcttattcatggctgtttcacggatgtcgaagtggaggctcagcagggttggaggttcccggagtctcccagctgaaatggaagtgcttggtgaggtttggtgtgtccgagccgaagagcagccaatgacaggcctggggatcgtctggcacagcccacttgacaaggccttggaaacttggtctctgcagcagcaaccggatttcagcctgggcctcggacacctcggcctgggactgtacatcttggcctcttacctactgtgtccgcgtcagcctccctcacagcctgatggcccctgcggcagccccaacccggtttcaggggctaagaaaactacagttgcatgaacgggtggaggtgagtgggaggcagaagcggcggggagaaccagtctgttccgagatctctggaccaaccagtggatcctgatggtcagccttgtctagagccccttccagcgtgcaggccagtcctcctggcattcttctaattacaccgagctgtgagtt

SEQ ID NO: 8191 - DNA, 1805 bp, Homo sapiens
ggaagaaaagaaggggaagaagatcaaaacccaccatgccccaggctcaacagcgtgctgatggaagtggaagagcctgaagtcttgcaggactcactggatagatgttattcgactccatcaatgtactttgaactacctgactcattccagcactacagaagtgtgttttactcatttgaggaacagcacatcagctttgcccttgacatggacaataggttttttactttgacggtgacaagtctccacctggtcttccagatgggagtcatattcccacaataagcagcccttactaagccgagaggtgtcattcctgcaggcaggacctataggcacctgaagatttgaatgaaactatagttccatttggaagcccagacataggatgggtcagtgggcatggctctattcctattctcagagcatgccagtggcaacctgtgctccgtctgaagacaatggacccacgttaggtgtgacacgttcacataactgtgcagcacatgccgggagtgatcagccggacattttaatttgaaccatgtatctctgggtagctacaaaattcctcagggatttcattttgcaggcatgtctctgagcttctatacctactcaaggtcagtgtcatctttgtgtttagttcatccaaaggtgttaccctggtttcaatgaacctaacctcattatttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgagcaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttgaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaactttttgacgggaacactgcagagacaatgctgtgagtttccaacctcagcccatctgcgggcagagaaggtctagtttgtccaacaccattatgatatcaggactggttacttggttaaggaggggtctaggagatctgtcccttttagagacaccttacttataatgaagtacttgggaaagtggttttcaagagtataaatatcctgtattctaatgatcatcctctaaacattttatcatttattaatcctccctgcctgtgtctattattatattcatatctctacgctgcaaattttgggtctcaatttttactgtgcctttgtttttactagtgtctgctgttgcaaaaagaagaaaacattctttgcctgagttttaatttttgtccaaagttaattttaatctatacaattaaaaccttttgcctatc

SEQ ID NO: 8192 - DNA, 1896 bp, Homo sapiens
gccggggaccacacagagaataacttgtctgactaccagtattcttggatgcagaagtgctgaagatgagcacacacacgtacggagaatttctggagaattcagctgctcagaacaagaactgagatccagagagatgatgactttgcccatagaccaaacaaagaaatacatgtttcagtcctgtgtcctcctgctatgtgtgtccggaattggtgggttcttggtctcactgacttcaagaatgaagctgcggaccctcgcggtgagtgttacagttcttaaaggcagtgtgtccagagtttgttcctactgatgtgtggatgtgttcggagtatcttccttctggtgggttcgtggtctcgctggctcaggagtgaagctgcagaccttcgtggtgagtgttacagctcttaaggtggtgcgtctggagttgttcattcctcccagcgggctcgtggtctcactggcttcaggagtgaagctgcagaccttcgcggtgagtgttacagctcataaaggcagcgtggacccaaagagtgagaagtagcaagatttattgcgaagagcgaaagaacaaagcttccacgatgtggaaggagaccccagcagattgccactgctggcttgggcagcctgcttttattctcttatttggcccccacccacatcctggtgattggtagagcccagtggtctgttttgacagggcgctgattggtgcgtttacaatcactgagccagatacaaaggttctccaggtccccactagattagctagatacagagtgtctattggtgcattcacaaaccctgagctagacacagggtgttgattggtgtgtttacaaaccttgagctagagacagagtgccgattggtgtatttacaatccctgagctagacacaaaggttctccacgtccgcaccagactcaggagcccagctggcttcacccagtggatcccgcactgcccctgcaggtggagctgcctgccagtccctcgcggtgcgcccgcactcctcagcccttgggtggtcgatgggactgggcgctgtggagcaggaggcggcgcttgctggggaggctcctgcggcacaggtgcccacggagggggtgggaggctcaggcatggcgggctgcaggtcccgagccctgccccttgggaaggcagctagggccccgggagaaatcgagcgcagcgccggtgggtcagcactgctgggggacccagtacaccctccacagccactggctcgggtgctaagcccctcattgcctggggccggcagggcctgccggctgctccgagtgcgggccgccaagctcacacccacccagaactccagctggcctgcaagcgtcgcgtgcagccccggttcctgctcgcacctctccctccacacctccctgcaagctgagggagccggctccggccttggcaagcccagaaaggggctcccacagtgcagcggtgggctgaagggctcctcaagtgccgccaaagtgggagcccaggcagaggaggcaccgagagcgagtgagggctctgaggactgccagcacgctgtcacctctcactagtagctatcctacttttaaataaagaattaggctgggcacggtagctcacgcctgtaatcccagcacttcgggaggccaaggggggtggatcacctgaggtcaggaattcgagaccagcctggccaacatggcaaaaccccatctctactaagaatacaaaaatttgccaggcatggtggcgggtgcctgtaatcccagctgcttgagagactgaggtgggagaatcacttgaacccgggaggcgaaggttgcggtaagccgagattgcaccacggtgcttcggcctgggcggcagagtgagactctgtttc

SEQ ID NO: 8193 - DNA, 552 bp, Homo sapiens; identical to SEQ ID NO: 8190

SEQ ID NO: 8194 - DNA, 4020 bp, Homo sapiens
gaggcagtgatattgtggaagattgaaatccacagataattcatgaccctcatcttatcactttactccatctttttatcctattaaattatttttgacaagatgtcctggtagactaaaggtgaacagatttgctcttgctcatcttctggtggatattttaacttgctattcacaatcaggacaaccaaagtcaaggacccagatgaaccacaaggcagctagtcagctacttagaggttggttacattcgaataaaaagtagtcagggaatgggggaggtggggagttggggagtacttggcagttgggatatgatccatttttttaaacaagttttttgtagatcccttgtaaaataataataataatgttgtgaatctccatgccaagtgaaaaaggcctaaagatgagttgaatttgtgataccatgggtaaggcatggaagaactcttgaatgtgttggccattttctctaactaacatgtggtatgtatggtcccctatattagatagaagtctttgctacatgtaattcaaaagcatctcgcttttctcaggaaccaaaggcttatgatgtaggacaaagaaatcatcttagaactgtcaagcatattttcacaataccatgtcaagatcaggaaaacacccttttgctagtgtgcttaacttatttatttcttctaggaaacaatagataaacagcatgaaaatgtaaatcatctggcatcactgatagaatttctgaaagagaaagagaagtagatggtcaaccagtcactagttggttggcatgaggtggtgtgcagaggaaagctgcattcactattgagtaaaaacttgtagaaagcacattatagagcttatgttggaatccatcttggaggatttttgttttaaactgtctttagcattttccctcttcccttctaatgggcattataattgtttcatctactctgtgaatctacataggtctttttttttagatgtttgatacattttaagtatttttaaatagatgaaaattctaaatgattttccctcaaatctatctagattattttaagatgagacaagattattgtcaatccctgaatgtctggagttacctcccatggatttttttttcctttggcctgggttttataaacaacttgaacatcatatcatataggataacaaaggaggaagttaacttaattcacctcagacttcagcctaagattcaatcaaattcatccttcagcctgtcttgtttcttctttatgtttcttttacttattgctgctaggatcctacataggatttctatagaaatgtatgaaattctgtggtcactgcatgtcaggattgcacagtatgttacaatacaatttcaaagagaacccacatttgtgagatttacagaccaaggtgtggtggaggaggtagaattgcagatcagataaaaagtgagcttacacttgaacttagttattcactgtgacctaaatttagtcctattgtaatatgtgcctgtcacaacacaaatacccctcttgaaagagatttactcatctatccaagcacttaatttggaaattttattgtcctattgcaaaatgaaacaaaattaaaagtggcctcgagtacttggtaagttacttaaaatttttacaaaaatatcccactcaatgccaaatctttcagtcctcaaaggcatttaagtccaatagtcatgctttaaatatggctttaaattatgccaccaaaatggtgcacttcacagattcaccagactgtagcatcataaagttaatttacagtttttacaacattgcttctacattcttactggtttacattaaaatcctttaagccaaaaggaagcttgctctatggatttaaatgcaaacttcatttaccagtgcaggaagtctcataaaactcagatgtactcccacaaaaattttattggcctttttgtaagagatgaaaaagaattgacacagttctctttaaagagaagaacttttttattattatttttatctccaactgcaggtggtgtcttttgccaaggtctctgtatttttctttcagttgtctttgggaggggatgttaagtcaaatcactaaaacagggttctctttggattaaaagttctggatttattgcaactattttccttgagaaacattctcagcatcaggattgataaacaaatgtagatgattaaaataggataattggttttagataatatcttctactgccaaacttctggcaaatttacctgtgaatttcaaaatgttataaaatctcttgatatgcttttgtttttccttttagccattttctcttcaatttcttagtccctctgccctctgtaaatgtgttgagtgatatagctatcagatgtattgaaggcaaagttctcgcagaggtctctgttccagctctgtaaaggtcacaggaatcgtgaaggagctgagaaatcttcctctccggcccactgtctgtggcccattgtcattgtttcctcatgaaacattgcagagtttgaatcctcagtaactctcattgactggattagaggtgatggccacagcaaatgggagagcaaaatgttggcctacagagaatgacacaattttattcgcctttggtgttagttgccatagtgctgtatttgaaaatcgatgctttagccaaaagctgaatgaccaccgtttccgtagtttccactgttttgtctgcatagaattttcctgaactacaagcaaaaatgtattttgtccaatgtcacaaaagtgaaaatgttactaatcttagatgtgttgcatattttgtgtttttacgttccaaactctttcaaaagctgccgttacaaagctgtttggctgtattgacagcatgtggtgtttttacaaaagcaattctaggagagccagtgtctaccatgaactcctgacatccccactccagggtcattcatgacattgaaatggcaacttgtacactgtaattcttcgaaaagtaacaggggatggaaatcagacctggccgttagtcactagtgtgtagtaccgtgatctgaagtaggaaatttaactgacatagaataattgtggtttttgaagcagctactcattgctttttccttttgctgtgaagatcatggattgggaatgtcctcgtgaggtggacctaaggcagtaacatttaaacttcatgtcctagcacccgccctccatctgacccaaagataaaaaaggcatcaagcttcatggttatgcctaagcttaaaaattcccttccccactactaatattgagttcagcagggccccatcttacttatttttcaaaaaagttatagctttgaattatagactatattactaaatttggtaaggtagttctttgcatgaatgggaatgtgtgtcaaaatactttcacaaaaggcatgattacaatggaaatgcccctttgcctccagttttgctaaccctaaaaagtatttcactaatttcaagcactgtttacactcaaatcccaaaattggccaaattatataattctcttaaattttcatttctgtaggtggagatttaactatggttctggtgaatcatagaagggagagacaatatttgaggggagtttatcagcagaatatcatgccttatgaccccattactgaaacacagacattacaatcagaaatagacctaataattccaatatccctccattaactagttccagtgatgctgagagacacagcaccctgtgccaggtatcagaaatataagcctcagcagagggtaactgaaaactttcaatcagaaacactctccaaggcttatggctagattatgtaggtcactaccattcaaaacttttctatacaaaggtggaaaagcactcagaatctgggaattttctggttggaagaacaatgttctccttttccaaattggaataaagactcagaattacccattcttcataatcatgtctgattggtacata

SEQ ID NO: 8195 - DNA, 1228 bp, Homo sapiens
gctggtatcaagatttattggcccaagcggtgacgacagatcagagcccaggcaaatacagcaggagaccttgaaggggaggaaccttggattaccatcttgcccggtcaatatatctgaatgccaaagccctccgctctgtatatgtcctgttgggagattaaatgcgtttacacctctgctgaagcggctttttctccggtgctcagagtaacctgacggctccggccccctccagggccgctgtccttggaagccctggcccgggttttccttcgttcctcacgaccagcccccttcaagggcaccctaccacctgccagcgacgcgaggcacctgctgggctcccagggaaagtcacgctggttccagctgtgactgcagccgccaccgcattgcgccgcacgtcagcaccaaccacgtggcagcgagcctgggagccatcagattcgctgcaaatctgcggggcttcagtggtggagatttatcgtcatgccagatgcgtgtgtgtgagatacataattcctctcacacggcctcataaatccaaaagggtcagcaataaatggaaaaaaataaaaaatcacagactaatttgttcagaagactagaaggggatcaatgagaaagctgtagctcagctcaaagtttgttctgaaattgggagcatggagcaggaacacattccccactggatccaaacatctgcattctcaggtgggctgggcaggagctggtgcaaaatcagatgcatggcccgagctgggcttcctgtgcacatggtgaatggggaccctgacacaggccggccattgttaacggcacctggggctaagcagccgccccggggctggagaaggcaggctgggtccagctgctcccgggcgaggggtgtctggagaggggctcttgcctcacggcagggggcccaaagaggttctaaggggcctggggtctctcaccagagctatggggtagagggccttggcagctccgtgtgtcctgtgacctggcatcttagggctttgccacgccagctttgtgatgcctcccaccagactgcatgcataaagtctggagtatgctcctctctgaagtggaggaggcctgaggccctggacaggagaagccacatcctggaaggatcagtgctgggacacagatgtccctaaggccaacacgctgctcatcaactccgcattcaagaagagaccctcagattcaaaag

SEQ ID NO: 8196 - DNA, 1158 bp, Homo sapiens
atggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacgcccagctcccgcctgccagtggcctcttcaggcccatggggctcattcctgacaacggcctttccaggcccagtttttcccttccggcggcctctccgggcccagaacctcctcaagtcggcctctccagacccacttgcaccctccgggcgttctctccgggcccagctcttcttcctggttgggtctccaggcccgattcctgcctctcaacaacctctttggactcagtgcctacccatctcctggcggccttggtcggcccacagcttcctcaagccaagctccccaggcccaggtcaggcctcacggtggcctctccaggatgagctcctgccctccgatggcatctccaggccccaaatggtctccggtcggtgggctcctccacgccaaggttgggcctcccggcgaccgccgcaggcccaagttgtcctgaagtcgggctctcccggccctgcctcccagcaagtaagcaagctcttttggctcaactcctgcccagctcccaaccgcctttgtaggccccgaactttctccagccaagctctgagggcccacctcctgcctcctggtggcctgtacagttctagcactggttggagaacagcctctgcaggcccctcccttgcctcccaggggcctctccaggcccagctcttgcccccacggcggcctcccggggccaagtccctgcctgcctcccagcagcccgcgtgcggcccagctcctccctcacggtggcctgttgatgcccaactcatgcctctggcaccctgcccagaggcgtga

SEQ ID NO: 8197 - DNA, 2339 bp, Homo sapiens
gggaggtggggcatgggaggaccagagacgaagggcttggaaggagacccccacatgcatcatttcctcctcttcacagtgtgctgggagtccagccgtgcactgtgccagatgcctcaggaggagaaccctccccagtgtactgtgaaggatgacacagcacttcttcctaatgacacgcgaccgtcctggtgcctctacatggttgatgcgggcagtgtgggaccctcagttctaggactggtccgcagagaaagcacccaggagcagagcgcttcggagcggtcctcagtggcgccacctgctggtgctaatagggacagccacaggcctcttgcagactggcccaccctgcctacttccctactgacaagttctttggtatttcaaaagggagaaaccactataaaagacaagaggaagggcaggtactaggtgtttcatttccagaattaaaaaaaaaatccatttaagacgtaccactgttttaccggactgaatgggactgtagtgccaagcacagccaggaaatagagaaactgttattatggaagggaatttgttcacatgggaaagcctcattaaatagattctatgtgtgatgtttgagtgaccaatgaaaatagctggcctcagttctgcatggcacactcccaagagcaacagttactattatcacaagcctggtataaataagatagaagcagccctggacccacagccagcaacctgggttattggcccagctctgtctttgtgtgcacatgtcatttggacatcttgtcacctttctaggtcctctgtaaagtgggaaaacagagtggagttggattgaatggtctccaagatcatttccagctctgacctttggtgttctcaggatttgtaaagcagagataggtaaaacacaaaagcagacccacggaccgacctttgtataactttggagtgtggttgctcatgcacatgtgaagtgcaggcagatcaaggttctgtggctttgtctgccctgtccattagagcacaatctggatagaatgccagccaccaagatgcatgaggggcagggtcaccatctcagaaggggaagcacaggaatgtgattgggatggttaaacctctcttctcctccctttgtgctggaacagcagttgaagtttggtcctggagtaattgctgtgatgacttggaaatgcccttggttgctgaggacagctctgtcctgtagtgacagagtgactgcctggctgtggctcttgggttcacagaatccctaatcctccaagcccctaagaggcagggcagggatgctacccacaatatatgcagaaccccagatggagcctgtgggagagagaggaaattaccgtcttcactgtaggcaaaggagaatggctgtgattagccatatatgcctataagaaggagcagagccatactgtccttgtgggttgggagaggggacacagaatccagggcaattgtctgaggtctcaaagtaagttaagccagagtcaaagccaaactccaagtcttggccaaggggatgagaaaagcaaggagctagtcttataggtcaaggaagatgaggtatagttaagagtcatcagtatcacagaacaggccagcagggctttattaggtatgtagaactattataaaccaaggatcttgggagatattaatatctgctggccagacctaaaaaaaactgaaggcccaaggaaagtgactggactcactggaaagtatctaacaaatactttggattccaaagtatttccaataccttgaagattcctttgaaaacatcaaagcacaaactcaaatctgcacaagattacaaaagcacaattttggtgttatttttagaatgcaatacacaaagctatgttcatttctctcagcaagcattttcctgggtagtagtaatagcttaggaatcaaatgccacttttgtttttccttttttcactagtttgaaataccacaaatcacaggtgagtcagtcctcccagaggaaaagacagtcctagggagaatcacaggcctggcagacaagaccacactgagagcagtagaaggaacctgcatgcttaagggacagaggactgtgttgtgttctcataatagaccgctggatgaagaagtggttaaaaaccaaccctcgaaaaacaaaaatccctggctaatcctgaaatatatttaacttgaagtctttggatgatttttttaaggttaaaaaaaagtttaggattattataaatcaatatttataaataagcaacaatgtatttggaatttttgtttacctgattaaatatgtttttggtatgtgt

SEQ ID NO: 8198 - DNA, 807 bp, Homo sapiens
aagtgaacaaaggtctctggttttcctaggcagaggaccctgcggccttccgcagtgtttgtgtccctgattacttgagattagggattggtgatgactcccaacgagcaccctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcctgcctttctattccacaaagccgccattgtcatcctggcccgttctcaatgagctgttgggcacacctcccagacggggtggtggccgcgcagaggggctcctcacttcccagtaggggcggccgggcagaggcgcccctcacctcccggacggggcggctggccgggcgggggggctgaccccccccacctccctcccggacggggcggctggccgggcggggggctgacacccccacctccctcccggacggggcggctggccgggcagaggggctcctcacttcccagtaggggcggccgggcagaggcgcccctcacctcccggacggggcggctggccgggcgggggggctgaccccccccacctccctcccggacggggcggctggccgggcagaggggctcctcacttcccagtaggggcggccgggcagaggcgcccctcacctccc

SEQ ID NO: 8199 - DNA, 1936 bp, Homo sapiens
aatatgagaacataattgttccagatctggaggccatcctttaagcttcttgcaacagtctgggagcaaagagtttactcgccactgggtagtgggccatggacaccccagtctccaccagaagttcgggattgcaaaatgggactctggcagcaaatttcaaactgtatgccagacctggccctttgcagtgatataaaatttttcttgaggtgtctggaaagatggctgaataggaacagctctgctctgcagctcccagcgagatcaacgcagaaggagataatttctgcatttccaactaaagtacccagctcatctcattgggactggttagacagtgggtgcagcccacagaaggcaagcagaagcagggtggggtgttgcctcacccgggaagcgcaaggggtcagggaactccctcccctagccaagggaagctgtgagggactgtgccgtgaggaacggggcattccggcacagatactatgctttccccacggtctttgcaacccacagaccaggagattcccttgggtgcctgcaccaccagggccctgggtttcaagcaaaaaactgggcagccatttgggcagacactgagctagcagcaggagtttttttcataccctagtagcccctagaatgccagcgagacagaactgttcactcccctggaaaggggcactgaagccagggagccaagtggtctagctcagcagatcccacccccacggagcccaacaagctaagacccactgggttgaaattctcgctgccagcacagcagtctgatgtccacctggaatgcttgagcttggtgcagggaggggcgtctgccattactgaggcttgattaggcagtttccccctcacagtgtaaacaaagctgctgggaagtttgaactgggtggagcccactgcagctcggcaaagttgctgtagcaagagtgtctctctagattcctcctctctgagcagggcatctctgaaacaaaggcagcagccccagtcagggacttatagataaaactcccatctccctgggacagagcacctgggggaaggggcagctgtgggcacagcttcaggacacttaaacgttcctgcctgctggctctgaagagagcagcagatctcccagcacagtgctcaagttctgctaagggacagactgcctcctcaagtgggtccctgacccctgtgcctccggagtgggagagaccttccagcaggggtcaacagacatctggtgggtgcccgtctgagacgaagcttccagaggaaggaacaggcagcaatctgtgctgttctgtagcctgcgctggtgatacccaggtaaacagggtctggagtggatctccaacaaactccagcagacctgcagcagaggggcctgactgttataaggaaaactaacaaacagaaaggaatagcgtcaacatcaacaaaaaggacatccacacaaaaaccccatccgaaggtcaccagcatcaaagaccaaaggtagataaatccatgaagatgaggaaaaaccagtgcaaaaaggctgaaaattccaaaaaccagaacaccttttctcctgcaaaggatcacaactccttgccagcaagagaacaaaactggatggagaatgagtttgacgaatttacagaaggaggcttcagaaggtgggtaataacaaactcctctgagctaaaggagcatgttctaacccaatgcaaggaagctaaaaatgaaaaaaggctggaggaattgctaactagaataaccactttagagaagaacataaatgatctgatggagctgaaaaacacagcacgagaccttcgtgaagcatacagaagtatcaatagctgaatcgatcaagcagaagaaaggatatcagagattgaagatcaacttaatgacataaagtgtgacgtcaagattagag

SEQ ID NO: 8200 - DNA, 3607 bp, Homo sapiens
gtcggccgcgtggctggaagacatggccactccagtcggtgttgagcacggcgagcagtctcaggcctttagtgatgatggtaaggctgcctgggtgggaaaacggggtcttccttgacacgacactaacatacttggcttcccttcctcagagacgaagtggtgacgataatctcggtttctccctcatagggtggttaggagggttaaaagtactggatgagaaaatgctttccaaacgttgagaaaatgttactatgtgaagggagagagctcaagcccgtcctcggcgtcatagggccggcttctgcgggggagagcgcctaacaacctgggcagccccgtgcgcctccgccgcgcgtgtgctgagcgtcatgcccaggggtcttcggtgcccgcgcacgggcagactctgacgatggtggttcttaattcagcatcaggagtgttaacgtgtgaagacgtgattccgcttggagtgtcttgaggacggccccaatcggtagttcatatttagctttacagataggagtcaataggattgtaaacttctggaaagccgtagttttaacaacgagccttttttcctcccccagaggcctttctttgtttggcatctgcagagacggtgaaaagcagagctccaggttgaaggatcagagtaatagatggagcccttaacatgagtaagagtgggtgcaggcagggcctgagtggtcactagaaatgagaaagcacagttggtgccatcacatacattcacctcctgctttattctgaagttcaagtatgagaatacgtgttgacatacaagccagctatggtaagaaattactcaaaattcagaatgctaattattttaatgataaaaatgagtagcgtctttgcccgtgtgatttggggccactaggtgtcattgtaaccagcgtggatcctcgttagggcatgcagggatgaaagagacatggcaaatgaattttggatcgctaggatttaggaatctttgttattggctgagctgaggatgatttaaagttatccctgtctgaaatggtatcttttgtgaggaggtctgacttgctgaggctcagctgtttaatacaaatctggagaataaaccttaaggtggtttctgttagaatgaagcctgttatccttctcttttagattaaaggtggtggctgtggccttgaaaacagtcatgtgaaaactcatcaccttaaggtgttaagtgtaaggatcttcatgatgaaatttctgtaaatggtgcagtcagcctcagtttccaaagccggaaaaggatcctctagtagccacggtgtggcagctgctctgaaccaggacctggacccggacccaaagtgccatgtctttaatgttagctcccagcgatgccagatgggatcagcacagccctgcctctgctgctaattgttcctctaaagtaatcgccatgcgttctttgggcttcatctttaaaggaatgaagcaactgagattattctggaaaaccttttggcagttagtgaaattagagtacaactaagaacattttcagacctccactgtggatgacctgggtataatctcacaaatcgatgggactgcaaggattgtaaactgaaatgaacatgattatactctgttggaagagcctaagaggaaactgatgccatgagtttcagagagtaatgcttaaccccagttacacaggatgccgtcttgtgtttcctcttgtttagttacccactacagtgattttgtgatctgctaatgggttgccacccacaaccattgctttagcacttttacttcaaatcaatgaaggattgataaaagttctcctggtgtctccgcagagtgccttccaggaacagatctttgcatagaatatcagtggtttccttttttgtttcaaatagtggtcagaaaatacccagtgttgactcaccaaggcaatcagcttcctttttccctttttttgttttttttttaacattttatatttttgctttattttattttattttattttattttattttattttattttattttttgagacggagttccactctgtcgccaggctggagtgaagtggtacaatcttggctcactgcaacctccacctcccgggttcaagcaattctcctggctcagcctcctgagtgctgggactacaggcgcgtaccttctttagtagagactgggtttcaccatgttggccaggatggtctctatctcctgaccttgtgatctgcctgcctcagcttcccaaagtgctgagatgacaggtgtgagccatcagacccagcatttttttttttaatttaaatttaaattttttttcatttttttgagaggttttttttgttttgttttgttgttgttgttgttgttgtttttgagacagtcttgctctgtcacccaggctgggagtgcagtggcatgatctctgcaacctctacctcccaggttcaagcaattcttgtgcctcagcctcccaagtaactgggactacaggtgcacgctaccacacctggctgattttttttgttttagtagagacagggtttcaaccatgttgcccaggttggtctcaaactcctgagctcaggcaatccacccgccttggcctcccaaagtgctaggattacaggtgtgagccaccacacccagctattttttctttcgttttttaattttaaagttgggggggggtctcaatttgttaccctggctggtctcgaactcccggacttaagcgatcctctggctccaagcccactaccagtctcaggtttctttactaaaagatcactacctttttttctcttatctgctgccatgtgagatgtggctttcaccttccgccatgattgtgaggccttcccagccatgtagaactgtaagtccaataaacctcttttgtaaattaaaaaaaaaaaatcactatttaagatactaggatggattgtgactgttgaggagtacttacatatcctacatttgactacattatttccaaaccaagtattccatccaaaggaacatactgctatcatagagaccaaggagggactgtttaaggttgccaaggtgaagcgagctgagaggctttgtcctcgtgccagtaactctgaaatctctcttaattcctgctgtccaggcagcagaatgccatggtttccccaagtaggtagctgctttagcagttaaagcccaaatgtctgttctgttgatcagaggtctctgaatttctgaagtggtgtttcgtttctggtgactgagttaatcctttacaatccctcttgtaaagtgtgctaatagaaagaatccacctttcaaagctgcagaaccagaccgtgccctaaattgaccaacgtaactgatgtgcctcaggaagtctcttgccagctgtccctgtgaagacccccctcctcccccccagctgctgccttgcacactgaagcatctcagactgtgcaaagccgtgtagtcatcaagacagtaaatcccagggcttggttaagtgctgtgtgataacttgtttggatgagacttaacttaaaaccacttacaataaacttgggaaactaccgtca

SEQ ID NO: 8201 - DNA, 1008 bp, Homo sapiens
ctttctttgcggaatcaccatggcggctgggaccctgtacacgtatcctgaaaactggagggccttcaaggctctcatcgctgctcagtacagcggggctcagatccgcgtgctctccgcaccaccccacttccattttggccaaaccaaccgcacctctgaatttcttcgccattgcctactatgtgagcaatgaggagctgcggggaagtactccagaggcagcagcccaggtggtgcagtgggtgagctttgctgattccgatatagtgcccccagccagtacctgggtgttccccaccttgggcatcatgcaccacaacaaacaggccactgagaatgcaaaggaggaagtgaggcgaattctggggctgctggatgcttacttgaagacgaggacttttctggtgggcgaacgagtgacattggctgctgagcccaaggccaaggaccccttcgctcacctgcccaagagtacctttgtgttggatgaatttaagcgcaagtactccaatgaggacacactctctgtggcactgccatatttctgggagcactttgataaggacggctggtccctgtggtactcagagtatcgcttccctgaagaactcactcagaccttcatgagctgcaatctcatcactggaatgttccagcgactggacaagctgaggaagaatgccttcgccagtgtcatcctttttggaaccaacaatagcagctccatttctggagtctgggtcttccgaggccaggagcttgcctttccgctgagtccagattggcaggtggactacgagtcatacacatggcggaaactggatcctggcagagaggagacccagacgctggttcgagagtacttttcctgggagggggccttccagcatgtgggcaaagccttcaatcacggcaagatcttcaagtgaacatctcttgccatcacctagctgcctgcacctgcccttcagggagatgggggtcattaaaggaaactgaacattg

SEQ ID NO: 8202 - DNA, 498 bp, Homo sapiens
atgagttgctccaggtccaggtcactggaggcttcgtcctcaagggggacacttccagcctcctgggtcaggggttcccggtgtctgggctcttctttcgcagatgaggggcaggcccccttacacgctgataggcccaggttctttggcactgttctaacttcttttccctctgaaaagctggctgccaaggccttgctctggggagctttaaattttttcttagggcctaactggtcagaatctgaattcccttggccttctttccttcccattctgggtgcaggaggagctgtggatttcctgcctagagatctcttcattatcttcctctgcagtgtcctgcctcggccatctgctgtgcctgcatcacccccaagccctttttctctccttcctccttttccaactcttcctctttctcctttttctctaagcaggatcctgggctgttcaaaccagagagctgtaagtcttttctttccccattactgttag

SEQ ID NO: 8203 - DNA, 1742 bp, Homo sapiens
atgccttgggagctaagtggttgctgcccttgaccactgtgaagactggtgtgggaagggtcgctttggatgcacttgagcaggggtccccaacccctgagccatggagccgcaaggagccacacagcaggaggtgggaccatccagttgcaggaaaacaagcttgacacgcccactaattctacattatgctcctacctcccggcagcctctccaggcccagaactttctccagtcagcctctacagaccaagctcatgactcacaatggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacacccagctcccgcctgccagtggcctcttcaggcccatggggctcattcctgacaacggcctttccaggcccagtttttcccttccggcggcctctccgggcccagaacctcctcaagtcagcctctccagacccacttgcaccctccgggcgttctctccgggcccagctcttcttcctggttgggtctccaggcccgattcctgcctctcaacaacctctttggactcagtgcctacccatctcctggcggccttggtcggcccacagcttcctcaagccaagctccccaggcccaggtcaggcctcacggtggcctctccaggatgagctcctgccctccgatggcatctccaggccccaaatggtctccggtcggtgggctcctccacgccaaggttgggcctcccggcgactgccgcaggcccaagttgtcctgaagtcgggctctcccggccctgcctcccagcaagtaagcaagctcttttggctcaactcctgcccagctcccaaccgcctttgtaggccccgaactttctccagccaagctctgagggcccacctcctgcctcctggtggcctgtacagttctagcactggttggagaacagcctctgcaggccccgcccttgcctcccaggggcctctccaggcccagctcttgcccccacggcggcctcccggggccaagtccctgcctgcctcccagcagcccgcgtgcggcccagctcctccctcacggtggcctgttgatgcccaactcatgcctctggcaccctgcccagaggcgtgagcccctgcctcacactggctcctcccacgctgagagaggtcagtgtgagccccttgcctcacaccggcccctcccacgctgagagaggtcagagtgagccccttgtctcacaccggcccctcccacgtggacagaggtcagcgtgagccccttgcctcacaccggcccctcccacgctgagagaggtcagtgtgagcccttgcctcacaccggcccctcccacgcggacagaggtcagcgtgagccccttgcctcacaccggcccctcccacgctgagagaggtcagtgtgagcccttgcctcaccccggcccctcc

SEQ ID NO: 8204 - DNA, 2404 bp, Homo sapiens
accggaggcgcggccgccctgggctgagaagacgccgtcggcccaggtggcatcagaacccacaggaggaagacagccagcccagaaggagccatggggggcctctggggatcgcaagggtcgaccccatcctccctgaaacaaggccggaggttgaggaggtctccgcccggccccgcagctgacaaccggtggagaaaccgcacctgccacgggaggggccgcggggtgggctcgagccaccatggggctggtacaagcaccctctccgctcaggacctcggccctcatcccagggcaccagggctcacagggggatgggcccgggtggggacgagggtgtggaggggcaggaagcacggcgggtggagcggagccgggtgcgggggtcgcgggggaccgcggggacggggccttgtgatgcaggagacggagggggctggtgacggaggacgggaggccgcaaggatgggggacgcgacatccttttcccctcccaccggctcaccagggatgcgcctccgcgactgcccgccccaatcccagggcggaggcctcgcgcaaaacccaggcgccgcggctccgcgctccggctgagggtccgcgccgccgcccgcccgctccttcccgctcggccgcggcctcagggacggatactccagcgcgcggttccaaccgaggcccgtggcgggtttagccccatgaagatgaactgggcacccgcgaatggctgggctctgctacaggaggcagccttcctctgcgtgcggccgcggagggctccgcgggggctcgagaggggcctcgagggtgtgtgtgaggccggcgctgtgctatggtgccccgggctcctccctgcgcgtggctgcggccggggcggcgggctcaggctggagaagggccgcgggacccggggaacgcggcctggaggacgaggaggactgggttcccggaggcaacaggaccggctcggcatctacagctactgtacgtggacttcgggcgctggacccacgggcggcctgtgcctctgtgtcgggctgggtggcgccctcagtgccctggggctgctgcggccctaggcctggctgggctcggtgaccacatctggcccccgggccgcaccgtcccccaggatcctccggcctgggctcccccttcctcccttgcccacagtcttggagccccagtgggtgcaggagctgctggctgcccctgtggacccgccatccaccgtcctgcccatgctgcctcgccatccacctgcctgcccacgccgcctcagcctcccacctcccacctagaggagaccatgggccctgccccacctgctccaggatgttagggtcccctcagccaaaaaggcagtggcctgtggctcctgtaccaacagcccagccacactccagagccgcccaaagggaggtgccaaggccaggaacccaagccaccccagctccccatgcctgcccaggggccgtggtaacccatggacagggaggtgacctcaggctggttctgccactgaggccctgaggaatcaggccctccccaaaagaagtaatgaaatggaccaaaggacttaagaatttggggggaagtaaggggaaaacgttaggtgctaaccacctgcccagaagagtggatctcacagcccaggaacattcccaagcaggaaaaccatccgtccaggaaccctaaccctaaaactaagcacaacccctacccctaacccctgaccctaacgctgacccttaaccataacccttaaccctaaccactaacgcaaaacactaacccttaaccctaacccctaacacctaacccccacctcaagcactaaaccctaagcctaaaccttaaccctaactgctaacactaacccataaccctaagccctagccccaaccctaaacttgaccctgaacccaagcctccaacccaaccccgacacaaacccctaaccctaacccctaattctagccctaatccctaaatccaacaccaacccttgaccggacccctgacccctaaccctaacctcaactcataacctcaacccctactcctacacctaacccctaccctaatgctagccataaacctaacacccaaacccaaactcgaacctatgcctacccctaaaaccctagcccgaaccgtaaccacaaatcctaacacacaacgctacccctaaacctaccactaccccaccccaaaccctgacaccgaaccctgaagctaaccctaacaacactaagcctaacccctaacccttaacccaactgtaactcctaatgctaaccctaacccttaactctaaccccttaccctaaactgtaacccctaaccctaatcccaaccccaacacgtaaccctaacccctatcccctaccctaaaacc

SEQ ID NO: 8205 - DNA, 1748 bp, Homo sapiens
ccgggccctgcggagcgtgagcagctagcacccggcgggccagcgagcgtccctgcagccagcgagcaggaggaggagctgctgccgggcggagggcagccgcgggagccgaagagggcgccccaggtggttgccccctccctctcctgagatgtcaggaaggagggggccacctgtgtcctccacaggggccccccgaagcctggggactcccagccccagagctccgaggcggaggaggtgctgacaggtgctccgagagatgctccctctcccctcatgctccctccccatcctcctccttttcctcctccccagtgtgccaattgagtcccaacccccaccctcaacattgcccccttttctggcccctgagtgggaccttctctccccccgagtagtcctgtctaggggtgcccctgctgggccccctctgctcttcctgctggaggctggggcctttcgggagtcagcaggtgccccggccaaccgcagccggcgtgggtccacggtcgcggaccctctacctccgactgcaaagcaggattctcgcatctgggctttcgacgaggtcctcagcagatgggagacaacctctggctcggcctacgtgcccaagacccatggcgggccctgcgcccagcccagagccccagagcctgcagaccccacgcggactgtggggatcaaggattcaggagaaaagctcagacaccgcagctgaaccctcctactgaccacaaagtaccagagcagcgagacgagggcgcagtacacttgctctcccggcccggacgcgcgcgcccccaaatacgtcgggccccagcccctcacaactctcggaccaccaccgcggggggccttcccagtatccgaccggggcgtcctgaaccgccgccagctctatctgaccacctcggcgcgggactttcggttctatcccaagacggagccgtccggatacccccgcaaggactacctgacctactggagcttagaagagacgccccaactctggagtcacgacccgcagcggcagccctgtctctgctcttccaggccgcctcgagcgccgcacggcgggccatgtctccggctcaggaaacctacagctcctcgccgcacccgctccgccggctcgaccgcttccgcccgctggaggcgacttggggtggcccccactggaagcccctgccgggcatacacagcgtcccgaaagcctacagcaccgagaactcccgctcaggccgctgtaagccggggctagtgggagcctgccgggccagccccaccccagacacgccccctggcgtgggggcggagcagagctctgggcagccgctcactacgcggtgtcggacctaggtgggctcgcactcattaagtctatccgcagtgtggggacaggactagcccagacacgcccactcagctgcggctggatcgcggggaagggactaagtccagacaatgtcctccgaggctgcggccccgcgggcaggacacacctcctgcgggcctattcaataatcagttaaatcacctgaagcacacgcatttccggggaccgctccgggcatcctggcttgagggtagggtgggcggaggttcctaagggagaggtggggctcgggctgaatccctcgttggggggcatctgggtcaagtggcttccctggcagcacagtcacggggagaccctctctcactgggcagaagctaagtccgaagccgcgcccctcctgtta

SEQ ID NO: 8206 - DNA, 1747 bp, Homo sapiens; identical to SEQ ID NO: 8112

SEQ ID NO: 8207 - DNA, 390 bp, Homo sapiens
atgtgttgcaactactacggcaactcctgtggctatggctccagctatggctgtggctatggctctggttatggctatggctatggctccagctatggctgtggctatggaactggctacagctgtggctatggctgtggctatggctctggttatggctgtggctatggctccagctatggctgtggctatggaactggctacagctgtggctatggctctggctacagctgtggctatggctctggctctggctgtggctatggaactggcttcggctgtgggtatggctgtggttatggaactggctatggctgtggatgtggctctggctctggctactgtggctaccggccattttgctttagaagatgctattcttcctgctaa

SEQ ID NO: 8208 - DNA, 141 bp, Homo sapiens
atggctcttcctcagggtctattgacattcagggatgtggccatagaattctctcaggaggagtggaaatgcctggaccctgctcagaggactctatacagagacgtgatgctggagaattataggaacctggtctccctg

SEQ ID NO: 8209 - DNA, 1441 bp, Homo sapiens
gggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaacatttggaattttcgtatacgtggattccagaggggtgacagcgaaacgtgggaccatccagttgcaggaaaacaagcttaacacgcccactaattctacattatgctcctacctcccggcagcctctccaggcccagaactttctccagtcagcctctacagaccaagctcatgactcacaatggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccaggcccaactcctgtcccaggacgtcatctccgggcccaaaacttactcaagttagactctctagtcccaactgctgcctcctggtggcctatgaaggcccaaaatctcctcaagttgacctgtccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctcatggcggccaatgtaggcccaaaacttcctcaagtcaaactctccaggcccaccttctgcttcccggtggcatcaacaggcccagctttgacttgagaacagcctctgcaggccctgctcttgcctcccaggggctttttccaggcccagctcttgcctcatggcagctgccccaggccaaatttctgcctgcctgccagcagcctcaacaggcacagctcctccctcacagtggcccatttaggcccaactcatgactgtgaggccatttccaggcctag

SEQ ID NO: 8210 - DNA, 2661 bp, Homo sapiens
gcctctgcctcccgtcagcctctacagtcccaacgtctgcctcacagcagattcttcacgcccagcatctacctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccaggcccaactcctgtcccaggacgtcatctccgggcccaaaacttactcaagttagactctctagtcccaactgctgcctcctggtggcctatgaaggcccaaaatctcctcaagttgacctgtccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctcatggcggccaatgtaggcccaaaacttcctcaagtcaaactctccaggcccaccttctgcttcccggtggcatcaacaggcccagctttgacttgagaacagcctctgcaggccctgctcttgcctcccaggggctttttccaggcccagctcttgcctcatggcagctgccccaggccaaatttctgcctgcctgccagcagcctcaacaggcacagctcctccctcacagtggcccatttaggcccaactcatgactgtgaggccatttccaggcctagtgcctgcctcgtggctgactcttgaagcccaaaacttcctcaaatcaggcttttgcccaacttctgtctactgtcggactctacaggtcagcctctgcctcacagtggaccctccagacccagatggtgtctcactgtggcatcctcaggcgaagctcctgcctttcggcagcctctccaggcccagctcctcctgcctcccagtggcctctttcggcccagcccagctcatgcctcccggcggccttcccaagccccgcttttgactttcggtggcctctgcaggcctcgacaaggcccagcctcctgcctcccgaaggcctgcacaggcccagcctctgcctcacagcggactctccacgcccagctagctgttgcttcactgcggcctcccgagtccaaagctcctgcctctcggccgcttcggcaggcccagctcccgcctgccagtggcctcttcaggcccatggggctcattcctgacaacggcctttccaggcccagtttttcccttccggcggcctctccgggcccagaacctcctcaagtcggcctctccagacccacttgcaccctccgggcgttctctccgggcccagctcttcttcctggttgggtctccaggcccgattcctgcctctcaacaacctctttggactcagtgcctacccatctcctggcggccttggtcggcccacagcttcctcaagccaagctccccaggcccaggtcaggcctcacggtggcctctccaggatgagctcctgccctccgatggcatctccaggccccaaatggtctccggtcggtgggctcctccacgccaaggttgggcctcccggcgaccgccgcaggcccaagttgtcctgaagtcgggctctcccggctgcatctccaggccggactctggcccgactccaggtcccaacaacgtctttggactcagctcctgcccagctcccagcggccctggtaggcccacaacttccctaagccaagctccccaggcccagctcaggcctcgcggtggcctctccaggctcagctcctggccctccgatgacatctgcaggccccaaatggcctccggtcggtgggctcctctaggcccagcttgggcctcccggcggcctccgcaggcccaaatcgtcccgaagtcagtctctccaggcttagctccagcctcccggcggcctctgcaggcccaagtcgtcctcaagtcggcctggaagtgggcctggaagagcagcaagtcggcctccctgggcccagctccgtcctctcgacggcctctccaggtgcaaaacttcctcgagtcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcctctcgaaggcctgcacgggcccggcctcggcctcggcctcacagcagactctccacgcccagctagctctcgcctcactgcggcctccccagtccaaagctcctgcctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatgtaaatattttgataggt

SEQ ID NO: 8211 - DNA, 3741 bp, Homo sapiens
agagaaagaggcaactacattgcctggaggaagcctaaggaacccaggcatccagctgcccacgcctgagtccaagattcttcccaggaacacaaacgtaggagacccacgctcctggaagcaccagcctttatctcttcaccttcaagtcccctttctcaagaatcctctgttctttgccctctaaagtcttggtacatctaggacccaggcatcttgctttccagccacaaagagacagatgaagatgcagaaaggaaatgttctccttatgtttggtctactattgcatttagaagctgcaacaaattccaatgagactagcacctctgccaacactggatccagtgtgatctccagtggagccagcacagccaccaactctgggtccagtgtgacctccagtggggtcagcacagccaccatctcagggtccagcgtgacctccaatggggtcagcatagtcaccaactctgagttccatacaacctccagtgggatcagcacagccaccaactctgagttcagcacagcgtccagtgggatcagcatagccaccaactctgagtccagcacaacctccagtggggccagcacagccaccaactctgagtccagcacaccctccagtggggccagcacagtcaccaactctgggtccagtgtgacctccagtggagccagcactgccaccaactctgagtccagcacagtgtccagtagggccagcactgccaccaactctgagtctagcacactctccagtggggccagcacagccaccaactctgactccagcacaacctccagtggggctagcacagccaccaactctgagtccagcacaacctccagtggggccagcacagccaccaactctgagtccagcacagtgtccagtagggccagcactgccaccaactctgagtccagcacaacctccagtggggccagcacagccaccaactctgagtccagaacgacctccaatggggctggcacagccaccaactctgagtccagcacgacctccagtggggccagcacagccaccaactctgactccagcacagtgtccagtggggccagcactgccaccaactctgagtccagcacgacctccagtggggccagcacagccaccaactctgagtccagcacgacctccagtggggctagcacagccaccaactctgactccagcacaacctccagtggggccggcacagccaccaactctgagtccagcacagtgtccagtgggatcagcacagtcaccaattctgagtccagcacaccctccagtggggccaacacagccaccaactctgagtccagtacgacctccagtggggccaacacagccaccaactctgagtccagcacagtgtccagtggggccagcactgccaccaactctgagtccagcacaacctccagtggggtcagcacagccaccaactctgagtccagcacaacctccagtggggctagcacagccaccaactctgactccagcacaacctccagtgaggccagcacagccaccaactctgagtctagcacagtgtccagtgggatcagcacagtcaccaattctgagtccagcacaacctccagtggggccaacacagccaccaactctgggtccagtgtgacctctgcaggctctggaacagcagctctgactggaatgcacacaacttcccatagtgcatctactgcagtgagtgaggcaaagcctggtgggtccctggtgccgtgggaaatcttcctcatcaccctggtctcggttgtggcggccgtggggctctttgctgggctcttcttctgtgtgagaaacagcctgtccctgagaaacacctttaacacagctgtctaccaccctcatggcctcaaccatggccttggtccaggccctggagggaatcatggagccccccacaggcccaggtggagtcctaactggttctggaggagaccagtatcatcgatagccatggagatgagcgggaggaacagcgggccctgagcagccccggaagcaagtgccgcattcttcaggaaggaagagacctgggcacccaagacctggtttcctttcattcatcccaggagacccctcccagctttgtttgagatcctgaaaatcttgaagaaggtattcctcacctttcttgcctttaccagacactggaaagagaatactatattgctcatttagctaagaaataaatacatctcatctaacacacacgacaaagagaagctgtgcttgccccggggtgggtatctagctctgagatgaactcagttataggagaaaacctccatgctggactccatctggcattcaaaatctccacagtaaaatccaaagacctcattcttatctgtgtgtctgcattttctaatcctttttgccccaggcaaggtccctgtatctctgagacaccccgattggctggagaattgacttgggagagataaggagggagggcgggtgccagcatgctatgggctcctgcgtgaggcctgtggtacacagagattaggttgtgatacatgaagagccaagagcaggatgaggtggaggcgttacaactacctgctctgtgtgtggggggggaggggggaggggggtacgcatattcacttgaagtcgaggttcccagggcatttccatgtgctccaggcctgactacccatcagggtggaggagctggtgacactcatctccctgagtgctccctggtttcccaagggaaagactttctggcctgctgaggtcgaatcttccaagaggctcttgcaaagacccgagattctcataaatccctgcccagaagagctgcacgtatccctttcatgagtccagggaagagggtcctccaggtcttggaagacagaggggagctgctttagaggctaagttgctttgagcccacaaggtaatggagggctcctacttgggacagagccctcagcagagaattagcagtctgttggtgggttcaccccaactcacagcagtagaaactgctccatcttccaccacttattgggtttctccagtgtcagcaaaccaaagaattggatcttaccaatgcggctataggaaaacagcctgttgcatggtaagagtgataccatcttgaagtgaaaccaccacaatggccattttttttttagatggagttttgcagtggtgcaatcatagctcattgcagccttcaattcctgggctcaggcaatcctcctgcctcagcctcctgagtagctgggactacagtttcgtgtgccaccatgcctggctaatttttagaattttttgtagggacagggcctcactctgttgcacaagctggtcttgaactcctggcctccttgaactcctcctgccttcgcctcccaaagtgctgagattacaggtgtgagccactgcacctcgccagatgtccaatgtctgactcctgcataccaaggtgttctgtatcaagggctttaaaacaatgcctgtagcgtaattaacctctcacaaagatgcttatctaacctccccagcagtcatgggtttcagcaagaaagtctgtgatgtgaccagttgcacatgttttcccctaaaagcttactctagaaaggatattttttggagagggagtgtgggaatccaccatcttgtggccacctcagacatcacttctctttggaagactccattaaatatttctctgtgagaaa

SEQ ID NO: 8212 - DNA, 2161 bp, Homo sapiens
agagtagcaaaatgggcctctccccaactcccctcctcatcccccagcacaaggcaaagggcaccccttgctgtgagtttgggggcaccggctgtcgggggccgacccagaactttgcggggtcccctgagggacccgtggcgggaccggccccgggttcgtcaaattccgccgatgctttcaggaggctgattaaacaaacgacaagattggagtgggaaatgagaggctcttaaaagtggaagctttttgtttgtccatttacaagaaattggacaatgaatcacttcaggaagatggaggtcatcaacctcaccaccctacctatgataccagtggatgagcacctggctgtctcgcttgtcgcacggaatacaatggtgaagactgtgaggaaggagttagagaacaatccaccctcatgccttattggctccatgcaccaggtgaaccaaaagattgctgacataaatctgcgtaccgagccgtcggccaacagcctggcaattgagagatttgagttggagaagaaggctttaagagagaaaactcgcagcagtccagaagacaaaggcaaaaacctttccctcagccttgatgctcttttcatgggtcaagagacaaaggaaatctcagtattcctgcaaaggctccgaactcagacatgccagatcttctgttataaaaaggaaaacagcagataaaaatctgctggcagagctgtaccagtattccaacttcaacagctccaagccaaacaagcttccgaatggcgtggacttctgtgacatggtgggcaacgtggtccgggctgagagagactgccttagtggcaagcatttctgttcaggtagagaattagagaagtttctctcttcttcttctccaagagccatctggctggatagcttttggtggatatttcatgagaggtaccagccaaacaaggagctccagaataatctgtttgaccggatagcccagcactatgccttacttttgtttcgtgtacccaagtcccactctgaagaggcgctcttaaaaaggctgccatcacttctcagcaaagccgtgtacaccagcttctgttgctgctttccacagtcctggttcgacacgcacgaattcaagtctgacatctgtaacacaatgagcctgtggatttcaggcacctatcctagcccacagagctatgacagctgggactactcggaactagacccagagcgattccgcagagaagaattaatgttgtacagaagaagactgacaaaggggagagagttttctttgtttgctggtaagagagccttctcccagaagccagcccagagcaggaaattctaccaccctcagtcttctagtgcaaattcacccagtgaaaaaacctcttcggccaagcagaactcagaaaaaagcttacgaatgcagaatactgcaaaagagcatcattgtcagaccctggtcttgaagaaacctacgcaagaagtcaagaggatatcagaagcaagagaatgtgagaatatgtttcctaaaaagtcgtgtgctgcctgcaaaagccctgagctgacttcaaacctcttcaacatttatgggaagagccctctgattgtgtactttctccagaactatgccagtctgcagcagcacggcaagaatgtgttgatagtcagaagggaaaagaccacgagcgccactgactgcaccccaacgtatactgatgtcatcagcgagaccctgtgcagcatgaagaagcggaaagacaacctcaatcagttgtaccagcatcattggactgaatggaattattttgacaagcatctaaaggagctgcaagacaacttctccagggaaatgaagaatattgatccaaaagcagcagatacaaaaaaggcaaaccacatgttcatcccaccttcagccgtcaatgaggaatcacctgacaagaaaactaaggaggggaaaggaggagagggaaagagaagagaaacagaagttgaacatttctttccactcacttccaagccctgaggagctccacaacctagaaccaggaagcgcctacagaatccgtgatatttctgctacgaggtggagtggaacaagaaaataagaaaattgtggccaaagacagaaataggaatcatgatttctccatagg

SEQ ID NO: 8213 - DNA, 1156 bp, Homo sapiens
atatctcaggctgatctaaaagaactggaaacaaaaaagaagatttcccaggtgatctgggcagcctctaccaatgtgatgcgaatgatgagaatgtgatggcgaagatgaggagcccctgacaaacgtagtcgggaatgacgaaaactgtccagcagcaacagaaccctggtggaccagatgaccttagaaaacacaaaatcaatgtgcaaaaatcatgagcattcctatacacaaataacagacaaacagagagccaaatcatgagtgaactcccattcacaattgcttcaaagagaataaaatacctaagaattcaacttacaagggatgtgaaggacctcttcaagaagaactacaaaccactgctcaatgaaataaaagaggacacaaacaaatggaagaacattccatgctcatggataggaagaatcaatatcatgaaaatggccatactacctaaggtaatttatagattcaatgccattcccatcaagctaccaatgactttcttcacaaaactggaaaaaactactttaaagttcatatggaaccaaaaaagagccctcattgccaagacaatcataagcaaaaagaacaaagctggaggcatcacactgcctgactttaaactatgctacaaggctacagtaaccaaaacagcatgctgctggtacctaaacagagatatagaccaatggaacagaacagaggtctcagaaataacaatacacatctacaaccatctgatctttgacaaacctgacaaaaacaagcaatggggaaaggattccctatttaataaatagtgctgggaaaactggctagccatatgtagaaagctgaaactggatcccttccttacaccttatacaaaaattaattcaagatggattaaagacttacatgttagacctaaaaccataaaaaccctagatgaaaacctaggtaataccattcgggacagaggcatgggcaaggacttcatgactaaaacaccaaaagtaatgacaacaaaagccaaaatagacaaatgggatctaattaaactgaagagcttctgcacaggaaaagaaactaccatcagagtgaacaggcaacctacagaatgggagaaaatttttgtagtctactcatctgacaaagggctaatatc

SEQ ID NO: 8214 - DNA, 1738 bp, Homo sapiens
gatggcagaagaaactcaacacaacaaattggctgcagccaagaaaaagttaaaagaatattggcagaaaaacagccctagagttccagcaggagcgaacaggaacaggaaaacaaatggcagtatccctgagaaagccacttctggtggttgccagccacctagggattcagcaacaggtttccacagggaaggccctacatcatctgctaccctgaaagatctggagagcccgtgccaagaacgagcagtagtcctggattcaaggtccgtagaaatcagtcaactgaagaacaccatcaaatctctgaaacaacagaagaaacaagtggaacatcagctggaagaagaaaagaaagcaaacaacaagaaacagaaagccaaaagggtgctagaggttcaaatccagacattgaacatacagaaagaggaactaaatacggacctgtaccacatgaaacgttctctcagatactttgaagaaaagtccaaggatctggctgtccgcctgcaacattcattgcagcgtaaaggagagttagagagtgttctctctaatgtcatggccacacagaagaagaaggcaaaccagttgaaggagtcttttcaacaagtccaattagaaagagatgagtattctgaacatctaaaaggagagagggcccggtggcagcagaggatgagaaaaatgtcgcaggagatttgcacattaaagaaagagaagcagcaagatatgcgtcgggtagagaagctggagaggagcttgtccaaactcaaaaaccagatggctgaacccttgcccccggagcccccagcagtgccctctgaggtggagctgcagcacctgaggaaggaactagagagagtggcaggagagctccaggcccaggtcaaaaagaatcagcgcataagtctcctgaaccagcgacaagaagagaggattcaggagcaggaagagaggcttcggaagcaggaggagaggattcaggagcagcacaagagccttcagcagctggccaagccacagagcgtcttcgaggagccggagcacctggaagcggccagccagcagaaccagcagctaacggcccagctgagcctcatggctctccctggggaaggacacggagaacatctggacagtgagggggaggaggcacctcagcccatgccgagtgtcccagaggacctggagagcagggaggccatgagcagctttatggaccacctgaaggagaaggcagacctgagtgagctggtgaaaaaagaactctgcttcatccaccactggcgagacagacgccatcagaaaacccatcaccttttatcagaaccagggggctgtgccaaagatgcggcactgggaggaggacaccatcaggctggagctcagggaggagatgaaggtgaagctgctggagctgcagcagatggtattgcggcttacagcaactacaacaatgggcacagaaaattcctggccgctgcccacaaccctgctgatgagcccggtccaggagccccagctccccaggagcttggggctgcagacaagcatggtgatcttcgtgaggtgagcctcacctcctctgcccaaggagaggccagggaggatcctctccttgacaagcctactgcacagccgatcgtgcaggaccacaaggagcacccaggcttgggcagcaactgctgtgtgccattattttgttgggcttggctgccaagaagaaggagataa

SEQ ID NO: 8215 - DNA, 1825 bp, Homo sapiens
gatggcagaagaaactcaacacaacaaattggctgcagccaagaaaaagttaaaagaatattggcagaaaaacagccctagagttccagcaggagcgaacaggaacaggaaaacaaatggcagtatccctgagaaagccacttctggtggttgccagccacctagggattcagcaacaggtttccacagggaaggccctacatcatctgctaccctgaaagatctggagagcccgtgccaagaacgagcagtagtcctggattcaaggtccgtagaaatcagtcaactgaagaacaccatcaaatctctgaaacaacagaagaaacaagtggaacatcagctggaagaagaaaagaaagcaaacaacaagaaacagaaagccaaaagggtgctagaggttcaaatccagacattgaacatacagaaagaggaactaaatacggacctgtaccacatgaaacgttctctcagatactttgaagaaaagtccaaggatctggctgtccgcctgcaacattcattgcagcgtaaaggagagttagagagtgttctctctaatgtcatggccacacagaagaagaaggcaaaccagttgtccagccgcagcaaagcacgtacggagtggaagttagagcagtccatgcgggaggaggcactactgaaagtgcagctgacacagttgaaggagtcttttcaacaagtccaattagaaagagatgagtattctgaacatctaaaaggagagagggcccggtggcagcagaggatgagaaaaatgtcgcaggagatttgcacattaaagaaagagaagcagcaagatatgcgtcgggtagagaagctggagaggagcttgtccaaactcaaaaaccagatggctgaacccttgcccccggagcccccagcagtgccctctgaggtggagctgcagcacctgaggaaggaactagagagagtggcaggagagctccaggcccaggtcaaaaagaatcagcgcataagtctcctgaaccagcgacaagaagagaggattcaggagcaggaagagaggcttcggaagcaggaggagaggattcaggagcagcacaagagccttcagcagctggccaagccacagagcgtcttcgaggagccggagcacctggaagcggccagccagcagaaccagcagctaacggcccagctgagcctcatggctctccctggggaaggacacggagaacatctggacagtgagggggaggaggcacctcagcccatgccgagtgtcccagaggacctggagagcagggaggccatgagcagctttatggaccacctgaaggagaaggcagacctgagtgagctggtgaaaaaagaactctgcttcatccaccactggcgagacagacgccatcagaaaacccatcaccttttatcagaaccagggggctgtgccaaagatgcggcactgggaggaggacaccatcaggctggagctcagggaggagatgaaggtgaagctgctggagctgcagcagatggtattgcggcttacagcaactacaacaatgggcacagaaaattcctggccgctgcccacaaccctgctgatgagcccggtccaggagccccagctccccaggagcttggggctgcagacaagcatggtgatcttcgtgaggtgagcctcacctcctctgcccaaggagaggccagggaggatcctctccttgacaagcctactgcacagccgatcgtgcaggaccacaaggagcacccaggcttgggcagcaactgctgtgtgccattattttgttgggcttggctgccaagaagaaggagataa

SEQ ID NO: 8216 - DNA, 380 bp, Homo sapiens
cagctgcaggacaagttcgagcatcttaaaatgattcaacaggaggagataaggaagctcgaggaagagaaaaaacaactggaaggagaaatcatagatttttataaaatgaaagctgcctctgaagcactgcagactcagctgagcaccgatacaaagaaagacaaacatcctgatccatatgaattcctcttgttaagaaaaataaagcatccaggattcaatgaagaactgactatcaccttgttaatcattcagaaacatgttgcaggcttaagccatttttgatatagatactgaaacaattacttgctaagagcaaacttgaaggtatggataaggccctgagtcatcttcctgagctgaatgatatttaagct

SEQ ID NO: 8217 - DNA, 10322 bp, Homo sapiens
ccgcccggcctctaccaccgaggaaaggggtaaccggcgcgggggttcccagcgccagcctgcgccaatccccagaaactccgtgaatcacctcgggatagcaaacggattatacaaaggcagtgtcttctggggtccttttcatgcctctaggaccaggacctgcattcaccctctccactgacacattggtctgggcccccggcccggctgtcaccatagaaacggcatctcgcggacaacgcggcggctcacgaaggttccattgttatgctaaacgggaaagtggagaccgcgccggcgttgcctagagaacgcctggactcagagtagcaaaatgggcctctccccaactcccctcctcatcccccagcacaaggcaaagggcaccccttgctgtgagtttgggggcaccggctgtcgggggccgacccagaactttgcggggtcccctgagggacccgtggcgggaccggccccgggttcgtcaaattccgccgatgctttcaggaggctgattaaacaaacgacaagattggagtgggaaatgagaggctcttaaaagtggaagctttttgtttgtccatttacaagaaattggacaatgaatcacttcaggaagatggaggtcatcaacctcaccaccctacctatgataccagtggatgagcacctggctgtctcgcttgtcgcacggaatacaatggtgaagactgtgaggaaggagttagagaacaatccaccctcatgccttattggctccatgcaccaggtgaaccaaaagattgctgacataaatctgcgtaccgagccgtcggccaacagcctggcaattgagagatttgagttggagaagaaggctttaagagagaaaactcgcagcagtccagaagacaaagtcaagagacaaaggaaatctcagtattcctgcaaaggctccgaactcagacatgccagatcttctgttataaaaaggaaaacagcagataaaaatctgctggcagagctgtaccagtattccaacttcaacagctccaagccaaacaagcttccgaatggcgtggacttctgtgacatggtgggcaacgtggtccgggctgagagagactgccttagtggcaagcatttctgttcaggtagagaattagagaagtttctctcttcttcttctccaagagccatctggctggatagcttttggtggatatttcatgagaggtaccagccaaacaaggagctccagaataatctgtttgaccggatagcccagcactatgccttacttttgtttcgtgtacccaagtcccactctgaagaggcgctcttaaaaaggctgccatcacttctcagcaaagccgtgtacaccagcttctgttgctgctttccacagtcctggttcgacacgcacgaattcaagtctgacatctgtaacacaatgagcctgtggatttcaggcacctatcctagcccacagagctatgacagctgggactactcggaactagacccagagcgattccgcagagaagaattaatgttgtacagaagaagactgacaaaggggagagagttttctttgtttgctggtaagagagccttctcccagaagccagcccagagcaggaaattctaccaccctcagtcttctagtgcaaattcacccagtgaaaaaacctcttcggccaagcagaactcagaaaaaagcttacgaatgcagaatactgcaaaagagcatcattgtcagaccctggtcttgaagaaacctacgcaagaagtcaagaggatatcagaagcaagagaatgtgagaatatgtttcctaaaaagtcgtgtgctgcctgcaaaagccctgagctgacttcaaacctcttcaacatttatgggaagagccctctgattgtgtactttctccagaactatgccagtctgcagcagcacggcaagaatgtgttgatagtcagaagggaaaagaccacgagcaccccagactgcaccccaacgtatactgatgtcatcagcgagaccctgtgcagcatgaagaagcggaaagacaacctcaatcagttgtaccagcatcattggactgaatggaattattttgacaagcatctaaaggagctgcaagacaacttctccagggaaatgaagaatattgatccaaaagcagcagatacaaaaaaggcaaaccacatgttcatcccaccttcagccgtcaatgaggaatcacctgacaagaaaactaaggaggggaaaggaggagagggaaagagaagagaaacagaagttgaacatttctttccactcacttccaagccctgaggagctccacaacctagaaccaggaagcgcctacagaatccgtgatatttctgctacgaggtggagtggaacaagaaaataagaaaattgtggccaaagacagaaataggaatcatgatttctccataggggaaggattccgttgtagtttttcctaggctgagtgaaaagcaggagtagagagttggtgcttgggtcactacatttattcatagatttactctttcagtattttattacgtgcatgctggtaagtatgttacaaatatgacctcatacaaaggtaaaactttcataccagccgtatgaagtagggattatccactgcattttacgcagcagcaagcccaggtttagaaaggtttccgaagttctctgctgtagacactgggtaattaacagtagataagacacagtccctgttctcaagggagtcaccatctggtagagggaagacagatgtatcaacacattaaatgctgtaagtattggacagaggaaaaagagaaaagtgttgtgagggaaaaggaaaatgggcctagaggagtgcaattttttgtaacaagctttgtggaactattaatttgataatttgataggcgcttctattatgctgcctctgaacctttgcctcctgctcctctaaccactgggattgccagcctatttccaatatgccctctttctgcctggcaaacatcttgtcttttctaaactcagcccagggacatgacatctgtaatgtgtttctgtgtgactcccaggcttctgccttcttaacctctcaccttccagctcatttgagtgaatctttgtccaagaattgagagaaactttataggtaaagcatgcacatgttgtctgatttaatctaaaatagaaataagaaaacaaaaaataatactgcaactagggacacatttagtcactcccagttcatgagacaaggaatagtaaagttcattcctaccatagcaaaagtcaggatttaaatgtaaattaatttttttaattaaaaaattttaaattaggccaggcgtggtggctcacacctgtaatcccagcactttgggaggctgaagtgggcagatcacgaggtcaggagttcgagaccatcctggccaacatggtgaaaccccatctctactaaaaatacaaaaattagctggatgttgtggcgggcacctgtaatcccagctactcgggaggctgaggcagaagaatcgttggaacccaggtggcggaggttgcagtgagccaagaccatgctattgcactccagcctgggcaacaagagcgaaactctgtctcaaaaaaaaattttttttaattaattttaactaaattaaattttttagaggcagactctcagtctgttgtccaggctggaatgcagtggcgcagtcatagctcactgcaacctcaaattcctgggctgaagcaatcctcccacctcagcctcccaagtagctaggactacaggtatgccaccatgtctggctaatttttaaagaaatttttttgtagagatgggatctcactgtgttgcccaggctggtctcgaactcctggcttcaagtaatcctcctgccttgtccttccaaagcactgggattctaagtgtgagccaccacacctggcctggagtatctaatattgtataacataataatagtaatcataggtgatgtcatttattgagtacttagtatgtgctgagtgctctgctaagtctggtttagacattatctcagttaaccttcctggtgtcccccaagatggatattgttacctccattttctcctaggaagaaacggacttgggggggatgattaggtatttgctagatgtctattctgtaccatccctgcactaggccctgtgaatacagagataaataaagacacagtccctgaccttatggggctcacaatctggaaaaaagagaaggatgtgtaaaccaataaatgcattaatgctccgatagaaagctgcgtggaatctgagaaaaaccaaggcagatgaagccagtgtgccagcagccctttgggacagaagatatttcactgaggggcacaggcacaggggttggtttgccaaaggaccagcagctgggctgaagggcataggttttatcatttgagcttcaaggcacaaggcagtgacctggtctgtgctagaacagttcacctgtcacagccaagaggaaagaaatggtgcagatggctgtttgcccaaaccaagcagcagataagcagatcttgggaaatgtagctcatccctcagacacacatctttacttgaatcctgagtagaactctaggtgacccccttggaggctattactcatgtaaaaggggatgaaggaaaggtaagagagaaggagcttaggctttggcatgagaaaatttgggcctttgaatccctgccctgcttcaccatatggatgtgtgactcagcatagtagctgtgcatcttgacctttctgaacgtgctttcttgactgcagaaagggaatgcctgcctaggagggttgttgtgaggattagatgagataatttgtgcaaagttcttggcacagtacttttcactttgtaattgccacaagctgttattgttgttattgctgttataaagtgtactcttcttggccgggtgcagtggctcatgcctgtaatcccagcactttgggaggccaaggcaggtggatcgcctgaggtcaggagtttgagaccagcctggccaacgtggcgaaactccatctctactaaaaatacaaaaaaattagccgggcacaatggcaggtgcctgtaacctcagctactcaggaggctgaggcaggagaatcacttgaacccgggaggtggaggatgcagtgagctgagattgcaccattgcactccagcctgggtaacaagagtgaaactccatctcaaaaaaaaaaaaaaaaaagtatagtcttctgaaaccagaacgtgtgagcacctgccgagtacaaggcaccatgtggggcagataagcagaacactctctcaccttccctttactaccccagccactgtcaactcttcatttgcagtttctctaggaaccacactttcctatttctggatcttttgtctgttgctgcttctggacctgaaaatgccttctcctccctcctctttgttaactgccaacatcactaattcctgctcttcctccaggaccccgcttagacgtccctcatcttgggagccttccctaatataccaggagcaaggtaggcacaagtgctccactgcattatgctccaacagcattctgtgccatcccattatggcagcagttaccatagtagattggaattgcctgtctacctatccaccgctactattagcccccatacagcaagaaggtctccttattttctaagcccaggacaaactgcatttctgtctgtcaggaccatttgttgcacagtccaagatcatccctgcatggaccctttccagaaatgactgaggactcagagttgtagcctctcaggatgttaaatatgaagaaacctgtctctgccctttgtaaacattagaagggaaaattatggggaagaattatttgccctttataagggaagcggggtagagcatcaaagggaactaacatttaaaaagcatttgctgtaatgtgggataaagcaaatgagtaattgtatgatattctaattctgtcattcccagtgttgctgaaaacccatactctcagcatggaagaagataaattcagatgttaaactagaagagatgaagttaaaatcctatagtcctgattttgaattgcttatgaattgatgatgaaatgtatgttttagaacatacagtttcctgaagaacaggagggatagctggagaggggataggagggaagctggaaggggttacaaagaggcccaaataaacttttgggggtgacagatatgtctactatcttgattgtggtgaatggctcatgggtgtatacacacctaaatacactttaaatgtgtgcagtttctcatatgtcaattatacttcgataaagctttgttaaaaaacgaacaggccaggcatggtggctcacacctgtaatcccagcactttggaaggccaaggcaagaggattgcttgaggccaggagtttgagaccaaacaggacaacatagtgagaccttgcctctacaaaaacataaaaaattagtccgatgtggtagtgcatacctatagtcctagctactagggaggctgaggtgggaggatcgcttgagcctgggagcttaaggctgccatgagctgtgattgtgctactagactcagcctggatgatagagcaagactgtgtctgggaaaaaaaaaaaaaaaaacctgagccaggtgcggtggctaacgcctgtaatctcagcactttgggaggccgaggcgggtggattgcctgagaccagtagtttgagaccagcctgaccaacatggcgaaatcctgtctctactcaaaatgcaaaattagccgggtgtggtggcagctgcctgtagtcccgggtactcgcaaggctgaggcaggagaattgcttgaacccaggaagcggaggttacagtgagccaagatcatgccactgcactccagcctggacaacacagtgagactctgtctcaaaaatatgtgtatatatttcctaaaactctgtccactgaaatgacctagaaataaagactgacccggcagcagtgacccagactgtggtcttgaaatactatttgccctaaaaggatctagggatccttgaagaaatgatcagttccaggtctagggcaggaaaatcatgagacctgaaacatcttatcacacttaacaccaaggaagctatcaaagacaaggatcctgtcagaaagacttgggagcaaacttagagacaatcccattagctaaaagagaggaccatttgggcattaataataattgccatatttgaagcacgtcaaacgtgttctcacctgtaagttcatattgtgacttttaaaaaacggattggtgtctggacgcggtggctcacgcctgtaatcccagcactttgggaggccgaggtgggcagatcacctgaggtcaggagtttgagaccagcctggccaacaaggcaaaatcccgtctctactaaaaatacaaaaatcagccaggcgtggtggtgcatgcctggaatcctagctattcgggaggccgagacacaagaatcacttgaacttgggaggcggaggttacagtgagctgagatcgcaccactgcactccagcctaggtgatggagtgagactgtctcaaagataaaaaaggaaaggggaaaggaggaaactaattggatactaggaaacttcctcattattttgaaaattggtaagtaaatgaataagcatttatcatgccattcccatatgaactgtattaccaggtaaccaaatagtagtggaacagaaacttgtctttagaaacaatccacctaataaattcagaaataatgatagacttaaaatatcaccattttgaaacccctaatgaattaatggatctaggttgattatccatggctgcttacatcacaaaagacaaacagctattaaatgccttttgatactagaccataagaccacctatcaaatagtcttacaaataagtaaacttgaatgtgatctgaactctagatccaaccaccataacaggaaatacagaggatggggacatcatggcaaatggtaaatgacacctaggggatgcaatcagcaaaatccaggccatggaaaactccagggcaaatgacttcatttttttcaacaaataagtttcaagggaaaaagagagggggaatatatagattaaaagagacttaaaagaggacatcggttgccgagcatggtggcccatgcctgtaatcccagcactttaggaggccaaggtggaagaacccctagagcccaggaggtgagaccaaaccgggtaacatagtgagaccttgtctctacaaaaaaagtaaaaattagcagagcaaggtggcatacgcctgtagtcctagctacttgggaggctgacgtgggagaattgcttaagcctgggagttggagggtgcagtgagctatgatcatgccactgcacactccagcctaggtgacagaatgagaccacatctctaaaaagaaaaaaaaaagacatcaatcaattacaacatgtggacattatttggatcccattgaaacaaaatgtggcatttatgagacaaatggatatctgaatcttaaatattttatatataaaattattctaggcgtgataatagcattatggttatattttttaaagagttatcacattttagagatatatactgaaatattcacagatggaattacaagatttatggaatttgtactcaaataatatgggagagagaaagtggatggaggtataggtgaaacaagattgaccatgtgttgaaaattgttgaagatgggtgatgggaatattatactgttttacttttgtgcatatttgattttagccataatttttaaaattaaaggcatctaccatggacacttctaagcatattttacacactttcattgtggtctcactaaagccctgtgaatgaggtacaatttcccccattttcaaattgaggctcttcttgtttaaagcaccattactcctggcttgggacttctgttatacaatattctcctagcattctctttgccctttctcttgcccctccaatcagttctccacacaggagcccacatacttcatgtgtattaacccatttaattctcacaactcagcgccgatattattcttggttttcagataccgaaactcaggcacagagaggttaaataattttcccaagaccacacagctagtgaatggctgaagtgtgctctatgtctggcttagttgctgctcctatgtgtacttatgacaggaaaataaagtcaagatatgaatatacaagcctgccatatagtggtttagcatgtcagttaagagcatggtcactggagccagactgtgagcctcaggcaagttacttaacctcctggtgccccagttccatcgtgtaaataggggtgataattgttgtgcctcatggtgtctgtgtgaggagtggatgcatgaatctgtgggaggcacttagaacagtgcctgacacatggtaagtgcagcatgtactggctatcatgatcattattgggtgttcaacaaatactcgttccttttggcctctctcctttaattttgaaattaaaatcctccaccagaaccacttgcagttccccaaataagcctctgtgttccttctgcctttcccgccctgcccgattgacaaatcctcactgatccagccccaagctaagggccaccatccccgcaaccccagagagagcctctgcttggttcccagctgcatgtctaatccctctcatcctgccttgtgtggtgattatctctttctgcattgtcttctctactagactcatggctccttgagggcaggtacctacctgtctttatatccagcagagacgtggaattgagcagtgttgaataaatgctagtaaaataaactgtcatagcaagcctctcttggacacctatgtgctgaagttaaaaagtttttcaaatttggactgaaaaaatgagaaagcccaaaatgactattaaatatacatgtatgtgtgtgtatacatacacacagtcatgcaccacgtaacgatgtttcagtcagcagctgactgaatatatgacggtggtcccataagattataatggaactaaacaattcctatcacctagcgactcttagccttcgtaatgtcatagcgtaacgcattagtcacgtgtttgtggtgatgttggtgtgaacaaatgtactgtgttgcctgccagtcatataaaatatagtacacaatactggggtaatggtaataaatgactgttactggtt

SEQ ID NO: 8218 - DNA, 2393 bp, Homo sapiens
aagagacagggtctcgctctgtcactcaggctagagtgcagtggcgtgatctcagctcactgcagcctcaacctctcgggctcaagctatcctcccacctcagcaccttccccgctacccctcccaagtaactgggatgacaggcgtgtgcgaccacgcccagctaatttttgtattttttgtagagatggagtttcgctatgttgtcccaggctggtctcaaactcctgagctcaggcaatctgcccacctccgcctccaaaagtgctgggattataggcctgagccactgtgcccatctccctggcttattgatagccatcttctccctgagtccttacagggtcatccttttgtgtgtgtctgtgtcctaatctccccttataagaacacctgtcatactagattaggacccaccctattgacctcattttaccttaatcatctctataaagaccctatctccaaatacagtaccattctgaggtcctgtaacatatgaatttgaagggacacagttcagcccgtaacagtatccatggacataaagtgctcagcacaggtcatggcacagaaaatatccatgggaatgaccacagccaggagcccgagccgcctctgccctcgcgccagcctgcccactgcaccctgtgtctgagtgcagcttgtctgccctattccccaaccccagggctgacctcatttccctggatgaattgggcagcagactccatgtgtcctggctgagtcctcaccactctggcccacctgtgggctggctgagttacatggctgggtgtcccaggggctagccttggagtctgtagaccaaagtgcttctagaacagcagccagcctctgctgaaagactgagtcctgtggaatcattcactgccctcactaggtagtgccacactctctgcgcctctgagtggtgatatgtgtggagccacactcaccaagccggagccttcacactggtggcaacttacaggattgtcatgaggcaccttctcttcagcaacctgtttccttccccctggctcccctcccacattattttcccttgactgcttggctctctgcttgcatacaggcctagcataagggtgagatccagaggcagtggggaggggagccagtacccagggcctccgtgtgaactcttggtggtggctaccagagaaaggccgcctgaaatgattcttctgtgtgtggttgtaccaactcaggactcagctagtttcactggtttctttcttgctttccatttttagggaatttttttttgttcgttttgttttgttttagacagagtctcgctctgttgcccaggctgcagtgcagtggcattctcggctccttgcagcctctgcctcccagattcaagcagttctcctgcctcagcctcccaagtagctgggattgaaggtgcatgccaccacgcccggcttattttttgtatttttagtggagacagggtttcaccatgttggccaggctggtctcaaaactcctgacctcaggtgattcacctgccttggcatcccatagtgctaggattacaggcatgagccactgcgctcagccagaatttttttttttttttagacagagtttcgctcttgttgcccaggctggagtgcaatggtgtgatctcagctcactgcaacctccacctcccaggttcaagtgattttcctgccccagcctcccgagtagctaggattacaagcgtgtaccaccacgcctggctaatttttatatttttaatagagacagggtttcaccatgtttgccaggctggtctcgaactcctaacctcaggtgatccacctgccttggcctcccaaagtgctgggattacgggcgtgagccaccacacccagcctatttttgtatttaatagacatgaggtttccccatgttggtcaggctggtgtcaaactcctgacctcaggtgatccacctgcctcggcctcccaaaatgctgggattacaggcgtgtgccaccacacccagcctggaatattttttaagtttaaaaaaatttatatcactatggcaatacaaatgtatatacatatttgtttatacttttacaaaaaaagggaacagtaggccgggcgcggtggctcacgcttgtaatcccagcactttgggaagccgaggcgggtggatcacgaggtcaggagatcgagaccatcctggctaacacggtgaaaccccgtctctactaaaaatacaaaaaaagattagccaggcttggtgggcacctgtagtcccagctactcgggaggctgaggcaggagaatggcgtgaacccgggaggcggagcttgcagtgagctgagattgcactccagcctgggagacagagcgagactctgtctc

SEQ ID NO: 8219 - DNA, 2674 bp, Homo sapiens
atcccaatagctctaaatctgaaaccattgcattaaagatgttgttacgattattaaaagcattatcaactaggatcacatgcggctacgtgtctcggtgggcgacagctaaagaaacttgcaagcccgttgttccacaccaatttcagcgcgatggagacctctccagtctctccacatcttctctttgccgggcggagggaggaggctctctccatccccacgactgccgttctggggggcaagtcgagacgagcacgcctggctgctacctccgcacccgcgtcccacaagcttgctttcggggatctcacacatcaacatggaatctctccagaggccagaggagaatgaggggcactcgcgaggactaaggtagaaagccaggatccccgggctgcgggcgagcgcgtctcccatggctccccaggctcagccgctgcctcttctgggcaaatgcaaagcaagcaacgcacccaccccccgccctccccggaggccgacctggaaaaggaagagcgggaaggtgtctacaactgttcctcagccacagacagtcccaggatcatggcccagagagagagagagaaagagagaaagggacaggattaactcactgctgctccagatcatcggccatagtaaacaagccttgccaggtcctggcgagcccgcccagcgcctgacgccagcaccagctgacccgggaggccgcggggagcaagggggcgtggccgcgcagggggcagggctcgcggcgggccggcggtcggcggtgggaccctcaaaactctgcaacttggtttcagctagtggggcccttgctgtgttttcaatcactggcatgtgtcccggcagagatgtctctgacggtctcagaatgggacagtaatcctggtcacacatttgggggagtccttgcaggagctccgacagccctcccttctctcataactaaaaagtggtagaactacgcctgcacgctcgcacccactctttgggcttcccattgtaactgtgtcctcctgaaatcgacccttgttaatgttccttctagtaagaggcttaaatgtttgtggagacaacgccattggttgaatgctcctacaaagggcctggatgccagatttcgaaactaaaatacaggacacctagttaaatgtaaattccagatttaaataaagcaaatacttttttagaataagtatgggccatgcagtatttgggacataagtaggcatcctgtattttctctggcaaacctaaacctatatgacatctgccaaaatgggcatatctctgctctgatgttgactctgaccccaacctattttccagggaaaatatagctcaactccaggtcaccctcagtttggaggataacagttgaaggactcaccaataaggctaggtctcctttcggtatgtaaatgcggggacagggagataaggctggcttggcccagaggtcctgagtgcacttcagtttgctcagcagaggagctaaatcttgaggctggctgctgaatttgcttgtaccggtaaacagggcctgacctccctggaactgtcagatttcagatcatccccttagttaaaaccagactaggggtggggcgcggtggctcacgcctgtaatccctgcaccttgggaggccaaagtgggtggatcacttgcggtcagtagttcgagaccagtctggccaacatggtgaaaccccatctcttactaaaaatacaaaaaattagccaggtgtggtagcaggcacctgtaatcctagctactggggaggctgcggcagggagaattgcttgaacccaggaggcggaggttgcagtgagccaaaattgtgacactgcactccagcctgagagacagagtgagactccatctcaaaaaccaaaaacaaacaagcaaacaaacaaaaaaaaccagactggggagtggtggaggatgggtgagagaatgctggtgcacaggggtttatcaaagcatttttctttagccttcctgcaggacccagatgattctgagatttcttctttgtagcaacacagtgttaagctgatcattataaagacttaacgtttaggagaaccagcatttatagagtttaggggcttaggaatttgccagatgtggtacaaagtagttcaactagcagaggacttgtctctttcatgcaaccttttttttttttgagactgattctcactgtcacctaagctggaatgcagtgtcatgatcatggctcactgcagccttgaactcctgaggcaggagaattgcttgaacacgggaggaggaggttgcagtgagttgagatcgtgccattgcactccagcctgggggacagagcaagactccatcttggaaaaaaaaaattcagatttctagcacctaccctctgagattcagattcagctggtttggcttgatgctagaaagccgcatttttaggaagcaccgcagatactggtgctccacgagactcactggttggttagaagtatagattctggagtcatgaagcctggttaagttcagtatttgctttgccacttatccactgtaaatccttggccaagttatttagcatctcttaatttcttcctctggcttgtatcttgtgagaactaaccaagataattcaaataaacatgtggtacactt

SEQ ID NO: 8220 - DNA, 2077 bp, Homo sapiens
aggacacagtgagcgcttcaacgcgctgaactaaacgaatgaaggggaacaccaactcagctgtcacccccgcccccaagtgtcactggctagaagatcttcccccggttcgccggcagcaccggtgggtcttgtcacctctgcgccccgcagccctccggaggctgcagttgctgtctgctgacaggcgtcccctcaggagaacgggagctcctccagcgcagggccctgctcagcacccctggtcccgggggcccccacggaggccgccgcgctcagtgaaactttgccgcgcgcagcagtggccggagacccgcgcggaccctctccccgcggggacccgccagggcgagtcgcccctcccccgcggcagacgacccgacctgggccaaggtcggccaagtgctcgccgcctgcccagcggcccttggacccacaggacccggacccgagtgcgcggaagcctccgagccgcggccaggtctcagaatgcgcggcggggcagcccggcccgtcaagcagcgaagccgaaactagaagcctgaggtctggcttggtcactgtttgctggggaactccgacgagcaactacccttcggggactcagtttcccccgggccaagtgagacggacagctgcggctcccgcgagaactcgcgcgggaacaggagctgcgggctccgcacagcgcccggcacgtagacccagtctactaacgggctggaaggtcgcgctcccgcctccgcgcctccctagaacctttctcacctcaagctcgggctcccggactctctcacctcacggcccctccttccaccttgggccgcccagcctcaaccgccctcacttccgctgacccgccccccggaagcgatcctccgcagctgcgcaccgaggcgcacctccgcgcaccctcaggaggcgggtccagctcggtggcgaggggagcgcggcccccgagtgggcgaggcgctggcggctgtaggctccgataccgcggagcacactcccctccatcgagaccgtgcccccgcggggtctgtgtccccgggaggagttggctgcgtttggagatccctcggcctggtattcgtcgcgtctccctgcttgttgctctccacgtttagccccatccgacttctggaagcccaggggtgtgtcgctcgacccctaaaatatgctcctacccctagggcaaacttcagaatcctcaccctggcccccttcccagttcttggttcccaggcaggtccctttgcaaagcctctctccagcaagaatgcgcagaatgggcctctttctcctcttgactcctgccctccagcactttgcagctttcttctattttagcctctctctctctctctcacacacacacacacacacacacacacacacacacacacacacggtatattcaatgagtttgcttattagatgggtacttgatgtacaagactccagaggctctgtgggaagagccacattccttccaggctcactaacccactccctctttgtgctccagccctcactgtcttggtctgtggcatgcagttcctgggtcacatttccttctctgccttcagcacagcctcgggctgtgcctggctcccaggctggagttccttggttccaaagcctgcagtcccctctgccagagacagagctggtttcatgggtgaacagcccatgcagtcacaacgggccgcatgctcagaatcctgtacttggtttagtactttgctgttgccgtcttgaaatgattttctaataggggttcttgtgttttcattttgcacggggctgtgcaaattatgtgactggtcctggctagagacctcagaggtcgtccaccctgatctccaccatatctcaaacgctgaagattgacttccaggtctggccctcttcccaggatggcacattgtgttttaatcattacctttccctcctgtgcgatggcggatcatgcaagtccacgctggctgtctgtcctgggtgtagatgctgatttggtgtcccactcagatccccttgcaggaagaacggagctccctacctgggaatttccttc

SEQ ID NO: 8221 - DNA, 1073 bp, Homo sapiens
ctagagggcggcgaggtctctccgcgcagcgtcccaggggatgcggcgcgcccccgactgggtgcagcggcaggccgcccccggcagcaagtgccgggtgccatggcaacggcgggaatttcccagtcggggcggccggaagcagccccagccgggctcgcggcagcgaaagcaaaatccgatctctctcccgggggagcaaaatggacgaaaggcgaccccccaggcaggggcgctgggtgccttgggaatccgaggaatcccttctctttgccagtcggaggggactagatggagccgaaggggccggagatgggccgagcgctgccccccgggggtcctcggcgccggacgcagcttacgagcgcaacgcagcaggctccattcccggccgccgccgctcagcccattacgcaaacctggcgggtccaaccaaccccgctctgccgccgctgctggaacccatgaggcgtgcttgcaggcttcgggcactacgcggggctggaaataccacgcactgccccttcgcctagacccccgctcgggccacgcgggttctgccctcaaagctggtagctgccccagacttgggggtggggggaggggaaggggcgaggctggcgccccctcccgcttttggctcccgcgttcgttgcagcagctgttgccaaatgaaccccggaatgcggacgtgcaaaccctccaccccacccccagccacacacgtcgcggtcagagaactgggaagggggcgcggggtccgaggttctggaaaagcaagaactcacctgcaaacaggcagtcctcagctctggacttctggatcacgacgtcgatatccttctgaattcggtcttgccttgaacacatccccattaaataagtccttggaaaagaagcagccgctatttccaccccaaccccctcgcacgctttcagctttcgtaaatattcagttaaaaatgaaacctctggccgaggcaggggctgaaggccaactggtttcggaagtgatcctgggtgagaggaggagaaggaggaggaggaggtggaggtcggctttccatttccag

SEQ ID NO: 8222 - DNA, 324 bp, Homo sapiens
atgctcctcacctcccagacagtttttttttttttttttttttttttgagacagagtctcactctgttgtccagtctggaatgcaatggcacgatctcagctcactgcatcctccgcctcctgggttcaagcaagtctcctgcctcagcctccctagtagctggggttacaggcatgcaccaccatgcccggctaatttttgtatttttagtagagatggggtttcaccatgttggtcaggctggtctcgaactcctgacctcaggtaatccacccgccctggcctcccaaagggctgagattacaggtgcgagctaccgcgcc

SEQ ID NO: 8223 - DNA, 321 bp, Homo sapiens
atgaggcccaagaccctaaggaacagtgcagccaggagtcggaaggagcctgggtttctgaatcatcacatggaggggagctgtcttcagctgggagagctgtcttcagttggatactggtggccgtttgggcatcctgggccagcccaaggacatcttccagtggccgtttgggcatcctgggtggtagcaggtatctccattgcactctatttgccacctcaccctgaaggaaggtacgagggccccttcaaacgccatacaaagaccttccggagtgcccagtgtgcagattgcctggtacaatgtccagcctcccca

SEQ ID NO: 8224 - DNA, 1811 bp, Homo sapiens
gccgccgcggagcgaggttgcctggagagagcgcctgggcgcagaagggttaacgggccaccgggggctcgcagagcaggagggtgctctcggacggtgtgtcccccactgcactcctgaacttggaggacagggtcgccgcgagggacgcaggtgggtgcccttgatccagctcagcccgatggcagaagaggttgacaaaaaagaaagacacctgttggggtggcctgccagacccaggagtggagggctctgagggcccgggaattcggactcaggacagggattctccatggctaggcccagaaacacagggtccaaccactctccagcagggagacctgggggtgaaggggtgagccctgcgcaggtctctgttccttggtcttcactgggcagtgtggagaggtgtggccaggaggagcccgcgtttgtccagaccagggtctactctggcaccagagtgaccacctctgacctctcctttcctcgtcctgggccgggaacgacaccaaatgagggacatggaaagggctggagtaacaagagtcaggcagagcctgaagacttgggtggaacatgggcccttctctggagatcctggcctcccccgttcagtcagggtggagttgctgaccttagtggccggcccagccaggggaaggagtggccatcggcaacccccaccccaaccccaatccctgaggcgcccgctctggctcagccactctgacccctccctcaaattccgaaccctaggtctcagggagggcagtggggctgagtgtctgcccccaggcacattcctacccttctcttggtcattttctgccccagagctggcccacctcagcaatgcgagggctccctggattcctctcccgggtgcctttcagatccaacagaaacagattttttttttcctggaaagcagaactaagagtgggatgaggagcaggggtgggaaggactcaaagtgagaagaagggggcaaagagagtcaggcttggtggctggggtggcttccaagcctcacttctccagtgttcaaagctgaacttcagatggacttcccggctcttcagaatgagaggcctgtggctggggcatgaggcagccccggctgcacctctccttcccgcttccccagctggtagagacgcacaggaaacaagccctcactgaaccaactccagatgctggcacccagagtgggtgttacattgccggcttcttctctagagattaaaccgtcaacccatttagcttatcccttggccaaaaagtgtatgagatgtgcctggatgttccctaaagagcttatctaagaagggaagagaaagccgggaggcaagtaggacagagagatgactggggaaggtcttgtgtctggaagacccaaggaaggggcttctggtgggtcctcagagagagtgtctggcgcatcctcagtggagccttcctcctctactttctaggcacctctgggagggcaggagtgggagcagatgacaaccattttagaaggagccctctggctgggtgcggtggctcacacctgtcatcccagcactttgggaggccaaggcaggagaagcgcttgaggcctggagttcaagaccagcctgtgcaatttagctggatcccatctccaccaaaaaataccaaaattagctgggtgtggtggtgcacgcatgtagtcccacctactcaggaggctgaggaaggagagcctgtgagtttgaggctgcaatgagctttggtggcaccactgccctccagcctggatgacagagtgagatctccatctc

SEQ ID NO: 8225 - DNA, 998 bp, Homo sapiens
cacacagctgcagagatgaataaacaaagaggaaccttctcagaagtgagtctggcccaggacccaaagcggcagcaaaggaaacctaaaggcaataaaagctccatttcaggaaccgaacaggaaatattccaagtagaattaaatcttcaaaatccttccctgaatcatcaagggattgataaaatatatgactgccaaggtttactgccacctccagagaagctcactgccgaggtcctaggaatcatttgcattgtcctgatggccactgtgttaaaaacaatagttcttattcctttcctggagcagaacaatttttccccgaatacaagaacgcagaaagcacgtcattgtggccattgtcctgaggagtggattacatattccaacagttgttattacattggtaaggaaagaagaacttgggaagagagtttgcaggcctgtgcttcaaagaactcttctagtctgctttgtatagataatgaagaagaaatgaaatttctggccagcattttaccttcctcatggattggtgtgtttcgtaacagcagtcatcatccatgggtgacaataaatggtttggctttcaaacatgagataaaagactcagatcatgctgaacgtaactgtgcaatgctacatgtacgtggacttatatcagaccagtgtggatcttcaagaatcattagacggggtttcatcatgttgaccaggctggtcttgaactcctgagctcaagaaatcaacacatcttggcctcccaagttgctgggattactgacacaagccaccgcccctgagtgctcatgtaccatttagcttgtgttttaaaaatctactttttctgccctccctatttttaactagatgatgttttaaaaattacttttccctctctatatagtttgatttaagcattagtcatttacaacaaatattaatattaaaatgcagaccgttatgattggaaaataaatcaatgaacaatataa

SEQ ID NO: 8226 - DNA, 4739 bp, Homo sapiens
attcctggaacctcgttcccaaagcggcagtcgatccctggtctccacggcggtgcagcctcagcctcctcgcttttcacggtcggcttgggcgtcccttcggaatgccttcctcactgatggtgctttattaggattcctcttgtgcttaattacctcctagcctcctgctggcagcggggtgccgcctcctcaccgtaattaggctccgtcgagagccctttcccttcttgccagccccagcaggctcagagttggccgaagccaggggggaggggacggccatgggaacccagcggtgtgacccctgccctcggcgacggggccaaggtcaaggccagagttgttggccagacccacatagaacctcaagacaccccccttatctctctcgcacccggaacgtgagcccagcgcctggacgtggagaattcctatctgaggaggggcgctggggttaggtgccagtgcttgggcccccggcagcctaaaccactcctttaagtggtccgacgggtgctggggaaatgtcccatctggaacccagggatccccccaagagcggcttccctctgctcttagatgcgagaaggaagttctgattttgcggacacccgggaggtggccagggccaggcagactctgccaagtgcccttccagcttctggtccaacgagggaacactttgggatgagagttaccggcttgtcggaactcctctggtgacgatttgtgggtggagcacacacaagtgtagagttatagctgaggtctttacctttccgtcttccaggcagccttctgtgcctctgctctgagaacatgagactcatccttgattctggcacacgggtgttacttggtcacatgaaataaaaggttacgggcatggtggttcacgcctgtaatcccagcactttgggaggccgaggcggatggatcacgaagtcaggagaggaccagcctggccaagatggtgaaaccccgtgtctactagaaatacgaaaattagccgggcatggtggcaggcgcctgtaattccagctacttgggaggctgaggcagagaattgcttgaacccaggaggcggaggttgcagtgagccaagattgcgccactgcactccagcctgggtgacagagccagactccgtctcaaaaaaaaaaaaaagaaagaaaaacagggtcttgttctgttgctcaggctggagtggagtggtgtgatcacagctcactgcagcctcaacctcctgggtcctgggctcaagcaatcctcctgcctctgcttgcctagtagctgggacctcaggcacacatcagcacacctggccaacttttttttgtatgtttttgtagagatgagatctcactatgttgcccagtttggtctcaagctcttgagctcaagcgatcctcccacctgagcctcccaaagcgctgggattacaagcatgagccactatgtctggccctaatggacggtgttagacaatgacaggagtgcacataagagatcaaaactagaacttgcataattagtattatttattaagcacccagagaacagtcaagaccaaagtccctgcttgtccttggaaaaatgtcacctctatagcaggtgtcctaaccctgcagtccacccaccttaggaagtccttgaatagctctctgggggaaatctatcagctgcctgaagagctttgtgtgtatttgtacaccagcattttcctgaggaaggaggtgcctggcttcatcagtttctcaaagggtctaggacctcaaaagggatcagaatctagatatttggataccctattttttttttttttggcagaggtggggtctcgctatgttacccaggctgatctcgaactcctgagctcaaccatcctcctgcattggcctctcaaacagctgggattatagtcatgagccacagcgcccggccctgatacctttacgtcagcatttcccaacatactgtctcagggccacttacctgcaccagaactacctggaatatttaggaacagactcctggcccccaaccaaacctcctgagtcagtgtttcaggggaggggactgggatattttgttttgcaccgactccctaggtgattttgatgcttagccaaatgagaaccattgttcggagctaacatataacacagcaaacaactgtgtctgtgtcctctccttgggagagaactccagaagtaagttgctttgttgcatggggagggggagtgttggaaatcccactgggatgtgtcgtttcccccatatgtggcactaattgagctggaatatccagggagaggcagcagttctagggatgggagcaaggccagccagcctgccagagacacaggtgtggttttggtcggagaatgccatgactgagttaatccctccataccaggttccaccccagctccacaacatcctgtctgtctccccagacaaaccagcccagatcctcctgggccccagaaagatgacacagctgcccccgccccccccatctcctggcctggacccacttggcttcctatcttggaagacaatggttgagattccagggcagaagcatttttaaggctctacctaaaacggccccaccccagcttcattcctcctccatcttgtcccgcacttctgccggcagaccctggtaaagcgtgtcttccaccaggagccccgccttcttgagccccccacagttgccaagttcttctggcagcgcctctaagcggttgcctttgagctccaggcggctgagggctctgagggcacccacgtggggcgagagctggctcagctggttgtcgcccagaagcaacgtccgcagcttgcggcagaagaagagctcttcgggcagggcctccagggcattgtaggagagggccaggtgctgtaggttctgcaggaggcccacctcgggtggcagggagtgtagcccattgtgggacacatccagcagacggaggcctgagcacaggccgagctgggagggcagggtctccagcttgttgtagctgaggtagagctgctccaggctcctgagcttccgcacgtgctcagggacgtaggcgatctggttgtgccacagcctgagcgtgaccagcttccggcagtgctggaagctgaggatttcctcgatggagcgcaggtggttgtccttgaggtcaagttcctgcagcgcacccaggctgaacactgcatgggggatgcgctccagcccgcaggccaccagctccagctcccgcaatgccgccagcttcttgaggctgttcagggcaaccagacgggccccatcgttgtgcaggctgagcctctgcaggtggccagcaacgtcggtcacactggctggcaccttcccggcgttgctccggagggacaacaccttgagctgcttcagctcccggaggctctccagggtggctgcccgagctagctcctgggggaaaagcccctccaggtgcagctcctccaagccccgcagcccaaacacccaaagcggcacctcgcggagctcctcgcatttgacgcgcatcaccttcaggtggtcccgcaggaagacctgcaaggagaagggtagcctggcgggcgagtggagcaagctgagctcctgcaagtgcaccagctgtgacagccccggggggaaggtgatatcgcagatggcctccagcctgagtgactccacctcactgagctcaaagacggtgtcgggcagacccggcagcatgcagagggccagctccagccggcccgcggcattgcgctgcagcttctgtcgaagcttctcgggcgtccactcgtggttgagattgagctgctttagacggctttcgctgacctcggacaggaagacggcgaagcgcttggagtagagggagtcgtactgatcgatgaggtgcagcatgaaggcgaagtcattcttgacgtcaggaatgtcccccatgccagtctcctcccgcacggaacggaaggagtactccttgaggggccggtggaagagccagtagagcgtgtagatgcaggtaagtccgtagatgcacacaaaggagatgtaacagaaggccagcttggagaagaggtgggccttggtgtggttgcagcagaagctggcgtagcccgtgacctctgacgtctccaccctacaggccaccaggaaactgatcttctccacatagaccaggttgtagaccaggatggccaggaacttacacactttcagcaccgtctgtcggatgtacatggtgtacaggatgtcgccctcttccacgtgcatgcggaacttcttcaccttctcaaacagggctttggcttgctcaccctccttcttgtccaacagggtgacaactggaggctcggtcaccaccttctccggttccgccagcactttctccttctcaccctcccctgccttccccggcccggtccctgccatggccactatggtggccgcagcccgttcggtggctgctgggcccttctggttctccccggatacctcggatagggccctggtggtccatggagagtcgaaacacttgcccaggatggagatgaagtgttcaatcttggagctggtgccagggaacttgaaccagaaactggtgcagaccatgaagatgagtgtgtgaatgaccacgaggtaagggaagtacttggcataccagtgcagggccgtctcataacacagctggttaataaagctgtattgctgcaggtcc

SEQ ID NO: 8227 - DNA, 4518 bp, Homo sapiens
cccgcggccgaggggcgggaccggctcggctcccccggcgccgcagcccgcagccccctcccctcgcctcctcgccgctggcggccaccgcgtcgctccggcccgggccccaccccaggcgactctgtgaggagcggccggaggccggaggcggaggtgcaagatggacaacaagagagacaaggcgaaggcaggggccgccgcgcggacgccggctgctcgcgctcctggacttctgacccccaggcccccaggctctcctcgaccccctcccccagtaactcccgcagccctccgagttctgggagctgcgggagcagtggggcgaaagcctctggcagagcgagcggggggcatcggcggggccactattcccgagtctgctccccgagcgggaccaacgcggagtgctgggacaagttcccgaaacccagcctccaggcccccagcctctgggagaggggagagagctcctcctgccaagaacaccagcccaggccctgtttctagcccagggcgtgccagcgggaccaccaggccaggccctcttggccagaagggactccggatctcagcggaggaaactgtggccagaggaaaagctacagaggctcccaaaaggagtgccctcagcgctggggcacggagagacacttccgggcctaccccaggaaccccgtccccggccatggcccgtcggtcccgggctgcgggcaccgaggtggggctcccccggccagctccgagtgcccggccacggcccccgacagagggcccccggaaatcagtgagcagcgcctcggagcacagtaccaccgagccaagcccggctgccaggaggcggcccagcgccggtgggggtctccagaggccggcctcgcgctccctgagctccagcgccacccctctctcctccccagcccgttctgggccctcagcccgcggaacacccagggctcctgcgcatccctcgcagcccaagccgaaaggactgcaggctctgcgaccccctcaggtcacacccccaaggaaggacgcagccccagcactaggaccgctttcttcctctcctttggccacaccctctccatcgggtaccaaggcaagacccgtaccgcctcccgacaatgcagccactcccctgccagccacgctccctccctctccaccggtaacgccccctccgccagccgctctccaaagtcaggccccgcccaccctgccggccacgccccactcgtcgagccttacctgtcagttggccacgccccttcctctagcccctccttctccctctgctccaccttctctgcagaccctcccctctccaccagccacgcccccctcgcaagttccacccacacagctgattatgtcctttccagaagcaggcgtctcttccctggccacagccgcttttgtggcttcagtctctccatcagtttcatcccctctgcagagtatgccccccacccaagctaatccagcgttgccctctcttccgactctcctctctcccttggccacacctcctctgtcagccatgtctcctctacaaggccctgtttctccggcaacatctctggggaattcggcttttcccctggccgcactccctcagccaggcctttctgctctgaccacgccccctccgcaggccagtccttccccgtctccgccctctctccaggccacgccccacactctggccactcttcctctgcaggactctcctcttctggccacattgcctctgcaggcctctccctctcctttgaccacagtctctctgcaggatcctcctctagtttctccctctcttttggcctcaccgcctctgcaggctccgccccacccacaggccccaccttctatgactacgccccctatgcaggccccgccctctctccagaccattcccccaatacaggtcccacattctctgacctcaccgtctctgcaggcacctccctctcctctggctttgtcctctctgcaggccacaacttctttgggctcacccactctgcaggccacacattctttcctgacaatgtcccctaggcaaacccaagcttctttgatctcaccttctcggccggcctctactccccctgattcaccccctctgcaggcccctctttcccttcctgcctcaccccctctgcagacttctctctctcctgctgtctcacccctaagctcacccctgaccatacaccctctgcaggcgctatcttctctggcctcccactctcctcaggcacctctctcttccctgatcatgccccctctggagacccaatcttccctagccccaccctctctgcagacacctcctgcttccctgaccacaccccctctggagaacctaccttctctagccccgcctcctctgcagacagcttctgctcccctgaccacaccccctctggagaacctaccttctctagccccgcctcctctgcagacagcttctgctcccctgaccacaccccatctggagactccaccttgtccagccccatgccctctgcaagcaccaccttcgccattgaccacgccccctccggagacgccctcttccatagccacgcctcctccacaggccccacctgctctggcctcaccccctttgcagggcctgccctctccccctctgtctcctttggccacgccccctccacaggccccacctgccctggccttgcctcctctgcaggcccctccctctccccctgcctcaccccctctgtctcctttggccacaccctctccacaggccccaaatgctctggcagtgcaccttctgcaggcccctttctctccccctccctcacccccagtgcaggcccctttctctccccctgcctcacccccagtgtctccttcggccacgcccccttcacaggccccaccctctctagccgcacctcctctgcaggtcccaccctctccccctgcctctcccccaatgtctccttcagccacgccccctccacaggccccaccccctctcgctgcgcctcctctgcaggtcccaccctctccccctgcctctcccccaatgtctccttcggccacgccccctccacgggtcccaccccttcttgccgctcctcctctgcaggtcccgccctctccccctgcctcactcccaatgtctcctttggctaagccccctccacaggccccacctgctctggccacacctcctctgcaggcccttccctctccgcctgcctcattccctgggcaggcccctttctcaccctctgcctcactcccaatgtctcctttggccacgcctcctccacaggccccacctgttctggcagcgccccttctgcaggtccctccctctccccctgcctcacccaccctgcaggccccacgccgccccccgaccccgggtccggatacctccgtctcgggcccacggctgaccctggcgttggcccccggcccgccgccgccgccctcgcgcagcccgtccagcacgctgagcggcccagacctggccggccacagcagcagcgccacgagcacgccagaggagctgcgtggctacgacagcgggcccgagggcggtgccgcagcctccccgccccccgacgcagagctcgccgcttgccacccggctgcctggagtcgaggccccgctccgccgctggctttccgcggagccccaggtgcgcccctgccgtggcctcccgctaccggaccgggctctgctgacggtctgtgcaccatctacgagactgaagggcccgagtcggcgacccccgcccctggcgcactggatccggggcccagtcccggcacgagcggtgggaaggcggcggctggggccggggccggggcgtcctcgcggagcccgaagcaggcgcgcctgggcgagctgccactgggggcgctgcaggcgagcgtcgtgcagcacctgctgagccggacgctgctgctggcggctgccgagggtgccgcgggcggcagcggcgggggcccaggaggtgcggagggtggtggcgtcacagggggcgcccgggctgcactcagcgacgccgaactcggccgctgggccgaactactgtctcccctggacgagtcccgtgccagcatcacctcggtcaccagcttctctccggacgacgtggcctccccgcagggtgactggaccgtggtggaggtggagaccttccactgagccagaccacagccccgcctgctacaccccacccctgccttaggatccgcccctccgggtacgccgtttgttttagaccccgcctccactgccctggagccccgctgggtggattagtcttagctccctagagcctgagcctttggcctcggaggctcgggacctacccacagctttgacctaggcccgcccctcgagctccgcccctttggcctaggacacgccccgtttccccgagtcccgccccgtgtgcagtgtattgcccaccccgcacagcctgagtttgcaataaaactgggacactgggacttgca

SEQ ID NO: 8228 - DNA, 2889 bp, Homo sapiens
agacaagaaggatggtgctgtggccgagatctgtagatgcacacggctggtaacagagcaaccgggaccaagggacaacaagagctcaggagaaggggagagacaggtcgcccagagagtagacaatccagggcttgaggaggctggctgtgcggtttattttttctctccacaaagacacacactgtctaaactgtgtggctggttgttactaagaagctgctgcgagagggaaaaatgtatttaataaaaggccctgtgtttgtggtcttcttgggcttgctgtgagctctggaaatcttgaggtgtgaccagatttcagccttcaaaaccaagatggactgcccttgagaaggggtggtcagagggaaacatgttcacgctctccctcctgagccggggccacgggaagctgggccaggacaaacagaagttagaagtctactttgaaccagaggattacttgaactggaggtccccagaagactatgttcctgtcagcaaacctcaagataagaacaatgccagtcagcactcctggagcctctttctccctaaaactttcagtactagaaagggtgccctgatcctgtactcagaaggttttgccatttcggcatggacacccaaagagaggagaaaaggcccctactgccccagaggtccctggaggaagctggatcttgaactgcacacacttcaagacctcaaagaagccatcctggcatatggaaggcagcagggagagcaggacagagcctggcaaccatacctccacttccgaagccagctggagagccaggcccaacggcagatccagccagggcattcagccaagagatacctccgaggcctcctgcggacttggcccccagacgccatgtataggctctggtgcgcaggatacatcaaggattctgtgctactccaggacagtcaacttaatgtaccaaagaagctcaggccacaacaagatctttcaggtgtacccccaaaataccatctcctgcctgtcttcccttcattttggattcaacaaggaaaatcttttgaacaacgtcaacagggcctggatgaaggggaagctggagctgctggacacgtggaccagggccctctagccaagaaccatggcagtcaggggactcgcttgccaccacgcaggaagcagccctggcaggaagatgaaacgcaggcagaggacacgtcaatagagaatcacctttgtttatatgcttcaaaggagagctacaatgaaaagacacagcaaacctccaggaaggcctttgggcatggccgcatcgatcactcttggctcccaagtgacaaatcccacattacattctgtggaggcgccttccctaataggaaggcagatctcagcgataaacaaaggaacgtgaaactccacaaggccagaagcagccacttgttacaggtgcttcctgctgaaagaagcctcttccctcctgtagcatctgccactggctccagaataatcacccctggggaagtgaagaagaaaaaggcaccaaaggctttgaaattacctcctatctcagaagaaccacccagagtcttggagcccctgaagagccaatttaaagccaatgagcccccaacagagctcttcatcttaccggtggagattcattaccacaccaaacaacccccaaaagagaaagcccacagaagaggtgctccacaccctgagtcagaaccagaaagcagcgaagaatccacacctgtgtggagacctcccctgaagcatgcgtccttagaaacaccatgggagttaacagtgcatctcccagtggacgcgagcagggacacactctcacctcaaggtagctcctccctccctccagcatccctcgggaacctcactctgaagggaagcaaggcaagacacacaagggtccacagccaaggaaaaggagtctggaagggagatgatgatgccccacctcacgatgtggccccaccattggatcttctacccccgattaaaggaaaaaaaagtcctgagagccagaagggcgtggacagccctaggacatcagaccacaacagccccccaagtctcccgaacatgagagtgcccaggagggcactgccagcagctcaagaagattccagcgaccctacactgggacacttcttgctgggtccagatggagaaaaagtctgcctgtccctcccagggcatacccaaaccgaggcgcttccatcgggtaaagcctatgaatctgtcaattcaaatatcagccatgaagaggaagggcctagtagtcagcatttcctaaaagacatggctgctgctgcttcagaccaagggaaggatgatgacctggagactttctctcctaaaaatagtctttgattaacagagaaatcaaacactgaacctagagccaatcttcacatgaacctttatgaaacctcaccgttgacccaaacaacagagaagcagggagcccagcagtccttggaggcagcagctcagaagacaggagagcctcaaagttgtataaataaagcgctgatatgttcaaacagaaaagaattttacacgcgcaagctgcacatcgacatgacgccgttcctgaaggtgatctcacactgagaagacgaggggttttatagacacaaacacaggaattccagttaatacacttctgcatggtacaaaaacagcttcagaagtccctcagagctcctgcattatcagaagggacagaaaataggcagtttgtagcagatgaagaaagaacaaattaggacagtaatcacagccagccatcggggacaaatcagtcgggtgtctggtttgggtggtgggggacagggaacagagaggagaaagagtaactttaaaccacctcataa

SEQ ID NO: 8229 - DNA, 915 bp, Homo sapiens
gggggagaggtagagatgagacaagaggtagaggggagaggtagaggtagccacgagctgataattacagacaagagatgcggagtatgtgggggctcattatcctgcatagtctatctttgtatatctttgaacttttcaagaataaaaaagcttaaaaagtatacatggcctggtcctaccagagactcacccaatgccagcctccagccagggagagccaagtttgcattttcacacgcatctcacactcctctgcactctcaacttggagcgctccaaacagggaaaccccaagccttgctggcttctgccaaccccctgagcagaagcatgggtccccctgatcaccacctcaccaccctcatcctgatctcactggagactccctttcccggtctgctaagtagcgggtgttttccttgacactaacgctaccgctagaccacggtgggcttggcaacaggtgtcttcccagatgctggcgttaccgctagaccaaggagccctctggtggccctgtccgggcataacagaaagcttgcactcttgtcttctggtcactcctcactgtcccctcagctcccatctctgtatggcctggtttttcctaggttatgattgtagagcgaggattattataatactggaataaagaataattactacaaactaatgattaatgattcatatataatcatatctaagatctatatctagtataactattcttattttatatattttattatactggaacagctcgtgccctcggtctcttgcctcggcacctgggtggcttgctgcccacatccaccaagtgcactttgggaggctgaggctggaggactgctggaggccaggagttcaataccagcctgggcaacatagggagaccccccccccaccatctcc

SEQ ID NO: 8230 - DNA, 2260 bp, Homo sapiens
agttacagagcgactgggaggggacaaaatggagttgaggtttaggggcaccctaaaggtcgtttggaggtctagcaagcacttcatggtctcctccggaaagggccgtggcaaagcctagtaccccgatcaggaagatgacttctggccctcgggatgcggtgagcggcaggaagaggcaggctggggttccgaggaccccagagtccatcacaggagcagatacagtgacctcgggaatcttcccggccccagcggaggcgagcggatagatagccctggctcaaggaaaaaagcgagccgactccaggagctggaatgcccacccaacctcctcccggctcaggtgaggtacgccagtccccctctggaaatggggccctggtaccgacagggcaggggtgccggggccgcaacctccccatccagggatactcaccggaggggcggcccaccgcgtcttcgcagccggccggcgcctggcactcggaaagctcgcaaaaaggaaccgcgtgcccgctagcgctgggacgaggaggagcgcgcggcggaggccagagaaaaagccgcagcggcgcgcgcgcacccggacagccggcggaggcgggactcagcgcgagcccggaaaagacgcgcccggaggggcgggcggagcgggggcgcgcggtggtgtggcagagccagccgaatcgctggctgcagacggctcggcccacccacgcgcccgcccccgctcgcccgggacgtcagtcgaaaaggcggagccgaacgggcttcccggggcgcgggaggggcgctgcgaggaaggcgaggcggctaacggctcgcctcaagttgttgctcccgctggcgatccgcttctgtcagtctcgctgctggtgtcgttgagtgtgtttcgggatgtccttgcgcctaacagcagtgaggcgcagaattggcccacgccctcacctgcggcttgcttcgcaggactccaccccaggataaaagttcccctcgggtcatcttccagctgccctcaaaagacactcatttttgggtttcactgctcctctttaagagagctatcttgaacactttgactaaaagcatcttgctcctgtaagcctgaactaatgcctctcatccgtttatcttgcctcttactgcgttaagatccccgctcactcccactgatgaaatatcacaaggacgcaggattttcacgttgtctttcatttccacgatggtatcatggcaaaaaaacccccaactgataaggaaaagtcaccgcagctttgtgacatcttactagccctgatcattgcttataagccggtcatacgaatgctgttccaacagatgcaagaaattgctattaaaattaaaatgccagcgaactatctgagggcttcaaaagggacagaccataattgcaaatgaggcctgataaactgccaagaatatatcacccaaaaaaataaatctcaagaattcttccagttccctgatgcgtaatggtgaactagcttcctgttcctgatggtaattgacatttcacttcacttgctgatttccattttcccatagaattaccatttgtgcttgtgtgtgtgtatatatatatgtatatataaaatgccttaccacctgagattacaagctagagtagttcttcagtgtgcatcacaattatctggggtgcttgttgaaatgtaggtacctggagctacaacccccaggtattttgattctgatctgggtagggataagaaatttgaatttttaataagcagcccaggtgacactaaaagtggttagctgagagcacagagctatagtttttgtgttactactctaaagccatattaccaattcaatttccaagaaacccacccacttacatataatatacctataaatattgctaagacagtcatgtagcttcctttttcaagattgacctacaaagttcagtacttcaaacaacgagtttaattgtcatgtttattttatgaaatcttgttttaataccagaaataagcaatcatatgtcaggtacgtaattcactgggtaactatgatgtacagagcactatcacctacagttgggttaacacaaatgaaattgaagaaatgaatatcgctgttctcaataaagttagtgtctagttgtggaattaaaatatagatataatacaaacccagtgtagcacataaatcagtgtgctggatgaagatgaaaaagaacttgtaattaaagagtacttttgccagtttc

SEQ ID NO: 8231 - DNA, 824 bp, Homo sapiens
atgttttgttgcttaggatatgaatggctgagcggaggctgtaaaacctggcactctgcttgggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccggtgcacttacaatttggtattacctgggagtgaaaagaaatattacagccatgcctaactgacttcttgaggtcagaatggcggcagtggagcatcgtcattcttcaggattgccctactggccctacctcacagctgaaactttaaaaaacaggatgggccaccagccacctcctccaactc

SEQ ID NO: 8232 - DNA, 1170 bp, Homo sapiens
gctcctacctcccggcagcctctccaggcccagaactttctccagtcagcctctacagaccaagctcatgactcacaatggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaagtcgacctcaccaggcccagctcctgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccaggcccaactcctgtcccaggacgtcatctccgggcccaaaacttactcaagtcaaactctccaggcccaccttctgcttcccggtggcatcaacaggcccagctttgacttgagaacagcctctgcaggccctgctcttgcctcccaggggctttttccaggcccagctcttgcctcatggcagctgccccaggccaaatttctgcctgcctgccagcagcctcaacaggcacagctcctccctcacagtggcccatttaggcccaactcatgactgtgaggccatttccaggcctagtgcctgcctcgtggctgactcttgaagcccaaaacttcctcaaatcaggcttttgcccaacttctgtctactgtcggactctacaggtcagcctctgcctcacagtggaccctccagacccagatggtgtctcactgtggcatcctcaggcgaagctcctgcctttcggcagcctctccaggcccagctcctcctgcctcccagtggcctctttcggcccagcccagctcatgcctcccggcggccttcccaagccccgcttttgac

SEQ ID NO: 8233 - DNA, 2261 bp, Homo sapiens
aatgagaaacccctacacagggctctatgtcccctcgccctctccagtcaaggccaccacaagccaagggaggtctgggcgtgagaggtgagaccccgtgctccccctgccctgggtggaggaagggggtgccctgccaccctgagaacaatggtgtgtgcagaagagaagggactgaaactctttgaagatgttccaggatttagcacccagggagcggcggagactcagccccaccagcctccggcacggagggaggaaagcgttccccaggctgctcaggagaacgtttgttgctgtagtgggcagtcaccttccaaccggggacagtcacccccctgctcggggacagtcacccccccgctcggggacagtcacccccccgctcgggcacagtcacccccctgctcggggacagtcatccccccgctcggggacagtcaccctcccggaatggggcttcctttctcggggctgggaatcaccctggatccctccccactcggggtgctcttgggccatctgagggctcctgggtcactcttgggccttctcagggttcctgggtcattcttgggccatctgagggttcctgagcccaatgacacttctgcctaggctcgcgctgcgggaggaagcagccaggcgaggtcccctccgtgccccggtgcagcctggcctgggagagaggagcccccagcgacaccgagagccaaaacagggcagagtttctcagaggtggcacccggccagggagcccctcgcggctacagggtttctccacggactcggccatctggggagagcagcccagagccctcgagcctcctgctgtattctgtggcctgggacttggggggacccattgaggacactgggacgcagccaaagggaggtgcagacagtgtgtactggcgtttccggggaccaagcccagaaggagcaggacggccacctcctggcctggaggaaaatcctgcttcctggcaagaaaaccacccctagaggaataggactggggtgcaggacgctttctcaggcaaccgcccctttccttctccaaaactggggcaggaaaagagcattcaggccaggcagcgaaaaccccagctctggtacctcccgccccagcagaggccgcctggaggcacggagttccggcctggatgaggcctgggaagcccagcgactcacaggccacggccgcttcccctctccgaggaaggaaaagtccctgcagcgcggcctcggctaaggctccggtgcccaagcaaaggaagggagcgtgcttgcagacgcctcctgctgggagcctgccacgcccgccacaccctgcgcggggacaaagctctccgtggctgtggcagggacacaccgcgtgtgggtggctgcaagccagcagccccgagcggcccctcccgctagactcccagcctgggccctctgtcctccaggcaacgagaacatggatgcctcgcttttcagagactcgcgttcttggaacttacacccttttgggtttgctatttttacccaccctgagccttccggtctccatggcgacgcctccaaacagcagattccaggcggcaatgacgtcatctctccctttcctgccgcccaggccttggaggtactgctgcctggggccgggggtgggggtgggggggctgcagggcttccctggccccctcccatacccacctggtgctcccccaaccagagatccaaggcctgtgggccacggctgcgcctctcctgactccagcttgcccgtctgtccttgggggcagcgtccttccttctctcggccccttggagcagctctgcgggaaccccacagcagcccagcggattgaacgcaaaagacagccaccctcctgctccggatcctgggaggaggctacacgctggcgctgagacagcaacctgcctggcctgggaagccccccgcagcccctacatcagaagcttgctcttggcgcagtggctcacgcctgtaatcccagcactttgggaggctgaggcgggcggatcacgaggtcaggagatcgagaccaacctggctaacacggtgaaaccctgtcgctcctaaaaatacaaaaaaacaaattagctgggcgtggtggcgggcgcctgtagtcccagctactcgggaggctgaggcaggagaatggtgtgaacctgggaggtggagcttgcagtgagccgagatcacactactgcactccagcctgggcgacaaagcaagactccgtctc

SEQ ID NO: 8234 - DNA, 336 bp, Homo sapiens
atggtttcgttgtgggtggaggatactttcctgtcccctggctttgggtttgcccacgtggcttgctctggccttggaatgaagcagaaacgaaaggctgccagttccgagcccacgtctgaagtcgccttaggtggttccgcgggccccgtgcgctcccaccttcacccagagggccttctctggtgcagccgctgcttcttcagcctccgcccaaaaggaacggagccccctggccgatccgcaggcctacagggagccacagagcgcagcggctggaccagcgttcaagcccaagcacaggcctgcgagaaccttgttccagccgccgtttag

SEQ ID NO: 8235 - DNA, 5177 bp, Homo sapiens
agaatgacttccgctcagtgcccggcactagcgtgtgtcatgtccccgctgcgtttctggggcccatggcccctccttatgtggcaactattgtggctactagtcaaggaggctcagcctctggagtgggtcaaggacccgctccagctgacctctaaccccctggggccgcctgagccctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagctgcccctggagccagagcagttcttggcttcacagcaggatttaaaggacaagctgagtccacaggaaaggctccctgtttcgcccaagaagctgaagaaagatccagctcagcgttggagccttgctgagattattggaattatacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactggacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttaaatttccaaggaaactatatttcttacattgatggaaatgtatggaaagcatacagttggaccgagaaactaattctcagagaaaataacttgactgaattacacaaggattcatttgaaggcctgctatccctccagtatttagatttatcctgcaataaaatacagtctattgaaagacatacatttgaaccactaccatttttgaagtttataaatcttagttgcaatgtaattacagaactcagctttggaacatttcaggcctggcacggaatgcagtttttacataagttaattctcaatcacaatcctctgacaactgttgaagatccgtatctctttaaattgccagcattaaaatatctagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccacacattgtcctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactacgttacatcttgccttatttctcagcggtaaacctagatgtgaaatcactgttactaccgttaattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccactttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctgggacccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgcctcattgtgatatgttgtcaccgaaggtcattacaagaagatgaagaaggattctcaaggggcattttcagatttctgccacggaggggatgctcttcgcgaagggagagtcaggatggactttcctcatttggacagccgctctggtttaaagatatgtacaaacctctcagtgccacaagaataaataatcatgcatggaagctgcacaagaagtcatctaatgaggacaagatcctcaacagggaccctggggacagcgaagccccaacggaggaggaggagagtgaagccctgccataggaggagaacacagcccacctcaggcctcctgcaaaaatacatagaataaacaacaacagttactaaataaa

SEQ ID NO: 8236 - DNA, 4982 bp, Homo sapiens
agaatgacttccgctcagtgcccggcactagcgtgtgtcatgtccccgctgcgtttctggggcccatggcccctccttatgtggcaactattgtggctactagtcaaggaggctcagcctctggagtgggtcaaggacccgctccagctgacctctaaccccctggggccgcctgagccctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagctgcccctggagccagagcagttcttggcttcacagcaggatttaaaggacaagctgagtccacaggaaaggctccctgtttcgcccaagaagctgaagaaagatccagctcagcgttggagccttgctgagattattggaattatacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactggacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttaaatttccaaggaaactatatttcttacattgatggaaatgtatggaaagcatacagttggaccgagaaactaattctcagagaaaataacttgactgaattacacaaggattcatttgaaggcctgctatccctccagtatttagatttatcctgcaataaaatacagtctattgaaagacatacatttgaaccactaccatttttgaagtttataaatcttagttgcaatgtaattacagaactcagctttggaacatttcaggcctggcacggaatgcagtttttacataagttaattctcaatcacaatcctctgacaactgttgaagatccgtatctctttaaattgccagcattaaaatatctagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccacacattgtcctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactacgttacatcttgccttatttctcagcggtaaacctagatgtgaaatcactgttactaccgttaattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccactttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctgggacccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgcctcattgtgatatgttgtcaccgaaggtcattacaagaagatgaagaaggattctcaagggacagcgaagccccaacggaggaggaggagagtgaagccctgccataggaggagaacacagcccacctcaggcctcctgcaaaaatacatagaataaacaacaacagttactaaataaa

SEQ ID NO: 8237 - DNA, 3656 bp, Homo sapiens
ctttcacaacagagaaagaggcaactacattgcctggaggaagcctaaggaacccaggcatccagctgcccacgcctgagtccaagattcttcccaggaacacaaacgtaggagacccacgctcctggaagcaccagcctttatctcttcaccttcaagtcccctttctcaagaatcctctgttctttgccctctaaagtcttggtacatctaggacccaggcatcttgctttccagccacaaagagacagatgaagatgcagaaaggaaatgttctccttatgtttggtctactattgcatttagaagctgcaacaaattccaatgagactagcacctctgccaacactggatccagtgtgatctccagtggagccagcacagccaccaactctgggtccagtgtgacctccagtggggtcagcacagccaccatctcagggtccagcgtgacctccaatggggtcagcatagtcaccaactctgagttccatacaacctccagtgggatcagcacagccaccaactctgagttcagcacagcgtccagtgggatcagcatagccaccaactctgagtccagcacaacctccagtggggccagcacagccaccaactctgagtccagcacaccctccagtggggccagcactgccaccaactctgagtctagcacactctccagtggggccagcacagccaccaactctgactccagcacaacctccagtggggctagcacagccaccaactctgagtccagcacaacctccagtggggccagcacagccaccaactctgagtccagcacagtgtccagtagggccagcactgccaccaactctgagtccagcacaacctccagtggggccagcacagccaccaactctgagtccagaacgacctccaatggggctggcacagccaccaactctgagtccagcacgacctccagtggggccagcacagccaccaactctgactccagcacagtgtccagtggggccagcactgccaccaactctgagtccagcacgacctccagtggggccagcacagccaccaactctgagtccagcacgacctccagtggggctagcacagccaccaactctgactccagcacaacctccagtggggccggcacagccaccaactctgagtccagcacagtgtccagtgggatcagcacagtcaccaattctgagtccagcacaccctccagtggggccaacacagccaccaactctgagtccagtacgacctccagtggggccaacacagccaccaactctgagtccagcacagtgtccagtggggccagcactgccaccaactctgagtccagcacaacctccagtggggtcagcacagccaccaactctgagtccagcacaacctccagtggggctagcacagccaccaactctgactccagcacaacctccagtgaggccagcacagccaccaactctgagtctagcacagtgtccagtgggatcagcacagtcaccaattctgagtccagcacaacctccagtggggccaacacagccaccaactctgggtccagtgtgacctctgcaggctctggaacagcagctctgactggaatgcacacaacttcccatagtgcatctactgcagtgagtgaggcaaagcctggtgggtccctggtgccgtgggaaatcttcctcatcaccctggtctcggttgtggcggccgtggggctctttgctgggctcttcttctgtgtgagaaacagcctgtccctgagaaacacctttaacacagctgtctaccaccctcatggcctcaaccatggccttggtccaggccctggagggaatcatggagccccccacaggcccaggtggagtcctaactggttctggaggagaccagtatcatcgatagccatggagatgagcgggaggaacagcgggccctgagcagccccggaagcaagtgccgcattcttcaggaaggaagagacctgggcacccaagacctggtttcctttcattcatcccaggagacccctcccagctttgtttgagatcctgaaaatcttgaagaaggtattcctcacctttcttgcctttaccagacactggaaagagaatactatattgctcatttagctaagaaataaatacatctcatctaacacacacgacaaagagaagctgtgcttgccccggggtgggtatctagctctgagatgaactcagttataggagaaaacctccatgctggactccatctggcattcaaaatctccacagtaaaatccaaagacctcattcttatctgtgtgtctgcattttctaatcctttttgccccaggcaaggtccctgtatctctgagacaccccgattggctggagaattgacttgggagagataaggagggagggcgggtgccagcatgctatgggctcctgcgtgaggcctgtggtacacagagattaggttgtgatacatgaagagccaagagcaggatgaggtggaggcgttacaactacctgctctgtgtgtggggggggaggggggaggggggtacgcatattcacttgaagtcgaggttcccagggcatttccatgtgctccaggcctgactacccatcagggtggaggagctggtgacactcatctccctgagtgctccctggtttcccaagggaaagactttctggcctgctgaggtcgaatcttccaagaggctcttgcaaagacccgagattctcataaatccctgcccagaagagctgcacgtatccctttcatgagtccagggaagagggtcctccaggtcttggaagacagaggggagctgctttagaggctaagttgctttgagcccacaaggtaatggagggctcctacttgggacagagccctcagcagagaattagcagtctgttggtgggttcaccccaactcacagcagtagaaactgctccatcttccaccacttattgggtttctccagtgtcagcaaaccaaagaattggatcttaccaatgcggctataggaaaacagcctgttgcatggtaagagtgataccatcttgaagtgaaaccaccacaatggccattttttttttagatggagttttgcagtggtgcaatcatagctcattgcagccttcaattcctgggctcaggcaatcctcctgcctcagcctcctgagtagctgggactacagtttcgtgtgccaccatgcctggctaatttttagaattttttgtagggacagggcctcactctgttgcacaagctggtcttgaactcctggcctccttgaactcctcctgccttcgcctcccaaagtgctgagattacaggtgtgagccactgcacctcgccagatgtccaatgtctgactcctgcataccaaggtgttctgtatcaagggctttaaaacaatgcctgtagcgtaattaacctctcacaaagatgcttatctaacctccccagcagtcatgggtttcagcaagaaagtctgtgatgtgaccagttgcacatgttttcccctaaaagcttactctagaaaggatattttttggagagggagtgtgggaatccaccatcttgtggccacctcagacatcacttctctttggaagactccattaaatatttctctgtg

SEQ ID NO: 8238 - DNA, 807 bp, Homo sapiens; identical to SEQ ID NO: 8198

SEQ ID NO: 8239 - DNA, 2348 bp, Homo sapiens
agcggctaggagggcggggcgcgtgcgcgcgcacctcgctcacgcgccggcgcgctccttttgcaggctcgtggcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacttttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacagctgctgccacaagggcccctggtgcagtatttggattggccaagggtttcaggacaggaaggaggtgattga

SEQ ID NO: 8240 - DNA, 1273 bp, Homo sapiens
agtgagcggggcggggcacgcggcggaagacagacctcccgccctgggagacagcaccccccgacccccgagagagagatcgacagagaaggggacaagatgcagtcagagaaaccccaaggcctgttcctccaattgaatcccaatgcatcctccactgagactcaactcctggtgccagctctagagagcagagatacacttccacctacccactgtttcatggcaggcactgagtcaccccttgggaatccctggcccctgtccctgcccccaccatgctggacaggatgcgtgctgcctgccccaaggggtcagaggaagccagggcctctagggctcagtatttttatcagcctaggaaacaagagacacagaagcggaaaccatgtggtcagagaaagtgaacagcccttatctcaggggaacccccaccagggctgggggccagacaccaggaagggacgttgaaaagactgtggtccggtgggcccaggtttcagggcttattttgctttggttttatgtaactcttgcagaaggggaaatgatgtgcttaaaaaccagtgagaaatctcctgggtggaggagcaaatttggtcaccagagttttctgtaatttacttctcaacctccagcttagggatcctaaccccaactccccccaaggccaaacctggactctttgcatgccacttccgaaaagctccagcctgtgagaggaaccggacgccagggtcacacacagcttgaagtctcttctctgaatcacagcagcttcctctcacaggatctttctcaccagcccttccccctcctgcaccctgaacatctgcctggtccttcagaggccttggtctcttccgaacttcaggctgtcttattcaaggatctcatgcccacccatgttcccgtgttcccagaggcgtgccctccctgtcttctactgccttccacttccactcctgggattctcctgtagagaactgggctcaaaacctgaaagataagtttctgattgataagatgctctggtgtaactatgcagacagtgcactcaccagcacatgtctgtactctccttgcagccctgtcctttctttttgccaagttcccagttgtgtcctgggcgatggtagtggggtctacctatcttagtttccagggagcccccctctctcctccgtgggaatcccagactctccctccacctctcaggacttcaactactggttcttggaaaaggaaatgtttatagggaaggccatgcctg

SEQ ID NO: 8241 - DNA, 99 bp, Homo sapiens
atgcttaattttgacatttcagcagcaccgaggaagacagcattgatgaagctggaaaccatcattcacagcaaactattgcaaggacagaaaaccaaa

SEQ ID NO: 8242 - DNA, 99 bp, Homo sapiens
atgcttaattttgacatttcagcagcaccgaggaagacagcattgatgaagctggaaaccatcattcacagcaaactattgcaaggacaaaaaaccaaa

SEQ ID NO: 8243 - DNA, 2096 bp, Homo sapiens
atgcagttttacacattgaaaataattctcaatcacaatcctctgacaactgttgaagatccgtatctctttaaattgccagcattaaaatatctagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccacacattgtcctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactacgttacatcttgccttatttctcagcggtaaacctagatgtgaaatcactgttactaccgttaattaaactgccaaccacaggaaacagcctggcaaagattcaaactgtaggccaaaaccggcagagagtgaagagagtcctcatgggcccaaggagcatccagaaaagacacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccactttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgcctcattgtgatatgttgtcaccgaaggtcattacaagaagatgaagaaggattctcaagggacagcgaagccccaacggaggaggaggagagtgaagccctgccataggaggagaacacagcccacctcaggcctcctgcaaaaatacatagaataaacaacaacagttactaaataaa

SEQ ID NO: 8244 - DNA, 4982 bp, Homo sapiens
agaatgacttccgctcagtgcccggcactagcgtgtgtcatgtccccgctgcgtttctggggcccatggcccctccttatgtggcaactattgtggctactagtcaaggaggctcagcctctggagtgggtcaaggacccgctccagctgacctctaaccccctggggccgcctgagccctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagctgcccctggagccagagcagttcttggcttcacagcaggatttaaaggacaagctgagtccacaggaaaggctccctgtttcgcccaagaagctgaagaaagatccagctcagcgttggagccttgctgagattattggaattatacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactggacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttaaatttccaaggaaactatatttcttacattgatggaaatgtatggaaagcatacagttggaccgagaaactaattctcagagaaaataacttgactgaattacacaaggattcatttgaaggcctgctatccctccagtatttagatttatcctgcaataaaatacagtctattgaaagacatacatttgaaccactaccatttttgaagtttataaatcttagttgcaatgtaattacagaactcagctttggaacatttcaggcctggcacggaatgcagtttttacataagttaattctcaatcacaatcctctgacaactgttgaagatccgtatctctttaaattgccagcattaaaatatctagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccacacattgtcctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactacgttacatcttgccttatttctcagcggtaaacctagatgtgaaatcactgttactaccgttaattaaactgccaaccacaggaaacagcctggcaaagattcaaactgtaggccaaaaccggcagagagtgaagagagtcctcatgggcccaaggagcatccagaaaagacacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccactttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgcctcattgtgatatgttgtcaccgaaggtcattacaagaagatgaagaaggattctcaagggacagcgaagccccaacggaggaggaggagagtgaagccctgccataggaggagaacacagcccacctcaggcctcctgcaaaaatacatagaataaacaacaacagttactaaataaa

SEQ ID NO: 8245 - DNA, 2333 bp, Homo sapiens
atggagtttcaccgtgttgcccaggctggtgtcgaactcctgagctcaggcgatccgcccgcctcagcttcccaaagtgttgggattataggcgtgagccactgcacctggcacataaatttccaaggaaactatatttcttacattgatggaaatgtatggaaagcatacagttggaccgagaaactaattctcagagaaaataacttgactgaattacacaaggattcatttgaaggcctgctatccctccagtatttaattctcaatcacaatcctctgacaactgttgaagatccgtatctctttaaattgccagcattaaaatatctagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccacacattgtcctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactacgttacatcttgccttatttctcagcggtaaacctagatgtgaaatcactgttactaccgttaattaaactgccaaccacaggaaacagcctggcaaagattcaaactgtaggccaaaaccggcagagagtgaagagagtcctcatgggcccaaggagcatccagaaaagacacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccactttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgcctcattgtgatatgttgtcaccgaaggtcattacaagaagatgaagaaggattctcaagggacagcgaagccccaacggaggaggaggagagtgaagccctgccataggaggagaacacagcccacctcaggcctcctgcaaaaatacatagaataaacaacaacagttactaaataaa

SEQ ID NO: 8246 - DNA, 1273 bp, Homo sapiens
agtgagcggggcggggcacgcggcggaagacagacctcccgccctgggagacagcaccccccgacccccgagagagagatcgacagagaaggggacaagatgcagtcagagaaaccccaaggcctgttcctccaattgaatcccaatgcatcctccactgagactcaactcctggtgccagctctagagagcagagatacacttccacctacccactgtttcatggcaggcactgagtcaccccttgggaatccctggcccctgtccctgcccccaccatgctggacaggatgcgtgctgcctgccccaaggggtcagaggaagccagggcctctagggctcagtatttttatcagcctaggaaacaagagacacagaagcggaaaccatgtggtcagagaaagtgaacagcccttatctcaggggaacccccaccagggctgggggccagacaccaggaagggacgttgaaaagactgtggtccggtggacccaggtttcagggcttattttgctttggttttatgtaactcttgcagaaggggaaatgatgtgcttaaaaaccagtgagaaatctcctgggtggaggagcaaatttggtcaccagagttttctgtaatttacttctcaacctccagcttagggatcctaaccccaactccccccaaggccaaacctggactctttgcatgccacttccgaaaagctccagcctgtgagaggaaccggacgccagggtcacacacagcttgaagtctcttctctgaatcacagcagcttcctctcacaggatctttctcaccagcccttccccctcctgcaccctgaacatctgcctggtccttcagaggccttggtctcttccgaacttcaggctgtcttattcaaggatctcatgcccacccatgttcccgtgttcccagaggcgtgccctccctgtcttctactgccttccacttccactcctgggattctcctgtagagaactgggctcaaaacctgaaagataagtttctgattgataagatgctctggtgtaactatgcagacagtgcactcaccagcacatgtctgtactctccttgcagccctgtcctttctttttgccaagttcccagttgtgtcctgggcgatggtagtggggtctacctatcttagtttccagggagcccccctctctcctccgtgggaatcccagactctccctccacctctcaggacttcaactactggttcttggaaaaggaaatgtttatagggaaggccatgcctg

SEQ ID NO: 8247 - DNA, 876 bp, Homo sapiens
tctgcgggtggcggcggcgcggggagccggttgcaggccgagatgctgcagatggacctgatcgacgcgacgggggactccacgcctgacgaacccgacgtccatttctccaagaagttcctgaacatcttcatgagtggccgctcccgctcctccagtgccgagtccttcgggctgttctcctgcatcatcaaccgggaggagcaggagcagacccaccggaccatattcaggtttgtgcctcgacacgaagacgaacctgagctggaagtggatgaccctctgctagtggagctccaggctgaagactactggtacgaggcctacaacatgcgcactggtgcccggggcttctttactgcctattacgccatcgaagtcaccaaggagcccgagcacatggcagccctggctaaaaacagtgactgggtggaccagttccgggtgaagttcctgggctcagtccaggttccctatcacaagggcgatgtcgtcctctctgccgctatgcaaaagattgccaccacccgccggctaaccgtgcactttaacccgccctccagctgtgtcctggagatcagcgtgcggggtgtgaagataggtgtcaaggccgatgactcccaggaggccaaggggaataaatgtagccactttttccagttaaaaaacatctctttccgcggatatcatccaaagaacaacaagtactttgggttcatcaccaagcacctcgccgaccaccggtttgcctgccacgtctttgtgtctgaagactccaccaaagccctggcagagtccgtggggagagcattccagcagtttcacaagcagtttgtggagtacacctgccccacagaagatatctacctggagtag

SEQ ID NO: 8248 - DNA, 2183 bp, Homo sapiens
agtaggaactgaagaagatggcgtgcctgggcttcctcctccccgtgggcttcctcctcctcatcagcaccgtggccgggggaaagtacggcgtggcccacgtggtgtcggagaattggagcaaggactactgtatcctgttcagctccgactacatcaccctcccccgggacctgcaccacgccccactcctgcccctgtatgatggcaccaaggcaccctggtgcccgggtgaggattccccccaccaggcccagctccgctcccccagccagcggcccctccgccagaccactgccatggtcatgaggggtaactgcagcttccacacgaaaggctggctggctcagggccaaggtgcccacgggctgctcatcgtgagccgggtcagtgaccaacagtgctcagacaccaccctggcaccccaggatccccgccagcccctggcagacctcaccatccctgtggctatgctccactatgctgacatgctggacatcctcagccacactcgtggggaggccgtcgtccgcgtggccatgtacgcacccccagagcccatcatcgactacaacatgctggtcatcttcatcctggctgtgggcacagtggctgcaggcggctactgggccggcctgaccgaagccaaccggctacagcggcgccgtgcccgaagaggaggggggcctggtggtcaccatcagctgcaggaagctgcagcagctgagggagcccagaaggaagataatgaggacatcccagtggacttcacgccggccatgacaggcgtggtggtcaccctgtcctgctcgctcatgctgctgctctacttcttctatgaccactttgtctatgtcaccattgggatctttggcctgggtgctggcattggcctctacagctgcctgtcacccctggtgtgccgcctgtccctgcggcaataccagaggcctccgcacagcctctgggcctctctgccgctgcctctgctgctgctggcgagcctgtgcacaaccgtgatcatcttctgggtggcctaccgcaatgaggaccgctgggcgtggctcctgcaggacacactgggcatttcctactgcctgttcgtcctgcaccgtgtgcggctgcccactctcaagaactgctcctccttcctgctggccctgctggcctttgatgtcttctttgtcttcgtcacccccttcttcaccaaaaccggtgagagcatcatggcgcaggttgccttgggccctgcagagtcttcaagccatgagaggctgcccatggtactcaaagtgccccggctaagagtctccgccttgaccctgtgcagccagcccttctccatccttggcttcggtgacattgtggtccccggcttcctggttgcttactgttgcccctttgatgtgcaagtctgctcccgtcaggtctacttcgtggcctgcactgtggcctatgctgtgggcctgctggtcacattcatggccatggtcctcatgcagatgggccaacctgccttgctctacctagtgtccagcaccctgctcaccagcctggctgtggctgcctgccgccaagagctcagcctcttctggactggccagggcagagctaagatgtgtgggctcggctgtgccccttcggctggctctaggcagaagcaggagggcgcagcagacgcccacacagccagcacacttgagagaggcaccagccgaggagcaggggacttagacagcaaccctggagaagacaccactgagattgtcaccatatctgagaatgaagccaccaatccagaggaccgcagtgatagccccgagggctggagtgacgcccacttggatcctaatgagctgcccttcatcccccctagggcctcggaggagctgatgccactgatgccaatggccatgctgatcccactcatgcccctgatgccccggccctcagagctgggccacgtccatgcccaagcccaggcccacgagactggcctgccctgggcgggactccacaagaggaagggtttgaaagtaagaaagagcatgtcgacccaggctcccttgtgaactggaggccctgggacacacgcctctcaaagggctggtggaacattgcagagcaaagccatgcatggcaacaagaaatcagggcatcaaagagatttcatatctacccaa

SEQ ID NO: 8249 - DNA, 1273 bp, Homo sapiens; identical to SEQ ID NO: 8240

SEQ ID NO: 8250 - DNA, 2096 bp, Homo sapiens
atgcagttttacacattgaaaataattctcaatcacaatcctctgacaactgttgaagatccgtatctctttaaattgccagcattaaaatatctagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccatacattgtcctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactacgttacatcttgccttatttctcagcggtaaacctagatgtgaaatcactgttactaccgttaattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacccgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgccttattgtgatatgttgtcaccgaaggtcattacaagaagatgaagaaggattctcaagggacagcgaagccccaacggaggaggaggagagtgaagccctgccataggaggagaacacagcccacctcaggcctcctgcaaaaatacatagaataaacaacaacagttactaaatgaa

SEQ ID NO: 8251 - DNA, 470 bp, Homo sapiens
ggtgccagaagcccaggaagcacacatcaaggctcacttgccagcggggtgctgccaataaaatgtagtcacgtggaatttggaatgtggaaaggaggtagaagtcatcctttcctcccccatagcagcaggtgtgcaggctctggtggtcagctggactccatactcccccaccagtcaccagcctggggaccgtggggctgcaaggacctcagcagcggtttcccaagtttcctgacttcttccatcctctggaaatcagctgtggttcgtgagccacacatctccccacaccaagctcctccatacaagacctcggactgcatcagagctatcagcttcccagtttgcacaattcatcaagaaattatgcggggtcactggcacaaatgatgaggcatctcctggaagcttaacttcttatccatcccatctcttggacagatgatgccagttaattactttgaatg

SEQ ID NO: 8252 - DNA, 876 bp, Homo sapiens; identical to SEQ ID NO: 8247

SEQ ID NO: 8253 - DNA, 2139 bp, Homo sapiens
aaacaacaactggaaaagaagcattgcataagaccaggatgtctctgaaatggacgtcagtctttctgctgatacagctcagttgttactttagctctggaagctgtggaaaggtgctagtgtggcccacagaatacagccattggataaatatgaagacaatcctggaagagcttgttcagaggggtcatgaggtgactgtgttgacatcttcggcttctactcttgtcaatgccagtaaatcatctgctattaaattagaagtttatcctacatctttaactaaaaatgatttggaagattctcttctgaaaattctcgatagatggatatatggtgtttcaaaaaatacattttggtcatatttttcacaattacaagaattgtgttgggaatattatgactacagtaacaagctctgtaaagatgcagttttgaataagaaacttatgatgaaactacaagagtcaaagtttgatgtcattctggcagatgcccttaatccctgtggtgagctactggctgaactatttaacataccctttctgtacagtcttcgattctctgttggctacacatttgagaagaatggtggaggatttctgttccctccttcctatgtacctgttgttatgtcagaattaagtgatcaaatgattttcatggagaggataaaaaatatgatacatatgctttattttgacttttggtttcaaatttatgatctgaagaagtgggaccagttttatagtgaagttctaggaagacccactacattatttgagacaatggggaaagctgaaatgtggctcattcgaacctattgggattttgaatttcctcgcccattcttaccaaatgttgattttgttggaggacttcactgtaaaccagccaaacccctgcctaaggaaatggaagagtttgtgcagagctctggagaaaatggtattgtggtgttttctctggggtcgatgatcagtaacatgtcagaagaaagtgccaacatgattgcatcagcccttgcccagatcccacaaaaggttctatggagatttgatggcaagaagccaaatactttaggttccaatactcgactgtacaagtggttaccccagaatgaccttcttggtcatcccaaaaccaaagcttttataactcatggtggaaccaatggcatctatgaggcgatctaccatgggatccctatggtgggcattcccttgtttgcggatcaacatgataacattgctcacatgaaagccaagggagcagccctcagtgtggacatcaggaccatgtcaagtagagatttgctcaatgcattgaagtcagtcattaatgaccctgtctataaagagaatgtcatgaaattatcaagaattcatcatgaccaaccaatgaagcccctggatcgagcagtcttctggattgagtttgtcatgcgccacaaaggagccaagcaccttcgagtcgcagctcacaacctcacctggatccagtaccactctttggatgtgatagcattcctgctggcctgcgtggcaactgtgatatttatcatcacaaaattttgcctgttttgtttccgaaagcttgccaaaaaaggaaagaagaagaaaagagattagttatatcaaaagcctgaagtggaatgactgaaagatgggactcctcctttatttcagcatggagggttttaaatggaggatttcctttttcctgtgacaaaacatcttttcacaacttaccttgttaagacaaaatttattttccagggatttaatacgtactttagctggaattattctatgtcaatgatttttaagctatgaaaaatacaatggggggaaggatagcatttggagatatacctaatgttaaatgacgagttactggatgcagcacgccaacatggcacatgtatacatatgtagctaacctgcacgttgtgcacatgtaccctaaaacttaaagtataatttaaaaaaagcaaaaaaaaaaaaatacaactcttttttttaaaccaggaaggaaaatgtgaacatggaaacaacttctagtattggatctgaaaataaagtgtcatccaagccataaaaaaaaaagaaaagaaaaataaaaataatataaaacctt

SEQ ID NO: 8254 - DNA, 99 bp, Homo sapiens; identical to SEQ ID NO: 8242

SEQ ID NO: 8255 - DNA, 375 bp, Homo sapiens
atgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacttctatccacacagaccgggcaaccatccgatttctcaattttttccccacccttcccgcctttctattccacaaaaccgccattgtcatcatggcccatccccaatgagccgttgggcacacctcccagacggggtcgtggccgggcagaggggctcctcacttcccagtag

SEQ ID NO: 8256 - DNA, 1197 bp, Homo sapiens
actaccctgtggtccctgaggagcattacactgagaagttttctcctattttgtctttcattctccacatcctcttttgttctagtgcatggcatgggaagccctctctaggaggatgctgtggccacacaagcgctggacgaaccgctggagtaggtgacttccaaggtgtcctgatgtagtagctattagacaagctcctgcatttggccagtaattagcatgctgctgcacattgccactaggtggtgctgctgctccattcccaagtaacccacatgcatccctggctggggtcagccttggggtttcccaagtgtagaggaatccatctctgtgcctgtggtaatggctggacaccaggtgagaccctgtctcaaaacaaaacagaaataacaaaaaataaggtgacttgctggaggccacatggctgtgagccaaatacaggtctgggttatcagggctcacatacttctaagtacaccctactgccttggaatctgctgaagaccaagcccctgcccccaagccatggcaaagaaggagggaaggaagcaaaggtgcccagcggggacaactcggggaggggcgaggtgcccagggcccaggaaggccaagcagcatgtggcagggcagcatcaggtgactcccaagaaggaatgaggagaggatgtgaggaaagagccacagcacagaggcctgctgttaggtcagcggagaccacggcccatgggacctggatctacccttgatgctaacaatgttctttggggaaaaaatctataatcacaaagtttctgcaactggactgtagtcatggttgcagaactgtatagatttactaggaaccatcaaattgttcacttacaatgggtaaattgtacagtacataggttatccctcagtaaagctgtatgaaatttatagtcatgaaactaatagtgacaaacgagctgggtaagtaggtctcagctgttctgtaggcactttgagaagaggaagagtagcatctcggttttaataaaagaaagcctggcccatggcgtccagcttctgcttgaatactttcagtgcccgggagctcagtatctcaaagcagcccactcctgtttaagagaactctaaaccttagaatgttgaaatacatcattattattctagtactgctgtgaaaaataaatgtctttgttttgccac

SEQ ID NO: 8257 - DNA, 1115 bp, Homo sapiens
gggtgattggttggttgctgttcctgcccccacgcctgtcgtggtttagctgaactgagctgaaatcctaaaggccgcggagtcggcggtgttgtaggtagcggtaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcggtgtctgggatgttggcagccacttcaaaatcagacctctgtggcagcattttttccagaacacaaaaggtgccagaagcccaggaagcacacatcaaggctcacttgccagcggggtgctgccaataaaatgtagtcacgtggaatttggaatgtggaaaggaggtagaagtcatcctttcctcccccatagcagcaggtgtgcaggctctggtggtcagctggactccatactcccccaccagtcaccagcctggggaccgtggggctgcaaggacctcagcagcggtttcccaagtttcctgacttcttccatcctctggaaatcagctgtgagctatcagcttcccagtttgcacaattcatcaagaaattatgcggggtcactggcacaaatgatgaggcatctcctggaagcttaacttcttatccatcccatctcttggacagatgatgccagttaattactttgaataaatatgggcaaaagcttatcattatcaacaaatgagaagaaagaaaccctatgccaggtaacaccaaagctttggcccagtgccctctgttgaaacatcctaggctttttctttccactcctattacaactgatctgatttggccccttcacacctcactcctagattttgctagacctttctattttgtctccctgaattaagcttttccttttggacactttacatatggattctaaaacaatcctctgcatgtctacacttgcacataatgcaaaaaacaaaataaaataatcttcctgttttgatc

SEQ ID NO: 8258 - DNA, 3656 bp, Homo sapiens
ctttcacaacagagaaagaggcaactacattgcctggaggaagcctaaggaacccaggcatccagctgcccacgcctgagtccaagattcttcccaggaacacaaacgtaggagacccacgctcctggaagcaccagcctttatctcttcaccttcaagtcccctttctcaagaatcctctgttctttgccctctaaagtcttggtacatctaggacccaggcatcttgctttccagccacaaagagacagatgaagatgcagaaaggaaatgttctccttatgtttggtctactattgcatttagaagctgcaacaaattccaatgagactagcacctctgccaacactggatccagtgtgatctccagtggagccagcacagccaccaactctgggtccagtgtgacctccagtggggtcagcacagccaccatctcagggtccagcgtgacctccaatggggtcagcatagtcaccaactctgagttccatacaacctccagtgggatcagcacagccaccaactctgagttcagcacagcgtccagtgggatcagcatagccaccaactctgagtccagcacaacctccagtggggccagcacagccaccaactctgagtccagcacaccctccagtggggccagcactgccaccaactctgagtctagcacactctccagtggggccagcacagccaccaactctgactccagcacaacctccagtggggctagcacagccaccaactctgagtccagcacaacctccagtggggccagcacagccaccaactctgagtccagcacagtgtccagtagggccagcactgccaccaactctgagtccagcacaacctccagtggggccagcacagccaccaactctgagtccagaacgacctccaatggggctggcacagccaccaactctgagtccagcacgacctccagtggggccagcacagccaccaactctgactccagcacaacctccagtggggccggcacagccaccaactctgagtccagcacgacctccagtggggccagcacagccaccaactctgagtccagcacgacctccagtggggctagcacagccaccaactctgactccagcacaacctccagtggggccggcacagccaccaactctgagtccagcacagtgtccagtgggatcagcacagtcaccaattctgagtccagcacaccctccagtggggccaacacagccaccaactctgagtccagtacgacctccagtggggccaacacagccaccaactctgagtccagcacagtgtccagtggggccagcactgccaccaactctgagtccagcacaacctccagtggggtcagcacagccaccaactctgagtccagcacaacctccagtggggctagcacagccaccaactctgactccagcacaacctccagtgaggccagcacagccaccaactctgagtctagcacagtgtccagtgggatcagcacagtcaccaattctgagtccagcacaacctccagtggggccaacacagccaccaactctgggtccagtgtgacctctgcaggctctggaacagcagctctgactggaatgcacacaacttcccatagtgcatctactgcagtgagtgaggcaaagcctggtgggtccctggtgccgtgggaaatcttcctcatcaccctggtctcggttgtggcggccgtggggctctttgctgggctcttcttctgtgtgagaaacagcctgtccctgagaaacacctttaacacagctgtctaccaccctcatggcctcaaccatggccttggtccaggccctggagggaatcatggagccccccacaggcccaggtggagtcctaactggttctggaggagaccagtatcatcgatagccatggagatgagcgggaggaacagcgggccctgagcagccccggaagcaagtgccgcattcttcaggaaggaagagacctgggcacccaagacctggtttcctttcattcatcccaggagacccctcccagctttgtttgagatcctgaaaatcttgaagaaggtattcctcacctttcttgcctttaccagacactggaaagagaatactatattgctcatttagctaagaaataaatacatctcatctaacacacacgacaaagagaagctgtgcttgccccggggtgggtatctagctctgagatgaactcagttataggagaaaacctccatgctggactccatctggcattcaaaatctccacagtaaaatccaaagacctcattcttatctgtgtgtctgcattttctaatcctttttgccccaggcaaggtccctgtatctctgagacaccccgattggctggagaattgacttgggagagataaggagggagggcgggtgccagcatgctatgggctcctgcgtgaggcctgtggtacacagagattaggttgtgatacatgaagagccaagagcaggatgaggtggaggcgttacaactacctgctctgtgtgtggggggggagtggggaggggggtacgcatattcacttgaagtcgaggttcccagggcatttccatgtgctccaggcctgactacccatcagggtggaggagctggtgacactcatctccctgagtgctccctggtttcccaagggaaagactttctggcctgctgaggtcgaatcttccaagaggctcttgcaaagacccgagattctcataaatccctgcccagaagagctgcacgtatccctttcatgagtccagggaagagggtcctccaggtcttggaagacagaggggagctgctttagaggctaagttgctttgagcccacaaggtaatggagggctcctacttgggacagagccctcagcagagaattagcagtctgttggtgggttcaccccaactcacagcagtagaaactgctccatcttccaccacttattgggtttctccagtgtcagcaaaccaaagaattggatcttaccaatgcggctataggaaaacagcctgttgcatggtaagagtgataccatcttgaagtgaaaccaccacaatggccattttttttttagatggagttttgcagtggtgcaatcatagctcattgcagccttcaattcctgggctcaggcaatcctcctgcctcagcctcctgagtagctgggactacagtttcgtgtgccaccatgcctggctaatttttagaattttttgtagggacagggcctcactctgttgcacaagctggtcttgaactcctggcctccttgaactcctcctgccttcgcctcccaaagtgctgagattacaggtgtgagccactgcacctcgccagatgtccaatgtctgactcctgcataccaaggtgttctgtatcaagggctttaaaacaatgcctgtagcgtaattaacctctcacaaagatgcttatctaacctccccagcagtcatgggtttcagcaagaaagtctgtgatgtgaccagttgcacatgttttcccctaaaagcttactctagaaaggatattttttggagagggagtgtgggaatccaccatcttgtggccacctcagacatcacttctctttggaagactccattaaatatttctctgtg

SEQ ID NO: 8259 - DNA, 4982 bp, Homo sapiens
agaatgacttccgctcagtgcccggcactagcgtgtgtcatgtccccgctgcgtttctggggcccatggcccctccttatgtggcaactattgtggctactagtcaaggaggctcagcctctggagtgggtcaaggacccgctccagctgacctctaaccccctggggccgcctgagccctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagctgcccctggagccagagcagttcttggcttcacagcaggatttaaaggacaagctgagtccacaggaaaggctccctgtttcgcccaagaagctgaagaaagatccagctcagcgttggagccttgctgagattattggaattatacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactggacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttaaatttccaaggaaactatatttcttacattgatggaaatgtatggaaagcatacagttggaccgagaaactaattctcagagaaaataacttgactgaattacacaaggattcatttgaaggcctgctatccctccagtatttagatttatcctgcaataaaatacagtctattgaaagacatacatttgaaccactaccatttttgaagtttataaatcttagttgcaatgtaattacagaactcagctttggaacatttcaggcctggcacggaatgcagtttttacataagttaattctcaatcacaatcctctgacaactgttgaagatccgtatctctttaaattgccagcattaaaatatctagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccatacattgtcctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactacgttacatcttgccttatttctcagcggtaaacctagatgtgaaatcactgttactaccgttaattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacccgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgccttattgtgatatgttgtcaccgaaggtcattacaagaagatgaagaaggattctcaagggacagcgaagccccaacggaggaggaggagagtgaagccctgccataggaggagaacacagcccacctcaggcctcctgcaaaaatacatagaataaacaacaacagttactaaatgaa

SEQ ID NO: 8260 - DNA, 1273 bp, Homo sapiens; identical to SEQ ID NO: 8246

SEQ ID NO: 8261 - DNA, 2333 bp, Homo sapiens
atggagtttcaccgtgttgcccaggctggtgtcgaactcctgagctcaggcgatccgcccgcctcagcttcccaaagtgttgggattataggcgtgagccactgcacctggcacataaatttccaaggaaactatatttcttacattgatggaaatgtatggaaagcatacagttggaccgagaaactaattctcagagaaaataacttgactgaattacacaaggattcatttgaaggcctgctatccctccagtatttaattctcaatcacaatcctctgacaactgttgaagatccgtatctctttaaattgccagcattaaaatatctagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccacacattgtcctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactacgttacatcttgccttatttctcagcggtaaacctagatgtgaaatcactgttactaccgttaattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccactttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctgggacccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgcctcattgtgatatgttgtcaccgaaggtcattacaagaagatgaagaaggattctcaagggacagcgaagccccaacggaggaggaggagagtgaagccctgccataggaggagaacacagcccacctcaggcctcctgcaaaaatacatagaataaacaacaacagttactaaataaa

SEQ ID NO: 8262 - DNA, 849 bp, Homo sapiens
gggtgattggttggttgctgttcctgcccccacgcctgtcgtggtttagctgaactgagctgaaatcctaaaggccgcggagtcggcggtgttgtaggtagcggtaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcggtgtctgggatgttggcagccacttcaaaatcagacctctgtggcagcattttttccagaacacaaaagagctatcagcttcccagtttgcacaattcatcaagaaattatgcggggtcactggcacaaatgatgaggcatctcctggaagcttaacttcttatccatcccatctcttggacagatgatgccagttaattactttgaataaatatgggcaaaagcttatcattatcaacaaatgagaagaaagaaaccctatgccaggtaacaccaaagctttggcccagtgccctctgttgaaacatcctaggctttttctttccactcctattacaactgatctgatttggccccttcacacctcactcctagattttgctagacctttctattttgtctccctgaattaagcttttccttttggacactttacatatggattctaaaacaatcctctgcatgtctacacttgcacataatgcaaaaaacaaaataaaataatcttcctgttttgatc

SEQ ID NO: 8263 - DNA, 99 bp, Homo sapiens; identical to SEQ ID NO: 8241

SEQ ID NO: 8264 - DNA, 1445 bp, Homo sapiens
cactatttgtcttgtaattggagtgtctgagtccattatgtttaatgtaattattgacctcattgggtttaagtctgtccattgtcatttgctgccttctaatattatctctttcttgctcaactatttttcttatgttaccttctttagatgaataaaaacctttgcattattgtagtcttctaagtgtcctaattacacattctcttattatttctttaattgtctgagaaagcataatgatctgtgacttattataaccaatagcagaccacaacttccctgactttcacctacctgtgcccacagcccaggggagaatcagtgctctggctctgagacacaggggtggtgggagtaggagagtgattggatgatgaatctgtagctgcagaggcatctgggcccctcacctgcattcctcatagatgtctcctccattgaatgcctgcgatgccctctcctctgtgtgctcctgccagagtctccccatctccactgacagcagctccacccttctgctcactcagtccaatactgtgggtgtccttgattcttcttctcacatccattagcaagtgctgtgagtccatcttcaaattcatccagaatcccttcacttctcactatttcccctgctcacaccctagtcaaggtaagcgacgtctccatcctggaatactgcactcctttcccaccgttttccccactgcctcactagtcccccacctctcaattttgttctcagcacagcagccagaaagaagctttcaaaggatgagccctaccatgtcccacttttcaaaactgtcctccccatgtcattcagagcaaaggtcaacacccttcccacacccttcagggctacctgctctagccacacctttgacctcacttcagtttctctgtgtccagcccttctggcttcttcctccttccaggaacacagacaatttcctgccctagtgcatctgcactgaaggttcccctgcctgaaaagaactttcccagacatccttgtagacaactcctcacatccctcaaatctttactccaaggtcacatttgcaacaaggcccatgctgaccacccagcacaacagccaccttcctgtccccacagcccaccctctggatcacctgccacacagcacttgccaccttctaactcaagcattttctgttcctactctgcttatactatatctatcatctgcctacagaggtgtccaattttttggcttccctgggccagttgggaagaataagcattgtcttgagccacacataaaatacactaatgacagctgatgagcagaaagaatagaaaaaagaaaaacatgtgcgtgcataattttcatgatatttgctaccacagataagcaaaaaaacttcttacattcaaagctgtcccgggccacacgcagcccgagagctgcaggttgg

SEQ ID NO: 8265 - DNA, 876 bp, Homo sapiens; identical to SEQ ID NO: 8247

SEQ ID NO: 8266 - DNA, 2136 bp, Homo sapiens
agctggattcacacacttggatgtagacctcgaccttcacaggactcttcattgctggttggcaatgatgtatcggccagatgtggtgagggctaggaaaagagtttgttgggaaccctgggttatcggcctcgtcatcttcatatccctgattgtcctggcagtgtgcattggactcactgttcattatgtgagatataatcaaaagaagacctacaattactatagcacattgtcatttacaactgacaaactatatgctgagtttggcagagaggcttctaacaattttacagaaatgagccagagacttgaatcaatggtgaaaaatgcattttataaatctccattaagggaagaatttgtcaagtctcaggttatcaagttcagtcaacagaagcatggagtgttggctcatatgctgttgatttgtagatttcactctactgaggatcctgaaactgtagataaaattgttcaacttgttttacatgaaaagctgcaagatgctgtaggaccccctaaagtagatcctcagtcagttaaaattaaaaaaatcaacaagacagaaacagacagctatctaaaccattgctgcggaacacgaagaagtaaaactctaggtcagagtctcaggatcgttggtgggacagaagtagaagagggtgaatggccctggcaggctagcctgcagtgggatgggagtcatcgctgtggagcaaccttaattaatgccacatggcttgtgagtgctgctcactgttttacaacatataagaaccctgccagatggactgcttcctttggagtaacaataaaaccttcgaaaatgaaacggggtctccggagaataattgtccatgaaaaatacaaacacccatcacatgactatgatatttctcttgcagagctttctagccctgttccctacacaaatgcagtacatagagtttgtctccctgatgcatcctatgagtttcaaccaggtgatgtgatgtttgtgacaggatttggagcactgaaaaatgatggttacagtcaaaatcatcttcgacaagcacaggtgactctcatagacgctacaacttgcaatgaacctcaagcttacaatgacgccataactcctagaatgttatgtgctggctccttagaaggaaaaacagatgcatgccagggtgactctggaggaccactggttagttcagatgctagagatatctggtaccttgctggaatagtgagctggggagatgaatgtgcgaaacccaacaagcctggtgtttatactagagttacggccttgcgggactggattacttcaaaaactggtatctaagagagaaaagcctcatggaacagataacatttttttttgttttttgggtgtggaggccatttttagagatacagaattggagaagacttgcaaaacagctagatttgactgatctcaataaactgtttgcttgatgcatgtattttcttcccagctctgttccgcacataagcatcctgcttctgccagatcaactctgtcatctgtgagcaatagttgaaactttatgtacatagagaaatagataatacaatattacattacagcctgtattcatttgttctctagaagttttgtcagaattttgacttgttgacataaatttgtaatgcatatatacaatttgaagcactccttttcttcagttcctcagctcctctcatttcagcaaatatccattttcaaggtgcagaacaaggagtgaaagaaaatataagaagaaaaaaatcccctacattttattggcacagaaaagtattaggtgtttttcttagtggaatattagaaatgatcatattcattatgaaaggtcaagcaaagacagcagaataccaatcacttcatcatttaggaagtatgggaactaagttaaggaaatccagaaagaagccaagatatatccttattttcatttccaaacaactactatgataaatgtgaagaagattctgtttttttgtgacctataataattatacaaacttcatgcaatgtacttgttctaagcaaattaaagcaaatatttatttaacattgttactgaggatgtcaacatataacaataaaatataaatcaccca

SEQ ID NO: 8267 - DNA, 807 bp, Homo sapiens; identical to SEQ ID NO: 8198

SEQ ID NO: 8268 - DNA, 336 bp, Homo sapiens
tgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcccacagtgttacaagggaccagactcaaaattagcagggtggaggct

SEQ ID NO: 8269 - DNA, 381 bp, Homo sapiens
atggagtttgggctgaactgggttttccttgttgctattataaaaggtgcccagtgtgaggtgcagctggtggagtctgggggaggcttggtacagcctggggggtccctgagactgtcctgtccagactctggattcaccttcagtaaccactacatgagctgggtccgccaggctccagggaagggactggagtggatttcatacattagtggtgatagtggttacacaaactacgcagactctgtgaagggccgattcaccatctccagggacaacgccaataactcaccgtatctgcaaatgaacagcttgagagctgaggacacggctgtgtattactgtgtgaaacacacagcgaggggaaatttacaattctat

SEQ ID NO: 8270 - DNA, 312 bp, Homo sapiens
atgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcccacagttgggtcaggcacatattttaaactcaaa

SEQ ID NO: 8271 - DNA, 548 bp, Homo sapiens
tgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaactgggactctggggtcccagacagattcagcggcagtgggtcaggcactgatttcacactgaaaatcagcagggtggaggctgaggatgttggggtttattactgcatgcaaggtacacactggcctcccacagtggtacagccctgaacaaaaacctccctgtggggtggcccagctgcccacatgtggtgcttgtctggggagcagctcagcagggtctcagaatctgtgtaagaggaagatgctgaagaatcacagagttgaaggcaccactacctggttt

SEQ ID NO: 8272 - DNA, 355 bp, Homo sapiens
agcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctc

SEQ ID NO: 8273 - DNA, 764 bp, Homo sapiens
aggagaggggaagagagagaaggagagggaatcccagttcttgcagccactgggaatcaagaggcccaactccgtcttggtcttcaagcaaacaaacaaacaacaatgggccgtgggaagggtgaatgtgggtccagacccacccctcctcagcttcctataaaagctggggaccaggtactgctgatacacacaccatgaggctctccaggagaccagagacctttctgctggcctttgtgttgctctgcaccctcctgggtcttgggtgcccactacactgcgaaatatgtacggcggcggggagcaggtgccatggccaaatgaagacctgcagcagtgacaaggacacatgtgtgctcctggtcgggaaggctacttcaagtaagaggatgtggcctgggacctggtggggaggtggggtgtaccttcagggtggaagagactaccatgctgaggggggatcatcatggttctcaagacgggagcgtgggaagaaatcagtggagagcaggaaagagggaaagaccatcatgagatggagggaacagaaataagtggtgtgatagaaatcattattgtcacagaattctgaaaatgacactgtcctaaagagaaggaaaatgtgggaggggtgagagttaatagactttcttaggcagaagaggggtaaggaaagacactgtggggggcagagaaatagtgagaggggaagaatctaactggcaggaggtggaaatggtggggagtggatagagaaggaa

SEQ ID NO: 8274 - DNA, 939 bp, Homo sapiens
ctggctctgaggcccagaagaatggccagtaaccggcaaagatcactcagagggcccagtcacccatctcatatggaagaacctttcctgcagatggtccaggccagcgagtccctcccaccctcccaaacgtgggctcagcgtgagttcttcctccccagcgagtcctgggagttccctggcttcacccggcaagcctaccaccagctggctctgaagctgccgccctgcacagatatgaagtccaaggtgcgtcagcggctcatccacccttggaagggtggcgcccagcacacctggggctttcacacgtggctcgatgtgtgccgtctgcctgccaccttccccacccagcctgacaggccctacgatagcaatgtctggcgctggctgaccgactccaatgcccacagatgcccccccacggagcaccccatcccccctccctcctggatggggcaaaacagcttcctgaccttcatccactgttatcccacgtttgtggacatgaaaaggaagaagcaggtgattttcaggacagtgaaggagttgaaggaggtggagaagctcaagttgaggagtgaggcaagagcacccccactcgatgcccagggcaacatccagccgccagcgagcttcaagaagtaccggcacatatccgctggtgggaggtttgaaccccagggcctccagctcatgcccaacccgtttcccaataatttcgccaggagctggccctgcccaaaccctctgcctcactaccaggagaaggtgctaaagctggccttgctgcccagcgcgcccctgagccaggacctcataagggatttccaaaccctgataaaggacagaactgccttacccctccaccatctctccaaggcacaagcaagcaaatccccagcaaggaagaggaagagaagacctggacacttctag

SEQ ID NO: 8275 - DNA, 1176 bp, Homo sapiens
aatccacaaactgccatctactagtccatttgtgagctggctggtaaattcaccttcctgggcctcagtttcttcatcagtaaaatgggataatgatggtgccttcctagttgggttgtggtgaaggttaaatgagatgccatgtagaagtgcagaggagaagggctgctataaggggctccaggtgggtgctgctgttatgattgggcacctactgcatgctgtgtccctgcatacaggagtcgacctttgagacctgcttgttcatggctgtttcacagatgtcgaagtggaggctcagcagggttggaggttcccggagtctcccagctgaaatggaagtgcttggtgaggtttggtgtgtccgagccgaagagcagccaatgacaggcctggggatcgtctggcacagcccacttcttgacaaggccttggaaacttggtctctgcagcagcaaccggatttcagcctgggcctcggacacctcggcctgggtacggatgcgacttggatgcagtccttccctggcagtggaggggatgcccaggctggcacaggagtctcgggtcttctccggctctaccccaatctgctgtgtgattttgggcccaggcagggacccctctgggctctgttactggagaaaaggcaaatggctgggacgggtgggtccccagccctccttgcctggaggtctgcgagttggagggctctggggtaaagccagagccgggcccggggagagcctaggctcatctctggtgaacagggtaccctctagccaaagcaggggcaaggcgaggcacatgcccctcatatgggagctggggctgaccccctctcctagccctgcacaccttgagcacatggccttggcccatctgccctgtgggtggacactttccagccctgggtcctgaactctaccaatcagcaggaacctagactcctgaggggtgcagcctggatgggaggtcagggaactgggttcctgagcgcatctctgtgccattcatctctccattggtttcccaaatgtggactgagcacacactgtgagtcaggcctgagctaggttctagggatgctactgtcaacaagacagatgaaggttcctgccctcatggaggggagggagacaataagcaaagaaataaatgcatgatgtaatgtca

SEQ ID NO: 8276 - DNA, 537 bp, Homo sapiens
aggagtcgacctttgagacctgcttgttcatggctgtttcacagatgtcgaagtggaggctcagcagggttggaggttcccggagtctcccagctgaaatggaagtgcttggtgaggtttggtgtgtccgagccgaagagcagccaatgacaggcctggggatcgtctggcacagcccacttcttgacaaggccttggaaacttggtctctgcagcagcaaccggatttcagcctgggcctcggacacctcggcctgggactgtacatcttggcctcttacctactgtgtccgcgtcagcctccctcacagcctgatggcccctgcggcagccccaacccggtttcaggggctaagaaaactacagttgcatgaacgggtggaggtgagtgggaggcagaagcggcggggagaaccagtctgttccgagatctctggaccaaccagtggatcctgatggtcagccttgtctagagccccttccagcgtgcaggccagtcctcctggcattcttctaattacaccgagctgtgagtta

SEQ ID NO: 8277 - DNA, 1175 bp, Homo sapiens
aatccacaaactgccatctactagtccatttgtgagctggctggtaaattcaccttcctgggcctcagtttcttcatcagtaaaatgggataatgatggtgccttcctagttgggttgtggtgaaggttaaatgagatgccatgtagaagtgcagaggagaagggctgctataaggggctccaggtgggtgctgctgttatgattgggcacctactgcatgctgtgtccctgcatacaggagtcgacctttgagacctgcttgttcatggctgtttcacagatgtcgaagtggaggctcagcagggttggaggttcccggagtctcccagctgaaatggaagtgcttggtgaggtttggtgtgtccgagccgaagagcagccaatgacaggcctggggatcgtctggcacagcccacttcttgacaaggccttggaaacttggtctctgcagcagcaaccggatttcagcctgggcctcggacacctcggcctgggtacggatgcgacttggatgcagtccttccctggcagtggaggggatgcccaggctggcacaggagtctcgggtcttctccggctctaccccaatctgctgtgtgattttgggcccaggcagggacccctctgggctctgttactggagaaaaggcaaatggctgggacgggtgggtccccagccctccttgcctggaggtctgcgagttggagggctctggggtaaagccagagccgggcccggggagagcctaggctcatctctggtgaacagggtaccctctagccaaagcaggggcaaggcgaggcacatgcccctcatatgggagctggggctgaccccctctcctagccctgcacaccttgagcacatggccttggcccatctgccctgtgggtggacactttccagccctgggtcctgaactctaccaatcagcaggaacctagactcctgaggggtgcagcctggatgggaggtcagggaactgggttcctgagcgcatctctgtgccattcatctctccattggtttcccaaatgtggactgagcacacactgtgagtcaggcctgagctaggttctagggatgctactgtcaacaagacagatgaaggttcctgccctcatggaggggagggagacaataagcaaagaaataaatgcatgatgtaatgtc

SEQ ID NO: 8278 - DNA, 611 bp, Homo sapiens
aatccacaaactgccatctactagtccatttgtgagctggctggtaaattcaccttcctgggcctcagtttcttcatcagtaaaatgggataatgatggtgccttcctagttgggttgtggtgaaggttaaatgagatgccatgtagaagtgcagaggagaagggctgctataaggggctccaggtgggtgctgctgttatgattgggcacctactgcatgctgtgtccctgcatacaggagtcgacctttgagacctgcttgttcatggctgtttcacagatgtcgaagtggaggctcagcagggttggaggttcccggagtctcccagctgaaatggaagtgcttggtgaggtttggtgtgtccgagccgaagagcagccaatgacaggcctggggatcgtctggcacagcccacttcttgacaaggccttggaaacttggtctctgcagcagcaaccggatttcagcctgggcctcggacacctcggcctgggactgtacatcttggcctcttacctactgtgtccgcgtcagcctccctcacagcctgatggcccctgcggcagccccaacccggtttcaggggctaagaaaactacagttgcatga

SEQ ID NO: 8279 - DNA, 2124 bp, Homo sapiens
atggtggacccagtgcctgaagaagagaaggcaggagcggaacccggcgactctggaggggacgaggccgtggcgtccgtgccccctgattcccagggcgcacaggagcccgcagcttcctcggcctcggcctcggcctccgcggcggtgccccgcaaggcagaagtcccatgtgcagccgcagaaggcgggcggcgggagcagtccccgctgctgcacctcgacctcttcaacttcgactgcccagaggcggagggcagccgctacgtgctgaccagcccccgctcgctagaggcctgcgcccgctgtgcggtcaagccggtggagctgctgccacgggccctggccgacctggtgcgagaggctccgggccgctccatgcgggtggccaccggcctgtatgaggcctacgaggcggagcggcgcgccaagctgcagcaatgccgggccgagcgcgagcgcatcatgcgcgaggagaagcggcgtcttttcacgcctttgagccccgcggccgccgccgccgccgccgccgccgcggcctcggccccgagcgcgggcagcagcagcagctgcagcagcgccagcctcccggcctcgcccgcgccgcgtgcggcccgcaaggcttcccctagtccctcctccgcccggacccaacctccgccagcgggttctcgaacaggcaggaagagccattcgctggactcactgtcccgccggcgtgagggcgccctcagctccgagtcgggcgcatcgtcgtcatcctacagtggggaaagcttgagggagctgcgctggccgcctcgggcctcggccaggaacagctgcccagcggggtcggcgtcctccaccaccaacgctccgggccgcccgtctgccctgaccctggttccgatcaccggccgcagcttcagcctcggcgacctgagccattcgccgcagaccgctcagcacgtggagcgcatcgtgcgtcaagtgcgtgcagagcgcggcctgcgcggggtgccggagcgtgaccggaagatcgcggcgctcatgctggcgcggcaccaggaggagctcctgctgctggagcaacgcgcggctgcccacggccagtgggagctgcagcgcgtgcacgccaagcagcggcgggagcgcgaggagcgggagaagcagcgcgccctagagcagggccgccgagcctgggccgcgcaggtggaggagcggcgaggccgccgtggccgcgaagagcgcgaggcggcgcggcggcggcagcggcagtacgagcgcagcgaggagcggcggcgggagctggccgaacgccagggcctcctgcggcgggagcgggcggagcgcgcggcccgggaggatcggctgcgcaagcttcagcaggagcagaacctgaagcaacgtgaggaaggtctacaggaagggcgggagcgggctgagcagatccgcagggagcgcgcccagcgcgcggcccgcgccaagcagcggcaggagggccagctgcagcgggagaagcgggagctgagccgggccgagcgggcgcgccacgaggcgctgctacagggtcggacccggcagcagcgccaggagcgagagggcctgcggagctcgctggaagccagtttgggccgtgcgcaggagaactacgagcatttggtggagcagcgcacccgggagctgcgggagcgggcccggcgagaggagctgcagggtcggcgggccaaggaggcggcagagcgcaaagagcgggaacatcaggcgcacctggaggcgctggcccgggcgggggagcgacggctgcagcacgcgacgcaggtggccgaggaagcagtgcagcagaaggcgcggcgcgtgggccagagccggctggagaaggaacgagcccagcgcgccaacaaggagaaggtggagagggacgaagactgccgccggcgagagctactccaggccatcgggcgcaagctggagcgcagcgagcagctgacgcgggaacggcgcagtgcgctggagagcgcccgctccacagcccgggcttccttccacgtgcgtgagaaggtgcgcgaggagaccaacacgcgatccttcgaccgcatggtgcgggaggcccagctacacgccagcctggaccgcaaataa

SEQ ID NO: 8280 - DNA, 1257 bp, Homo sapiens
ccataaacaaaaaactaaataaatttattccataaagattttaaacttctacaattcattaaaaagacataaattcaaaagtcaaaatggtaaaaatattcacaacatatgacaatcaaatggttaatttccttttataaagagtttataggaataaatgagaaagaagtaaacccaaataaaagtagacaaaggtcatgagcagttcatttaaaaagaaatacaaatatctataaacatacgaaaagataatcaccttaatatcattaataattaatattttctcccacatcagcaaaaatctgcatgtttgttaaagctgagtgttttaagggtgtgatgaaatggacaccattacacaggactgcctttcaggaaggttctctgccactggaaaagggtacagcttttctagagggcaataggtgatttctattaaaatatcaaagacacactccttgcccttgtacttcaactatttatctgggcttagtacaagttctcctagctacatgtacaaggatgctactgcaacatcatgccttagagaaaaaggcatagtatatttggtattgtaccaatgtcaatttcccagaattgatattatactacagttgtcaccactgggggaagagtactcagggactctatgtactacttttgcaacttcctatgagactataattacttcaaaataaaaagtgtttctttaaaaaaatcatggtgcataagtatttatggtttcttacaaagtatgaaaaggtaagggcaatccttgtttaattaaattcaaaatgagtgagcagaacatatgtaaccagaaggacaaatccacccttcccttttgtcaagcacatctgtgtgaagagaccaccaacaggctttgtgtgagcaacaaggctgtttattcacttgagtgcaagtgggctgagtctgaaaacagagtcagtgaagggagatggggaaggggttgctttataggagttgggtaggtaatggaaaattacagtaaaaagtggttatctattgttagcagaggagggggtcacaaggtacatggtggggagatgataagacccattgtccagaagaagactgtcacaaggtcgattgatcagttaaggtaggacagggacaggtcacaatggtggaatgttgtaatgttggttaatcagttaaggcaggaactggctgttttacttcttgtgtggtttttcagctgccccagacttcttggctcctgcaggccatctggac

SEQ ID NO: 8281 - DNA, 950 bp, Homo sapiens
agcgggacgggcgggcgcgcgggcgttgttgggctcctctgagcggttgaggttggggctggggttgagctcgggttgggttcctcctggggcaggagggaaaggcgggagccagggcgtcagggcctgcggacgatgtgtgtgtgaaagggcgcgtcagccataagaagccatatgcgtgcgagccggtccccaccgtccccgcggcgttgtcaccatcatcatgaggccactggagcagcctcaggcgctgctgccggggggccgggcgcggggtgcgtcgggctctgcaggttggcactcacacccagcgcgcaggatggcaggaatagcacatttcaaacctacaagaaagaagtgtgcctcccccgtcattcgatgcaccctggcccctgggccatctgctgtgaatgccagaccagattcgggggccgcctgcctgtgtccagggtggaagcagcactgccttactgggtccctctgtccctgagaccccgaaagcagcacccctgctggatgcatgctgctggcacaactgctggcggatctgcggtgatgagtgcctgttgtccaagttccagcagctccaggccccctaccaggaccagctaccggctcctgcagcgcgtctgctgcccctcggcctcctgaccctcctccaggccatcccgagggtcatcatggccattcgccagtgttttggggtttgaagttggaatcttcagctactgtcaagaacagccacaaaaatgtgtcacgatcaagatctttgagagtccaccaatcaggaggcgtctgtgacagtcgctgtcttctcagaacagaatccacacccaggattcaacccaaatgatttctcatcaggtgattcttggttgtagcaaagttcatgtgaatgtgggtgagtttctgttatgaatgtggtcaataaatgttatttgtgaaactct

SEQ ID NO: 8282 - DNA, 1668 bp, Homo sapiens
atgaggaggccgtccacagcgtcactaacgcggacgccgcccagggcatcgccaacgaggatgccatccagggcatcgctaaagatgacaccgttcagggcatcgctaacaaagatggagtctacggcattgctgaggacgctgcccagggcatcgctaatgaggacgccgaccagggcatcgctaatgaggacaccacccagggcatcgccaacgaggaagccgcccagggcatcgccgaggacgccatccagggcatcgccaacgaggaggttgcccagggcatcgccaatggggtcgccgcacagggcatcgccaatgaggacgccacccagggcatcgccaactgggacgccgtccacggcttcgccaacggggacgccgtcctcagcttcgccaacggggacgccgcccagggcatcgccaacggggacgccaccaagggcatgggcaacgaggtcaccatccacggcatcgctaacgaggacgccgtccagggcatcgctaacgaggtggccgcccagggcatcgccaacgaggacgccgcccagggaatcgccgaggatgtcgcacagggcatcgccaacgaggacgccgcccagggcatcgccaacaaggaggccgcccagggcatcgccaacgaggacgccgcccagggaatcgctgaggacgtcgcacagggcatcgccaacgaggatgccgcccagggcatcgccaacgaggaggccgcccagggcatcgccaacagggtcgccgcccagggcatcgccaatgacgccacccagggcatcgccgaggacaccgcccagggcttcgccaacgacgacgccgtccagggcatcgctaacgaggacgccgtcctgggcatcgccaacgacgacgccgtccagggcatcgctaatgaagatggagtccacggtatcgataacgaggacaccgcccagggcatcgccaactgggactccgtccagggcctcgccgacggggacgccgtccagggcctcgctgactgggtcgccgtccagggcctcgctgacggggacgccgtcaagggcatcgctgatcgggacgccgtcaagggcatcgctgacggggacgccgcccagggcatccctgacggggacgtcgtccacggcatcgctgacgaggacaccatccagggcatcgctgacgaggacgcagtccagctcatcgctgacgaggaccccgtccatggcatcactaacgaggacgccgcccagggcatcactaactaggacgccgcccagggcatcgctaactaggacgctgcccagggcatcgctaacgaggacgccgcccagggcatcgctaacgaggacaccgtccatggtatccctaaagaggtcaccgtccagggcgtcactaacgaggacgccgtccagggcgtcgctaacgatgacgccgtccagggcgtcgctaacgaggacgccgtccacggcgtcgctaactgggacgccgcccacggcgtcgctaacgaggacgccgcccacggcatcgctaacgaggtcgccgcccacggcttcgctaacgaggacgccctccacggcatcgctaacgaggatgccgtccacggcatcgctaacgagaaaatcaaatgttaaccagcagtgccctgcttcaacaccatcatcggaagtcataagttga

SEQ ID NO: 8283 - DNA, 2153 bp, Homo sapiens
aggctgtgcatgcctgtgtactgcaagtaccagttccataagactccagttcacaagaccaagggggagccccatggaacccacgtttatttccaggacatcaacgtcatcttccttggggcactgcaccccagtgacctaagggaatacctggagggcccccccatggtggtggaagttcacgaccgggaccgcaagtcagaggagtgttctcagaagcccgtgctgtttggggaggaccctctggattcatacctcaacttccaggccctcatctctcccagagagacagagaacaacccctttgagtcccagaacaagatgtggtacccttatggcatcgcccaggtcagttttgctgacctcctccttggccacaagtacttgaatctggccgtccccatccacagctgtgaggttcagcccacacactgcggccaggacagcaggagaaggaaggttgtggggcttggggtccccagagatggccaccagcacggcccaatgcccaggggcaactacctagaggctgactcccagctcaagttgcgagtggacatcgcggtgccactgagggccggggccagagctgctgatcctgaccttgggggctcccagtttggccgcatcatcttcgtctttgactttaagaaggtctccctgctccacagcctgctgcaggacatcaccatgatcaacgctaaggccctcggcctggactcctaccctgtcaggaccctgcagcagatcctgtcagccttcaaggtgcgtgtgcgggtccaggagcagcagcacctggatgtgctcactggcttccacctgctggacgggaagacacaccttttcatcctggaaggcctggccgaccaaggcttgaggcagctgtgggagaaccaccaaagctggattcccaggtcagaacacaggaaatacaaggtgctgtacaactcacagctgctgttccgcagccggctctatggggacctggaggccatcctgtaccacgtgcacctcttccagcccacggagctgctgctgcagcaggcggtgttcttcctgcgagacactgagcggaggcgggtcttccaggctctagccaggatccacgacatctgctataacagcaccaccctctgggacgtgacggtgagggacctgctgccctcctctgctatgataaaagacttgagccaagagtttgggatgcccctttcgcaagaagaactcacagatgagaaactgtttgccctaccacctcagcctgcccccaatcttgaggactaccacagtcggaactccaccctcaccttagagatccacgcccaccaggagccaagaaagagattcacgtactcacaggattacctctcagccatggtggagcccctggacttgaaggaagaggagaagaaagcccagaagaaatcccgccaggcctggctcacagccaggggattccaagtgacaggtcttcagagcgacaccgaaagcagctttcaggatctcaagctgccacccatcaaagagctgaatgaggagtggaaggaaaactccctgtttgctaatgtactggagcctgtgttggatcgagacaggtggagctgggacaggcaccacgtggactttgatctgtacaagaaaccaccacctttcctcgagctgctcccttcgcccgcaccaaagcctgtaacagtcaggaagaagaaagggaacagccccatctcctgagcagcacagaccctcccacggccaccgcatggtgaacctgcacagcctcccccacacccgaccacaccctcctcaacaatcaacttcattaaagtgcagcaggacagatggcagcagccaggccctgtgtgaggctgggctgggctcacctcgtggtcgtggttgcggagcccaatgcggatggagcggctggcccgcgacagcacggccgtcatgccatacaggttgatgaggatgttggccacccgcttcagtaccagctgctcctccatgatggtctgggatcacagaggctccaagtggggactcactacctagaccagtcccccacatggtccctccctgggctgcatctttgcctgtcttagtctcctgtgttccttgagaaagtggagtcaataacacctttctcttcaggttgtggg

SEQ ID NO: 8284 - DNA, 2291 bp, Homo sapiens
gagcgctttctccatccagctggccgtcatgccgctccttgccgagatggggtttcacaattttggccaggctggtcttgaactcctgacctcgtgattgtcttacatgtccgtgtgaagagaccaaacaggctttgtaggctgtgcatgcctgtgtactgcaagtaccagttccataagactccagttcacaagaccaagggggagccccatggaacccacgtttatttccaggacatcaacgtcatcttccttggggcactgcaccccagtgacctaagggaatacctggagggcccccccatggtggtggaagttcacgaccgggaccgcaagtcagaggagtgttctcagaagcccgtgctgtttggggaggaccctctggattcatacctcaacttccaggccctcatctctcccagagagacagagaacaacccctttgagtcccagaacaagatgtggtacccttatggcatcgcccaggtcagttttgctgacctcctccttggccacaagtacttgaatctggccgtccccatccacagctgtgaggttcagcccacacactgcggccaggacagcaggagaaggaaggttgtggggcttggggtccccagagatggccaccagcacggcccaatgcccaggggcaactacctagaggctgactcccagctcaagttgcgagtggacatcgcggtgccactgagggccggggccagagctgctgatcctgaccttgggggctcccagtttggccgcatcatcttcgtctttgactttaagaaggtctccctgctccacagcctgctgcaggacatcaccatgatcaacgctaaggccctcggcctggactcctaccctgtcaggaccctgcagcagatcctgtcagccttcaaggtgcgtgtgcgggtccaggagcagcagcacctggatgtgctcactggcttccacctgctggacgggaagacacaccttttcatcctggaaggcctggccgaccaaggcttgaggcagctgtgggagaaccaccaaagctggattcccaggtcagaacacaggaaatacaaggtgctgtacaactcacagctgctgttccgcagccggctctatggggacctggaggccatcctgtaccacgtgcacctcttccagcccacggagctgctgctgcagcaggcggtgttcttcctgcgagacactgagcggaggcgggtcttccaggctctagccaggatccacgacatctgctataacagcaccaccctctgggacgtgacggtgagggacctgctgccctcctctgctatgataaaagacttgagccaagagtttgggatgcccctttcgcaagaagaactcacagatgagaaactgtttgccctaccacctcagcctgcccccaatcttgaggactaccacagtcggaactccaccctcaccttagagatccacgcccaccaggagccaagaaagagattcacgtactcacaggattacctctcagccatggtggagcccctggacttgaaggaagaggagaagaaagcccagaagaaatcccgccaggcctggctcacagccaggggattccaagtgacaggtcttcagagcgacaccgaaagcagctttcaggatctcaagctgccacccatcaaagagctgaatgaggagtggaaggaaaactccctgtttgctaatgtactggagcctgtgttggatcgagacaggtggagctgggacaggcaccacgtggactttgatctgtacaagaaaccaccacctttcctcgagctgctcccttcgcccgcaccaaagcctgtaacagtcaggaagaagaaagggaacagccccatctcctgagcagcacagaccctcccacggccaccgcatggtgaacctgcacagcctcccccacacccgaccacaccctcctcaacaatcaacttcattaaagtgcagcaggacagatggcagcagccaggccctgtgtgaggctgggctgggctcacctcgtggtcgtggttgcggagcccaatgcggatggagcggctggcccgcgacagcacggccgtcatgccatacaggttgatgaggatgttggccacccgcttcagtaccagctgctcctccatgatggtctgggatcacagaggctccaagtggggactcactacctagaccagtcccccacatggtccctccctgggctgcatctttgcctgtcttagtctcctgtgttccttgagaaagtggagtcaataacacctttctcttcaggttgtggg

SEQ ID NO: 8285 - DNA, 532 bp, Homo sapiens
gattgccttttgactttaaaaacagaagttccgatcatgaccgaggagcaaaagcaggatttaaatcccctgaccataaagatcaagtgtgcttcctgccttccatcacagcctgtacccattcaggaactagagaggctgtgcatgcctgtgtactgcaagtaccagttccataagactccagttcacaagaccaagggggagccccatggaacccacgtttatttccaggacatcaacgtcatcttccttggggcactgcaccccagtgacctaagggaatacctggagggcccccccatggtggtggaagttcacgaccgggaccgcaagtcagaggagtgttctcagaagcccgtgctgtttggggaggaccctctggattcatacctcaacttccaggccctcatctctcccagagagacagagaacaacccctttgagtcccagaacaagatgtggtacccttatggcatcgcccaggtcagttttgctgacctcctccttggccacaagtacttgaatctggccg

SEQ ID NO: 8286 - DNA, 3657 bp, Homo sapiens
tccctgtcctgtaataactgtagagcactttaaagaatcactgggtgttaaaggccttccgctgtatccagacccctccagagtacctggcacaaagactcagaacaacttagaatctgactacttggccagagatggcccttcaagcaacagctcattccacagcagcgaagaggaagggactgaccttgaaggagacatgctggactgcagtgggtctcggcctctccttatggagtctgaagaagaagatgagagctgcagaccccccccggggaagctgggaggagccgttccattcgctccaccagaagtctctcctgagcaagcaaagacagtgcaaggtggaagaaagaaccagtttcaagccttcacacagccagccactgatgggctcagtgagccagatgtttttgccatagctcccttcaggagctcaagggttccaaatgatgacatggacattttctccaaagccccatttgtctccaagagcagtatggctccttcccagccagaggagtcagacgtgtttttgagagctcctttcactaagaagaaaagcatggaggagttaacagttatccaatgcacctcccaggagctgcctgcacagaccggtctcctcagtcagacaggtgatgtccccctgcccgcgggccgtgagagagctgtgtacacctctgtccaagctcagtattccacagctggttttgtgcaacagtctaacctcctgtcccattctgtacaagcagcagaccatctggacagcatctctcccaggggatcctgcctggaatctgggggtcattctaatgacagaaacaaaggacctcagctccagaaagaagctgtctcaggccccatggctggcaaaccattccgcccccagtccttatccaagtattcccgtcactatagcccagaagacgagccaagtccagaagcccagcccattgctgcctacaaaattgtttcacaaaccaacaagcagtcgatagctgggtctgtttctatcacatccctttcctccaggactacggagctgccagctgctgatccatttgctctagcacccttcccttcaaaatcaggcaagaaaccctaggagcaaaacctgagcctcaagcctcttgtctctatcccaccctcaatacccgccatggcactcccagcttagccttctgaagaagaaatattatcagttcttatatttcaattccctgcgtcagagcagaattgcttgacccagggaggcagactttgcagtgagccaagattgtgtcattgcactccagcctgggcgagaagagcaaaactccgcctcaaaaaaaaaaaaaaaattgtcactggagacatgatgggtggagactctacataccttctttgaatacagaaacggatgcaaacacatgcaaattacttttttttttttttttggtgatgcatgaaaaaactttgacttgtggattacattaattattagtaacagttagattctgccgacttgtattacagtagggtcttatttccttaaagagaaaaaaaaatacagtcatgccccacttaatgatgagggagacattcagagaaatgcatccttaggtgattttgtcattgtgtgaacatcacagagtgtacttaacacaaacctagatggcacggcctactacctacctaggctatatggtccagcctgttgctcctgggctacaaacctgtacagcatgttactgtactgaatactgtaggcagttgtaacacaatggtaagtatttctgtatccaaacattttagacatagaaaaggtacagtaaaaatatggtataatcttatgggaccatcatggtatatgtggtccatcattgatggaatcgtttttatgcagcacatgactgtatataatcaacaaacaactctactttcttgttttcgtttgttgtgtttttgctttacacatttgatagggaacatagaagttgtgacctttcatttcagtggaaagcattgagccagaatatatttattcctaaaccatcgagccacacatgcattgatgaaccctgaaagaatccacagtaattgactaacaggcagtactgaatgaaagatgtcatatgtggtgaaaaatatttaatatatcagtttcttgggctcacatacagccctttagttccaagtgcttggttagattagaaaatgggatgaacacaatttgatgctgaagcagctgctgagcagcacccagggagtctaggtcatacgccctatattgttttcggcccacttattgttgagttgaaaagtctcatatttgtagactagagtgtatgtgtttagaggctcatgttgtatctgagttttctctggcaactaagatctctttctaaacgttctagaaagatactggtatcttactggcccattatttagtaagttttagaatacatgtacatcagtgttttcaactgcttggtggacatttcactgatgcataatcaaagtagcagattataatcatcagagtgatctgacaaggaaattctgtatttgcttccataaagaaaaataatcaaaacatatatcagatataatatatatgcagtatatcacataggaaattttattgtaggaaattagagaaggatgctactcaattcattctctagcaggaagaatacagcttaaaaatcacttgggtccctttaataaagaaaagtgtgattctgtgttgtgtgtttggaactgaaattggagaacacgtgccagtcgactgtgaaatggttgctggataaaaccacagatgtggttttatccgagaaatgtgggactgaaattattttgatgagaggtacataagagagctgcagaaaagactgtagcttctgaggaggcaggagtaccttgttaatatccaaaccacccctgagttctaatgttccaactccacctaaacgaggaattggaaactttaaatggaattatctaatttaaattcttagttttttctttgtctttctcagctgatacttgtagttttgttttgttttttaaccaccaagaacacttgcaagtttgttactgaaaacatcactaaaggaaaagaagagtttcaaaatgcttgaaaagtagtatgtggttgggaattgtttttgttcaagtccctggaagtcctcttggcttagctcccttgttcctgttcccacttcatttccttacttaacattcccctattttgagcatgtcaataagtgcatgatgaatggcacagttgaatgatcatgttaactttaattgcttcctttgttgctgtaaacagtttcttgttaagtttcagccaagtctgtgacaatctcaccaaataagaatgaaatgggcggggtgtggtggctcacacttggaatcccagcactctgggaggctgtgttgggccgatcgcttgagctcatgagttcaagaccaacctgggcaacatggcaaaaccttgtctctacaaaaaatacaaaaattagccaggcatggtggtgcacacctgtagtcccagctacttgggaggcttaggtgggaggatggcttgagcacgggaggcagaggttgcactaagccaagatcgtgtcactgcactccagcccaggcaatagagccagaccctgtctc

SEQ ID NO: 8287 - DNA, 4340 bp, Homo sapiens
ctagactgggcggtgatcaggatctgaatgcacagggcgggtgttcagcgattgtttactacgttgaacgtgacctccaggaaagcagttctggccgagatcccctgacaacgcaaagcaagaagtaacgtggaaggaggctccccaagctggctggccattttgctgctgtgtgtggaggtgctgccagtggcatgcccaaacccaaagctggaagaggaataaattacaagtggtcaaggttgcatccttttgagcccaggacctgcttgtaagccgagagggttctctggccctaatctagccaagcaccatggagagaatcagtgccttcttcagctctatctgggacaccatcttgaccaaacaccaagaaggcatctacaacaccatctgcctgggagtcctcctgggcctgccactcttggtgatcatcacactcctcttcatctgttgccattgctgctggagcccaccaggcaagaggggccagcagccagagaagaacaagaagaagaagaagaagaagaagaagaaggatgaagaagacctctggatctctgctcaacccaagcttctccagatggagaagagaccatcactgcctgtttagttaggcaggaagcagaggtgtttcctttctggggctaagcctccttctgaccacacacagacatttcaggaacccctgaaataatgcactatgtccatgtccacagagtaactactcaaccaaggaacaaacctcagactaagtgtcccagtggagggcagtcccagggaccacgtggacaattcttggatactgtcttggcagctatgtgtccaatagcaatgctccttactgcagacccaggcatgcctcccacctgtctctggcataccccacatgcaaagcacaaagaacatttatccatacatctcaatatggttcccaagtgtgtgcacatgcacgtaacacacacacacacaaattcaggtagcaggtacgtgggcaagtatattctgctcatcaaatggtcattggctatgtactttgtgcagggaagtacattatctacagtcacaaaaatgtctcatgggaaagccttgccagattcagacacatatatacaatttcctaaccagcaaggcccccatacaccatctattccataaaccactcaggttacagatgcatgctttcctatttctaactctacacataaacttttactggaagtactcataattggacattccagcaacctgctacagtccccacccttgtgtgtcttgatacagacacaccaagtttctgtgcctctgacccctcacctgtgccaagatgtttaaagtgtgatggttcaaaattcattgaaagctcttttcttgtaactcatgacaaagtccgtcctcattgccactgagaggtgtttaatgtgatccaagacctctctgtgaaacattacccccgcaaaccactcagcaaagtgcctttctccaagcaagaacaaagagctcttggtggtgactgctagaaaattatggaagcccactcatttatgtcagtggactgcaactgtgtacctgtgcaatgtttacagatggaaagggtgaggagatgctacacctgagctaggtatctcctatataaccaaagtttccagcagggaaggaactagacaatcatcagtgcagtctcacagaaggcaacactggaagtgatgtcataaggttgtgatgtgtgcacggtatggcacaggtgggatgcagaggtaacagagtttaaatgaaagtaggatgaagctataaagaggtttatttatatttatattgaagctcaggcaagtgccttgcacacagtaggtacttataactaactgtggttactgttggatatgtgatgttgttaagggtaagcttgtaatacctcaccagttctccccgagtgatcttctcttctaagtgagcccactaattgctgcaatggatgaaattgggtgtttaatgctggagagcacatgtaggtgacacatgtgccttgaggtatgtgaggacatgtaaattagatccacagtgagctgaggagggctttccccgccagagtgaggttgggaagcagagttaatccacttataggatgaactgcttggtatttttattgtattgtgactgtattacaaagatggacaattcactccttgggagcaagttatgctctagaagtttatttacaaatatgctgggcagctctcttgaaatattttcccaaggaagctattctacacagtggcaaaattgctatctaattaataatgtagctaaactatgatatttatagtagcaaaaaactaaattctataagattgcattaaaggaaagatatattctatttgctcacttgggctgcttggtactcacctgccctccaggtgtactttaggcctgtggagggtgggcatttagtggtgacccttgcaccagggttttctaacagatgaccctgtgaatcataatttaaacctgcatatattttatagccagtcacatttgccctctcaccctatatggccataaactgcctaagcactcaggcctcccactcatcaacccctttgaccagagaaagaagcactctggttctctatccccttgtcacatagagagtttgtcatggggcctctggctgtgcccttcacataacagaatgacttgccatctgcctgcaccaaacccagggatgtggaagacatctccccacaactgccactgctcaccaggacaagctgcccttcctgtctccacctctcagtccccctagaatggatggctggggagaggtggaggctgacagctgagacgtagtgtcagatatgatctaggagggcggatcaccgggatccgggaccatacaagtaacatggtttccatggcaactgcttgctcctttgaattaagacagcagtcagttgtcattgccatgacaaggcctctatctccaggcacaatgtccctgctgtctcctaatccaatggacttgctctcaccccagggatgaaacacccagaaactcacttctcagtcacttccacagccgatgactcagaagagccaaacccagaatggggcctctcttttccccatcacagactcccctgacaacctttcctggcgtaactagaggagtcccagtgcaggataggccctaaacgttttgttaaataaacaggtgcatgaaaggagcctaaggccattgttgatatccactctcttctttccacttccttctcatctttttctccatgttttatgcttctctgattccctcttctgcctgcaccagaccagccccagccctttattcctctccattttcactccttccagcctctgtccctgaactgccactggcaacccatgggacctcaggaccagagactgcttgactcatctggggagggtaagttcacgggggacaaaaaaatgattcctaaagaagaggcttcctagaccagcacaggctcgagaaagacatcccctaggcctggacttctgagcagctttagccaggctccggacggcagccagaggaggcctttccccattgctcctttccccattgctcaatggattccatgtttctttttcttggggggagcagggagggagaaaggtagaaaaatggcagccacctttccaagaaaaatataaagggtccaagctgtatagtatttgtcagtatttttttctgtaaaattcaaacacacacaaaagaaaaatttatttaaataaaatactttgaaaatgaaaagtcttgatgtagtcagatggttactctcttaacattaggtattacccccactcagacatcactcagaaatgatcaatgcagggactctttctgtgacacaaatgtcccagccctccctggtcaccgccttcgccatggtagagtcataggtctgaggatgaggaatgtggctgtctcacccttgcttgcaaaacagatggccttggagaccagactccctcaaaggtgccagctacaggaaaaatatactgatgttccttggcaacacttacagaactttccatcaatgaggtccatcaatggcttcttaaaggaaaaggggggaaatagcaaaaacctaaggaagaatggacctttgagttaaatccagtgtttgttgggaaaggagggatcaaaaacctctatagtagccactagggcaaaaactgtgtgtatgtgtgtgtgtaagtgtgtgtacactgttcaatatggttcaatatggtaccaatagccacatgtgactatttaaattcattgcaatgaaataaaattaaaggtatactagctc

SEQ ID NO: 8288 - DNA, 1958 bp, Homo sapiens
aaagccaagcgtcgtcgtcacccaaggtcaaggggtggaagttacacctggtgcagccctcggctctgatgcaaaagcagcttttgcccctggctgcgggacagcgctgtgactactcgcaacgggagagctgctgccagtcgccacaccgtgcggaaagcgccggcgaccggagcactgacaatggtctgcataggggagcggagagaagcttctgttgcgccctagatccgctgcctcggcgcccgcccgcagggaggagggggcgcgacaggtcgtctagcgcgtgccccggagcccgcgcccgggtctggccgcctggggcctgtgcttccttcagagactcacacaagaggtttatcatgagaaggaccgcactatttcatttcactcctacaagttttcatttacgttacacattgagaaagttatgagaagcaactgtcactctctggaggtggagactgccgtgattcacaaagacaagaggatggatcatgaagccgcccagctggagaagcagcatgtgcacaatgtgtacgagagcacagccccttacttcagcgacctgcagagcaaagcctggcctcgtgtccgccagttcctgcaagagcagaagccaggcagcctcatcgctgacataggtaaccaggcagcctcatcgctgacataggtaaccaggcagcctcatcgctgacataggtaaccaggcagcctcatcgctgacataggtaaccaggcagcctcattgctgtcataggtaacccagcactgggccgtgtagcatgaaataccttccattgagcctttgcttttcacattgatttttcatttttgttctaataggaatcctgaaattgcacccttggcatgccagtacctagaatattcattttacagcagaaactcgagacagtcaagtcagcagcaagtaaaaaactttctcaaacttttattttatttttattcttttgagatggagtttcactcttgtcaaccagattggagtgcagtggtgcaatctcagcttgctgcaaactccgcctcccaggttcaactgattctcctgcctcagactcccaaatagctatgattacaggcacccgccaccacgcccagctaatttttgtatttttagtagaaacggggttttgccatgttggccagactggtctcaaactcctgacctcagatgatccatctgtctcggcttcccaaagtgctgggattacaggcttgagccaccgtgcctggcctcaaactttacctttagacagtggctcttcagggcctttgtgtacatcctccaccaaaacggacctgacattgattgactaaatcaggatggaaatgatggcttgtgaaactaaccgttgtaaatttaaagatattcacatttgccaaatgtgttctcctctggtggctcactttgagtggctcacatgccttctatagaattgtgggattatggaagaggtccagtaatatcttatgaatctcatgggtcctttcctttaattattctataggtgtttcattataggagcgcatctttaattagacagtattttaataataacttatttgtctggaggacgttggttcagtatcttcgtaaatcaagaactggtaaaccacagcttagtagatctaggactaagacttaaaatgtggttggaatctcactcaaggcctacccacctaaaactgcgttctagcaattgcatgctgactgcacctatgagtcgtaagtctgtagttgcaaagtgtgtctagtttgatattctttctaaatactggtaagagaaacagacataccagaacttgtggcttgctgaagatggtatgagtaatgtggaatctggggaaggggtgcatgtcacatggaaattgggagtctttgaaaaatatctctatcctgtaaattaaaaaataataaatctagtttcggagtgtgc

SEQ ID NO: 8289 - DNA, 699 bp, Homo sapiens
gcgcgaccccgtctccaggcgccatggccagaggcctccagtccccgattctggcccgcgctgagtgccaggggcggcagggggcaccgttgggggttctccagtgggaggaacgtgctctgtgaggtcagcgcgccgcggcccgggtcacaatgctgccctcctcgacgcccgggcccgggcacgccacagagacctgcccggctccgcctggaccggagcgttctcccgcggccagggctccggcagctgcttctagcctgggaccggtctcaaccgccgggagagcgccccggggcttggacatgagcgcccaggagcccccgcagggtcggagattccccattgaggccggagactcccgtggccttgccgccgcccccgagtcccaggacagcccggaggcggtagcgacggagcacaacccggtcaggccgcttcgtcgctgccctggatgccactgcctgacgctgctgcacgtgcccatcgacgtctacctcgccatgggcgggagcccccgggcccgcgccacgtgagtgcgcctgctccctgcggctccgcgggagctgggcgggaacgaggcccccagcgggccaccacgctgaggtcgcatgcgccgagcacgagacaatgatgcacattttaaaataaaagaatgatgcacattttaataaagcacagcacaaactgttctttcca

SEQ ID NO: 8290 - DNA, 603 bp, Homo sapiens
gtatttcaaagctctctgggtcctggggatgagcagtgccctctcatcctgtaataatcgtggacatcacacactgatgtacagacatggtgccagcgcctcccttccttggggtcttggaaaacccggtgccacaatgggatctaagtatccttggatcaatacggattcgtgtttctcacaccgaagttcagggctctggcagctccaggtcccctgaggccctgaggaaagagtcacttgaagtggagtggaccctggtactacttgcaattcctccaagaattcaacccagccagcaagacggagggcctcccaaatgctgcgatctgctccgtgctgctctgctgggccgtcactgccccctgtgcgttcctgcgggcgaggtcttctcccagaagcgagacaatgaacaggacagaagtgaattcattggccagaccctcaaactgttggtgaagaggaacgtttccttggaattaagctgccgctaagtaaaggtcaaggcacggggcagctggatgtccgtgtggatcctgcaaatggagaggctctgctgtggaaacagaatggaacttaacctcagctaaaacagtggtggag

SEQ ID NO: 8291 - DNA, 3071 bp, Homo sapiens
cccttagcgcagaagccccgcccacctagactgagccccacgttgctgccaaggctccacccactcccccactctcctcccgctcggtcccccaagcctggctggctccactcactctagcacccttcactgctgcctcctcagggaatgcttggccccagcgccttaggaaggagcctgctagggccttcagcactcagcggtttcttctacgcaatttctcagtttcaaataaagcccgtctgcggggcaatttcggccatccagacggtgaccggggcacccgcgatggccacctgagggacacagcagacagatgggggcagagagagagagagaaacaggcgtcgggtcctacagccagcatcagccgctgtcccggggccgccctggagcccgtgaggagcgctcatgcacatggggccggcaaggaaggggccctcagaccgcgtggcccccgtggacggtgcgtggcatgggggtgggcagggcgccacaggcgggcaggtgcggcccctccccgccgccgcagagggccgggtcccactgcccgtctgcctcctcctcctcctcatcgccgccgccccgcagtgccctgactgccgccggcctggggcccccccgccgctctgcacaccatgccccacctctgcccatccgaggccggggtcccgggctcagcctcccacagagagctgctggcggggttttgtgcagccggatgccatcctgcggtcggcggtggcgggcaatgaggaggggggctcggccccgtggggctgctgcagggagaaacagccacgtggcaaggcccctgccgaggcgcctccccgggcgtctctccctcttggatgaaaagtggctcgctggaagccccctgtccttccaggccctgctaaccctgcctgctatctggggatggctggacagatccagcagccatcttgctctgccacctcccaggtgagtggctctgggagccacgtcccctctgagggcgtcagtttgcccatccctaataaagggacattaacaggaagaggacccattttctagagggcacaaggaagaaaaagacgggtgcccaggcatgtgcaagggcacaaagaatggctggtgccatcgccgttgtcactaccagccacatccccaccaccgccactgccacgatttcaatgctggtgtcccctctgaagtccgtgctgagatcactactgcggccttcaagcgactgatccatggggcccactcatgtgaatgggatgaggggcccttataaaagggcctgatggagggaggccacggcttttccgctccttgcaacccctctgccgtgtaggaagcagcacagggcctctctggagggttgctgaccaggcaacctcgtgggaacagagagcagccctccccgacacagccctgccttggccttggacctcccagcctccagaactgtgagagattttcgttctttataaatccccaggctgtggggttttgttccagcagtgcaaaggggccgagatgatcgccatcaccaccgtcgtcatcaccagtgtcagcacaacttgtctctgtccctgcagggcgcagcccagagctgagcagcaaagcatacatccccttttgttctaaaagggcgcctcattgagcctgcgtcaccccagccagaagtgcccttctgcgggtggtattccagagccgctcccatgccctgcacccacacggcccagggctcccttcccgagacccaaaggacccagagcaacagggaggagttgttaccatttggtttttcagggccccttcgaaccgaagccctcgctgacaggagcccctgccgtcaatcacaaccacggcgtagcccagggaggccagtgtgttgagccgcaagtacttgatgcctttgaaggagttattcaccagctgcacctgtggggaggtgagggccagcagtccagcacgagatgccgggcaggacgggcctggcaggggagatgccggtgggctggggaccgggccgggctggggcctcagagcctaatgaaagcacctgtgccccggaggctctggatggacacctgggagtggcaaggcgggaggggcccatactcgggaccctgctagggagggggaagggccactgtcaggctctttctcagctgggccactgccccagtcctgcctggaacaactactctggcatgatggacattggggtggctccttctcgggtggggccatctgggcactgcggggtgctgagaagccactccaggccaggagaactcgcagtggtgatgaaccacaaagtacccagacatcgccccgtatcctctgtggggacagagctgctctgggtaagatgtgcgcctaagatggtccaactgccaatctgctgcctgcttttgacccctgctccaggaattgggcccagggcccatggccacctccataccaacctggagactaggggacttcctagaggaacaagggagagtcagcaggcggagggggaaggggaggccatccaggaagggcggggagcgtgcaaacgggcacagagaaaggagggtgaggggccccgaggaccctgtgtagtcagggcaggcggggtgggctggggcaccaggcaggtagccggggagcctcctctggttgactgttctacagctggcacttgagtggggatggggagtcctcgggtggatggtggggtgggggcctggggagcaggtgtgcactcacctgggggcctccatatacaaagaggacggtggggtgcttcttccctggctgcaaggcgtggggcttgtagatcatgccgtagagccgcacatccgagcgcgtgtggaaatggaagatctctggaggaacataatccggggggcagcctgcgggagacagggcggctatctggctgcccggggaagccacatccagctgacacccttgttctcctgcccaccccaagccttggagggtggaccaaagcaccccctcttttcctgggcttcccgagagttgataattgaaaaaaacgtttttttttcattaaataagatttgtac

SEQ ID NO: 8292 - DNA, 886 bp, Homo sapiens
ggggtcctcacggcgcaccgaggcgaggcgctctggtgacaagtagcggcggacactgctaaaagagagcacacaggtcttggaagaggctgggggtcccggccttgtgccttacctgcgcccggaggtcgcctccttcttgggagaggatggggacgtggcatagccacccacgcgccgcgggggtcccgagccattaaggggcgtcctggtgggaaggcctttcaagagctgacacactggagggatggggttaggggacagaagagggcgacgcagagcatccgccagcgccgcctttaggaccgccagctcgtcttcctgtaactgcagccgctgctccagcgccgacacgcggtcgtccacttccataccgctcgtgcccgacaaattgtcatctggaagacgggggagtgccggctgcagggccacccaggagctccagtgcccaaggggtccctcccgccttcctgggtctaagcggggggccagccacgcccctttcctgtcccgctacctggggctgggacacttggacatgagccaaggaagaggactctgaagggggaaggaaatccccacagctctccaacccatccgcacactcctctctgccacagcgcgctggccgtgtgaccttggggaagtcccttccctcttattttctaagagtctgtgaacccaggagcctctcgctctggctttaagatgctatgactaagacgtgaccaggcgcagtggctcacgcctgtaaccccagcactttgggaggccgaggcgggcgtatcacgaggtcaggagatcgagaccatcctggccaacatggtgaaaccccgtctctactaaaataaaattaaattaaaaataaaataaaatttaaaaaaaa

SEQ ID NO: 8293 - DNA, 1021 bp, Homo sapiens
cgaggccctgccccacgcccggtgattgtgcgcgcggccccgcccccgaggcgcacgccggcccagcgcccacagctgcggcggcctaggtgccgcgtggggcaagcaggtgcctcgcgtccaggcggctccgcggctggctgcctcccgagccggccgcgctcctcccagcgaggcgtggcggggaggcgtagtgaggctgggcccgtggcggttccctgaggagggccgagaaggggccgggggtgctaggggaacgggcgctgggggcagcggccccggtggatgctaagggcttcgggatcgggagagtccaccacgcctgcctgctcggctgagaatcgccatgccagctaaagggaaaaaaggaaaaggccagggcaagtctcatgggaagaaacagaagaaaccagaagtggacattctcagccccgcggccatgctgaacctctactacatcgcccacaacgtcgctgactgcctgcatctgcgaggcttccattggccgggtgctcccaaaggaaagaaagggagaagcaagtgacagcatttcacaacacatctctgttacagacaacaggacctggggaagagaagtcaggataacacaactgttgccagcaacatagactttactccagacgacttgagatgcaaattaagtgtgcttttctgtgatggtggaagatcaggaaatgcaccttacttcctctgttatgccagatatggttagccactttggttttttaggagctataggatgggaaaagcctgagtaattcctacacagtgtgctgaaattaatagaactttcagaaattattataattctgggtcaggattaaactttgctctcagaaggcagttctagttgcattaattgttttcttttgccaaagagcgtttgtcatttagagaagacacggcaagaaacactgggtttccttaggaacattcctctcttgggcaccatttccttttttttttttaatggaaaataataaatactttgtttctataa

SEQ ID NO: 8294 - DNA, 642 bp, Homo sapiens
gccaccatggtctggttctgcaacagtgccgactgccaattttcagtcttcgcccttaccaccataggatggatcctctcctctacgtccacgggcctcgtggagtggcgaatatggtacatgaaagacacctcgctctacccccctggaatcgcctgcgtgggaatatttagagtctgcatttaccggcgtcgcaccaacagcaccacaaccaaattttgttaccgatacagctaccaggacacctttctcccttttgaaatttccatggctcaacgcttcctactgactgccagcattttcggattcttcgggagagcctttaacatgtttgcacttagaaacatgtccatgagaatgtttgaggaggacacctacaattcattcgttgtttcaggaattctcaacattgctgctggtgtctttaacttaattgctgtgctccagaactacgatgccgtcataaactcacaggggatcaccttcctgccatctctccaaatgcccttcaagccagatgtgcaggaagttggcactgccattcaagtggcagggataggtgtcttgccgatgctgttaactgggatgttttctctgttttacaaatgtccccccatgctctaccaaatatttccaacgact

SEQ ID NO: 8295 - DNA, 835 bp, Homo sapiens
aatgaataaaggcatgacactgagattgaaggctagttctacttcagaaccacagagacatgagcaccagcaagtttgaggttggataaggatcttcagaactcctcagcttcagatggtcaagcactgcttcctcccttcttcaacggcatctctagcatgtatacttcccttaaatccaccttcgtagcatttgctgatggaagaggcacaacagagtccatgccttcacctcctctggccaactctaatcatgaatctcctgtgaatcagctgggaaacatgcagaatatgagattggggccctcattcatactaactggaattttccttggcaatggtagaacagaagcttctccattctttacagatgaatttgctttaagtaagatcttcccagagtacaaaagaaatttattcggaaaatttcaaactaatatggccttctcactggaactggatccaccatcccttttgctcagtgtcgtcttgtttatgttttagatcctttgcaaggtgagctacacctctgagaggagctcctggaaattaccagatacttaatgttgccagctgttacagatggaggtgatgcaccttgatgatgcataagtactgagcctgaatcctacaaatgggaaaaggtgctcatatcagacttatgcattagatatcaaactacaaaatacaagtgcagttgatacctgtttagatgatgtagagcaaggtaacagagtatgtattaaaagcaaaaattcccatgaagctgaaccgttactctctgccaaaacctcccactctcaagttttaagagccaataaaccttgtatctgta

SEQ ID NO: 8296 - DNA, 1424 bp, Homo sapiens
atggccccccagagagcggggccgggtctagggaagccctcttccaagaagtcccgtgccctgagaggagggccaggagtccccagggccagacagcgaagccccagagctgctgcggagctgaacaccgaggtccccaagccctccgcaaaggacgtggagatcctggagcaagagagcgaagtcctcgagccatcagtcgagcaggacgcagagagccccgggctgtccacagctgcgggctttgagagtcctgagccaggcagagacgaccctgggccgtccgaagcgcaaagggcggaggtccaggggcagcatccccctccaggccctaagacctcctcctccaggtcaggctcggaagccccccacctgcgttttccgccgtgccccgaggctccccagcgtcccccggaggagcggttcatggagacgcccatcgagcgcgaaatccgccgcagctgcgaacgcgaggagagcctgcgccggagccggggcctgagcccgggccgcgcaggccgtgaactcgtcgagctgcgcgtgcggccggtgctcaacctgccgggtcctggccccgcgctcccgcgcgccctggagcgggcgcgggcgggcgcgcagatgcagcgggacatcgagcgggaggcccaccggcaggcggcgctggcgcgccccgcggtccccgagccgcgcgcccggtcgccgccgcagccgctgggcgaactcaagcgcttcttcgaggccgcggcggggagcggctcctcggcgggggcgggggacggcgcgggcccgcagaggctgccagagcctgggggacggccgcgctcggccgtgcagggcgggtgccgggtgctgggcagcgccccgccgcctttcactccgtcactgctggagcaggaggtgcgcgccgtgcgcgagcgcgagcaggaactgcagcgccagcggcgcagcgtctatggcaccgcggagttcaaggagcctacgccgagcctcaccgcgagcaggggcgacggaaagttggtggtgatctggcccccccgcagaaaggtctcggagaacggcctggagcaggaggagcgcaaaccttgaggtttgaaaaggctgggacccccggccggaagtaacgtacgcgtcagaggaacagggcggggggcgtctagcattaggcctggagaagggtcggctctctgcattggggaagatgaaatcgacttgcctttgtgaaattgaccagccccctctataaaacttacagtcccccattgggaaactgaccaccacccacaactccgccagtgaaactgcccagcccttctctgcctaattgcaaactgaactaccctctcccttgactgttaagagggccggagttaccgcctcgattgccccactccccccacccccaataaagcctcttctttcagggc

SEQ ID NO: 8297 - DNA, 729 bp, Homo sapiens
gttgcaacctccagaaagaattcgtggtttcacccgggaaaacagctccccggattaaacggataggtttacacatactgatccacccagctattcatcttctgtttgctgctttaattgggtgcggttaaaaggccacgtccctaggcgttcaccggctttcttgccatctgctgcatgaaaactgactttgccgaaaaaattaacaaagaagagcgaaaatgacagaccgcaaccgggataagaaaagtacttcaccttcaaattcagacacagaaatgaaatctgaacaactgcctccttgtgtgaaccctggcaatcctgtgttttcatgtatgttggatccaaagacactccagacagccacctcactatcaaaacctcaaatgattatgtataaaaccaattcaagtcattatggtgaatttctacctattccacagtttttcccctgcaattatactccaaaggagcaagtattttcaagccatatcagagcaactggattttatcaaaataacactctaaatactgcacctgacagaaccagaactcttgattttcctaatattcaacacactctatgaaaatatattcctttgtatattgaagagaaaatatactcgggaaaaatgagtgttaaatctaagggtagaatacctaataaagaagataaaaagttttgaatcaatttttaaaataagttaaataaagtatttcaactgataa

SEQ ID NO: 8298 - DNA, 1318 bp, Homo sapiens
gggcccccgaaggatctcggaggcgaagttgctagaagatacgtaagagggccccagtggagatggaacaaccaaaggacggggctgggcctgaagggaacaacctgtccctgccgtcatctgggaccgagccatggccccctgcgcctctcccagcccctccacccttgctcctgaactccacagaccccacccacctggggctcccggagagcgtggcctctgtcaccgtgcccatacgcctggacaccctctcctgcctcctgcacagcgccctgctgggggcctacaccttccaacaggccttgccctcttgcccctgctgctcccaggcaggccactcccagccgggggcagttaggaggcctcccaggggacgcggaggctgggaagtcaggcacaggccaggctggggccgaggcctgcatcgacggggccttgggagagctgagcagccagagaggggccgggcggggggccctggggctggccccaggaccccaccaatgacactgccatcaccaccaacactgcctgcccaggatgggaagaaagaagctcgaggtccagagccacccctggaaacaccactggctgctgaggactgggagacagagtactaggaccttggagggtcaggcacctgagattgcagtcacccaggagggttttcctggggcccagagtgatctcagccctgtcagaagaaccccaagaaacatcttccatcctcccctctccccaaaaccacaatcccaggagtagctcctgtgaggcacttggtgaacctgacctaagtcacctgaatcccaagtgagaagaaaatcctaaacctcgtacccaaacctgtctccttgatggcctcaaccccattcccaatgccatccccaaccacaaccacaatccttacctcattctcaacccccagggctcctccaaccccattccctatcctctccctaatcccaaagccactcctacctgcctctctcttccccactctcaataccctgttcccaaacccattcattcccatccctgtcaccagtcccagctccacttctgcgcctcaaccctaacccaccctctttaccaacccctttctcctcattgcctgtgtacctcagcccatctttaatgtcctctgaatctacagccccaaagagctccatcctcaacctcagccacagccctgtgtccatccccacaaagaaccgcattggccccacatacccagacacctgtgactccccaccccactgcctgctcttcaggtagaaagccctggttgaacaataaacgcatgactctccctgaa

SEQ ID NO: 8299 - DNA, 1076 bp, Homo sapiens
gtctgcgcagccgcagtcagtgcggcgccagctctgcagagcccagacagggtccggttggggaggtcctcaggttctgaatcttgtgcctggagaaccagagaggaccctggagcaggaggagaaagagaagcttgtctcagaagctccacctcctcctggggcaatgcagagtctcaggcctgagcagacacgggggctgctggagcctgagaggaccaagactctgctgcctcgggagagccgggcctgggagaagcctcctcatcccgcctgcaccaaagactgggaggctgtggaggttggggcctccagccatgacagtgatgagaaagacctgtcttctcaagagactgggctttcccaggagtggagctcggtggaggaagatgacgaatcagagggctcccagggctttgtggagtggtcaaaagctccacaacaaacaaccatagtcttggtagtgtgcgtgctttttttgttcctggttttaacggggatgcctatgatgtttcacatttaactataatggtggctgttgttttaaaagtttaatttaatgaaatagatgccctatgtcatgttaaggaattgtgctagttaaaaatcaggaataggtgttgaatattttcaaatgcctttcaaacatcctttgagatgatttttaaaaaatttttggtgtgagttttcacatactttatttccatgaaatgaagacatcattgattgtaaaacattattttgtataccacggagaaagaaaagtgctaattaatcattaagatgccaccaactggaagatatctcctgactttgagaagatgaaaaaatgtgcaactgaagatcaatgaaatctggtacatttcctaacatcaaaccaactttgcattcttaaggttttggtgcaccagtcttttcatacactagattatatttattgatattttatgtaggattcttgcctctatcttcacatgtgagattggtgctatctttgtgaagttttggtatcatggttaagcttgcatcatagaaagacttgggtaacttttaccttttctatgcttttcaatagt

SEQ ID NO: 8300 - DNA, 1799 bp, Homo sapiens
aggtggccggtcgggctggaagggcggggatgagggatgggacgcatccccgggggatgctcctccaaagcttttatcgggcgagcgcagtggctcacgcctgtaattcctgcactttgggaggctaagggtctcactctattgtctaggctcgaatgcagtgacgtgatcatggatcactgcagtcctcaacttactgggctcaggatgaaaggcttcctagcacaaacaccacccctggagttcccggtacatcaataccagcctggggatcacgttctcatcaagagttggaagagggaaagcttgaaccagcttaggaggacctcatctggtactcttgatgaatgaaacagcaatctgaatggctgaaaaaggatggacccagcactccagggagaaaacttggcattctttgggaatctaacaggatgcagtgaacccaagccttttgaagagctcaccaatcagactgcccttgtctatccatgagcagatgtttgatagtattgcggaggccctctagtgggtatgctgccaagcaactggagtggcacttgggctctaatccagttgtctatccctttcaccctggcatttcatcagccaaacaaaaaccaactaactcagaaaaaaaggaaagcccctcaagggtcctttgaccccgatatctacatagatgctatcggggtcccctgaggggtaccaaacgaattcaaagctcgaaatcaaatagctgctggattcaagtctgtccttttcttgtggtctactataaataaaaatgtagactggataaattacatatactataaccaacaacgatttgtcagttacaccagggatgccattaaaggaatagctgaacaattgggtttcaccagccaaatggcctgggaaaatagaatagctcttgacatgatattagtggaagtccaatgttgtacctgtatccccaataatacagcccctgatgtaactatcactaagggtctataaggcctcaccactctaggaaatgaactagctgaaaattcgggaatgaatgatccctttacaggtgtaatggaaaaaatggtttggtagatggaaaggactaatggcctctattctcacctcccttgtgatcataataggggtgctcattctcttagggtgctgtattataccctgtgtctgcggactagttcaaaagctcatagaaacagcccttaccaagacctcccacaactctcccccaccctattcagataaacgtttatttctaagcaaccaagaagagcagtgaagccagatcctgttagaaatatatgaagaggaaggactacaaaatcaaaaggggaaaattattagacaaaatgagttgctctacaaaggtccaacttcgttgtcctttgttctgtaacctttgttctgtaaactgcccttcccgcagaaactgtctttcccgccgaccaaaactgcccttcactatcactgtaatccatacccctactctatttgaaactgccaatcgggatcagcttacattgtgtggttcaaccaccagccaatgaggaaaaaacacagaagcaaaagctatgatgcattagggttaaaaaccccttcctttccctgtccaatgtgctcttgagactgctacaggcgcaagcagccaccttctgcagaagtaaaccttgccttgctgagaaatttttcttttgagtgctggtctctctctgtggcaccaagaacttatttctaacatggagtgatttccaagatagatggttaagtgaaaataaaaactgttgccaggc

SEQ ID NO: 8301 - DNA, 415 bp, Homo sapiens
cttatccccaatttacaaatgaagaaatggaagtcaagacttttcccaaggccaccaaactggttaagtggcaagtacttaaggctcccaagttcagcaatgtttctaatagacttctgcctctgtgttccctggacaactccattccagtgcaagattctcatggttgaattcatagtgggcttctatgacttctgccttgccctggaggtccaatacaggaccagcaagttatttctgtgtggacagcccagtcccagaaggagcttgggaatacagcagcaggctttaaagcttgcctgtctttcgcctacgcttctggaatcctcaagttgtgttgacccacctgggaacactgctggttccagaatgccaagctccagtaattgtataaaataaaattaaaataccagaa

SEQ ID NO: 8302 - DNA, 660 bp, Homo sapiens
gtggagggcgaggctcccgggctctttctgtccagccaggagcagagagcgagagacactgaggggccgagacaaggagacctggaggcagggcttgggtggggctggcccctgcacccagggtcgaaccagggggctcccaggcaggggggatccattggctcagggaccagaccctgcccatgcccacccctgtcacgggagggaggggccctggcctcgcccagggtagccctgtcccagcttcagtgcgggctgctgggctctgcagaacagtccttcctgcagctggagcaggagaaccacagcctgaaaaggcagaatcaggaacttcgggagcagctgggggccctcctggggccggggcagcagttcctgcccctgtgtcccgaacactcaagctgcactgctctggcctggccccccgacccggctggcacgcagcccttggggaacagggcacctctgcagctgctgcggcgggagctgtgccaggggcaagaggctttcgtgcaacagtcccagaacgagctgcagcagatccgcctgtgctttgagaggaagaagatggtcatcacagaggtgtgggacaacgtggctgagatgcacatggccctgaacaaccaggccaccgggctcctggtaggtccccacagggca

SEQ ID NO: 8303 - DNA, 1594 bp, Homo sapiens
gcactgctgagactacaacacttggtttctttgagtttgactaaatattttacataggtgtaattatacagttttcctttttgactgtcttgttttacttaacagaatgttttcgagatttgtccttattgtagtacttttcaagatttccttatttttaaggctgaatgctatcccagtgaatatacgtgccctgtttgttgaatctactcatccttaaagatatgtattcatttcctaccaccgtagtggaagagatactatccctatctttacaactgatagcatttccaacagtaagctgtgagattctgcttgaaatcacctctcaaacaaataaaaaacagacctgggagacatgctacgctcattctgctgaagaaataggcatcatagctgggaaacggattcacaagacccaggctgttccctacatatgtttcctcctccgacatcagttcatcagtcaatcaagccatgtgagagtggaggccttgtattccctattattcttgggcactctactccaagtaggaaaaggccaggaggtcctgttaaaggatgcactcagagcccgggctccctaacatatgagagtgctaaccagcaggtgtagacttttcaggagtgaagaatgaggcaggcattccaaacctggaccttcatcaccttttgtttcatctcaagacaattctgagggactgttttggagcgtgtctggaaggtgaaccttgaagaagagtgtgggttttgatgtgactcagttgagatctttcatggggaggcaggaattcaatgcccagaatctgggctggtgtctttgaggtcagtaggttgcgtctttgtatccaagtccattgttactaggttggaggctggagattctaaatggcttccagaccatctctctgattctctttgggagatggggtctgaaagacaatgtcagtagttttgggaaattctagaaagtgtgcttggaaacgtgggaagagctcttgcctagtgcctaaatgctccatttgcagctctagccaagtagatacttggtaggtatagagccgggtttgcgtttatattagcaaaacctatgtcagagttgaagaagtagtcaggaaaaagcgtcttggtcgcaggccggggaacatcttaaaagcaaacttctagcctgctgactcttggcaatgagtgttggatcctggctaaagtgccttgaatgcagcatgaggccaatccatgaatccaacttctcatggagaaatgttaatattttttcagtttgaatcaatcagggtgaaactaccatgctattggtttgcttactttttattatttcatgtaaaatctaagacaaaatacattaaatgcttattgacatatgtatttattcttcaccaggctgataatatctgcctaattttaaactttcttccattttgtaggtttcaacttattctattgtaagatactgttaaatctaatagaggcattgtcacttttacgtataattttattttatttcatatatttcctattggttttttacatttaaattatggagcacttcatcatataaaaaacttcaattatattt

SEQ ID NO: 8304 - DNA, 3543 bp, Homo sapiens
cagcccagggccgggctgcccaccgtgccagcccagtttcaatgacccacctgagggtttccatcgtgggccaggggaccggcgcaggcgggcatccggagccaggcagtggccagcccatcccgggcagggtcataggtggggctgcaggcctcgaagccgccatgtgaaggcagcagcgaccccaggcagggcgggccaggttgaccttgcacctgctctcccctcagccccgcggccatgccgaccctggtcgtgggcacgccgcccacctgcctgggggacacacctcagccctgccacaagaacagccagaggcagggccccttctcccatggggccccagggagagcagccgactggaaggctgttgccaagcccaggctctgcgcacctgcagctgaggatgacgtggcagccctgaggtggcccgggccctcccagcagccagacccaccctgggcagctccccacgtggtcgggtctgacgacctcaaggaaccaggaccctgggggaaggcgtgcagcctgcccatgtggtccacaggcccggaggctagggatggggacagctcggtgtcatcgggccgcctctcgtgctcttcggggggccacgacgtgtgtgtgtcttggaaggagaggccaccccaggtgttggggccccagcagaggcccagaaagagtgacgcgcggctggagcagctgagagacaagatccgggcccaggcgtggcagcaggggagctgtgcgtccctgggcacctcagccccctccagcgcctccagactccacaaagcctccacgctgatgcttaggaggaaaggccaagaggcaaaaaatccccctccagcccctgaatgctcaggtttcagcatcttgagtgcagctgagcgcagagttgaagccaaggcatcccacggccaggggcgcgagctctccagggtctcccagcaccaggttcctgttctgagggaaaaacccaaaagggtcaaaagcagttcttgcaaaagagagaagacccccaagttgccctcccctagaagagcggccaaagacaaacacaaagacgaagattcggagctggttggtgtttacgcctggagaaagggacaagctctggtgaggtcgctgcttgggccccctcccgtcctccgcaggcaccatagcaaggatccctcgagagacccggctctcaccgtggacttaggagacagcgagaaagtcatagctgccaagtgctcaccggtttgtgcccagttgcccgatgccacctccgcctacagtgaccagcaggtgtctgggaacacacccagcctggcttccttcgaccagccagcgaccatacagacggccatggccatcctacaagacctgcgccagcaaatccaggctgggctggagctggcccaggcccgcaagggagggcaagagctcgggccatcaaagcggaggctgcaggacgtggcagggaggggctgctgcagggaccccaatgcccagagctccttctctaagagtccctgggccatgacagagaggaagcattcctctttagagagggctaggagtgtccacacctgggagccctggagctcctccactgcacgggagtcctgtccgcagagggcctggggggcccaaggacaggaccgctccttccagaggccggagagtccccatgagaggttgggccacttctcccagaggccctggagtgcactggctgggcaggcctgcagtccgcagagggcctggggggcccaaagacagggcccctcctcccagaggcctgggagcccccctgaaaagcggagccccttcccccagcagccctggagtgctgtagccacacagccctgtccacggagggcctggactgcctgtgaaacctgggaggaccctggccccagactgcggaaccctctggaaaggcccagtcctccagcccagcggccctggagcagctccggcgtgcagagggccggcccccagggcaagggcagaggcatcggctcccccgtctcggctgccaagcatgccctgccaaggcccaccgggagcttccctcagaacccacttgggaaggagaaggacacgctgcggccctgccccaggtcccgggggctcctgggaccctcgcacagctctgagtccttgcgggagttcatgcgccagaaggcgcaggcccggcggcggcaggccctggaggagaaggcctcggccctgcgcacacgggagctgaggagccggaggctgcaggaggtctaccggcagcagagggaggccgtcctcggcagggcggtccccgtggtctcccggaccacccctggcatcgtgacctttgtccccagttctgcacagtccgggggcctggaagcctccgggagcctggagtccccagtgctggaatggagcaaagtgacctctggcatggtgctggggggccaggaagccccaggcagcttctgcctgtgtttgaacagagcctggaaccatgctgagaccctagatcccccagggatggggggcccccaagatggccgggatgcccccgtgctgctgtcagcttcaccctctctgggatccctggagctccaggacctgaccacccgctacctaccccgggggatgtgcatctacctggacccaaaggaggctgagcacctgggcacttccagctccctgcacctccggcataagcaggcgcagctgcaggcgctagagaccacagccaaagtcctcaagcagcgggtcgatagcctcaccgccaagctgcagggtgccgaagcgctggacaccgtcagggacccagctgtgggcctgctgcgctcgtgcccccacagcctacctgccgcccccacgctcgccacccccacgcttgccaccccagcctgccctggagccttggggcccaactggggcagaggggcacctggggagtgggtgagcatgcagccccagccccttctgcccccgacctacttcctggacggcgagacactgtcgtggggccccagctgggagcaacagcagagtgtgagcccgagggcccactgcgagagcaagccccgaggtgtgtctcaggctcctctcctgctgtgatggcttgggtcccccgtcccgtgctcccggctgaccagggagtgaagccaggtgccctcttctccaaggttttccagaggagggacacgtggacgtgaaaccagacaaaaggctgcagagaggcgtggcccccttccaggccctcagcccctctgcggggagctcatatgcgggcccagccacgctgcaccctatctggggctccctgggactggaggagacgccgtcggtcggaggggcagattctgtggcgccctgcaccccccggagctgcggtaagggcgaccctgcggacaggccctgggctggctggtcgggtggccggggcatccaccgagaacaccttccactgcctagcactcgagcttggccctacggggtagagaaatccttttccacgtggagagcatccacgcctcgttattaaaggttttagaggct

SEQ ID NO: 8305 - DNA, 2931 bp, Homo sapiens
aaagtgctgtggggagtgatcacatttttcacaacagtaagtccctgactccacctcttctgccacaaacgtcagcatggtggtatcagccggcccttggtccagtgagaaggcagagatgaacattctagaaatcaacgagacattgcgcccccagctggcagagaagaaacagcagttcagaaacctcaaagagaaatgttttctaactcaactggccggcttcctggccaaccaacagaagaaatacaagtatgaagagtgtaaagacctcataaaatttatgctgaggaatgagcgacagttcaaggaggagaagcttgcagagcagctgaagcaagctgaggagctcaggcaatataaagtcctggttcactctcaggaacgagagctgacccagctaagggagaagttacgggaagggagagatgcctcccgctcattgtatgagcatctccaggccctcctcactccgtatgagccggacaagtcccaggggcaggacctccaagaacagctggctgaggggtgtagactggcacagcaccttgtccaaaagctcagcccagaaaatgacgaagatgaggatgaagatgttcaagttgaggaggctgagaaagtactggaatcatctgcccccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcccagtccctggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactgtccggcttcctggccaaccaacagaagaaatacaaatatgaagagtgcaaagacctcataaaatttatgctgaggaatgagcgacagttcaaggaggagaagcttgcggagcagctgaagcaagctgaggagctcaggcaatataaagtcctggttcacgctcaggaacgagagctgacccagttaagggagaagttgcgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttattcaaatagccatggctcttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcgtgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttagtaatccgagagatgt

SEQ ID NO: 8306 - DNA, 549 bp, Homo sapiens
aggtggcacggtgcacgccaagatggctgtgtccacagaggagctggaggccacggttcaggaagtcctggggagactgaagagccaccagtttttccagtccacatgggacactgttgccttcattgttttcctcaccttcatgggcaccgtgctgctcctgctgctgctggtcgtcgcccactgctgctgctgcagctcccccgggccccgcagggaaagccccaggaaggtgagcccctggaaggaaagacccaagggagtggataacttggccctggaaccctgaccctgtgtctcctgcccggtggcagtaacaaagccttctgtctgcccagagcctgagtctgcagtgtcttccagtccccgtctgggtgggtgacgcgggactcgccgccccactcaggtggccacctggcctctccaagccttcagtcagcacgactgtgccaggtcatcctcagtcacctagctgggaggggagctggtctcaggccgggcgcggtggctcacacctataatcccagcactttgggaggccgaggtggg

SEQ ID NO: 8307 - DNA, 629 bp, Homo sapiens
ttctaatccccacaatgaccccagcctaataatacaataatccccaagtagaaccaggggcccaaggccccctcgtcagctgggctcccacctccaagctgacgccctcaaccactctgctggggagcccaaagatgttaacttgtttaataatcaagccctgtgaaggagtttatagcatctgtggattttggtacccacggaggtgctggaaccaatcgttgaggattccaaggacaactctatgatgcaggcacacctgtcctagctgctcaagggtcgtgggatgcaggtggcacggtgcacgccaagatggctgtgtccacagaggagctggaggccacggttcaggaagtcctggggagactgaagagccaccagtttttccagtccacatgggacactgttgccttcattgttttcctcaccttcatgggcaccgtgctgctcctgctgctgctggtcgtcgcccactgctgctgctgcagctcccccgggccccgcagggaaagccccaggaaggtgagcccctggaaggaaagacccaagggagtggataacttggccctggaaccctgaccctgtgtctcctgcccggtggcagtaacaaagccttctgtctgcccaga

SEQ ID NO: 8308 - DNA, 822 bp, Homo sapiens
gcacttgctgtgacccccacctggaggcttctctgcagcaggagcaggagctgttacccttctaatccccacaatgaccccagcctaataatacaataatccccaagtagaaccaggggcccaaggccccctcgtcagctgggctcccacctccaagctgacgccctcaaccactctgctggggtgagcaaacccaggccccacagctggctagcgggatatccgtgtccacgattggcgccatgtgttttaagttgcagcgtcaaaaacatgaagagattgctttagcaaatatttacccagtcctgactctgcacatggcatcgttctaggagcccaaagatgttaacttgtttaataatcaagccctgtgaaggagtttatagcatctgtggattttggtacccacggaggtgctggaaccaatcgttgaggattccaaggacaactctatgatgcaggcacacctgtcctagctgctcaagggtcgtgggatgcaggtggcacggtgcacgccaagatggctgtgtccacagaggagctggaggccacggttcaggaagtcctggggagactgaagagccaccagtttttccagtccacatgggacactgttgccttcattgttttcctcaccttcatgggcaccgtgctgctcctgctgctgctggtcgtcgcccactgctgctgctgcagctcccccgggccccgcagggaaagccccaggaaggaaagacccaagggagtggataacttggccctggaaccctgaccctgtgtctcctgcccggtggcagtaacaaagccttctgtctgcccaga

SEQ ID NO: 8309 - DNA, 706 bp, Homo sapiens
aaattgacctccagagattctctttcctgaagataccctccaaaagacaagaggaaagtttgccttttctgctcccttcttggaaagatgcaaagtgctttagtaggctcctggcacaacaatggcttctatgggcactacagaagccaattcaagagtgaaagtgctagagaataccaccttgcagccaagccccagcctccagcagtgttcctgcagcgatgtcaggagccggcgcagcgacacttcttctccaagcacgacaaccgtacttcctttgacaaaggtccctattgcctgctgcagggaatcggaaggcggaaggacctggagcgcctgtggcagcggcacaccttcctgcgctgggcaccctgtgagatagagttgcgccagcaggggcccctggaatcttcttaccaggctgatttcaggccaggcccaggactcagtggcctcccccagcacctcatccactttgtgcaggtccagccttcccataccaggaccacctaccagcagaacttctgctgcccatcccagggtggccactatggcagctacaaggtagggccccaggcgccggtcactgacgtactgcctgacctcccagggatcccaagacccaagctgctgcagcactaccttcatgctggggtctctgagtgtctaaactggtccagagcattaaacaaggacagctgacaca

SEQ ID NO: 8310 - DNA, 1757 bp, Homo sapiens
gcgctgaagcgggtcccggaggagtggccacgacccagcacaggatgcagagcttcctgactctgctgaaggagcatgaggacacctgtgcacccccggcggagctggtgacccttgcgggcagactgtgccgggacttccaggatgaccttgcccaactgcagcctttggtcacagccattctggacagccagctccgcctgcatctcctggacaacgcagatgtggccctggcgtgcgcccgtgtcctggaccagcaggagcagcagcaggcggcttgccgcctcctggaggggtgccaggtgccgggaggcagccaggagttagtgcagctctggaacgacatccactaccgtctggtcatgaggaggctgggcgtggctgcgctcaccccggtgcagaagttccgctgcaggaagaggaaccccccgcccccctccctctgcccagaggggctgaagagccggaacttccccagagaggttcgtgagaagctgcacaatttcgctgtgggggtgaacaccaaccccagcaaggctgagagggagaacttggcattggagacgagcttgacccctgagcaggtgtacaactggtttgccaattaccggcgccgccaaagagcccttccccagcacatgaagccagcccagcaggccacagctgaagaccctggtgcgagggagaggggtcctgacctcctgcagccctcaggcaacccccgtgttgactctgggtttgtggacaggcctcagtggtcagaggaacgtgaggaaaaggggcctccacagtccccacagaccacccaaggaccatgggagccactggccttagccccggactttcccgcagatgagacagtctcaaagccactggatgtcagcggccatccccagagcgtgcaattggaggagggtctgggcacaagcagtggacggacagagctacgggtgggcagcttcctggtgacacagcccccactgcaagctcctgaattcatcctcacccagagccctccagagctggccccagccccatctgccttccccggccctgtgtctgccatggagctgagccaggccctgccctccagccaggtgcagtgttctgatagccaggcctctggtgatgccttctggggagccaggatgctccttgagttttcagggagcagcctgggctgagctatccccaggagccagacagcaccccaggaggagcgggtgtggatggtctgcctggtcaacacaaggagttacagagctttatcctgaatacaaaatgaaggtccccagagttcccctgggggctctgctgaaaagcagagattctttcccactgccatgtttgaatagtttggttagcaattccctgtagtagagaaagcatttgagaaatgttcgtgagatcagaagtcaaaggtgggtctgtcccactcacgcagcactggatcagtcgggctccggggcactcgtgcagagaaggccattctagagaggggagtgttctgctgctggctgccttgccgtctgcccgtgcacacagccagacttttccaccaagttaactgagtgaggtatgaggagtgttctgagatttctgtgtgtaggggcttctcccttgagtactgggaggcaaacctgtctgcgaatggcctaggcagggcagagtagggtggattttccctccaggttgtaattcactgtgtctatgacacaaatgttgtagtcaattaaagtttaatgttttgaactccc

SEQ ID NO: 8311 - DNA, 510 bp, Homo sapiens
atttgcccctccttccagaccctggcagccaccattctactctttgcctctatgaatttgactattgtagatagctcatgagtctccatgggatacttgcctccgcaggcaccataggagcagtggcagcttggctgatgagctataagccagccttgtttgggttcctattccttctgctgttgcttagcaactggttggtcaagtatgaacacaagctcaccctcccagagccccagcaggacgagatcctccaacggctgttgttcagtgaaatgaagatgaaggtcctagaaaatcagatgttcatcatatggaataaaatgaatcaccacgggcggtcaagcagacatcggaattttcccatgaaaaaacacagaatgaggaggcatgagtcaatttgccccaccctgtctgactgtacttcgagttcccccagctaatgaggccgaggcgggctggcctctgccgatgttaccttttacctcagtaaaacccagtcacagccta

SEQ ID NO: 8312 - DNA, 1346 bp, Homo sapiens
atggcatggacacaacactccggatggttaggactgcctgtcagcacagagctcctcaaatttcacacaagacaggctgttctcacatttcaatgcactcacctggagggcttaccacaacaaagatggccggacccctgcccagagtttcagattctttgttttctgccatggaattggccaaaatgtcagacatgacaaagcttcaccaagctgtggctgcaggagactacagcttagtgaagaagattttgaagaaaggtctctgtgacccaaactacaaagatgtagactggaatgaccggaccccacttcactgggctgcaatcaaagggcaaatggaggtgatacggctcctgatagaatatggagccaggccctgcctggttactagtgtgggctggaccccagctcattttgcagcagaagcaggccatctgaatatactcaaaactctccatgcattgcacgctgccatcgacgcccctgacttctttggagacacaccgaagaggattgcacagatctatggacagaaagcctgtgtggcatttctggaaaaggcagagcccgagtgccaggaccaccgttgcgctgcccagcagaaggggctgcctctggatgagcgtgatgaagactgggatgccaagaaaagggagctggagctgtctcttccttccctaaatcaaaacatgaataaaaagaataagaaaagtcgaggccccaccaggcccagcaataccaaggggaggagagtatgagaactcaaccttatgttttctggcaaggaactttccctggtgccagaaatgaggctgttaggcatggtggcctttccatgactttactcatagacccttacccacctggcttctgcccatggacctgtcattaggtgctgtccacatgggctgttgtttcctggctagcacctactgtgtacaataattaccgggaaaggacaaaacctgcttgcattttgtcatcagtggtttgcacagtcagcatcttttgacccctgccccccaacaataatagaatttcaggagacaaggaaactctggcatgaattaacttcatccctgataacgatcgagagataatgtaaaataatgaacatgtgattataggtctactttttcaactgtaaatttgggaaaattaaattcagatcagataattccaataaaaaattgcatccaaattgagatgcaaaatacacattagatttcaaacacttagtacaaaaatataaaatgtctccttaataatacttaatattgattccacattgaaatgataatattttggatattgcgttgaataagatatattaccaaaatgaa

SEQ ID NO: 8313 - DNA, 2422 bp, Homo sapiens
acattaaagctatttaattaattattattattattattttgagacagggtcttgctctgttgcccagactggactgcagtggcgtgatcatggctcactgcagcctcgacctccagggctcaagcgatcctcccacctcagcttcccaagtagcggggactgcaggcacatgccaccacacccagctatttttttttattgtttgttgagacagggtctcactatgttgcccaggctggtcttgaacttctgggctcaagcggtccacttgcctcggcctcccagagtgctaggattacaggcaggaggcactgcacctggccagaaaaaactattcttgacttcacattttccaccagcttcacccctgcccctttgcttctctttgcagcaaaacttcaaaaagcatagtccacgctctcccccaggcattcttgggtctctctacccaggattttgctcccccatcgccacatctccttttgccaagggcaccagaggcctccgtgttgttggatccagcggtcggctctcagcctcctcttaactgctcagtggcactggtgccgccaagcaacccttcctccaagagagccacaggctctgggatacttcactctggggttcctcctacctcacagactctcctggctggtcctcctcttctccccaacatcttatggccaggtctccaggctcttttctgtctacaggcactctccatgagtccttattcagtctcctggcctcaaatgccagctgtgctgagacccccttatttgtagctccagcctagcctgctctcccctgaaccccagactcatgtttccagctacctctgccgatatctaatagacacctcaaactcaacctgccccggctgcactcccgatcggcccccacctcctacagtcatcctgcttcagagactatagctccgttttcaagggctcaggccacacccttggaaccacccttgcatcctctctttccctcaaaccaccgcatctctcacctggattatcgtaacagcttcctgtgtcccagctgcagtcccccgcccattacattttgttcctaacacagcagccagagtgagccttttgaaagggaagattatggggctctttggctcacatagtgcagtgtctccccatctgaccactaaggcctggctgtgaccatatcacccctgcgacctcaactcccctcacctccactccagacacacctgctgttctatggtgctgcctgcagttcaacaccaaagaatattcttcgctccaggaagaaaaacggttttctccacctccaatcacaatgtgttcttttggcctatcttttgctccccacccacccttttttttgagacggagtcttgctctgtcgcccaggctggaatgcagtggcacgatcttggctcactgcaacctccacctccacctcccgggttcaagcgattcccctgcctcagcctcctgagtagctgggactataaatgcgtgccaccacgcccagctcattttttgtattttagtagagatggggtttcaccatgttagccaggatagtttcgatctcttgacctcgtgatccacccgccttggcctcccaaagtgctgggattacagctgtgagccaccgcgcccggccttattttccccttttaggaaacactgggaactattttcttctcagagaaaaacaggacttgcccaatagtaacatggaaacttaacagggtcttaacctgtgaagactctaggagcagaacccggagtaagggggagcaggggccggagtaaggggagcagggccccgtctaagatggggcagggcctgggctaagggagagcagggccgggctaaggggaggcagggcccagtctgaggtgggggcagggcctggtctaaggggagcagagcctgggctaaagggcagctgagcccagtctgaaggagagccgagctatctgaataggggctagcacctgttctaaaggaagtggctgctcccctgctttcgctgtaagagggaacacaggccttttaagaaaatgggaatcaagttttttgtttaatttcccaaaggttatatgttgacaattaacttcaaagtattagctgctttttgtaggccaaataaacacgtctgtgggccagatctggcccaggactagagttgccagtggcaacttctggcccaggctgaatggtgggcaggaaggaaatggagcccccaggagtgggagtgggagctgatgcctgggtacgggagctctgtgggtgggagtgagacaaaaaacagggtcttgagctctggggagcaagcagtgtcctccagtgaaggaaatcctggactcgcaggcagaagttttgcctcttactcgccatgtgctctgaataaagttacctgccctcc

SEQ ID NO: 8314 - DNA, 1794 bp, Homo sapiens
gcgttcccttaacgccggcagaacaagatggcggcggccacgtgggataaggaaagtaagtgtcggctgtcgcgtggtcactgccaccaccgacgccaccagtccctcccggtaggcctcacactcagatacagcgcgccggcctcccaccaaccgaaatgtttcacctccaagcacgggacccgcccgtcccagagaaagccaagcctacgtgtcagtggccattactctccccactcgctattccccggtcacggccggcgcggcgcgtgtgtggcgaggagccgccgtttcgcaggacatatgcaacttacctggaaattaaaacgtaaaaaacccggacgaacagcgagctcggaggagcacaaaaaacagggacggggctgcgccggaagacgattgataaagagtacgtagcgagaacgtcccggaacgttccccttgcgcgtcccggcgtgcgtgctgattggctgaggccagcaggagcggagtggtggggagaggaagggacagcaaagcgaagggagcagtgttctccgcgaaatggggtgtttccggaaatggggtgtttccggaaatggggtcgacttttgaacagctggtgcaccctaaacgtcagcatcccccccacaaccggctgagctgcctttatcccttccacaaaggaaccttctcaatctcatactacttgctgtccctgacatcatcctcccgtccttgccatcatttcccccgctggatcggatgtcttcctcaccatcgtagtcgtcttcctctaggtccctgccattctctgatgttaacctccttcaccttctagttctttaacctcataccctttaaaggcctgacattttatcccccaccgtcactgatgtcatcacccttcacagtccatgatgtcagacccaacgttttaaggtttgaccctgactcctactctttctcctctgtgctcaacatctagccgcctgtcatgggacccttttccctggcgtcattccatctcatctctgacttcagccctcacccttgtctgactgctggcgtgaagccagccccttaattttctcaccaatagactgcctgagatggcttttacaaaacaggatgctggccgggcgcggtggctcacgcctgtattcccagcactttgggaggccaaagcgggcggttcacgagttcaggagttcgagacctgcatggccaacatggtgaaaccccatctctactaaaaatacaaaaaaaaaaaaaaaaaaaaaaaaagaaaaaaaaaattagctgggtgtggtggcacgtgcctgtagtcccacctactcgggaggctgaggctggaaaatcgcttgaacccgggaggcggaggttgcagtgagccgagaccacgccattgcactccagcctgggtgaaaacaaaacaaaacaaaagaggatgctacgatcttcagaggttgtaaatcccaatccatagagcaatttttgctctcttcgaaagtaactgagcccttgccgggcgcagtggctcatgcctgtaatcccagcactttgggaggccgaagtgggcagatcacaaggtcaggagttcaagactaccctggccaatatggtgaaaccctgtctctactaacaatacaaaaaaaaaaaaaaattagccgggcgtggtggtaggcacctgtagtcccagctactcaggaggctgaggcgggataatcgcttgaacccgggaggtggaggttgcagtgagctgagatcatgccactgcactccagcttgggcgacagagcaagactcagtctc

SEQ ID NO: 8315 - DNA, 1646 bp, Homo sapiens
tatacacgcatatgcatacatatgtatattcatatacacgcatatgcatacatatgtatattcatatacacgcatatgcatacatatgtatattcatatacacgcatatgcatacatatgtatattcatatacacgcatatgcatacatatgtatattcatatacacgcatatgcatacatatgtatattcatatacacgcatatgcatacatatatgtatattcatatacacgcatatgcatacatatatgtatattcatatacacgcatatgcatacatatatgtatattcatatacacgcatatgcatacatatatgtatattcatatacacgcatatgcatacatatatgtgtattcatatgtacacatgcatacatatatgtgtattcatatgtacaatgcatgcatatgtgtattcatatgtacacatgcatgcatatgtgtatattcatatgtacacatgcatgcatatgtgtattcacaagtacacatgcatgcatatgtgtattcacatgtacacatgtatacataagtgtattcacatgtacacatgtatacatatgtgtattcatatacatatgtatacatgtgtatattcatatatacatatgtatacatatatgtgtatattcatatatacatatgtatacatatatacacacatatacatatacatacacacaacttttctttaaccatttgtctattgatgaacacagtttgtttctctatcttggctactgggaataacgcttcaatgaacatggcagtgcagatatatctgagatactgatttcatttcctttggatatatgcacagaagtgggattgctaaatcattcagtagttctatttttagtttttggaggaaactccatactgttttccataatggttgtgccgatttacaattgtacccttttcttcacatcctcaccaacacttaattattttttgattttgtgataatagccatcctagtaggtttgcggtcttatctcattgtggttttgatttgcagttccctgatgactagtgatgttgagcaccttttcatatacctgttggcaatctgtatgtcttctttggaaaaatgtcttttcaggtcctttgctctatttttaatcacgttatgagttgcatgagttccttatgcattttggatattaagcccctatcagatatatggtttgctgtgcaggaattttttagtttgatgtagtgctacttatttgtgtttgactttgttgcctgtgcttttggtgtcatacccccaaaaattattggcaagcccagtgtcaaaaacttttcttctctcttttcttccaggatttttatagtatcaggacttgtatttaagtcttcaatccactttgagttgatttttgtatatggtgtgaaataagagtccattttcatcctatggcaagtaaatatccagttttcacaacaccgtttactgaagagaccatcctttccccaatgtgtgttcttggcacctttgttgaaaatgaatggactaaattcataacttggcctctgggctctctattctgtcccactggtctctgtgtctgtttttatggcagtaccatactgttttgactactatagctttgtaataaaattacagatgccttac

SEQ ID NO: 8316 - DNA, 2501 bp, Homo sapiens
acggggaggggtttgaggaggggatcggaatgtggctcaagttcgggaggcgttacctgcggagggtttgaggcaggcccaagagcgagcccatggtcttccgacgcggggccaggggcgggccccaggatccggagcttcgtgcggggccgagtccaggtttggggcccgggaggcggggccagttagggcgactgtccctgggatcgtcgggtcaggccttgggctaacgtaggcactctcgcagttcctccgccttcaggaaggtcttttcagcaggggccttacgggtgcatgcttcggtcctggaggccttatcctagcctcctctccatcagcgccacccgtctggggcccgaaaggagggagctttccctctgtcccccagcctttggactgtcaccaaacaagccattcgttcatcaaatactttttaagcgcctaccatgtgcctgacaagggagatgtaacggtgagaaaaactaggtgtggtccaggcccttcaggggctcaggtgctcgtggaagaagtggacattgaagtacttatcacacaaatgaggataaaagtacgatagcgatatctaccacgaagctgttgttccccaccagaaccaaatgagcgcaagatctgacaaagaaaaaaaaaggttcatcttttattcctccaaacactttcatttaaatcaagaggatgggatgtggttattgctgtgtttttagacagaatcaacggtttctgggtctgagatgttgcatacaccttctcagtccctgtatcctgagatggagtcacctgagaatccacagcaagtcctaaccagggatgggtctgggtgattaaggaaggttggcttcagaactgggccaggggcactgctttgcttttgctgttttgatcagctctctgcctgaaggagacaagaaaaaccaacgggaacagctggggaaactgagttacagagcttgtctgcactgagtcatcaggagcaaatgctagatcagatagggtctctctctctgccacccaggccagagtgcagttgacgcagggcaggggagccccgaagtggagcatagtgtgtccggaactggtgggttcttggtctcactgacttcaagaaagaagccgcggaccctcgcggtgagtgtcacagttcttaaaggctgcgtgtccagagtttgttccttctgatgctcggatgtgttcagagtttcttccttctggtggttttgtggtctcgctggcttcaggagtgaagctgcagaccttcaagaaatgaggcttctccccaggaccagcattccacgaaggcagcccttttctagatggagaaaacagaacctgaagacacccgtttccctaaactgctctcgctcatgtaaactcctggagggcagaggcatgcctgccatcttcatcattgcattaccaccacccaacactatcgggggacctgccctgataatcagtctacaggtgtatccagcagctccagagagacagcgaccagcgagaaggggccatgatgatggaggtggttttgtcaaaacgaaaatggggatatgtagggaaaagaaagagagatcagactgttactgtgtctacatagaaagggaagacataagagactccattttgaaaaagacctgtactttaaacaattgctttgctgagatgttgttaatctgtagctttgccccagccactttgccccaaccactttgacccaatctggagctcataaaaacatgtgttgtatgaaatcaaggtttaaggcatgtagggctgtgcaggacgtgccttgttaaccaaatgtttgcaagcagtatacttggtaaaagtcatcaccattctctcatctcaataaaccaggggcacaatgcactgtggaaagccgcagggacctctgcccttgaaagctgggtattgtccaaagttcctccccatgtgatagtctgaaatatggcctcgtgggatgagaaagacctgacggtcccccagcgcgacacccataaaagatctgtgctgaggtggattagtcaaagaggaaagacttgcagttgagatagaggaaggccactgtctcctgactgcccctgggaactgaatgtctcggtataaaacacgattgtacatttgttcagttctgagatgggagaaaaaccgccctatggtgggaggcgagacatgtttacagcaatgctgccttgttatcctttactccactgagatgtctgggtggagagaaacataaatctggcttacatgcacgtccagtcatagtaccttcccttgaacttcattatgacatggattctattgctcacgtttgttgctgaccttctccttattatcaccctgccctcctactacattcctttttgctgaaataatgaagataataatcaataaaaactgagggaattcagagacctgtgccagtgcaggtccttagcatgctaagcgccggtcccctgggcccgctgttgtttctctat

SEQ ID NO: 8317 - DNA, 1428 bp, Homo sapiens
ctattttaaagttaccagttcagaaaaagctggttctagcacgtaggtctgatagaccatattctaaaggtcagctaaaaaggactttcaaaccagggcaagtaagattgtccgtagcattttggggccagaatggctttagtctctgagttgccacagggtaaggtaagaactatgagcaggtccttccaactcatgattcctaagttccagaaaagttaacaggccacagcttacattgggagctgaagattatctgggtcagttggctgtctttggtatttggctcgactttatgatatatgatgggaataatcagcttctgaatgccagtaaggttggggaagtgctgagaggagggactaggcagatttattaccaagtggttaatttttcatctctctggcctctgtataagtatgcagataagttacatgtaattcttctctacaaaactctccatcagttagtggtagagcctgttaaagtagcagcttggtattatgaatctgctaggctcttaaacacttacggacttctaggtatgaatgtagctggtataagctggcacctgtacatattccatttagtttgtaccgatacctctgtaagttcttcagcccctctgccctgtcccctacctttgattcatcaaatgcttataatttttgtttggagactactgcgtgcatgcctctattgctcttccttggctcttattatttggtcctactcctaactcacctgataactccaacttttggtagattttgttcctgtctcttatagtgtcccaacttggtttcttcctaccaaacaaaaagacacgggaagtatctgtagtagaatgtttctggtatccagttggcaaatggaaactgaggttggccccaactgttcttagaccacctttaggttttgttgatcttaatgaaatacacagcattgcatttcattccttttcatttaaactataaaattatatcaaatgatgcctacattaagattctccctataagactgccattccagatggcaaaaggtgaatagtcataatagaaaccaattcttaagcacatgtgtggtattcccttgaccacaccctgggccatggtatctgttaatatgaaagcacatggggaaccacagaggagaatggcctaggtggtggctgctgtttgctgaggtgtgctgcttactcaagcaggagggcacctctgactgcttgggatctccttttttttttttctttttttagacagagttttgctcttgtcactcaggctggagtgcaattttgtagtcttggctcacctcaacctctacctcccaggagaatcgcttgaacccaggaggcagaggttgcagtgagccgagttcacaccactgcaccactccagcctgggcgacaagagtgagactccatct

SEQ ID NO: 8318 - DNA, 1460 bp, Homo sapiens
cttcctgggccctggaatgggcctgaagtcagccggcctcagcccacagggtgaatgaggggtgggcacagcccggccgcggccccagcacacacgggcggacgcaggggcgggggagcgccagccccgcagtgtgttcggagcccagcggctctgagtcgccgccaccagcctggccgccttctgctccacgtctgttcacccgtcccctggaccggcaccgccacagagggtcagagtgttggcacctgtcttccgggtcagttcacccgtcccctggaccggcaccgccacagagggtcagagtgttggcacctgtcttccgggtcagttcacccgtcccctggaccggcaccggcacagagggtcagagtgttggcacctgtcttccggatctgttcacccctcccccggaccggcaccgccacagagggtcaggagtgttggcacctgtcttccgggtcagttcacccgtcccctggaccggcaccgccacagagggtcaggagtgttggcacctgtcttccggatctgttcacccgtcccctggaccggcaccgccacagagggtcagagtgttggcacctgtcttccggatctgttcacccgtcccctggaccggcaccgccacagagggtcagagtgttggcacctgtcttccggatctgttcacccgtcccctggaccggcaccgccacagagggtcagagtgttggcacctgtcttccggatctgttcacccgtcccctggaccggcaccgccacagagggtcagagtgttggcacctgtcttccggatctgttcacccctcccctggatcggcaccggcacagagggtcagagtgttggcacctgtcttccggatctgttcacccgtcccctggaccggcaccgccacagagggtcagagtgttggcacctgtcttccggatctgttcacccctcgcctggaccggcaccggcacagagggtcagagtgttggcacctgtcttccggatctgttcacccctcccctggaccggcaccgccacagagggtcagagtgttggcacctgtcttccggatctgttcacccctcccctggatcggcaccggcacagagggtcagagtgttggcacctgtcttccggatctgttcacccgtcccctggaccggcaccggcacagagggtcagagtgttggcacctgtcttccgggtctgttcacccgtcccctggactggcaccagcacagagggtcgagtgttggcacctgtcttctgggtctccatccctccctttgtttgttgagtgactgcatgttctcatttccttatcatacaattctttgagaggtatcattagctgcgtcttattttattttcaccttcttttctgttacctgtatgtttgaattttcctataagtatttttgtttcatctttgcttttttaaattaaaaaatcagttttaaaattg

SEQ ID NO: 8319 - DNA, 2440 bp, Homo sapiens
actgcaagaacgtaaggctgcagggaatacatttttaaagcgtcggtggggaactttctgggacgctcaaccccctgaatgcctggaccccctcagtaagagtcccatcaatagaggcagtccaacagcaatctctctgaggcagcctgagttaggtcacacttctggtctgtcctgctgttgcatctgctcagaactgttagtgaaggtgtaaactcctcccctgacagaacaagataatacccagtttcctttaaggccatcagtctacccaaataatctccgatgaattcccttttctgctgatagagtgtgtaccatgcccaaagtggtaaaaaccttccatccccagaccccctccaaggatgggaaaggtgagcctgatcctggaagagtatcttaccttccccttctggggatgactccccttggtgactccccttcccacacacgctatacccagtagctcagtcctaggcacacagaagcttcataccactggcgagcaactgttattggctgtaaggcagcaatgtgcactggatttttattctgctatccagttatgccctctccatactcattgccacagaattgggaggaccctgtggctaccttttgtccacaatagagagtagagtaggagagtggcatcccgatgagcaggcagtttctctctgcctgtcaggaatgccttgcctgatgtgtgtttctgcctatattgctcctagtcccaagtttctactactctgtgagaagaaaaatagatgctcacagacagaccaacatgattcctcccccgcttcctggaacccctgacaccctcccagatatgtcttgatctcctctttatcagatgtagattctcttcattggtgagtctttcatcaaacatccattttgcccataaggaagagtgtgtacatgtaaaaaataagattgaacgttctcttttggcaaaagagagagatcttatctgtcttcccttttcctaggacttttccttgagaaaaacctatatttattaatccttcctcttcactttgatatgtagataaatcttttgtttttgcagacagggtctcactttctcacccaggctagagtgcagtgggcatgatcagggcagccttactggagcctcaacctcccaagctcaagcaatcctctcacctcagcccccaaggagctgggactacaggtgcaggcccccacaccccactaacttttttatacttttttcgtctggaactcctgcaagcagccctcccacctcagcctcccaaagtgctggtaagacagccaggtgggaaggattccttggcagaatctccttttgacctgagcactgggaggaatgcaccctgtggtggagccttgggaaatttgcgccatttgcagtggggaggagcctggcccctccttttcctaggtggaacctgggattcagtctaccaggcaggaagcactctggctttggggagagtctctgtttccctttttttctttttgcccaataaattccattctcacccttcaaggcatctgtgagcctaatatttcatggccatgtgaccaggacccagctcttagctgaactaaggagaaagtcgtacaacagctttggcacccaatgtggggcttgagaagcggttgagtgacacggggactcaaaacttttcactgtcatttctaagccttttcatgcgtggacttctgagggtagggaaaccatgcccccactcccatcgctccctggggtcaggggcctttccatggcctttgccttcgttttttgggaaggataggcaagtcgcagctcctcattccctctcccctcccagctggggctggggaatgccacatgtccacagcatcttccccttccctggccaaggctcaactccatctgataagcttctctccctggtagaggaaccatttgcctaagaataaaaggtttattcccccaggcatccttttttcttcaccccatcaacagttaacttttaaaccagatgttttttttctttttcactaggctaggaatgataaggatccctgtttatattctccttaaagtttggttgtgaaaaaggatcttatggggactggttttcttctgcctgtctgtgtagctatatatatgttgtgtacatgatgtctatgaaaagagctcaaaggccaggcacggtggctcacacctgtaatcccagcacattgggaggctgagtcaggcagatcacctgaggtcgagagttcaagaccagcctgaccaacttggagaaaccccatctctactaaaaatacagaattagccaggcatggtggcacatgcctgtaatcccagctacttgggaggctgaggcaggagaatcacttaaacctgggaggtggagattgcactccagcgtgggcagcaggagcaaaactccatctc

SEQ ID NO: 8320 - DNA, 3626 bp, Homo sapiens
gattttagggaaaaaaattacttttcttagaaaaagaatacttgttttgtgttttgcctttttaactagactgtaagcaagaggatacaaacatgcctagtacatacttgagttccctgtagcccctaaaattgaaaaaggtaacaagtgggtgttagtttattgctttccagattgaccattttgcagttggagaacatattagtgaaagcacacaactcgaaaggacaaatgaaaggatacagagataatgcagttgaaagcaccttcacatctcgtttttatggatcagaaaaatggttacagattacatatcttaaaacacagatgccttctggttctgcagggaacatagaagatcttacttctttttttatttttttgagacagagtcttgctctgttgcccaggctggagtgcagtggcacaatctcagctcactgcaacctcagtctcccgggttcaagcatttctcatgcctcagccttccgagtagctgggattacaggcgtgcactgccgcacccagctaatttttgtatatttagtagagacagggtttcaccatatgttggccaggatggtctcgatctcctgacctcataagccactgtgcctggcctttttttttttttttaactgtaaattgacttttgctgaaatgccatcagagatgacttttaagtaaaagtggagtttaactgtactacatcctattcgtaagtcatggaacttcattacctcagattatatatatctctcaacacatttgccttattaaaaacagctttagtaactttattagatgttcagtggttcacaaaaatgcaaagctaacatttttaagagcctgataaaggtggagcagatgtaccacaagctgcagggaattaaatcctggtatgagttttataagttgcaaactaagaggaaggagtgggattctgagaaggtggagtcaaattttgttgaaaacagtgaaggcaatagctttcagatttcaaaaacgactacaaaacatctatgcttttggctgttttttccgttgaaaagctatgaatgcctttgcaaaaaaaatgttctcacaatgttggctcttattgataaaatgtaaaatttatacttggttggcattttgttgttttactcagctgtatgcattaagaagtctgctgggccaggtacagtggctcagcactttgggaggtcgaggtgggagaattgcttggggtcaggagttcgatactaacttgggcaatgttgcaagaccccatctttgcaacaacagcaaaattagacaagtatggtggcatgtgcctgtagtcctagctactcgggaggctgcttgagcccaggagtttgaggttacagtgaactgtgattgcctcaagccccactgcagtctctggcctggacaacagagcaagacctttttttttttttttttttttttgagacagagtctcgccctgtcacctgggctggagtgcaatggtgcgatcttggctcactgcaacctccgcctcctgggttcaaatgattctcctatctcagcctcccaagtagctgggattacaggtgcgtgcctccacgcttggctaattttttgtatctttagtagagatggggtttcaccatgttggtcaggctgctcttgaactcctgacctcaggtgatccgcccgccttggcctcccaaagtgctgggattacagctgtgagccactgagcctggcccaattagaagtcttaaataacatttttctagtataatatggtgggtttgcaaaaaataagactttatttttcttcagtcatcggtttctggccagccatggtggttcataactgtaatcccagcactttgggaagccaaagcaggaagatcacttgaggctaggagaattcgagactagcttgggcaacacagcgagcccccatctctacaaaaaataacaattagctgggcatggtggcatgcgcctgtagtcccagctactcttgggaggatcgcttgagctgggaggttgaggctgcagtgagctatgaccatgccactgcattccagcctaggtgacagagcaagaccctctctctaaaataaagtttttaaaaaattagaaaaaaacaaagtagtcagtttccaaggaataagtcttgagaaattggttttctcccttttgaaatgtcaatgtattttgtatgggaaaatcaaaactactgtaaagacctaagaaaagcatgtctccttttgtaacaaaccttgtgttattcatataattacattttggcatgaaaggaagggtaatagtttgtaaatagtttatggaactaacaagagattgcaagggaaatgtcaaggacatgacaaaggaattaatttaaacatctttaaaactgcattagtaacggccataatttttctagtgacagtcaaacaaataaatgttctaatttctgtgcagactacaaattgtgcatgatatgcccttgcttgtttatccacctgaaccatggaataatgatgctgaaggggaccccagtgctcatctagtgaccgaatccttatttgaccattgcaggaatcaagttcccccaaaccatgcatgtgaaagtaatgaaacatctaaaaatatatcctgcagcttgaacctctgcttactcataatagttcttacatccactccatgctcttgtctgtgttccaactccttcccctggtaatatgtttattaattgaaaaaatattacatacagtgcctgccctgtatgaaatactgaaacaggcactatggggtgcatggaacatagttcctgctgccatggagctcaccatttagatttggaagtaagacccacacagaagaaccaaggcataaaacaggaccgtatgtaaatcagtgtcaagggagctacaaactgctgtaaaatttcataggagggaaaggggattgggagatcacttccagctgagaaaagaatacaacaaaaatttttctattcacttgctttgagttttagggaaatcatgtagatttctggacttcagctttcttcctagtaaatgtttaataaaataacaacctatactccaagactggtttgaggtatcaccattctaaaatgcctgtgatcagagattttgaaattcaagacataatgcagttcaaagggtgctgctctttggcaagcaaagaacagttgtatctatcagtattgttaggactcttttcatctgcagggttttaatatttgtctgaattctagggggcaaatgcttaaaatgaaaatggtctcgtgcccttttattggcaaaaacaactttaaatgattaactctttgattgttagaagttttcacagactttggaataattcttactgacaggtagaccctcaaaatttggggtagatctcttttattttaagtagcattactatgaatgtaaatgtctagctttctaactttatttgaagaatagcaaattgttaaattaagtttgacctggatgcagtggctcatgcctgtaataccacactttgggaagccaagacaggaggatcgcttgatcccagaagttaagaccagccttggcaacacaacatgaccctgtctctataaagaaaac

SEQ ID NO: 8321 - DNA, 3435 bp, Homo sapiens
cctcaaataagagccacaaacgtggaagatatatccaaaggaaccaaattaaaggactggagaaagtctaggtgagatggctttgtcccgttgcaggcgagttccaagcacagagaaccaaatggtttccacagagaacatgtgtagaagggattgtaacccacaactgtctgaacccaagcactaagcttcaaaccagactctgtgctgcttctgctttatacacaggccctggctgaaaacccttgactttaccaggcatgcaaggagatgctaagtccactttggctgcagatctctaaacgaccacggcccgaagtgtcagtttcaaatgcttgtttcagctctgccctccccacatcaaatcccacctctctcacgctaaagcatcataatatatttgtgctgagagttgccttagaaatcattcagtattcagttcacgggggaagaaacagaaagcccctagaggtgacctcattagcctacagttgccctgagaactggtggcagaagcagattggtgtccagcctcctgatgtacatgccagtgctctttcccccaagccatgtgtctcctggtcacgccctttgtccttgctgtcctctactattctcttctggaagactcacgatgagagagccgacttctccaagctgcactcctagctctctgggacccagcagggaccgctgccttccagccagcagtttgaagaaggacagctaccatcaaacacagacttacagcctccctgatgccctggatgccaggaaatgtctggaccagtcaagataagagcaaggcagagccaggaagaaatggggacaggagttcctatttaaatatataaagaatcctttcctaggtagagaaaagtcatctagcaatgtgactgatcacctctccgtttatctgtttgatcaactggaatttctatacagaaggtttatacaaagaagccacaaacaaccattgtcacaatgacccctacataattccttgtgtaaatgctctggaaatgcacccagaagtctggagaaggtccaatcaaactgggtggcaggaagaagcaagctctgttctcagatcttcaacagaatcacctggaccctggggttgccaccacgctaagccaaggaggcctctgaatgcacgggagtgcagggtctgaagggagttgttaaaaggtgtttcttgatccaggaccatgtaaagacccaggagaaataggtatcccaaagagaacagcgtataagattcacaaaccaatgacaaacacgctgggttcgctgctggtctccacagttggttggttctgtagggctcagctgcctctttctctctacttctggtttcagaaaacacgagagagaagccgagtgctcatggagtttcctcaaagactcagcaaaaactaggctttgtgttctgagatcaggaagtaacagtgagagtccaaaattttcttccctgacaatgtctcctactcaagcagggcctggaagtcaccccctagaatcaaagccttgacatatgcaagctcatagtttattgcttcttctcccatctgcccgttgacagataaatcccagagggaataaaaacacattgccctcagcagattattcttcactgaagaataccagtcttttaacactccgctacagaaatagctttctgccggctgatggcttgttgcgctgcactaagagagcccgcacacctcgaagcttcgtcaagcaaagcctatgatttcacagacccagaaatgttttctttctctaagccaataacatatgcttgggtttatgccaactctaccagaggcgcacagatacaatgaggcatgaagttcagaataatagaaagtagagagttggaaagcacaggagaacccatctagaccaacctgttttgttgaaaaaggagctccctgacccagagaggttaagggtttgctgtgagacggtgcccctggttaaaggcagcatgagatgctgtcctctgatccccagcttcctagggctcttgcctctaggtcacactgccttgaggccaggagctgatattgattgaacagatgtgaaaacagaagaaaaaaaaattgtggtgactgccctctgacaattttccactttctttggaccaattttctttgccattatctggaaaaaaaaaaaatgtccagaagagcattttaaattcaggaagtggttctggaactaggagaagacacaccttgatgacagtaatattgtctaagtgagaaggaacaagctcttgaatgtttctagaaaaaccaaatatgataggagaccataaaattatacttcgtcatatggatttccagtttgagaaaacttagtggctaaacaaaggtgccgcttgagagatgcagacagaaatcagcctctgctttaagaacaagttgctacgctgaagaatgagaagaggaatggggcccagaggctgaaggtctggaccaatctcccttcccagataagcgcctggaccctcgttcctcagaagccacgtgtaattaccagctctttttggctacagagcacatgcccaggaggcttggagaagcaggaatttaaaacatgctagtttcagagccaagattggtgacaacaccatcagttactgtttgggcttcgggaagccgtgggctgcagcactgggtctggtgtcctgggctgtgtgggacctcagcaaggttgtttcctgaaatgaaagctcctcttctgggggatgacacaccaggaccacctgcagatgatgtttatgaatcccccagcaggggtggattgatcttacaatgggactgtgtaatataaacatttcattattctacaaaagaatacacacaataccacctaagggtctctaagaatagggttggagagtgacaatgagaaaatgccactcaaaaagaaatagagccgcattccttctacacaacattaatattaactttacatacaggggaaaaaaatggcattttaccttaagagttatttgtaaactctctccacaccatgagataaaatcagtgcagagctcagagctctgaatttcctcatttgggggctaatagactttaatgggggctcttcttggcatgcaaatgaacgtgtgtgtctctgagtgcatgtgtctgtgtgtgtacacacgtccctttgaagtttatttacttggtagcactaattgtaaaagggcacacccaggggaatttaatgaggcgacatgctagaatatagacattagaaagggaattaatattttcctcataatagcaagtaggtgaagtcaagtatgaggacagaaggaaagaaaaaggaaggcagggaaagagggaaggagaggagaggaacaggttttgatgatcgtagataagaaccaataaacactgttgcttcacactcccg

SEQ ID NO: 8322 - DNA, 1768 bp, Homo sapiens
attttcgcaccacagcactgcacggaaagtcagcgtgacggggacgaggagccccgcggagggatccgcgcgcagttcagtcgctacggccgacggacggagcgccgcgcccggcccgagatgcctccgccggccttaaagggggcccataaagacgcactgccaagggctccgtgtgccccggggccgcgggaatgcggatcgcagccggcagggaggggccgcggcggagccttagacttgggggagccaaggaggccactcccaggaggctgcggagcaaatgactgcctccccgagcccctggctgcaaaagcagaggttgcccgtggcttttgcagctctggacacgcgggtgcagcccagggaacgtggacaagaggtgttgacggaccggaccgtgcatttgagttggggcatatcgaagtggtttaattaaaagccgcgagtgtggccccagatcctggcgttatcaaagcaaatcaaagcctttcttttccagccgagcgggccctgtggaaatgagatgtacatttacccttgacgcaccgcaagcctggccgaggctctcaggttaattgatatttaatggaaatcatgcccatgaatatagtttccatcatttcacccttgatagacgtcagccctgggcgcagggggaggctgaagaatgcaggagggggcattaggcttgctgagagagtaaatagaagagcggacagaaacgttctgaggcgggaaaaagggctcgcgctggggagggtgacatttcctcgggcaggacgcggctcccgggtctcagccccggcgcgcagcgaaccagggccggctgcggttcccggaggagtgcggagggcagacgaccgcaagttccccccaggagcctcccagccggcgttcagatcgcgccggttccaggcagctgcaggcggcccatcttatgctaacgatcctacttcctccgccaagcctgtgaaattactgccgagagagcgcgcaggcctcaaagttacgaatttttcccaaagcagagaaagagaaggctcagcctagtttgtgagcagagatgaagaaaagttgcccgagtcatgtggcccagtcgagtgtgaatcgacaaaatattcccgactgagccccgtttccttcgggataggtacaatgtcgtgagggcgccaggcccacagccttggaaatagacctccaaggcgcccctgctcaagctaaacgcaccacgccggctttccacaccaaatgcaaatttccgaaaaccccagacggcctcagagatgctgcaggctggcgagcgatttcagctacccctagctccttgtgggttggcccagcctgcgagcgcgatcctgacttgtgtccgggtggactgaaatatcatttttacaaatggagaaaatgagatcgagatggacagacatagcaaggtgataatgtccgactcaattatttctactgggaatgactgaaaggtaaaggaatcgttaatgaatctggagatgacagaggcatgctttatttaatttttaaattagtaaggagtgcagacttggggtggtggagagcaagggtttttttgttgttgttgctgtttgtttttgtggggttttttttctgctggttattgccaagtataatgactttctttaaatccgaaggcgaacgaattgattctgacaattaaggatttgtccttcaatcttgcaaatgcccaattaaaagattattattgtcaataaagccttggagctacctttgt

SEQ ID NO: 8323 - DNA, 1966 bp, Homo sapiens
agcagctgcccctgcaaatgtcagcgccagcccagtcaaaagagcttgaaacctaccaagccggaggactgtgctgtgcctctctcgcccacattttccccaagcactctcaggaacctggcaacagtgtccccttgtggccaagcctggaacatcacatctgtacgttgcaatctgtggatcagctacgagactgagagaaaggaatgaaaggatggaagaattacaagatcaggcactgctgtctgtctgttccacggatgtaaccacagcacacgcgtggctcacggtactagtgtgataaatgcttgttacatgaaggcgtgaacagggatgagaagagacttcctggagaaacaaaaggactaacaatcaggaaggggaggtgatcggggcaggagtaaagtggacacctcagcaaagccattcgctgtgatctctgattgtgcagtgtcatgtcctgtcaccagagccccctcgtgtttgatgttggccaatgccgccagcatgatctagcaggccaaatcctaatctaccattctctgacaccagctggtcccctgggtcgtccacccgatgtcccccattctccccacttggcctcccccacaggctctcggcaaaggaccgtgggaggcacctgtgacactgcccttttcctgtgcagctgtttttcttcttcattcttttcactcctcgttactcttttttttttcactctcagcccacacaaaactaggaactttgttattctacttatttttctgtactctgtctgtttgcacacagatggatatctgagagccagcgaactttctttacctcctagtatcatttcatgaaaattagtagcacctgcacaatggggccttggagacaggaataaaaggaaaaatctggaatggaatcacatgacgcaacaggctatgaagactccctgcccggctgctatatgtctggtaaacagaataaatagtacttgagcatccctgactctgagactgtggggtagctggttgttttaagatgggaccagggtattgtgcacttattgccaattcttgcttcagtaagtggggtggctgtgcagagtgagtggcctgtgtatgaaccagggtccgtcccatctaatgagagtccggtcaggctgagtcctcaccaagacttcagcgtggattcatcagtaaccttggttcactggcaggcttgctggactttggagaaaaggctgaccctcccccaaagcagcccattgctgccactgccctaggaacagagggcctggagccagggcttgacctggtacaggagcttttgcacaaggccggctcaaacctccaaacctggggaaacaggatgcatggtgaagtgaagaagaaagaaaatgcatccaccgttccttcctgttggtgtcagcacgatgaggaataattacctggatctggaaagcaggcgtgtgggaggctgcaggcccccctgatctgtgtagttaggcacttaatttttcatcctcctccttctctctgccctcccgaaaccgccgttttcaaaggaaaaacagaaaaacgtatctgggtaacccgtgtaatactgtttacatcagcccacttggcccagaaaggataccagctccttactgatgctcagataacagggttagtgcttaaaaaaattatgccttgggccgggtgcggtggctcacgcctataatcccagcactttgggaggctgaggtgggtggatcacaaggtcaagagatcaagaccatcctggccaaccaacatagtgaacctgtctctactaaaaatacaaaaagtagctgggcgtagtggcgcatgcctgtagtcccagctgctcgggaggctgaggcaggagagtcgtttaggcctggcaggcggaggttgcagtgagctgagattgcgccacactgcactccagcccaggcggtggagtgagtctccatctc

SEQ ID NO: 8324 - DNA, 1760 bp, Homo sapiens
atcacttctgctgctccacacacccagagaaggagtggggtggggggtggttaacagggtatgctgggggtggaggatttggtgggggctgggaggtgggggaggggcccagaaaaccttcctgattctggagggaggcttgcagagcaggccctgcaggggccatcccatcccttctcctgcctccctcctccagagcaaatccttggtgcctggagggctctaaaggaggagttgctgtcccgtgctccttcgcaatttaccctgtgcacggaagtcctccagagctctaacctctccccgacccctgcagtatctccctttgttcagtcttcagtggaaatggagaaattcctagttccactctccatgttcttgtctggtgagaggacttggaaattactcctgcaggttgattttcttaaccagggtggggagtattataggaactggagaaagaggagaaggacttagtatttagtgtctgaaaatattttgctcttgaggactctgacagctggaaccacacctggttgccccactcatctgatggtggggcagtagttccagtgaccagaaaaattaaacctcaatttacattctgagggtgaggctagaggtaccctcaggaaaggtactggactgggagtcaggagacctggatttgaggactagccctgccctgccacttactagctgggcgaccttggacaagccactagtcccctctggacctcaacttccttatctgtaaaacaagggggtgggccaggcgatgtctaatcaggttccggtcagctccaggctccagcatgtggagatcctgtgtgtggcatcacttagcgccgagaagtgcagaagtcacagttgcccctgccccttctcaccctggatcctcacccaggtgtcgcatcatgccagtcagtctggccgactccaccaatggagatgggaacctgggacccagagagaaaggatgcagttccctcctggcataggctcccaggcacaaaaatagcatctcgagaaatacccacggctgatgtggattcgcacaaagagacacacaagtgtacagaccacagcaaggaccgtgctgacggggctctgagatagggagacaacagaaaaagacaaacagcgatggagatgaaaactgttgatttgtgaggggcctccacagagaaaaacagggaaggtaacaagaaatgcatgcatctacagcaagaaagatggatgctacagagagagagggggacttcctggtgatgagaggaggtggaaattatgctcagtgtcaggagggtgagtgaagacatctgcagcagaatttatgagagtgcacaaagaattgattctataaccttcctgccctcaagtggcttccacctcaagtggaagattcagactcggattgctaacgaaaagtacctaaggacccacaaagaagtagagtggctcataagtggtttcttcagagaaatatttttgaaaagaccagacaacatcctagaatttgctgcagactacttcacggatccaagacttcccaacaagattcacatgcagctaattaaagacaagaaagcggcttaattagcaaaatcatgatgctcagctgttgggagagaccagacggaatccagcctcgggggtcatctggaggcatgagagccctactgccatcagtgtgggtttccaagctgccttgggctctgtctactgtcgcaaaagcttttaaagatattcattaaacacgg

SEQ ID NO: 8325 - DNA, 2804 bp, Homo sapiens
ctgcttgcaaatagaagaatgaccttcagtaatgctcacgtaaacagatcttccatatgacagcacttgccctgccaagtgtcaggccactgggcaaattaaaggaggatggagtgtaggtcttgaacactagagaggccaggtgtttggactaacctgtagcattttatgtttcttgcagatgttcccacaagcctgcatttccagagcatgctgaaatctcagtggcagaacaagccttttgacaaaatcaaacctcccaaaaagttatcgcttaagcacagagcacccatgccgggcagtctgccagatccagctcgtaaggacaggcacaaattggtcagctccttcctaacaacagccatgttgaagcatcacacagacatgagcagttcgagctacttggcagccacccaccatcctccacacagtcccttggtgcgacagctctccacctcctcagattcccctgcacccgccagctctagctcacaggttacagccagcacatcgcagcagccagtaaggaggagaaggggagagagctcattcgatattaacaacattgtcatcccaatgtctgttgctgcaacaactcgcgtagagaaactgcaatacaaggaaatccttacgcccagctggcgggaggttgatcttcagtctctgaaggggagtcctgatgaggagaatgaagagattgaggacctatccgatgcagcctttgccgccctgcatgccaaatgtgaggagatggagagggcacggtggctgtggaccacgagtgtgccaccccagcggcggggcagcaggtcctacaggtcatcagacggccggacaaccccccagctgggcagtgccaacccctccaccccccagcctgcctcccctgatgtcagcagtagccactctttgtcagaatactcccatggtcagtcccctaggagccccattagcccggaactgcactcagcacccctcacccctgtggctcgggacactccgcgacacttagccagtgaggatacccgttgttccacaccagagctggggctggatgaacagtctgtccagccctgggagcggcggaccttccccctggcgcacagtccccaggcggagtgtgaggaccagctggatgcacaggagcgagcagcccgctgcactcgacgcacctcaggcagcaagactggccgggagacagaggcagcgcccacctcgcctcccactgtccccctcaagagtcggcatctggtggcagcagccacagctcagcgcccgactcacagatgagcgggagacagccatctaaacagactcactaactattggcattaaagcttcagaaatctctgcgtttgatattcaaacatcatatgccggaaattttcacagtttttagtgaacttaaggaatttagatcctactttggtatttttttttcttgttttaatttttgttttgtttttgtttccatgttttcttgtcacacacctgagcacttcctcccgttggcaaacagaagttcaggatgagaccctgctggcctggtcctggcacatcctctgcactgttgaatcactggacttactgatcttagatgaccaccccctccctcacacctgtgggcagggcagaacagcctggcgggcagagggctacagtttagcatggccttcttgagctagggtggaatggggcagggtgctctggactcttaccccctcccctcccatctgtggcttggctctgctgtggccctcctggctgggtccccttggttttttgtgctggaacatccccaccagagcctctctgccataactgccagctgctctccccgagtgctcagctggcagaacacctttcctttctcacccagaacttaagagactgattttttgtttcatctgcatttggtcttctctgttttgactctctcactgcagtaacctggctgtggctgctcaggttcccctcctcatgccccttggtacccttccctgtctgctctcccatgccatgtacacacccacaacccatccttccacttggaatatttttaccacctatcctgatctttgaaggtagggttaggactacttaacctctattcccactcccctgcaaactgggggttgtgggaagtgagcagccatctccctgtgtgattttttttttttttccctctgattcactttgccatgtttccttcacatccagatccctgtcggtgttagttccactcttggtctttcacgctccccttgcctgtggaacattgtctggtcctagctgtggttcccattgttcccccttcacccttctctgttaaccttgtgcctgtctcctgtatgatcacatcaccaaaaagggggaggggggagaagactctttttttttggccattttgtaatcgtataaaaatagtagacaactgcttaatggttggggttttttcacaattttcaacattagtgatttttttttctgtttgcaagttaaagggtttgtcattgtttctttaaaaaaaaaatacaataatgcaccatatccctatgcataaagtgcttcttctatttataaggttgaaaattctgaataacccttttagcattgaaaaaaaaacaaaaacaaaaaatggaaaaaaaaaccttgtattttgtaaatattttcttttcctgctttggagctgtgtaatggcagcgaaacatgtagctgtctttgttctatagaaatgcttttcttcagagaagctgatctttgttaatgtcttgattctgttcgcaaagcacagactagtgctt

SEQ ID NO: 8326 - DNA, 4735 bp, Homo sapiens
agtctgttctctggggaggcagtaaggggccgtggagctggcctcggcctcggcatcgggagaggctggacttcctgtctctctgtgctgaatggctgcgatggcgcccgctctcactgacgcagcagctgaagcacaccatatccggttcaaactggctcccccatcctctaccttgtcccctggcagtgccgaaaataacggcaacgccaacatccttattgctgccaacggaaccaaaagaaaagccattgctgcagaggatcccagcctagatttccgaaataatcctaccaaggaagacttgggaaagctgcaaccactggtggcatcttatctctgctctgatgtaacatctgttccctcaaaggagtctttgaagttgcaaggggtcttcagcaagcagacagtccttaaatctcatcctctcttatctcagtcctatgaactccgagctgagctgttggggagacagccagttttggagttttccttagaaaatcttagaaccatgaatacgagtggtcagacagctctgccacaagcacctgtaaatgggttggctaagaaattgactaaaagttcaacacattctgatcatgacaattccacttccctcaatgggggaaaacgggctctcacttcatctgctcttcatgggggtgaaatgggaggatctgaatctggggacttgaaggggggtatgaccaattgcactcttccacatagaagccttgatgtagaacacacaactttgtatagcaataatagcactgcaaacaaatcttctgtcaattccatggaacagccggcacttcaaggaagcagtaggttatcacctggtacagactccagctctaacttggggggtgtcaaattggagggtaaaaagtctcccctgtcttccattcttttcagtgctttagattctgacacaaggataacagctttactgcggcgacaggctgacattgagagccgtgcccgcagattacaaaagcgcttacaggttgtgcaagccaagcaggttgagaggcatatacaacatcagctgggtggatttttggagaagactttgagcaaactgccaaacttggaatccttgagaccacggagccagttgatgctgactcgaaaggctgaagctgccttgagaaaagctgccagtgagaccaccacttcagagggacttagcaactttctgaaaagcaattcaatttcagaagaattggagagatttacagctagtggcatagccaacttgaggtgcagtgaacaggcatttgattcagatgtcactgacagtagttcaggaggggagtctgatattgaagaggaagaactgaccagagctgatcccgagcagcgtcatgtacccctgagacgcaggtcagaatggaaatgggctgcagaccgggcagctattgtcagccgctggaactggcttcaggctcatgtttctgacttggaatatcgaattcgtcagcaaacagacatttacaaacagatacgtgctaataaggggttgatagttcttggggaggtacctcccccagagcatacaacagacttatttcttccgcttagttctgaggtgaagacagatcatgggactgataaattgattgagtctgtttctcagccattggaaaaccatggtgcccctattattggtcatatttcagagtcactgtctaccaaatcatgtggagcactcagacctgtcaatggagttattaacactcttcagcctgtcttggcagaccacattccaggtgacagctctgatgctgaggaacaattacataagaagcaacgactgaatctcgtctcttcatcatctgatggcacctgtgtggcagcccggacacgtcctgtactgagctgtaagaagcggaggcttgttcgacccaacagcatcgttcctctttccaagaaggttcaccggaacagcacaatccgccctggctgtgatgtgaatccctcctgcgcactgtgtggttcaggcagcatcaacaccatgcctcccgaaattcactatgaagcccctctgttggaacgtctttcccagttggactcttgtgttcatcctgttctagcatttccagatgatgttcccacaagcctgcatttccagagcatgctgaaatctcagtggcagaacaagccttttgacaaaatcaaacctcccaaaaagttatcgcttaagcacagagcacccatgccgggcagtctgccagatccagctcgtaaggacaggcacaaattggtcagctccttcctaacaacagccaagctgtcccatcaccaaacccggcctgacaggacccacaggcagcacttagacgatgtgggggccgtgcccatggtggagcgagtgacagcgccaaaagcagagcgcttgctcaacccaccaccacccgtgcatgacccaaaccacagcaaaatgagattgcgagaccattcatctgagagaagtgaagtgttgaagcatcacacagacatgagcagttcgagctacttggcagccacccaccatcctccacacagtcccttggtgcgacagctctccacctcctcagattcccctgcacccgccagctctagctcacaggttacagccagcacatcgcagcagccagtaaggaggagaaggggagagagctcattcgatattaacaacattgtcatcccaatgtctgttgctgcaacaactcgcgtagagaaactgcaatacaaggaaatccttacgcccagctggcgggaggttgatcttcagtctctgaaggggagtcctgatgaggagaatgaagagattgaggacctatccgatgcagcctttgccgccctgcatgccaaatgtgaggagatggagagggcacggtggctgtggaccacgagtgtgccaccccagcggcggggcagcaggtcctacaggtcatcagacggccggacaaccccccagctgggcagtgccaacccctccaccccccagcctgcctcccctgatgtcagcagtagccactctttgtcagaatactcccatggtcagtcccctaggagccccattagcccggaactgcactcagcacccctcacccctgtggctcgggacactccgcgacacttagccagtgaggatacccgttgttccacaccagagctggggctggatgaacagtctgtccagccctgggagcggcggaccttccccctggcgcacagtccccaggcggagtgtgaggaccagctggatgcacaggagcgagcagcccgctgcactcgacgcacctcaggcagcaagactggccgggagacagaggcagcgcccacctcgcctcccactgtccccctcaagagtcggcatctggtggcagcagccacagctcagcgcccgactcacagatgagcgggagacagccatctaaacagactcactaactattggcattaaagcttcagaaatctctgcgtttgatattcaaacatcatatgccggaaattttcacagtttttagtgaacttaaggaatttagatcctactttggtatttttttttcttgttttaatttttgttttgtttttgtttccatgttttcttgtcacacacctgagcacttcctcccgttggcaaacagaagttcaggatgagaccctgctggcctggtcctggcacatcctctgcactgttgaatcactggacttactgatcttagatgaccaccccctccctcacacctgtgggcagggcagaacagcctggcgggcagagggctacagtttagcatggccttcttgagctagggtggaatggggcagggtgctctggactcttaccccctcccctcccatctgtggcttggctctgctgtggccctcctggctgggtccccttggttttttgtgctggaacatccccaccagagcctctctgccataactgccagctgctctccccgagtgctcagctggcagaacacctttcctttctcacccagaacttaagagactgattttttgtttcatctgcatttggtcttctctgttttgactctctcactgcagtaacctggctgtggctgctcaggttcccctcctcatgccccttggtacccttccctgtctgctctcccatgccatgtacacacccacaacccatccttccacttggaatatttttaccacctatcctgatctttgaaggtagggttaggactacttaacctctattcccactcccctgcaaactgggggttgtgggaagtgagcagccatctccctgtgtgattttttttttttttccctctgattcactttgccatgtttccttcacatccagatccctgtcggtgttagttccactcttggtctttcacgctccccttgcctgtggaacattgtctggtcctagctgtggttcccattgttcccccttcacccttctctgttaaccttgtgcctgtctcctgtatgatcacatcaccaaaaagggggaggggggagaagactctttttttttggccattttgtaatcgtataaaaatagtagacaactgcttaatggttggggttttttcacaattttcaacattagtgatttttttttctgtttgcaagttaaagggtttgtcattgtttctttaaaaaaaaaatacaataatgcaccatatccctatgcataaagtgcttcttctatttataaggttgaaaattctgaataacccttttagcattg

SEQ ID NO: 8327 - DNA, 486 bp, Homo sapiens
atgggtcaccgccccaacctggggcagccgccccatcccaacgcagttgctgccgctctccatgcctccctgtgcccagctaaccgggggacttgtcccctgggaaaacctgggtacccaggctgcctttggtttcagcccctactcctcttcccgggctgcctgtgctccccggacggcccctttccccgggctgtgttcacatcggctgggaagggtcccttgcagacagatcttggacgaggtcgcgtcccccctcgtgaccagcaaactcctaaaagcggcccttgccccagagcccctgtagcctccaaccggcagtcaggaggcagcgccgtctcagcgccgcttagtggcgccaggcgtgcctggaaatccgctttcgcagcgccccctcgtagccgcctccggccgcagaaaggcgttccctggacagagaagcgggcgcgcgggggcgggcgcgcggggccttgccggagaacctga

SEQ ID NO: 8328 - DNA, 1820 bp, Homo sapiens
agacgtggtccaggtttctgcacaggaatatcgagagcgtcatgaacccgagctatagagaaaggagatgaggtcagagaagtcgaaggggtgctggcgagacgggggtgatgcccacccgggcgagaaagcttcccaaagttctgggattacaggcgtgagccaccgcacccggctgacaagtgtccttctaagaaacacacagaggagaagacacagaagaggagagcaccatgtgatggtagacacagaaattggagttctacagccacaagccaaggaactcctggagccaccaggagatggaagatgcaaagaactgattttctctcagagcctctggagggagtgtggccctggtgacaccttgattttggacttctggcctacagaaccatgcacacaggaggacttcatttcccaggtctccttgcagtgaagttgaggccatgtgactggtcttgggccaatggaatgggtgcagaagggacacagcccatttctagactcagcctgaaatgtcctccataatccttactctttctcccttcactcactggctgcaggaagctgagaattatccttggacttacataaagcattttggactttatgtaagtaacaacctgttgtattaagctactaagattttacggttgtttgttaaatcagctaaccttaaacatcctaacaaacatagtgaaaccccgtctctactaaaaatacaaaaattagctggatgtggtcccacctgtagtcccagctactcgggaggctgaggcaggagaattgcttgaacctgggaggcggaggttgtggtgagctgagatcgcaccactgcactgcagcctgggcaacagagcaggactctatctcaaaaaaaaaacacaataaacatttcttacctactgtagtttttgtgggtcaggaatctgggagcagcttagttggatgatttctgctcacagtgttttatgaggttgcagtcaagatgttggctggggctgtagtcatctggagatttaactacggctggaggatccacttcaccatggttcactcacctggtgctggttgctggcaggaaatttcagctcttctcttatatggatctcttcacagattgcttgagtgtcctcaccgtatggtgactggcttcctttacagaaatcagttgaagggaatgggcaagtaagaaacagcaatgctttttatgacctagtcctgaagttccccaccattacttatgttcattggaagccagttgctaaggagagcctgcactcaaagattggggaaatagactttatctttcaaagtgttgaagaatttgcagacgtattttaaaaccaccacacaatccatcaacacatcatgtcggctctattcttgaaatagatccagaatttgaccacttttcaccatctccattgctattacccagatctaatcaacaccatcacttgcctggactagagatttcctcctcactgggctctctgcttctatctttagcccattgctatgatttggctgtgtccccacccaaaatctcatcttgaattataatcttcataatccccatgtgtcaaaggagagaccaggtggaggtaactgaatcatgggggtggtttccccaggctgtttttgtgatagtgagtgagttctcatgagatctgatggttttataaggggctcttccctcctttgcttgtgaagaaggtgccttttttcccctttgccttctgccatgattgtaagtttcctgaggcctccccagccaagctgaactgtgagtcaattaaacctcttttcttcgt

SEQ ID NO: 8329 - DNA, 1973 bp, Homo sapiens
ggggccatcccccttgttttacagacaaggaccctggataaaatgttttaccaagaatcacacaaattgtaagtggtagggccaggacacagacagggagtgtggttccaaaggcctatgctttccagtcaactatgctgcgtgcacagcctcccacccaccgccaacccagctgccctctgctcactcgctcaacagatgtttactaacatcaggtccccctgctctggcccccagggcagccccgggcttccgagaaggacccatatccacctctggcctcactctgcccatatgtactttctggtgacttcttccttgctccctttcccactaatccaaccaggatgttccagaaccagatttaagacgctttgctctctgagacacacaagtgcacccacagaggagggacatggtcctgtgcggagaccctgtggcatgcactgtctgagccatctgccccatcccagaggaagacctcagggtcaccccacccacatgagaccagccctgcagcaagctctcctgtcccacccatctctcctcctcccttggagaagctctcctgactctgctgtccaggtaggcccctctatgattctcaggaggatcccaatggctgggcacctctgcttcccacactggccacagctgctggacagcagggactgttgcacttacacctgtatcaatacacctgtgctcaatagtcacatggtgcaggaaggagtgtgtggccagtaagtggagctaagtctagacgccaccagaagctgggcatggtggtgcacgcctgtggtcccagctactcaggaggctgatgtggaaggattacctgagctcaggagttccaggctgcagtgagctaggatcatgccactgcactgcactccagcctgggtgacagactgagaccctactcgaaaaaaaaaaaacagatcctatccgaatatggggcaagtccgaaaaatgcaacaccaagcacctaaagctgacagaatcaacgtaacagagaacagcctcttcaaactggaaggcgctgagaaatccatgtgctgttctgggatcaggaatgagataaggtggccctggggctgctgcaggaaatgcgaggagaggctgacgggaggggacggggatgctgagtggaaggaggcagagctgcccaaggagccggggatgttcacgggtgcagagctctgcagcaagctgccgcctgcaagagaggcccggggaggacgggctgggtgagggcagcggaagccaggcgggccacacagagcaaggggcctgagccaggcaggaacccgaggagtcctccaggctgccctgcccacccacacccagtaccgatggtgatgcttcctgggtggggcactgtgctgttatcgaaagtcttctccagggcggccacgccaaactcattcaggtccaggtcatccaaagcagactctagggacagagaagagtgggatgtgacctcccgagggactatctgaccctgaccacctcgtctactgcccacgctgcatcttcacgcccatgctacgctggtgcctgccacaggacctggcacaaagcgggcacctagaaatgagtactgaaagaaaggagcaccaacttctagcaccagggattctgagaacgtcgtgctggccattcactacacaaggacaccagtgagatgagtggggactgaacaacacgtcttggggtgagactgtactcaccaaggggaaaaggcacctctttctaatttgcacaaaggagctctaagggtcagtcctggccctacaccttggggtcatttcccctttagctcaaaggactcagagtgcccatcccctgattttccgaagacagatgtctaaggggtctggtgtgctgatttgagactcgcttcagagactggggggtctctgaccccagacccagtcctgggctttcaaacagaaatggcctagttacct

SEQ ID NO: 8330 - DNA, 2464 bp, Homo sapiens
gtcaggcactgccctcgaggtcagatggggtggggctggatactggccatgaggattttttcaagagctgggttaatagtgagacgggcggacaccagatggctcgggctaagaagtaagtgggcggtgggaagctagaagccgtggtgtagacctactttgagaggttgggctgttcagacagggagaaagttcacagtttgaggaggtagataggtcaaaggaagagggtttgcttgtttttgagattggggcatcctgaacgttctcccaggccaagtgagaagaaaccagaagaggaacatgtcacccaaatgtgctgaaacagcccagcagctgcgctgcctcacagaaaatgtgcagaggcccctctgtcccaccatgcctgcctggggacggccttcactcgggctactcagggtttccccagcctgccaacccaagggtggcaggagctgtgggtgctcccagccccttctcaaggttggtctgtgggtagaaatgtgggctgcctcggggcgtcacagctacaaatgcataccagccctcagaaccacattcctgctccccagccctttcctccgcacccccatgcagaagcgcggccgccagctcacaaaggatagggagggatattgctcttggcatttgatgggaagcatctgctgcatcccattggggtgttgcccaggatggattggaaaagagttggcaggaaggctgagctctgtgctcacaacctggcttggtggtggccgaggagcttggcaggagcagagtgcaggacctgggaactgggggttggtgcatgtgtgcacgcacgtgtgtgtgtgtgtgcgtgcgtgctgggtgggtagggaggaagctgtgaaaccacatcccctcctctctgctgctgtgttgctgtgtgtttcagcagcacgtgggtgtcaccacacttcctagcaggtgtcaacctccaagactgttctgggctcttctcccagttggctgagttggaggtgggagtcccaactgtcccctgtggcttccagagtgggaccttgctgtgggataggctggccaatggtgctccctcccctgtgacccttctgttgggtgggtcacgaggaaggactgtgggtgttgcccacagacaggtggacatgtggcaaggacaccttgggaccttctttctgacgccccttgaagggggcactttctcagctttgagatgagtctctgtggatgtgggaagttcactatctcaagagcagcagccttggaaaatccaacacagaaccccgagtaggggcgggaaggggtcctgtcccgctcactggctgcctggcagagttctgcacaaggaagcgcctgtgttgctgtgggcggaggaatggactgagggctacattcgcttcctgttgccgctgtaactgcttatcacaaactcagtggcttaaagcaacagaggctccttcctttacagtgctaagggtcagaagccgatcagtctcaccggactaaagtcaaggtgttggcagaatccattcctgcctcttccagctttgggtgggaggctctgctggagttccttggcttgcggctgcatccctccagcctctgcctccatcctcctacagcctcctccttctctgcagtcagatctccctctgccttcctcttttttttttttgagacggagtcacccaggctggagtgcagtggcacaatcttggctcactgcagcctccgcctcctgggttcaagcgattctcctgcctcagcttcccgagtagctgggattacaggcatgtgctactacacctggctaatttttgtatttttagtagagacagggttttgccatgttggccaggctggtcttgaactcctgacctcaggtgatctgcctgcctcagcctcccaaagtgctgggattgcagccatgagccatcacacctggcctgcctccctcttaaaggacgcttgtgatttggggcccacctgggtaatctcttcatctcaacatcttcagttacatctacagagtccctgttgccacatgaggtaacacagtttgggaagggagagttattcagcctaccctaggggcctgtggtgtatctcagggcccttctgattttaagatataaagcaagaaaacaaactggctcaaggggaaaaaaggacacgttgaattctgttgctttaaatgtatatttttttattgtgctaaaatgcacagaacataaaatttgccattagtaacactgagtacattcacagtgtcgtgcaaccatcagcactgtctagcgccagaactttttcatcaccccaaagggaaaccccgtatccatgaaggactcactccccattcgccctctccagcccttggcagccaccagaatgctttctgtctccataaattcatttttaataagtgcaattctgtgtgactttaaaataaataaacatgagcacg

SEQ ID NO: 8331 - DNA, 1991 bp, Homo sapiens
cactttcctgcgagtcgctctccgaagtgtcgctgtccaccggctcctcgtccggggtgtctctcacagccagcagggccactaagtcggggacaccatttttgtcttctttggtgttcaagcggatggattcggccccagctggctccttctctgcctcttctttcttcgatttgtcggtgacggtgaccagagccaagaactcgcggggaccgtcttcttccccctcggagttgcagggcgcccactgcctaaccagctccctggcagcggcctgcagcgtggcgtacagcgcgctctggtcctcttctccgctcaggtcgccctggtcgatctcctcgatcacgatgcccaggctctcgtcggaagagtcctcggcctcactcctcgcgggagcagacggccgtcctcctcggcttctcttcttgcccttctgggtcaacctgttgcgtctggttctgtttctgcgaccccgacggcccctccttgggttcctggctgccccaagaagcgagccagcctgccctgttacctccccagaatcctgggcctgcgtctccgaagcgggaggggtgggtgcctccccgggggtcccagcctccgcggcctgcgtgggcccgtcatccagcagcaggcgtctcatctgcctcaggaccctcgtgtcctgcgcacggtccttccacagaaccctccagaccccatccttgcctgggatctccctgggaatggcagcgtgattgacgtcctccacaaactccaccagggcggcctgggccttctcgttcatcaaagccttcatgtgtcgcaacctgaacgtgcccaggggcaggagggtcggctgcaggacggcttcgacgtctgcctgctccaggccctccgggatgccggtgaccagcagggccctgtgcgcgtccacgtccaggctccggcaccagtcctgcaaaaggctcatggccatggtgcagcccccttggcgctgatcttggggcagcagggagcccgagataggggtgggctgcagcgcacggtgtcaatgcaaccctagaaagccacttgcagggcttagagtcccggttccggtgaatgtggcaaggctggagtggggctcggggctcgggggctctagctgcctgctggccggctggacgcagtgaccttcccccgggacccctctccagagctgtctgaggatccgcggggggcttacgtgtctgctttccaggacagctccctccctctctccctgacacaggcctgagtgactcggcaccgcagccaggtgcaggggggcggcgccgagtgcacctggagaggcgtgggaggtagcagccgcagcttgcctggcgctcgcgccgcgtctgagcgcgcaccctgggcctgaatctcagcagttccgctgcgacgcggctgctcgcgcgtgcgcctgcgcagagggagccgcacaccctcccctgtcccccgcccaaccgtctccatggcaacggtgcagccttgagctggggtctgcgtcgctgtggcctgagacgcttttcttaaaggtcccgatgacaaggacttggggcctggaagcaccactttcattaaccagcaaaaaacaaggccgaaaccacagagggccagaaatcactcaaggatacccgacctcattcaggggatagaggcctccttccagagggtaccggcatcactgggggttacaattcccccttccaggggccaggtggaattcaggattatataggcctaaatcaaagggcactggccttgcagcgtaggaccaggacttactcgggatactggcctcattcacagtatatgggtctcagtatcaaataggggggcccaggcaccacctgtgagcaagacaccattcagggtatatgggcctcacttgcagggtacaggccccactcgatgggaccggccctcactcccatacacgttcctgtattctgaactatgcatgcacaataaatcctgtggttttgcac

SEQ ID NO: 8332 - DNA, 2643 bp, Homo sapiens
attcccgctttccccattgctgagccaaagctcgcaccaaggagggctccaagccgggaccccggttggagaaaatcctggggcatccagcggcacggagggtgggaaccagatgagcctccgcctccgcgcacggtgcccacagtcacaccccccgttggtccacctgtgccaaaaaaaaaaaaaaaaaaaaaaaaaaaggcccttcatgcgcccgcagagggctctgaggaggcacgagatgaaggcagggtccgcggagaggtggcaagctgaattctgagaagccgctctgaccctgaccctggggtcacccctccgtggtgcaggtggcaccggagttgggctcgagcggagagccgcatgcccatcccagtctcaccgagccttcctaggaggaaatgccaggcccgggcgcccctaccccaaggcggtgatcctgtgaagctcgggccacctcagggtccagcgccctcagagatggatggtgttgacaccgaggaacgaggccgttccctctctttggtgaacggagaagctcctggcgtggttccctgcgcagtctccgggtccccaggccgtgatggggtgagcagggtgcgcggcgtggcccgggacacgagaccggcccggagcaccccggcgtgagcagcgggaaggagggcccgcccggagatttatggccgcagccggccccctgtgcactgagcgcgtctcggtcctttcccagccaaacagtggagtggaggacccgaccccggctggaggaagaggccagggccggaggcggggccgagaggagctggaatccatcggggctgggcctggcgcatcagtccgaattctgcccgccttgcgccctggtctcggtggggtgtggggcgctggcgccgcgtccctggtctttcaggcaggtccgggcagctcctggctgggttggcccgacctagacttggcgctgtatcgcggctgggcctgtcgcagcgaggggacggcgaacgtggctttcccgggcacagcctctccgggttttagccgcgcccgccagacacgggacctgcggaaaccggcgcttaagacgcccagccacacggcctctcagctggcagcagaagctggcaatccctcgggggggtgcccttcaatgagatgccagcggagagtgggggctttggtccccacctggaaaggcggttggcgcgacgggtggagtggctcgggtggccgcgccaaggaaaggatcctggctttttctttccccgctgggggagggataaggggagaacgtgtccaagcggccagcaataccagaatttgggaagaaccgggttcaacgccgaattgagagagaccgtctgatcgcgggagctgcaccagcccggtgtagggggccgagcctgcgccaacaaaagcgcgacaggggtgacggccgggctcaaggttggcctgtcctttggttttaaaacaaagacggagaattttgtcagtcgggaggcgtccagggagcggaggccggagccagcggcctaggaacacagggaaggcctcggctccggtggcccaggctggccgcggagaagcacgctgggccgggcctcggctagccagggcagcttctcccgcagctgcggcttagggctacaaggaagacccccccagcccccagccgattttctacccagtcaaacacacacacacacagacacgcgcgcgcgcgcgcgcacacacacacacacacacacacacacgcactttcactcaattgcgtccacagtttttggccacctatcccgctgggtaaacaaaagtatgagggggtggggagggggaggggatggaatgggggtggggcgcggaagatggcggctggacctggtggcctatggcctgtgccctatggccacagcgcccaggcctggtttttacatttcaatgtggcccgccatactggggagggcgtttccctggaccctgaagcctagttagggatgtcctagaggctcccctttacgaatgggggcacccgggctgcagccactactacttcgcttgggatcggtcctccgccccaagatggctcccagtcgctgtttactcagcgactgcagggacaccagggcgcggggccggggagcgggcgaagatcacggagcgtacagattggcccgggcaggtggcctctccgcgtggcccgcccgcgcccccaagcacgcggcagccctggaaaaccgcgtgggcaggatgcgtcctggccgccccgcctggtggccaggaactgggagccaccaccaccaccgcgtccccaggccctgctccccggccggactccggtggctgcagggccgcgcaaatatggagtgggtgccgggggcaggtatggaagggccggtgcaagggggctgggcgcacaaagcccaggcggggaggggacctcctctgccccgaaccgcggccctaatgaaataccggctgggttcgtcacaccgccgaggcgcacacttgaaaaatgcaaacgccattggcaaatccagggcaaacaggcagaatttttattagcaactaaatgatttatggcacacgtaccccgccgtcacaattacggcgtctcggagcatccagggggtgaaaacattaaacatttat

SEQ ID NO: 8333 - DNA, 1922 bp, Homo sapiens
aatctcaagcagaagagcaagagaagcaaaactcggttccctgtgaactcaagaggctttgcccagaagggatgcaaccagttatttcagcattaaatatccagacacagacagtacagacccatcctgctccaagaaacacatcagagcactgcactctgcctgcctgtgatgcccaggaagagcacagagatactgttgacggctccatcgcaaggactgagtcagcttcaggggaaatttggagacagacacacatggacggagaacatcatgtgaacacaaaggcagagatcagtgtgatgtcggcaaaccaaggagcaccaaggattaccagcaagccaccagaagcgaggagagaggcccgggacagatctctccctagcgccttcagcctgcgtggcctcactgacactttgatcttgggcttctgtcctccagaactgtgagacaatcaatttctgctgtgtaagccacctggtctgcggcactttgttatagcagccctagaaaactaagatggaactcgccggctggtcactgtcttccctcttatcacactaccttcccttactgcagctacttatttaactgtttcccaccaaaagaccctaacatccaggagtgtggggcccacatctgcctaattcgccactacggcccaagcccacctctggcacactggaggtgttcaagatgtgagctgacatatgaaagagctgtcctgactagttctagaatctcaggcatgtgactccccctcccagaatgtcaatttccccatctctctgcagagggaaaagaaaataattggagtagatgacctctgtgagtccttcgggctcaaaagatggccgggactcaccactgaaggtgtctgcatccatcatggtcagatcaggccatgagaaaccccactagaggtgctaaacagagggaatgggtcacagaggtgtgggaagcctgagaaaccactgcggccttcctgctggacttcagagaagggctggcctcattttatgggctttctgaaacccatattcagagaaacacacccaattcagcatggactggcaatgcctatccccaaggaaactccaaaaggggtgagtctcctgggcagtggtcactgagttactacaaggcctttggggttggggtggggatggtgggtcaacaggctcccctagaagccctgtgccctgacaaagtaaacaatggcaaaacatgtgcttcccagcactcacctccccacctccttctaacatcagaactgggtttctgatgatgggagaaaatgtaaatgaaatcaacggaaggatgatcctgtgagtaatctgacaagggagaaccagcttcctctcccatgaaccccagctgccttggctttcacccagacccctggcccacccggtgtcctccccagacagtggtactcacccacactgctgagggagctgctgctttctgagtctgagggcatggtggacaggacgctgtaggtagaacctggggaaagaggggagaccatgttactaaccccaaggggtcactcgtcttcaccccaagccagctgatcatcagtcaatgccaggccatgagagctacatgcaccaggcactagaaatccacatccacgggccaagcagaggaggcgcgctcagcagatctggacttcggtgtttctgccaggcctcccacctcactttatcggcccctcctgctctgggcaggcgggcagaggggaacttggagtcagtcagctggcttcttgttgggacatctggggaaaggcttagcaagggagtgacatgccccaggtaaacatggggtgtgggggtttcctccacatctctagcaatatgattctggcttccatgcagagggtaacagagcagaaattaaagaacaactgaactatc

SEQ ID NO: 8334 - DNA, 2007 bp, Homo sapiens
aaaacatagaatgtgcctaccctccacccagtgcttgaacatcccttccccctcatcactccggggaaggatcctgctcaacacccaactactcattcaaacctggaacccgaaactttaatgaaggttgctctactgagatttttctccccaccgaacatgtctgtgacccacaaagaagcccatgaaagaaagtgcccagagaaaccagagctgtggaaggctggctcgacggtgcccctcactgcccctgagaaaacagacccatttcctctctgcccacctctttccctgacatgtccccagcagcagtcctgtattcccagttcctctcaagatgttctgaatagtctctgggtatcctctcattgccttcaactcaagatatctaaaaccaaaactcattgtcttcccactcaaaacgtcctcccctttctgctgccaaccccagtcagtattgtctgcaggcttccaggcttggatccttgactcacggccacccaagcttccttcccccgtgtgcgattagtcagtaagtcttagtagtgatgagggcttcctgcaccgtgactgtccggcatgctttttcctctcccatttcctcagccaccagcaattccaggcccctctttacttcgtatgtattctagcgagatcaactggcaagacaaagctcagacgtcacctccagaaggttttcatggcttgtgataatctggcttcacctgtattctacttcatgagacaactgactatctcgtggcctcttccctgtggcctccatctctctttgcagctccagtccctggcacatgcttggcacacagctcactgcagctgctcaatgagttttgtggactggatgtttgcttgtgggaagtggaagcagggaccagatggatgggcagaaggattgtcctattcaaatatgcactggtggtcctgtcttgtgtttgggcaccagttgaatccaagagctctcaacctgtggagtgtcggatgaaatctatggaatccctcctcagaaaagcaaatgaacccacacaatgatggcgcagtttcattgtcatcagcctcctgaggcgtatccacaatcaccaggatatgggaacaaaggaattgtgtttaaatgtaaaaaagaagttctagaatttccacagaatttacattcttcttgttgtaaggaatatgcctggtaatggaactcaaatatcagcttggatcgccctggcctttgaaatttgaggtaaaattaggcttaagccgtatccagcgcacaacagaaacctcagtgtctcccacccagggactgtctcggaggctgtgtgttcagatgtcacttctgcctcccggcatctgctcctgagttttcactcttcagcctcccctcccaaggcctccttcctaccctggcactgggcttcttgccccgtccccctagaatccgtggcacaggggctttatctgtgtggagtctctacagacggttagaaacacagagtcagctagaaattaagcagtaggcagctgtgatgttttttgacagcctcatttctaaaaccccttcagcaaccccagtcaaggagcttctccctctagactccagcctcctgctgagtcacctgcaccgtctctgccttcctccccttcctcacatcctccctggccccatcttccaattcctctgaacttctgcagagcagccagctcttcctccagcttcaacttccccaccccaagcaggtggggcatcctgaccctgagcaaaagcagttctctccctaagaaacaccggtgacttttgttcatggcactccatggatgcaaagctctgagttctgttgaacagggactcacctacgagtggtggtgctatcagctgagacgggaagcagcactcagtagaagaagaaaaggcctggactggtgtgggcatgcactggctcgtgagaagcagggaaggtcgctcttatgggtcccgtttctaagtgacgttcacggcctggc

SEQ ID NO: 8335 - DNA, 3511 bp, Homo sapiens
atccagcccctccaggttgactcaagtcagagtgtgtgggggccagtcatggaacagagggagcctcctgcccagggcaagcgtggggagaccaccaggggccccagacaggtgagccgctccagcagggacagcacaggtggtgcatggtcggggctggacatcggggttagtcggcaaggatgaggagtctctggggatggaggctgaggcttggggttctcaggcaagggcaggcctaggtgcagcagagaattgtttggagggaggaaatcaagctttccttctagaaagggtgacagggaccaaagggagagggcagggacagcccctggaaagggcaggtgaggaaggtgaggctggaggggacccaagaagggatcctggggaggtagtggccaagagcagggtgagggccaggccgcacctttcgctgtacccagctctccctggggtggccctggccctgctctgctgtcccctgcaggacaggtgcctcaggcttgtcccagcttgtcctacagcaggtcctcagcacccacaggtcctgccttgggctctgcagaagcagggagtggtgaggtcaggaccctgggccacagaagaaatggtctgggggacaaggacgggggttgggggactgacagctgttttctgaaggcccggggagtggaggagaggggtgaggggccaaggcttggggctcagtatgggggcagctgcagggggtgagggggccagtggggccagtgaagagggcctagggtctggtatctgcagcaggcactcacagaggacagactgtttgcaaggtaggtcaggtgacagggagccaggggggctgaggaggctcagggcctgactccagggagagcagttgccatcccccaggtccagaggggccctgggaggagtccaggcagggctgaagctggaagaagtaagaggggctggcactcaaggactgcagccactggccaggtggggccaggtcggaccggctgccttccctggtctcagccccagccttctgtggctgcctcccccatcggagccatcagagagcaggatgtgggaggggcaggtgaaggacagcctctgtgatagtccctggtgtgctgcagcctggggtgaggggccttggggatgggaagggctgggagctgggagacgatggctcccagcacttggtcctgaggggccttggagcagcttcccccaggcctgcagaggcaacttctgacactcggggagctgaggccaagggaaggctccccagacacaaggagaaggggctgggggcagccagaaggctttgggctaccctccctggaggctcaggtcccaggtgacccctccagctgtgttccttccaagattgggacctgcaaagattgcagatgtgaggaaaggaaggtgtcttgggcattcttcccagtgtggctgagctgtgcctgtgaggacatgcagacactcagaggacctgtcctcaggggccccagggtgaaggtcaagatctcaccttacaaccagccgggccctgactacttccagccaccaggcccccaggacaggagcaggacagtggttatttccccagtggacggggggctccaggtcacataagaataacatgccctgtgacaaggcgtggggatgaaaatgcttccccctgggctgagattccaggacacctgagatggggggaccccggccacatgtttagagctctcagggaacctggagggcccctcagcctctgttcccctactggggagaacagaggcctggtggtagcaatttcagggaactcagagaaacactgttccccagaccttggagctccctctgtgcctggctctcactgtgaggccccccaccagctggtcctgctcagggagcctccacgtgtccccctggttcctccggccagcctaggggtggagggtgcggtccccatggcctgtaggaagtagggctcagaggggcaaagtcaccgccctgaggtcaccaggaggtcccggcagagggggttggggcctggctcagggcctgttctccctgctgagctcagtgggatggggccatctcaagggtcccactgtttttctctggtctctgccccagcatgtggtgggaccttgatttccatactctcatgtcaccagtctgttggggggcagaggttatggggtcactgatatcacctggctcattcctcccccatccaggctgtcccatgagaatgtctaatctgtatgtcatcggagtcaataatgtgttttgctatcgctctggttccagggatattgctcagccaaagggccagcatcccagtgaagaagatcagaaagaggcttccggtcaccaggagactcctggggagggcctaggctgggagtgggacacgggtggggttggatggaagagtaccaggtgggcctaggatggatggaggaggctgtgtccccagctacaggcctggagatgttacgggacccaacaggcccccagcctccatccccgtgctgggttctcaggtttagtgggggcagtgcctggggactcagagggaccctgaccccagagcttggagacccctctggagcatgcctggctctcactgtgaggcccgcaccagccagtcctgctctgagagcctcctcgtgtccccctggcttgtcctgccagcctgggggtggagggtgtggtccccatggcttgtgggagggagggcccagaggggcaaagtcaccaccctgaggccaccaggagatccctacagagggcagagtgggttggggcctgccttagggtctgttccccttgagctcggtgggacagggccatctcgagggtcccagtgtttttttctggtccctgccccagtgtttaatgggacacagcccctcacatccccagtctgtggggggcagaggtcatgggtcactgacatcccctggctcattcctcccacattcacccaacagaccccttatcctccatccccctgctgagactggggattggctcagggcctgttctccccactgagtttggtgggatggggccatcttgagggtctgggtgtttttctcaggtgggacctagatccccacagtccctcacgtgcccaatctgtggggtgggcatggggtcaccaaggtcacctggttcattcttcccccatccagattccgtctctagagcctttgaggtcactcctgacgctgacatggctgtgaagagctgggtgccaggcattactgcctccaaggttgctttgcgaggaataggtggggcatcaggaagaagccagttgcaggcaaggcctctgctgatgctgcttttttctcctgtacccatccatgggagggagctgtgagatggcctggcagaacccgctcttggaccccacagaatgagaggctcaccctgcacaggaacatcctggggcagcaggctcagcacattttaaattttgagtatgaacaaagtaaacttcagggtt

SEQ ID NO: 8336 - DNA, 2610 bp, Homo sapiens
tgtcagatgcagcccagcagagaggccctggaactcagaggactcccaaagtccgtgagcacagtgtcctcaacaaaaccccccctcaccacaccttcctcaacaaacccctcacgccaactggctctggaggactgtgtccaattgcgagctgccttggatttaggttatggtcctgaatgctgctgccaccacctccctgaagtggctcacaagtcctcagcctccgccggagccccaagtgccagactcccccttcagccgcacagcctgggcactcggaccaagctgccaccttccctgtgcttgccggggccaggtaggacacgtctcacaacagagccttttccgggggcgcccttctgcagtgattcttgcagtcctgcactctgctgtgttctgctcacaccaggcagggggagagggagcgtggcccctctgggaagctcccaggacggcaggggtgggtgctgccctacagatacagtacctgctgcacagggaatggacgcctcctggacggtggccccagcccaggaatggctgggacacccactccagtcttgcccacagtctgcttccagaggacacttgcccctgcctctccccacccccaccacgccctgcatctcgcagccacctggaaggagatgtagaccccactgtggtaaggagctgttcagagcccccggagccctccacttcctaccacgcagacatcctgctgctgtgcgacacagatggaccagggcttgtcctgaaggtcccaggatgcacattcctcagggatggctactctcctccccctccctgttaacagactggttttccatggactcctttaagcccccaagtctggcctctggtcaaatttcaaagacatgatggggtggtctgttaagactgagtagctcatgtggcaccaggtgagggctgctcaggcctgcattaaggaggggagcccgaacaacgggcctcccccttccccccacccacaacgaagcagctgctgctggctcctctcccagagactggaagagaattgatgagaacaccggggacccagcagttccactcccaggcctaaatctaagagggcaaagtcaagcctccactcaaaaccttgtgtgtgcacacactcccggcagcaggattcacaacagccacggagtggaagcagagccagctgtccagtggaggatgaacacacagcggggaagacatgggccgtgcaaccgcggctgccacagagaaagcgcaggagcagtgcatgctgcgtgagaagctgggcaccaggcagaaagcagagtccgggagctgggggaggaggggacagcaagtgcctgctcaatggccctgaggtttaaggtgatggagctgatctagatagaattgggggtgatggctgtataactgggaatacactaaaatccctgacttgtacactgtggccacctgaagtgaacagtacacgctttctgtctcagtaaagctacgcaaagaacagcagacatcccgcatgaagtcagctctccagggccgcaccatgggagctatgggctggcagtggccggctctgctcttgacacacaggaaggatgcaaactcagagccccagtggggtcacggccttgcccggagaactccctctggggatggcagcctgccgtccccttgcctagcctggatgccacatcccgcggcagcgaagcagcctcctgcttgaccgtctggcccggggacccttttgtctcctgggtcagtttcattctttccccaggctgtgctcctgatgaagcagcatcgtagctgatgttgaagggcctcacgccagcacctaggctggtcttccctgggtgcctgcttgagcacgtggcccaaaacagccgttgcatggggcactcagaacccaccacaccctcgccccttcccagcccgccaccctgtggctgaggccctgtgccttgagcaagctgctgcccctcctcctcctggtccagttctgcccacacctgggtgcccacctcccctccctgtggtctccaggagctgcccccaacatgccctgggcagcagtgctcatcgtagccccgtctgtggcctggacaggctctgaccactcctgcgttggcacagcttcctcgggaggctcctgccaacaccactcggcacggtgggctcaacacggcagcggcaacgggtgggagtacttgcctctgcctggcccgaatggcggttttccatttggatttggggatgagcagccaatgagcctatctcattcccgttaacgtgagagaaacatccagacgctatcctcaggtctcacacacccccgccgtgctctgcaccacacctggcaggggcacccccgactgtatgctgggcatcagctcccaggcccgagcgcctcacctcacactggggattggagccctcaggccctagagacactggcttgagaaacttttgagatggagtctcgctctgttgcccaggctggagtgcagtggcatgatctcagttcacagcagcctctgcctcctgcgggttctggaaattcttgtgcctcagcctcctgagtagctggaattacaggcgtgtgccacc

SEQ ID NO: 8337 - DNA, 3312 bp, Homo sapiens
atcagctagcaagtattcacaggcacatccaacctccatccttacattccacaaggatttgagtgtctgttataggtataaaagcctgccgttggtggaaaaggaaaaggtggtccagttagacaagatgccaccggcttctgaaaccagacatctttgaaaacccacccatctacctgcaggaaaaggcaagggacctgacctcgcctgggctcagggaagaggttgctgggatcataaccccaggaagagacgggatggaaggagagcatgcagggagcagaggacaggctactctccaaggaggagagggaagaggccacagaaatggaaaaggggccaggacaagtcagtggagagatggtcagggcctggcgaggaggagcaggacaaaagcggtggagctcagccccgtggcggcagggccactcccattcatctggtcctctacttctgaagttctcgaatgcagaatgagatgtacagatgggccagcaggtgatatgctatctgtcataggttaaggcctcattattttattcatttttaaacttttttttttttgagacagggtcttgttctgtcgcccaggctggtttgcagtggtgccaccatggttcactgtaaccttgaagcccctgggctcaagtgatcctcctgcctcagcctccagagtaacgaggactacaggtgcacaccgccatgcccagctaatttcttaacgttttgtagagaaaggctctcactgtgttgcccaggctggtcttgaactccttgactcaagcaatcctcctgtcttggcttcccaaagtgttgggattacaggtgtgagccactgctcccagccacaagttttattttaaatgtttacctttcaatgatcacttcgaggagatttaagcttactctttcttttttttttttcttgagatggagtcttgctgtgtcgtccaggctggagtgcagtggtgctatcttggctcactgcaacctctgcttcccaggttcaagtgattctcctacctcagcctcccgagtagctgagactacaggcatgtgccaccactccctactaatttttgtatttttagtagagtcggggtttcaccatgttagccaggttggtctcgaactcctgacctaaagtgatctgcctgcctcagcctcccaaagtgctgggaggcatgagccaccatgcctggctcattgtctagtttttaccaagaagatgatgagatatgccagagggctccgtatctgctatgagaacgtcccccaagagcagctggccgtggtgctgcagctggagctgtgcttggagctcttcttcacccccatggcggtcaccaccttctgccactggcactttgtgcagatcatgctctctggccccaagtggggacctggaggtgctgaagagccaagagactggctgccgtgaccctcttcaacttcctggtctgcttggaccctgtgctttgtctcccatggtgggttcccccagtggaagagtcaaattggtgggcaggcgcagtgttgttcagtgctctcgatgctgcattgaccccttgattttctttgtttttgtttttattttgttttgttttgtttttgagatggagtcttgctctgtcacccaggctggagtgcagtggtgtgatgatcttggctcactgcaacctccgcctcctgggttctcctgcctcagcctcccgggtagctgggattacaggcacccaccaccacacccggctaatttttgtatttttagtagagacgaggtttcaacccctactcaggctggtgtcaaactcctgaccgcaagtgatctgcccaccttggcctcccaaagtgttgcaattacaggcgtgagccaccatgcccagcctaaccccttgattttctgtttctcttcctccaccgtgcgcaaagcctttgacagagggccacggaggtggcagcacggcgggggtctcactgtctgggtggtggtgaaagctctggagagccagctgcagagagaagatgtggatcttagggacggccaatgtcaccttcacaggagattagaggcgccagcttggggtaaccttttggggaaggagggctcaaaaagaggaacaatgaaacagaactaaggtgagttctcctgtgcccagtttcagaggtcaaggagagtagtagatagctcaaacccaactcagccattgagtgagtgttttcattttgttccttggggtctatgatattttctattttcttttctttccttttgttttggtttgtttgtttgtttggttggttggttggttggttggttttagagacagggtttccctctgtcacccaggctggaatgcagtagtgtgatcacatcacactgcagcttctaactcatgggttcaagccatcctcctgcctcagcctcctgagtagctgggactccaggtgcacgccaccatggccggctaattgtttattttttatagagacagggtttcactatgttggccaggatgttcaacaacttctgccttcaagcgatcttccctcctgggcctccccaagtgctgagtttacaagcatcagccaccacacccagcctatgacattttcttcattatggctggtactgcctcatgaaaagggggttcctcatgctggatctgaacaacccagcacaggcaagtctggggagcaaggcaggagcctgcatgtggactcaaaggaccggcacccgaaacaaagcagtggctggcacaggtggacaaaccaggcaagaaaagcaactgtccttcggagcagagtccacgtgatgggaagaaacagacacagtctcactctgttgcccaggctgaagtcaacggcatgatctcagctcactgcaacctccacctcctgggttcaagcaattctcgtgcctcagcctcccaagtagcttggattacagtaaaagctgccaaggtcctcttcaacgtgatggcgtaaatccagctctttctgcaagaaggctcaccagccttcccaccagctcttctccccaccccagccctgcagccctgcagcctgaccctaggtaatgagtggtggggagtgacccaggcatgcacgacctgcccagaggaaagggagttcaaagaaggacccgagaccctcacaggaacctagcagattggcacaagtgccagatgtatccaggacagacactttccccaggactccaggggtaaaggagtgccccacctctccactccttgcctttcttaactgaattcagattgtcgtgaacattcaagaaaagcattgtggctg

SEQ ID NO: 8338 - DNA, 3930 bp, Homo sapiens
cgggacatggatgtatttttctccccacagctctgtgctcaagccttgcagagggagatggcagagaggaaggctgccggcaagcagcacaggtaggtgattgtgatggacaaattttaaggatgtttttgttttaagatgaagctttgactgtctagtaaagaaaacagtgttttaattcttctacaagtcaactctttcactgtcttcaagacaggaaatgatggaaaagcagggagtgctggagagacacatgagtcaggaggcagcccagggacagctagggctagagaaccctttctggagaggtaggagctctctgggaaggcacccacttaacttctgctccacaatccacacccctgcttctcctttctggggtgagggcttgggttgggtaattgttatgtttcctggaaacagttccaagcacttactaaagagaacagttatcccgctgggtggcaggaccgtttttctcacgtgccacagctgaatgactcttggctggtcccctgtgaatagcggagcacaggcccctccactgactgtggacatcattccaccctgatgtcttggttacttttaactgaggggatgagcctagaaggcaaatgggtcagctccccttccaaccttgagtcagtgggaaggctttattttttttattattatttgagaaaagtaacactaataacattttagaatgggagccataagtgctgatgagagcagaaattttctggctatgtcttcatggatcaatatttcttcttttcttaaagaatcagaagacatagccagaaaacagagaagacaaaggtaaatgctggagtcattttccctctgcctagttcaggacagttttgtcttttcctacagcgccctctcctggcctgtcctctgctctctgggttctgtggtgccttttctaactggacttttttgaaagcaaaatcttccccatgagctttcaggcttctccatttccagctggtcatctttggtggcacctccagaagccataaatgcttaagggccaagggctgcagggctgtcactgttctgtttccagaaataacatgagaggatgccattgaactccactgaggtaggtcttatggcccagtagaccctgactgatcccttttactcaagatggtgtgggatcccctttccaaaatatgtggggcttcctttttttttttttttgctgtgattttcttttctgctatgaggtaagtgattaaccttcagaatatccgccgtaatcccagaagtgaaaactcattgatccaacattaatatgtgctttgtgcaattttgaatgttctttggcaaagtcaattccataattcatcacagtcccatctctgttgttaactgtgttgagcaaaaacgcccccaccctcacccagtgttgcccttgatctaatattctaagtgtcagaggttccatattttaatagaaaatgtgccctggctgtgaggtagtggagagtgaacgtcactcattacctacagggacaattctcaatgaaggccttaaatgatgctcaattaagctggttctcatgtggcctctgtgtcttcgacagctgctgaatcctctgatcacacacgatgggacttgtacacttgaaatcaaacatatttttaaaacttctgttgttgagaattcccacctcatttttccatggacaaaattattctttatgtcatagtgcacttaaaatttggtattacctagaagttaaagaaatatgataaccgtgccaaactgctatctctaggtaagattattccgtcagaaaaccctctcccagttcccctgtagctcttcaggaatccccatctccccatagctctttgtgcccatggatggcgcttccaaagtagagaagaccgtttgtcaagaagggaagcagaagggggacgagagggtcttgcaggcagagctggaatcgacttccactctgcttcttgcaagctgtgtgatgctaggtgaaatttctccttcctctggagcctctattttcttagatttggagcagggtggtcacactgaccttgtagatttctgagaatcagagacagcacatgaaaagcctggaggccattctcttaagagtagctgtgactcatgtgtggacaatgggcttttcatgcttctgtttctctctgtttatctgatgcaaggaacatgctccggtgatgatggtgagggaggaattaggatagacatagacacccctgtgtcagaaacatgcttctttattactgggttatgactctgtcttcccagggacaggccccagcctgcgtacatttgcagacagagtggcgtgtggggatagcagtttgtccccacgacttttcttcactcccctgctgttggaaggactcagttgaagggacactttatggcattgatgctgccattttgaaacctggaggagggaaaggtgcaagggactatcacctgaggcataaggtgcagcttgtgttggttttggtgtttttgtgtccatcatattcatatatttcaaaacattttctcctcctgacttgtaggtcaatgtggctacagggaagcctcatcctttctcagaatggccctacttgcccgatgtcatggctggcccttcaggaccattgatgggctgccagccgcctcctctacctgggtgttgtctgggaactcaaacactccctccatctgaaggttttctgggacctcaacaaactcctccactggagagtcctctgggaattcaaccacctccactcgactgtcctctgggaactcagccacctcctgcactagagagtcccctgaaaacttaaccacctcctccactcgattgttctctggggccttatccagctcctgcagctgtcagtcctccaggacctcatccacctactgcagctgcctgtctttccggacctcatccaccacctgcggctgtcaatcctccaggacctcaatcacctgctgcacctgttggtcctccatgacctcattgacccacggcatgcatctgacctcatccacctcctgcagctgtcagtcctccgggacctcattcacctcctgcagctgtcggtcctccgggacctcatccacctctcgaagctggtggtcctccggaacctcatccacctcctgcagctggtggtcctccgggacctcatccaccttttgcagctgttggtcttccgggacctcattcacctcctgcagctgttggtcctctgggacttcatccacaccctgcagctgtaggtcttctgggacctcatccacctcctgcagctgttggtcctctgggacctcatccacctcctggagctgtaagtcttctgggacctcatcaacatgctacatgtgtctgtcttccgggacctcatccacctcctacagctcttggtcctcccagacctcatccacgtccagcatgtgtcttccctccaggacctcatccatcttttatagctgccttcctctaggacatcatttacctttttgttctgtgaggcctctgggacctccgactacatctccacttagtaacctctggatcctcagccaccccttctacctgggtggcgtctggcccctcaataaccaccttcacatgaatctcctcggttacttcaataatctccatttgtggtccctgggacttcagccacttcctccaccagggtctcctctagtacatctgccacctcctccacttggctggcctctgctatctgaactcctccaggacctcaaccagctcccctacccattgttgcctgtaggacctcgaccacgacctccacatgtactacttggtatatttatctgaacagtatgaactgagttgcaaaatggattcatctttccctttctgaatgaatagaaatgttacagattgt

SEQ ID NO: 8339 - DNA, 3384 bp, Homo sapiens
agaagctaagagccagcacttgttcaccatgtgctcatttcctgtctctatgacaggctgccgtgctccagtttgcgaatgcccatccacctgtgaagggctgagccaagccctgggcacgtggcttcatctcctgtgtcaattcaggcaagaggaagagagaggaggaagcttctagatccaagccagaggaggtggatgcagcatctgccgcccacagctttggggcctggcccagcctccacctggccgagacacccaaccccgaccccacccacatgggcgtgcagaagagcctgagatggtgcacactgacccatggcagagttacagttatggaacaatccgaatgactgaatcacagcaccacagtaatgattctgcaacactgaacttgactgtcccaaggaaatcacaactgccatctcaagaaagcctgtctgcagcaaccattccatggtcctcaaagtcgtggccaccggagaggctggtttcaattcgcccccaactccggctggagagagttgaggaggaaggcagcggcctgggctgagtgggaaatgcctgcactggagggttggtggcccccatgctggatggaggcaggaacgggaggctcctggaattgtcctctcttctgccagagaggggaggcgggccgtcactgtgcagaagcccagccagcaccgagaaggaagtgggtgcctgtgggaccctcgcctctctgcggaggggcctgtggaaatgcagcctgtgccctgggccagccctgctcctaggagggtcctgctgcctcatttgctctctctccctccttctcctctccactcccacctttttttctaggaactttgaaccctcgttttcacccagtcccatcgagaagccaagtgctccctcctcaggccagagctcccagctgcagacacaggttcagcccccagctgagcgaggagcggcttccatgccggggcctgcctctctgccgctctccaccggtccttcgcagccgctccgatgctctccacgggtcctttgcagccgcgtcctggccctgaggcggtgacacagaagcccacgtccgtttcctttctgcttgcctgtttgtaggtgggaccaggcttcctgtctgcccatccccagaaggcaaagcctttaggtcccccctctgctgactcaggcacaaaagggttttttctttcttagttttggaatctgagtggaagggcacatgctgtggatcatattctccttctagtctctcggttgctcacgtgggagtaagtaggagctgtgggaccttgtccttaagccattaaagatgtggtgagttttattgagcctgctgcccaccctgtgatatcttttgctggtttgcttctccacaagcagattccagacaaggatcagtgtctgtggggtggtctcaggaacaccttgttgggagtgggggtgaaacagaagaggcaagaatcccaggctgggagcaggccctgcacgggccactgagctcagcccactggggcgttggggagtgggtgtgcttctgccttcatgacacctggggcctcggggtctggagcgagctcagggaggccccacagagtgtgggggctgcaggctggtcttttcttcgctgaccgctgaggctggggcctcgtcctgcttctgtgctgtgctttgcgttgccagagagaaccccagcgggagtgattcaggaggcgggcgctgccacgtcctgactgcagagaacctcctggagaaacagaagccatgggtcctgatgcccgagccggcgacgactctgagcacactgtgagcagagaacctcctggagaaacagaggccatgggtcctgacgcctgagccagcaacttactctgagcacactgtgaagggcggctgtgaatttttcttctttctcaaacaacgatgcaatcattgggatcacttgtcctcctgggatgggtttgtgtgagactgatgtcttccgaaaaacacagccccaagggagtcgagacgatgtaccaggtagaataaggcacaggggagccgcttgacaaatcagacgacggcagccggcctgcctgcccgggtgatgccagcgagttgtgtttctgagagacgaaggaagccttccttccaggtttccacgtggagcagtgcctctctgcgtggttcctggcagcaggggatgccaggctgcagtggcagaatgttgagctgcatggccggcttccactcatgcgaagccagcagcaaccccctcctcaggggtgacaaccagagtgtcctccagacactgccagatgtcccctggggggaactgtctttggctgagaatcactgctttagacggatgatgatcgtttaaatggacagtgctgttcctggctccaagcagtcagttccctccctccctgtttacttacaaaacagccgcatccccgggattacgagtgagccagcggaggtgtgaccaaagagatgtcacagttcgcttttctttgtgatcaatacgtggaatgatttaggggcctgtgttaaaattacaaatcttctatagaagattttggcagcaaaatattttaaaagcctacgaaataaacagagatggcacattcagaggctccaaatcacagagcaaggaactgcatccacagtagcttttgccttcctcctctgccgctgttttgactcattgatctttgggtctggtggattttttgtgttggggagagaagagggaagaggcaggagggccattctcatggcaagctgaggtctcaggggccgggctgggagttagggggcgctggggtcccacccaggtggcagggccaggcaggtcatggcacctgctatggtcgtgctgaagtcctggaggcaacaaccattgttacttctaaacgataccaagagggaaagaacacatcccttcaacttttccttaaggagatctgtaaggcaggttggaagaatttgaagtccttctgccttcgcatgaacaaaaatgtgaagggggtttttaaaactcagatttgatctttacagtaaccagatggattttatttcaacatgccagagtttccacatcacgtcaccactgcacttcaacgtgctgttcttgaggctgtttaaagttcagccttggcacctgacatggcgcatctgttttaactccaggcgtgggggctcctggggaaacgacgacttctgatgcctgaccacccccaggctgacgccctccctcctgcccagggctgaggctggacccagggcacctccttcgaatggcctctctcttcctccctaacacagagcaatcaacagctgtataaaataattgccctaaaatcacaaattaaaagaaaatcagcagcc

SEQ ID NO: 8340 - DNA, 3222 bp, Homo sapiens
agtgcagctgtgttgtcaggcccagaggctgatgacagagaagcgtgagaaaggacccacagtcagaggaaagggggagaactatggcggattctgcagacatcaaaccatctaaccatttcacgatgcaatgatgcaccagcaacagccacatggccacagtggaccccgcaggcctggccctgcatcccgcctgccccagggtctggggtccatcggatcagcaccgcccaccacaagaaggcagtcatctgccagccaggaggagaggcctcgccagaaaccaatcctgccaacaccctgatcttggacctccagcctccaggactgagaaggaaatgtctgctgttgcagcgcccggctgtgctgctttgctccagcctccccagcagaccagtgtccagtcgttcaagggaatgagcctgtcagtagaggctgggctttgtggtgagccagcagggaaacttctcggggagggaggagggcaaagagaggccagcctggtggggaagaaggggtgggagtggagaagacacagaggccgcacactgagtgaggaggaccaaggcgcaaggcccttttcaccaggctcctgtgctctcaggggagacagggagggtggcattggctagaagggcctgcccagccctggagaaaggagctcacagcagggtcgtgaagagggcagggactgggtggggggtgctaccatgtgacctgctaggaatgaatctgcgttagcgtccgtctggctggagtagagatgcttcagcacgtgtggggctgcacacaggcacgcagggtggaggcccctccactctacagccccacagccagcacctgccttctcacctcttctagtccagggcccgagaagccattagcaaccatcctcacctcagtgtgaatctgcaactctgccgctccagtgtgaaggaggagaaggagagcaggaaggggtgtccaccaccacgtgcccacaggagcaaggctcccaccctcccggggtatgaacttgaacccctgtgacctctgtgggtgcatctgcacagaatgcaggtcccctgtcccccagccaccgcaccacaccagcctagccatcctcgcgagccgccacaggcctgggaccccccagggcactggaacacagcagccccagtgagcacctggagcccgagcctggaccggaggccacggacggcttcgaacaggccagcccccaggaggggcggctcttctacagccagcccggcactgcccgcccagcctcccagatccagaggcagctgctccagagagagtgggggctccagggacttctcccaagcaagatgaaaacacaggtttttgcgtgaaagttccttcttaaatactgacagcaagtttagagcccatctcagatccctggctgtgctccatcagcccaacagccacagacccaaaatttaaagtagccatgcgccctgagagcccaacctgcctggccacgcacaggccagccatggtcccaggagtgggcgtgtgcccccgacaccacacagctgtgtccctcccttccatcccccacccacaggcagagctggaaagatcagcaccacggagagagacgagcatggccagtcccaggcccccaggccgccctgcccacctgccccatccctcccgaactgtcccctcagagctgggtcctgggctgagactccccaaactgtgaccttcaaggcttctcacacagctcaccccagcctcacggcctccagctctgccgctcactgtccccaccacactctccctggacccccacccctccagctgctggggcaggaaatcaagcctccgactgaccctcctggtgggacccctgaagagaaaggcgtgtaagggggactctgtgcacacctgcgtaagggggactctgcacacctgcagaaccgcccatccctggagcccggcctgcagtcaccgtcgagaggagaggcctggagcacagagtggatcctgtggcatggggactttgccgttggcagaacacgcaccctggggggaagggccctggctccatcgtgcccagcaagtacctggcccatatcagggacatatgagtaaaggacagaccacctggtccagtccccacttgcctgaggacagcagcccagacccccatgaatgatgaaagtccttctctgggttgagctgaaacctcccttccttatctcccacccatgtcccccgtccccctgggaaagtctgcggtatccaagggcagccctgggctccttcagctctccagtccccatggtgaaagatccgcagagaggccaaccctcccttgggtcggctatgccaggcgggcatatgagaggccccagacgtctgcaacgctggcccgatgcccatccagtgagccagccccgcgctgcttctatccagggagtctctggatttgggctcctcaggcagcagagcacacatggagacgcggagaccccagagaagaccccacaggactggagcccaaggccaggggctgtgaggggaccccagtgaggggactgcagctgccccagctccacggcgcaactgagcttcagagagcacacgcccgggcctcacacgctgggcctcctggcctcagcttgcctaccctgtgaggacgaccacgaagtccatgacgttccagccgttccgcagttccagttcctgcgtcctccccttgttcctgccagcgggggatggcatcacgcaggcatggtgaatcctggcccttgggacttccctgcgccttgcacagatcgcacagattgtggtagatggtcccttgcaagtgtcatcctgcctgatgcatcaccaccgaggaagcgaccgaagtcagagacagaggatgctgccactccccaagaatgaagccgggcttcattcccatcacctaggctgcagtacaggggcatgatctcggctcactgcaacctccacctcctggactcaagcaaccctcccattccagcctcccaggtagcaaggactacaggcacacaccaccatgccaggctaatttttgtttgtttgtttttgttgagacggtgtttcaccatgttgcccaggctggcctcgaactcctgagttcaagtgatctgcccaccttggcctctcaaagtgctgggattacaggcacgagccaccacactcagccttcatcatctaataaaatctaaccaaatcctt

SEQ ID NO: 8341 - DNA, 2934 bp, Homo sapiens
gttactggaaatgaggagagcctcccaggtcccagcagagctgctgctggtgcctcccactgtgggctccacagaggcagaggatgagggagccactgatacctccctgtaaggcagcctccctgagcgagcaggagcaggtcaggggtgagtgtggaatgatgacagcccagggcatcctaggcccccggggcaagagcaagctccctgtgcttcctgacccccgcctcatttgcagatacatgtgctcatgtcgggagatacctggagtcatctcaactcctgtcccccattccgcaggtccacaagtcaccaggttccattccccttcccctccacatatctcagagctgtcacagactctccatgccccatttcaggggtcttggcccaggccttgtcatgccttatctggaccaagagcaatggtccccaaccagctccacccaggtaccccctgccccgcccatgtcccccacagttgcaccatgcctgctggcacctgccctctcttcactggtgctccagcagctgcagaggcagggctgaaccctgggcccgctctcagggcccccacctcctgctcatcctccacatggcccaagcccttcatgactgtttgcctcttgcccacatcttccatgttgacgtcgcctgggactggaggatgcatcagagcacggatccttgagccagcttaaaaacggtgtgtgaggccgggcacggtggctcacgcctgtaatcccagcactttgggaggccgagggtctacaggagttagtgcatgcagtgtgcttaggacagggcctgctggaggaatgtttactactactattaatgactggtacccggggctagtgatccagcatttcctgcctagcgccttgtccattccatgagaaccggccctcctcagcctcaccagggacatcgacatgtctgaccccctgcagcctgcagggggaggacacggagaccctgagcaggcagcgacttctggagttcaacagccccctagggcagacctgtggatgcaaagccgggctccaggtacgcagtgcccttgggggccgccaggtgctggcagcagggccacggggacctgggactgagccctctctgcctccaggaaaaagcaaaatgggatcatggtcccaggcgtccattcgaggtcctctccccttggcaggagacgaaggacactgaacccagcactcagcatgggctggcaaacctaatcagtgcccatggattatgtttgccatccactgactggtggacggattgaggaccttggagttatcttcctgaatcttccctccttgatggcaactcacctccgctcaccaaggggtccaggaaggcacctgactctcaggaccgctggcgtcttggccagcctgggagagaaattcatctggcttatggcacagggacagaagcaggccggctgaggacaaggtaacagaagggctagggcttttagaagacaaagcttccttcacggatgcagaaggagaatgctgtttctctgcgctgggcaacctgggtttgaatcccatctctgggataagtgtgcagggcgcacagcaggtgttcggcacacagagcccttactgaagatactgctcaacaaggcagggtctgcctggcgctggcttcaggcccttggcaggggctgggcagccactcttgcccatgccctggtggccccgagatgccagcactcctctgggtggttggggaacccacccagggtggaggaggtgggcaaggcctgggattccacatctccagggcagcagaccccacggtctccagggatcttgtctgtgcccaaactcctgagacttccctgtcctttcccacaagggccctggctctggtggctgcagaagtgggaggaggggatgtgggggagtctggggaaggccaccttccatgacgctctgccaagccaggaggagcgaaggaataacctggtccccgtgctggaccctggactccaggaagcagagcccacagccggctcagccttgggtcccctgcctctgtggagctggccctaccccagatggccactgtgcctgaggcccggcatctgaccctctgtcctccctgccgaggggccagaacagaggccccggcaacaggcaaggcgcagtgcacggagctgaccccgtgcctcggtccaggcctagcaacaggaagtgagaggccaatgccggtaaacgagatccgaaagattagaggcctcgctgccgccccaagttagaggacaagttcctggaaggaggaggaagctgccgcagtaaataacgccagaccccagcgtcccagctgtcagcagccagtgcggccgcaggctgatatggggtttcactatgttgaccagactggtctcgaactgctgaccttgtgatccgcccgccttggactctcaaagtgctgggattgaaggcatgagccactgcacccagccctggggtgaaatctttgcaacgcacagaacccgcaaggatcagtatgcttgcacataccaaccagcctgaccagtcaatgagaaaagaccagaacatgctcttcacaaagaggaattcaaacggctaaaacataagaaaaggggctgggcgcggtggctcacgcctgtaatcccagcactttgggaggccaagacgggtgtatcacgaggtcaggagatcgagaccatcctggctaacacggtgaaaccccgtctctactaaaaatacaagaaaaattagccgggcatggtggcgggcgcctgtggtcccagctactcgggaggctgaggcaggagaatggtgtgaacttgggaggcggagcttgcagtgagccgagatcgcgccactgcactccagcctgggcgatagagcgagactccgtctcaaaaaataaataaataaataaataaat

SEQ ID NO: 8342 - DNA, 1405 bp, Homo sapiens
acacgaagagcaccacacagagcggcaggtagaaggcgcctacggtggagaacacggcgtaggaaggctcgcggcttacctggcactcctcgctgccctcagagtacgtctctccccagccaaaaagcagcggggccagagagatgacagcggagagtgcccaggtgagcgcgatcatgacgttggagacgcacttgcgggtgcggagcgtgtattccatgtggcgcgtgatggaccagtagcggtccagggctatggccgtcacgttccagatgctggccgtgcagcaaagcacgtcgcacgcgatccaaagctggcacagcctccgacctagctgccagcggcgcccggacagctcgtgcaccaggctcagcggcatgaccagcgcggccaccaggacatccgagacggccatggatgccaccaggttgtggggcacgcggtggaaggtgcgtacacggaggatggtcgccagcaccagcaggttccaggcgaacgtcgccgccaccagaaagcccagcaaggcagccggctgcagccttaactccgtgctagggaagccagttttgggggaacctgctttctgggacctgccttctgtccctgttgcccccgccaccccttcggaggctgcagctccggagagcgaatgctggcgcgcccaccgagacctgccttatccaagtggagatctagccctacagtaaaacaagtatcaggagaatgcactgagaaaagagaaagtcctccactggaacctagaggacgggacaacatcattaaataccggattattcacagggctgtttcaaacaccacttaaaaacagctgatggtgactgcctgcatgcagagcaactgtgcatggccccaatctggaagcaagcttgtgcttctttaaggcaaatcaccttcttgaggtcatggaactaatgggaatgagatgtaaactatgaatcctcttctttggaaaaagttctgcatctagtctcagggcctgttatctggaggaatggatgaactgtgttgcccacaggcgggcctcaatggatctctatgaatcttgaaaggcattatgggcttgtgattatattccctactgattccccaggccacagctgtctgtattgatagctaagtgagcagcagaatagttaataaggacaaagccaaggatgactgaggataatttgtgaaaaatagagtgtcataaatttagggactgaatagaatattcccacaaaggagagatccaatggagcatttccagaagggacaaaccctgttcagaaagtctggcttatctcttaaaaatacacaaataaaaaatcataatatttcagcttcatcttaaagcatagccccaattttatcttgaaaaacactgaaaaggaaaagaatctga

SEQ ID NO: 8343 - DNA, 1386 bp, Homo sapiens
agtcacacagctgcctggtaggtgactggaggccttgatcggttctcattgagattttgctgctgtgaccccaaccctgcctccctccccaccctgcgatggcagaagaaactcaacacaacaaattggctgcagccaagaaaaaggtaaaaacgcactaggtcatagcccctcaacccagccacagatcccctctgatgacaagacccctgccagagtctatacgactcctgaggcacactggactcgtcccccctaccccggtgcctctgggctacccccaccaaagttttgtcagtcagccccaccccttcagcaagcagcccagtccttgccctcgccaatcaccccagggtgactttgggtgggtgagtcctggggcttcccgctccattactgggccctcatctcctgccgccccaagcttgatctccctgggctctttgggctctcatctccaaggagccaggccccaccctcgccagtcatccctgggtgactttggactggtgactcctgggactccctgctgcagactgtgccctcccctcctgctgcctcaaggtcgacctccctgggttctttgtgctggcgtctccaaggagctgggtcccaaccctgtgcttccctcccccatcgtggagcagcgacttggacatggtgctgacatggtccctccccccgaccaggaggagtggaatgttgtgatgtcacagtccacctagtaactgccgttactgcaagactggcctttgatcttacgacccagtcccctaagcgttctcaccccgtttctggttcctctggtcacagcacaaatttccagctggaaggggaatggagactatgggacctaggaggaagaggttccaggctgcctcactcccttacagatgttgacggtgggaaaagcctacacttcccccatgaactcaaaacgttgacagtatctctgggtggcaatgagagaatgggtttggtttggttttctcccaggcttctactttccagagagattttaacatttttttctgagttctccacctcatattctaattctccatggttctgggaccagactctccttcagtcagtggtctctgaagtgacatttgctcatcttctgtggaatagatcttgggaaactgaacttgacaccttgaatcttcctcatattatctcaaccttgggtactttgagtgccacaggataaatgtgggacatctttctgaagcatcagtttcccttgattctcttgagatcaagagaaaaaacatgaatgtacttagggatgacagtcacataggtttctaagagtataccagacctctctctgaaatgaggcttgggttatcctctttctgataaattctgatttaagagaaa

SEQ ID NO: 8344 - DNA, 1386 bp, Homo sapiens
agtcacacagctgcctggtaggtgactggaggccttgatcggttctcattgagattttgctgctgtgaccccaaccctgcctccctccccaccctgcgatggcagaagaaactcaacacaacaaattggctgcagccaagaaaaaggtaaaaacgcactaggtcatagcccctcaacccagccacagatcccctctgatgacaagacccctgccagagtctatacgactcctgaggcacactggactggtcccccctaccccggtgcctctgggctacccccaccaaagttttgtcagtcagccccaccccttcagcaagcagcccagtccttgccctcgccaatcaccccagggtgactttgggtgggtgagtcctggggcttcccgctccattactgggccctcatctcctgccgccccaagcttgatctccctgggctctttgggctctcatctccaaggagccaggccccaccctcgccagtcatccctgggtgactttggactggtgactcctgggactccctgctgcagactgtgccctcccctcctgctgcctcaaggtcgacctccctgggttctttgtgctggcgtctccaaggagctgggtcccaaccctgtgcttccctcccccatcgtggagcagcgacttggacatggtgctgacatggtccctccccccgaccaggaggagtggaatgttgtgatgtcacagtccacctagtaactgctgttactgcaagactggcctttgatcttacgacccagtcccctaagcgttctcaccccgtttctggttcctctggtcacagcacaaatttccagctggaaggggaatggagactatgggacctaggagcaagaggttccaggctgcctcactcccttacagatgttgacggtgggaaaagcctacacttcccccatgaactcaaaacgttgacagtatctctgggtggcaatgagagaatgggtttggtttggttttctcccaggcttctactttccagagagattttaacatttttttctgagttctccacctcatattctaattctccatggttctgggaccagactctccttcagtcagtggtctctgaagtgacatttgctcatcttctgtggaatagatcttgggaaactgaacttgacaccttgaatcttcctcatattatctcaaccttgggtactttgagtgccacaggataaatatgggacatctttctgaagcatcagtttcccttgattctcttgagatcaagagaaaaaacatgaatgtacttagggatgacagtcacataggtttctaagagtataccagacctctctctgaaatgaggcttgggttgtcctctttctgataaattctgatttaagagaaa

SEQ ID NO: 8345 - DNA, 1357 bp, Homo sapiens
acctggcgctggggctccggtccgcagtggctccggcaggagggagagaacgaggagggaggcttggaaacgccgggagtagcggtgaggccgacgccggggaagcgaatcgatactgcgttactggacgcccgtgggcctcatgaggatggtcgattccctcattcgttattcacgatttattagggatggcggccgcgtctgtccctccagagagctcgattatccatccggccagcagcgccattaagcgcactgacggtgggaggctcgagttagaaattaggataggaatcttcgcccagttttggagcgcctgcctcctcttccctcgttgctcgcagccaaggcagccgcgaagctgggggcctcgggtgaatgctttcgccctctggccggcgaccaggagacctgcgcacactggccgccgagtgaccccagctcgagcctgcagccacaccagcgggacgggggcggggaggaagaggaagggcggagagacttccttccagagggagtggtccgagaaccggcgggagaagggccaagggaagatccggtcacctgctccggagcctgcaggcggagaggcgagtagttcaccggccccggaggaaaggggaccctcccactgttcccaggcaaatgtgtcgccggcatcctgcactctgccggggaagacgcgcatccactcgctctgcagggaggggaacgcgggaaggactcccagtcagccgcccctctctggctacaagaccccgaacaagagaaacctgtaacaggggctctgcggagatctggatcccacccaccaaccacatgggcacctggggggctgcccctcggggcattatcagccagtgggaagggggttgacgttcctctgcggcccatgaatcctggagggctgcccgaggggccaccggggtccatccacttattcttcggttgttaagcgccagacaggagagaaccgctagagaggagtgtgctaagaccctattacccactaaaactccattttcatcttttgcgtcctggatgactagtctccacattcctggcctttctggtttctcaggagaaccttctgacccaactcttcccacatcgaaagagtttcctagtcttttgttctactactagccgacatagaaagcacctgtcatgtgccagtgtcaaatactgcgctaggaactgggaactcaaggcacaggagcctggcttttgcgcagggcgctcacaggccggtgggtgcaaaccctgaaggacacacagcctgtccctttagcgcccatcgcttctggtgtgagctcccgctaagggtgggtgagtactggggtgggcttccagaaga

SEQ ID NO: 8346 - DNA, 1482 bp, Homo sapiens
ccacatggggcttgaggccaagaacagcccttgttgccaccaacatggagactttgtaccatatcccattcttagtgctcgagtgttccaacctgaagttgaagaagccaccctggctgcacatgccatcagccatgactgtgtatgctctggtggtggtgtcttacttcctcatgactggaggaataattatatgatattgttgaacccccaagtattggctgatgaacgtgggcatcagaggccagtagctttcttggcctacaaagtaaatggacagtatattatggaaggatttgcatccagcttcctgtttacaatgggaggtttaggtttcataatgctggaccagtcgaatgcaccaaatatcccaaaactcaatcgattttttttcttctattcattggattcgtctgtgtcctactgagttttttcatggctggagtattcatgtgaatgaaactgccgggctatctgatgggttagagcgcctttaagaagaaatcagtggatactggatttgctcctgtcaatgaagttctaaaggctgtaccaatcctccaatatgaaatgtgggaaagaatgaagagcagcagtaaaagaaatacctagcgaaaaaaacaggaagcatattgaagctcggactagaatttcttcttggtatcagagagacaagtttatcacagtatttttttttttcctgctgacctattgataataccaacaatgttgagtggcattttcttcttagtttttaatttcttaaagaaaatatactccatatctgcagggaaaaaaataaaaatccacacctgagaacagatccatacaacctgcttacaaagaacagctcctgtgctacctgaggctgatttatttgaagaacaaaaggaagagagacaatttagtgtagacaagtgctattcaatagaactttttgcagcagtggaaatatccataaatctgcagtatccaaccaaactagccacagacagctgctgagcaattgaaatgaagctggcacaactaaggaactgaagttcttattttaattcaacttcaaatggtcacatgtcactagtgactaccacactggacagtgcaggtgtagacggagttcagatcagactcctgaaacttaatggctctaaccttaggcaagttacgttaacatctaagcctcaatccctccaagtagaatgggtgcacctaaatcatagggttgtcctgttgtcctgagcaacattatgtaaagcacttagcccagagcctagcacatagttatctagagttgggaacgtcactcctggtgtgcatgtccagaccctacccgggagaagggcctaacctatgactttagaaccctcagttgcaggtgtgcatgttccagccaacactccactctgagtgcaggctcatcaggacaccatatggttgtaaactggctgccatgtcccaatccttccagctcttgagggtcag

SEQ ID NO: 8347 - DNA, 1543 bp, Homo sapiens
tagagggaaggctgtctagctacatctagggcaacatgtctgtcatttacctctaagaattatttagcagcttagaacccattccagacactgatgcatttgaaaaaccccccaaacccaccacatttacctcctgtggaaagtgctagaaataagaccatcctcctgcagcagttgagtgccctgcccgactcacctctctggggcttggggatgacccgcgtgtttttggctgacttgactgaggcatctcttgcactctgcagtttaatttcccttaagtgtctccctggggactctggaaagagtgggaaggtgagtctgggattggcagggtgctcagggatccaaacatcagtcgcccccagcagccaacagcagaagacagcttcctgtgggacgggaggaaggtgctgtggaccccacccagcctctcccaggaagggagctggcagccattccacagcccgagcctggcccagcaagggagaagctcagctcttctcccctccggcctcagcaggctgctcagggactcagcctggggtcacataaggcctttccaacaggccactctgcatcccctgtcggcctcccaaatggtgagaccaagagtgtccaggacatggggaaactggaaggcagcagcctcgagggccgggtccaggatccatgtcctccagtgaggcctggcgcccttggccgtaacccagcagaggaaagggcgggccgtggacttggagaaggttttcccttggaccacacagaatgcggcactggcctggacacgatcacgctggtcactcgtatgcccatgttcagcctgctcagggagacaggaacagactacaggagcagcaggctgaggcacgcccccaggcaccccgtgaggcgggcagggcagggaagctggtgctccaggatgcgtttcctgcccgcgcaccaggcttggctcccgggcccccacagcctgtgggttttctgagcaagggacagggaggtgcccaggcctggttgcccaggcaggcctgacaggaactggcgagaagccaccctggagggccgggcgcaggccaaggcagggcggtggggcgctgaaccagctccaaactgctggcagagctggccagagtgaggaagtgaggttcccaagcacagaaggcaaatcaaaaaggaatgccacctccagggaagacactacactgccaaaggagatgcggccttgcccggctcgaaaagaggtcattttcagaacatgggactctccaagccctgaggacaggaggcagcctggggagtatgaacctcgcacctggtaggggaccccacacccgaggtaccacccaaaacacagcccagatctgcacggagggatggttccctgagcaggcgtgactgtcacagacaggctgggcctgggggctgtcgggaggctgctgtcccaggctgggtctggatacaaaacttggactgtgtcaagcagcgggacgctggcaggagcaccgggaaggccagcacgtggctgcaacgtctcccgccttca

SEQ ID NO: 8348 - DNA, 1528 bp, Homo sapiens
cccaagccgggagagctggcagatcagagagggactttccagataaatcccatctggggaaacgttactatcttccacaagcaatttttctaaaaatgcaaatgctcttttatagagctcggccttccctcctttaagaaagggcttgccgattcaaacctgcccgactcagctggattaagttgggcaagggagatttgccgtcagtctgcaacctggtggcagatggagatggaaccaagatttaccctggaagtaggatattagtcaatggctgtcactggggtacaatgttcagaacgatgcaaacagacacggagggttgattcttcttcagggaaatggctggccactcccttgatttgggagaaactaaactggccttctcgttcccagtcccagaacctccacccctttcgaattcttcccaacgggctgaccctgcccggcgcccaggagcgccctgggtatctcctggctgctctcccgaatccttgcgcgccgcgcccctaccaggttcactgggtgcacgtagccgttctcatagcggtcctcctgcaacagctgccgcagtctcgctgtctccgccttccgctccctggcggaggcggaggccagagagcgctccaaggaagactaaaaacccaggccgggaagcgcggggtgagaaagcgaggtgggtggcgagagcgtgagcgcccctctgctgaccccggggagcgtggactacgagttggcgcccaagtccagaatccgcgcgcaccgcggaaaatatttgcaatacctgccacgtccaaggttcagctgaggccaatgtaaagccagtattataggacacttctcagactgagagcccaatgtcgttggaaaccactgggccacaggaaaggcaggctctctcagtcctgctcctgccatggaagaagcctgctcccaccatgccttctgccacgagtaaaagttccctgaggcctccccagaagcagatgctgtcgtgcttcctgtatagctgcagaactacttcaaatcatcccaacaccagagaacactaaatgacagtggacaggaagacagtgtaccttttgctcctgatgatcgtaagaacaacctccttcctcttattgtgaagtgcaaggtgcaaaaaggaggcctgctgcttgttcaggactatgtcagcattgtggctcagaagaagcgcaacggctttggcgtggccttcccttgcagcaaagtgaagtgcagtgttcttttgaagaaaaacagacacagaaaacgtggtgacagtgtctaatctgtcttatttcactgcttaactgcttaaaagacattagcgacactatttaataccaaaatacatagcacttaaaactggtgttcagaatcaagcttcaaaataatgagtttatagttctagcatggtgtgtgtgcatgtgtgggaagtggatctgtgtgtgtgtgtgtgtgtgtgtgtgtgtgagagatagagaaagagagagagagagagagagagagagagagagagagaatg

SEQ ID NO: 8349 - DNA, 1199 bp, Homo sapiens
caccggccccgccgccatcaccaccaccgtcacctccgccgctgcctccttggggccctcctccttcaccgcccccttagccacctctacacattctaggctttctgtcctggagaagaagctataatcggtttccttgtgggcccggtgcgcagccatggcggacggtggcggcggcggcagcggcggtgcgggcccggcctcgacccgggccagcaggggcctttttgacagcttccgccgggactgcaaggctgacgtggacaccaagccagcttaccaaaacctgagccagaaagcggataattttgtgtcgacacatctggacaagcaggaatggaatcctccagcaaacgacaaccaactgcacgatggtctgaggcagagtgtggttcagtcagggaggtcagaagctggagtggacaggattagttctcaggtggtggatccaaaactaaaccacatcttcaggccacaaatagaacaaataattcatgaattcctggtggcccagaaagaagcagctgtgccagcactccctccagagccagaaggccaggaccctccagctccgtctcaggacacttcctaagaatatgcctgacagcttttgaaagcgctatttaatttttggtgaagaaatggattcggttacataagagtgcagtttcagattgaagataagccaagttcatcactgagctcaagatttccacctcgaccatgagcagtgaccagattgaaagggaagcaagttcgccagagagaaagttgaccgtggcaccctcctgcattgcgctgccatttggccagcctttccaagggcatgacaccaaacacacactacagagagggaaacactaccgcgacccaggattgtcctgaaacagacatctatacttgaacatggagactgcacatggattttagggtttgtgctctgagataaacgaaagctacagcgagagaacataaccaatcccaaagacaatttcaaagaacaatgacagtaaaggttaactgggaggaatatttgacagtacttatttgatattgtctctcagagttgcaaactagattgtacacaacattagtgtcagatagctttgaagttgtgaccttcttgtacatgaatcttctagccagtttcctttcctttgtaagagataacaaagcatgaaaccctagaatgagtgaga

SEQ ID NO: 8350 - DNA, 1322 bp, Homo sapiens
cagagatgctgccgctgctgctgccgctgcccctgctgtgggcagggccctcgctcaggatgcaagattccggctggagatgccagagtccgtgacggtgcaggagggtctgtgcatctttgtgcactgttcggtcttctacctcgagtatggctggaaagattctacccctgcttatggccactggttccgggaaggggtcagtgtagaccaggagactccgccacaaacaactcaactcaaaaagtgcagaaggagacccagggccgattccacctcctcggtgatccctcaaggaacaactgctccctgagcatcagagacgccaggaggagggacaacggttcatacttcttttgggtggcgagaggaagaacaaaatttagttacaaatattccccgctctctgtgtatgtgacagccctgacccacaggcccgacatcctcatcccggagttcctaaagtctggccatcccagcaacctgacctgctctgtgccctgggtctgtgagcagggaacaccccccatcttctcctggatgtcagctgcccccacctccctgggccccaggaccctccactcctcagtgctcacgatcatcccacggcctcaggaccacggcaccaacctcatctgtcaggtgacgttccccggagctggtgtgaccacggagagaaccatccagctcagtgtctcctggaaatcaggaaccgtggaagaggtggttgttttggccgtgggggtagtggctgtgaagatcctgcttctctgcctttgcctcatcatcctcagtttccacaagaagaaggcggtgagggcagtggaggttgaggagaatgtatatgctgtcatgggttaatctctcaggcctccagactgtacttccagatgtctcctcatccagttcctccacagtctgaatggccatgtttcctcttcattgctggagaatgaagtgcaaatgccactgcctggactgaaggcctttcacgatctgtcttctgctggactctgctcctgatcccccttctccttgcatcacccgaagtctccctacacccaccaggccaagccctctgtgattctgagactttgcatgtgtagttacttctcctgaaatggccttcctccccattcctgccaatccaggtccttatcatccttcaggttgtcttaaatgtcatccaggtgtgtgtatttttatgtaatccttgtatgatattaagcggagatgtggcatttgttcattaatttgtagacatattcagtaaccatactgaatacatataatgactatgtgccagcatttccgtatgtgca

SEQ ID NO: 8351 - DNA, 1373 bp, Homo sapiens
agagatgctgccgctgctgctgccgctgcccctgctgtgggcagggccctcgctcaggatgcaagattccggctggagatgccagagtccgtgacggtgcaggagggtctgtgcatctttgtgcactgttcggtcttctacctcgagtatggctggaaagattctacccctgcttatggccactggttccgggaaggggtcagtgtagaccaggagactccagtggccacaaacaactcaactcaaaaagtgcagaaggagacccagggccgattccacctcctcggtgatccctcaaggaacaactgctccctgagcatcagagacgccaggaggagggacaacggttcatacttcttttgggtggcgagaggaagaacaaaatttagttacaaatattccccgctctctgtgtatgtgacagccctgacccacaggcccgacatcctcatcccggagttcctaaagtctggccatcccagcaacctgacctgctctgtgccctgggtctgtgagcagggaacaccccccatcttctcctggatgtcagctgcccccacctccctgggccccaggaccctccactcctcagtgctcacgatcatcccacggcctcaggaccacggcaccaacctcatctgtcaggtgacgttccccggagctggtgtgaccacggagagaaccatccagctcagtgtctcctatcctctaatgaacccagtgattgaagcctccctagaagacggcacagggaaatcaggaaccgtggaagaggtggttgttttggccgtgggggtagtggctgtgaagatcctgcttctctgcctttgcctcatcatcctcagtttccacaagaagaaggcggtgagggcagtggaggttgaggagaatgtatatgctgtcatgggttaatctctcaggcctccagactgtacttccagatgtctcctcatccagttcctccacagtctgaatggccatgtttcctcttcattgctggagaatgaagtgcaaatgccactgcctggactgaaggcctttcacgatctgtcttctgctggactctgctcctgatcccccttctccttgcatcacccgaagtctccctacacccaccaggccaagccctctgtgattctgagactttgcatgtgtagttacttctcctgaaatggccttcctccccattcctgccaatccaggtccttatcatccttcaggttgtcttaaatgtcatccaggtgtgtgtatttttatgtaatccttgtatgatattaagcggagatgtggcatttgttcattaatttgtagacatattcagtaaccatactgaatacatataatgactatgtgccagcatttccgtatgtgca

SEQ ID NO: 8352 - DNA, 778 bp, Homo sapiens
gcagtgggggcggaggcggcagggatgcgatggcggagtcgctgcccctggagatgctcacatatattctgagcttcctgcctctgtcagatcagaaagaggcctccctcgtgagttgggcttggtaccgtgctgcccagaatgcccttcgggagagcctgggcctcaggggcatctgctgcatcagcctgaccaacctggatggctctctggcttcacaccaggtgctacaatctgttgcttaccacctgggcccacacctgcagagcttgtccctgggtggaggcagccccacagaggcctcctctgtggccctgatcctgggctgcccagccctgtgtgtccttgacctcagtggctgcaatagcctcttcacctcgggcacactgctggctcagccagagatggcacagagcgtccagcaggctttgagcggcctccgtgagctcaacctggctggcctgcgagacctggctgacctcagcttcaaccagctcagcagctgtgcccccagcctggagcgcctctccttggcatactgccacctcaccttcgagctaggcccagcctgaggctccatcggcccccaagactcctctcccgcccagttctccttctgcaacctgctgcgattagtgcaagagcgggctggcaggctgcgtgccctggacctgagtggcactggcttgccccccgaggccctgcaggctctgggccaggtagctgggctgcagcttcaggagctgagcctgcacagctgccgggacctctccacaga

SEQ ID NO: 8353 - DNA, 1042 bp, Homo sapiens
actttgtacctttctctcctcgactgtgaagcgggccgggacctgccaggccagaccaaaccggacctcgggggcgatgcggctgctgcccctgctgcggactgtcctctgggccgcgttcctcggctcccctctgcgcgggggctccagcctccgccacgtagtctactggaactccagtaaccccagcctgcggcgagagggctacaccgtgcaggtgaacgtgaacgactatctggatatttactgcccgcactacaacagctcgggggtgggccccggggcgggaccggggcccggaggcggggcagagcagtacgtgctgtacatggtgagccgcaacggctaccgcacctgcaacgccagccagggcttcaagcgctgggagtgcaaccggccgcacgccccgcacagccccatcaagttctcggagaagttccagcgctacagcgccttctctctgggctacgagttccacgccggccacgagtactactacatctccacgcccactcacaacctgcactggaagtgtctgaggatgaaggtgttcgtctgctgcgcctccacatcgcactccggggagaagccggtccccactctcccccagttcaccatgggccccaatgtgaagatcaacgtgctggaagactttgagggagagaaccctcaggtgcccaagcttgagaagagcatcagcgggaccagccccaaacgggaacacctgcccctggccgtgggcatcgccttcttcctcatgacgttcttggcctcctagctctgccccctcccctggggggggagagatggggcggggcttggaaggagcagggagcctttggcctctccaagggaagcctagtgggcctagacccctcctcccatggctagaagtggggcctgcaccatacatctgtgtccgccccctctaccccttccccccacgtagggcactgtagtggaccaagcacggggacagccatgggtcccgggcggccttgtggctctggtaatgtttggtaccaaacttgggggccaaaaa

SEQ ID NO: 8354 - DNA, 1131 bp, Homo sapiens
aaaggtggctggaaatggaagatgagaggatcctggacaacctgggggcagagggacgtcatggctctgagtgggagtggagaagatggcattttggtggatgggtggaggaagagcataggcacagatggccacgtggagtgtggtccacagataagtcacctggtggagtgcagccacagtgcctgagtcaggaggtctcagctcttgtttcaggaacacagtcatccctcagaaatggattgggtgacaagtggtctgcatgctgcacacgggcactggggcaaatggaacaaacaaaacagtcaaagaggagagcagggagagaagacagattcagtgttgccctcggcagatgcagaggaaacgagcacaaaaccctttcacatgtgccgggcgcaagcgacgctgcccagaaaccccgcgccaagccctgcagccgaggaattggagcttctgtgttactccaaacaatgcatctgtctttcattacactcggatttagatgaaatcggggcgcttgtgggcaaaccagtgaagatttcaaataagagaaattgtattatattagaatcataacgttttaaaaataattctgtattgaaggaagtttttaaagaatggctaatggtgccttagatgcaatgaagccctttcattcgttctctccccctgtcgccccattctcatcttcactgtcctaaatgaggcctccctggtcccctcgcctgggccgtcacagaggcctctgagtgatgtttctcctcccagctttcccctttctgccaggctccctccctccagttagcttcccgaagcctggacagggtgaaccgacttgaaggcttgaatttgagccccctccttgctcaccccacgctgggccagcgcctctcccctgggttaccctagtgcgctgtgcttacccggatctcaacacttatcacaaggatggaggtttgtggccatttcccctttttccccctgagacaggggtctccacaggggtggggctttgacccctttatgggtgtattcttggtactggttcctccaggcaaccaataaatatccactggctgatgggatgagtgatgtcactccccatccgcggttcctcactgagatttg

SEQ ID NO: 8355 - DNA, 1753 bp, Homo sapiens
tacgcacgtcctgattctcctggagtctccagcccgcccagtggccgcagtcacccaggtccagaggcggcggtatcacaggctctccgacatgtctatgctggctgaacgtcggcggaagcagaagtgggctgtggatcctcagaacactgcctggagtaatgacgattccaagtttggccagcggatgctagagaagatggggtggtctaaaggaaagggtttaggggctcaggagcaaggagccacagatcatattaaagttcaagtgaaaaataaccacctgggactcggagctaccatcaataatgaagacaactggattgcccatcaggatgattttaaccagcttctggccgaactgaacacttgccatgggcaggaaaccacagattcctcggacaagaaggaaaagaaatcttttagccttgaggaaaagtccaaaatctccaaaaaccgtgttcactatatgaaattcacaaaaggaaagtcgtggaaggcgctgacgctgtcccagaagaggccgtacgtggacgaggcggagcggctgcgcctgcagcacatgcaggactaccccaactacaagtaccggccgcgcaggaagaagcaggccaagcggctgtgcaagcgcgtggacccgggcttccttctgagctccctctcccgggaccagaacgccctgccggagaagagaagcggcagccggggggcgctgggggagaaggaggacaggggtgagtactcccccggcactgccctgcccagcctccggggctgctaccacgaggggccggctggtggtggcggcggcggcaccccgagcagtgtggacacgtacccgtacgggctgcccacacctcctgaaatgtctcccctggacgtgctggagccggagcagaccttcttctcctccccctgccaggaggagcatggccatccccgccgcatcccccacctgccagggcacccgtactcaccggagtacgccccaagccctctccactgtagccaccccctgggctccctggcccttggccagtcccccggcgtctccatgatgtcccctgtacccggctgtcccccatctcctgcctattactccccggccacctaccacccactccactccaacctccaagcccacctgggccagctttccccgcctcctgagcaccctggcttcgacgccctggatcaactgagccaggtggaactcctgggggacatggatcgcaatgaattcgaccagtatttgaacactcctggccacccagactccgccacaggggccatggccctcagtgggcatgttccggtctcccaggtgacaccaacgggtcccacagagaccagcctcatctccgtcctggctgatgccacggccacgtactacaacagctacagtgtgtcatagagctggaggcgccccgtccggtcagccctcgcgccctctccttcttgtgccttgagtggcagaggagccgtccagccacaccagctttcctcccaccgctcagggcagggaggtctgaactgcggccccagagcctttggcctaagctggactctccttatccgagtgccgcctctatccccttccccacgttccagcccctgcagcccacattttaagtatattccttcaagtgagttttcctccagcccctgagagttgctgtctcccagtggaatgttcactgacgtcttttcttggtagccatcatcgaaactaatggggggacagacttgatag

SEQ ID NO: 8356 - DNA, 1212 bp, Homo sapiens
gctaaactgagggatgggcagagaagggcaaactgtaactacagtttattttagctcatgtttaaatacaggatatactctgttttccttctgtacaggagagggaactcttcacagatgggaagcatttcctgtgagcctgtaattgtataagctgggagtaaagaggatgcccaggtacacatttttggctatgtttttgctggtggtgatcatggaggtggcttttgtttctttcagccataaggctagtgagaattttttctcctaattaaagtaaatctggaggcatcatgctacctgacttcaaactatactacaaggctacagtaaccaaaacagcatggtaccggtaccaaaacagagatatagatcaatggaacagaacagagccctcagaaataacaccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaatacttaaacgttagacctaaaaccataaaaaccgtagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaacctactcatctgacaaaggactaatatccagaatctacaatgaattcaaacaaatttacaagaaaaaaacaaacaaccccatcaaaaagtgggcgaaagacatgaacagacacttctcaaaagaagacatttatgcagccaaaaaacacatgaaaaaatgctcaccatcactggccatcagagaaatgcaaatcaaaaccacaatgagataccatctcacaccagttagaatggcagtcattaaaaagtctggaaacaacaggtgctggagaggatgtggagaaataggaacacttttacactgttggtgggactgtaaactagttcaaccattgtggaagtcagtgtggcgattcctcagggatctagaatagaaataccatttgacccagccatcccattact

SEQ ID NO: 8357 - DNA, 1273 bp, Homo sapiens
agtgagcggggcggggcacgcggcggaagacagacctcccgccctgggagagagcaccccccgacccccgagagagagatcgacagagaaggggacaagatgcagtcagagaaaccccaaggcctgttcctccaattgaatcccaatgcatcctccactgagactcaactcctggtgccagctctagagagcagagatacacttccacctacccactgtttcatggcaggcactgagtcaccccttgggaatccctggcccctgtccctgcccccaccatgctggacaggatgcctgctgcctgccccaaggggtcagaggaagccagggcctctagggctcagtatttttatcagcctaggaaacaagagacacagaagcggaaaccatgtggtcagagaaagtgaacagcccttatctcaggggaacccccaccagggctgggggccagacaccaggaagggacgttgaaaagactgtggtccggtgggcccaggtttcagggcttattttgctttggttttatgtaactcttgcagaaggggaaatgatgtgcttaaaaaccagtgagaaatctcctgggtggaggagcaaatttggtcaccagagttttctgtaatttacttctcaacctccagcttagggatcctaaccccaactccccccaaggccaaacctggactctttgcatgccacttccgaaaagctccagcctgtgagaggaaccggacgccagggtcacacacagcttgaagtctcttctctgaatcacagcagcttcctctcacaggatctttctcaccagcccttccccctcctgcaccctgaacatctgcctggtccttcagaggccttggtctcttccgaacttcaggctgtcttattcaaggatctcatgcccacccatgttcccgtgttcccagaggcgtgccctccctgtcttctactgccttccacttccactcctgggattctcctgtagagaactgggctcaaaacctgaaagataagtttctgattgataagatgctctggtgtaactatgcagacagtgcactcaccagcacatgtctgtactctccttgcagccctgtcctttctttttgccaagttcccagttgtgtcctgggcgatggtagtggggtctacctatcttagtttccagggagcccccctctctcctccgtgggaatcccagactctccctccacctctcaggacttcaactactggttcttggaaaaggaaatgtttatagggaaggccatgcctg

SEQ ID NO: 8358 - DNA, 1273 bp, Homo sapiens; identical to SEQ ID NO: 8357

SEQ ID NO: 8359 - DNA, 1558 bp, Homo sapiens
atcgtcggctcggaggctgaggggctgccgcagccgggagcccccctcgcctcgctcctcgctccgcttggtgtcatgtgattctctgagggagcagctgcgtgagtggagatgctttcagtggtggagaatggactggacccccaggctgccatcccggtcatcaagaagaagctggtgggatccgtgaaagccttgcaaaagcagtacgtgtccctggacatggtggtcactagtgaagacggagatgccaacaccatgtgcagcgccctggaggccgtatttatccatggcctgcacaccaagcacatccgagctgaggccggaggaaaaaggaagaaaagtgcccaccagaagcctctgccccagcctgtcttctggcccctcctgaaagctgtcacccccaaacacatcatctcagagttggagcacctgacgtttgtcaacatggatgtgggccgctgccgggcatggctgcggctggccctgaacaatggcctgatggagtgctacctgaagctgctgctgcaggagcaggcccgcttgcaactacagcggaaggaatctctggattccatttcccattcttcaggctctgaagacatcgaagtccatcactcgggccataagatacggaggaaccagaagccgactgcctcctccctcagcctggacacggccagttcatcccagctgtcctgcagcctaaactctgatagctgcttactccaagagaatggctccaagagtccagaccattgcgaggagcccatgtcctatgactcagacctgggcacagcaaatgctgaggactcagaccagtctctgcaagatataaagattttcagctgggcgcagtggctcacgcctgtaatcccagcactttgggaggccgaggcaggcggatcacaaagtcaagagatcgagacctttctggctaacacggtgaaacctcatctctactaaaaatacaaaaaattagccgggcgtggtggcgggcgcctgaagtcccagctactcaggaggctgaggcaggagaatggtgtggacccgggaggcggagcttgcagtgagctgagattgtgccactacactccagcctgggtgacagagtgagactctgtcccaaaaaaaaaaacaagatttttaaaatgtcttccttatttattactttctctcctacaaaggcagtatatacacactgttctatatcttgttttggagaagatcttttcatatcagagcttcttcattcttttatttttattttttatagagacgggggtctcactgtgttgcccaggctggtcttgaactcctgggctcaagagatcttcctgcctcaggctcccaaattgctggggattacaggcgtgagccactgcgctcagcctcattctttttttttctattgcatattgttctagtgtatcaatgtaccttagtttacttaatcagcccagtatttaatgggtgctggggcctgtgttttcataaataaccttgtgtatgtggtcttttagttctgcgtagctatctctgttccataaactcccag

SEQ ID NO: 8360 - DNA, 991 bp, Homo sapiens
atcgtcggctcggaggctgaggggctgccgcagccgggagcccccctcgcctcgctcctcgctccgcttggtgtcatgtgattctctgagggagcagctgcgtgagtggagatgctttcagtggtggagaatggactggacccccaggctgccatcccgacacatcatctcagagttggagcacctgacgtttgtcaacatggatgtgggccgctgccgggcatggctgcggctggccctgaacaatggcctgatggagtgctacctgaagctgctgctgcaggagcaggcccgcttgcaactacagcggaaggaatctctggattccatttcccattcttcaggctctgaagacatcgaagtccatcactcgggccataagatacggaggaaccagaagccgactgcctcctccctcagcctggacacggccagttcatcccagctgtcctgcagcctaaactctgatagctgcttactccaagagaatggctccaagagtccagaccattgcgaggagcccatgtcctatgactcagacctgggcacagcaaatgctgaggactcagaccagtctctgcaagaaaaaacaagagctggatctcagaggatgacttctaccggccttcccgggagcaacccctgaagagtgcttcagaccacccaatagcttcttacagggggactccagagtcaaggcctggtctccacaggcatttttctcaagaaccaagaaaaaactgctccctgggggcgttagaccaagcgtgtgtaccttccccaggaagaaggcaagcccaggcagccccatcccaggggcataagagtttccaggtggtacaccggaggcagatgggactgtccaacccattccagggtctcatgaagctgggcaccgtggagcggcagggggcaatgggcatctggaaggagctcttctgcgagctctccccactggagttccgcctctacctgagcaacgaggagcaca

SEQ ID NO: 8361 - DNA, 1162 bp, Homo sapiens
gagactttccctgggcctcaggatctcaccctccatcctgtctgccctgcaggatgccgcagctgagcctgtcctggctgggcctcgggcaggtggcagcattcccgtggctgctcctgctgctggctggggcctcccggctcctggccggcttcctggcctggacctatgccttctatgacaactgccgccgccttcagtactttccacaacccccaaaacagaaatggttttggggtcaaccaggacctcatcattgctacagaggaaggcttgaagaacttgacccagatgtcagccacctatccccagggctttaggatatggctgggtcccatcttccccttcatcgttttatgccaccctgacatcgtccggtctatcaccaatgcctcaggcccctgatggtcctcattcatgccagctgctattgcgcccaaggatgatctctccatcaggttcctgaagccctggctgggagaagggatactgctgagtggcggtgacaagtggagccgccaccgtcggatgctgacgcccgccttccatttcaacatcctgaaaccctatataaagatcttcaacaggagtgtgaacatcatgcacgacaagtggcagcacctggcctcagagggcagcagtcgtctggacatgtttgagcacatcagcctcatgaccttggacagtctgcagaaatgcatcttcagctttgacagccattgtcaggagaggcccagtgaatatattgctaccatcttggagctcagtgcccttgtagaaaaaagaaaccagcatatcctccagcacatggactttctgtattacctctcccatgacgggtggcgcttccgcagggcctgccgcctggtgcacgacttcacagatgccgtcatccaggagcggcgccatacccttcccactcagggtattgtgatttcctcaagaacaaagccaagtcctagactttggatttcattgatgtgcttctgctgagcaagggaccaaagacaaggcaaaggagctggggggaagaccttggaatgggggctctggtgatggtgaacaagagagatctagacattcagagtgggtttgagtttctggaagaagatcggaccttcagagattgtctcaggtgagactcgggagtctcagagatagt

SEQ ID NO: 8362 - DNA, 4262 bp, Homo sapiens
gtcgcgtccgcacttctcctgcccgagagagactgagccgcgctggcagctcgcgtcgagtcggtctgccctagccgcatcccgcggcgcccggtcgggctccgggcaccaggcaacacctaggccgttcccttcagacagccccgggccagcggccccctcgggaaatgtccagcggccgcagaaggggcagcgccccctggcacagcttctcccggttcttcgctccccgaagtccttcccgggacaaggaagaggaagaggaggagaggccggggacgagcccgcctccagctccaggccggtccgctgccagtgttgaaaatgagcccatgagcacaagtcagaaaaaggaaaatgtactttcatcagaagcagtaaagattcgccaaagtgaggacaaaaggaaccatgctgagaagccagtcactcttccagtgcaggaagatcccaaaaaggcatatgatctttccagttccacttcagataccaaaataggagaaagtgacagacagccaaaagaaagcttttttcagtttcttggtaacttattcaatatctcggggaaatcatctctaggtgaagctaagcagtcttctttcaaagatgaccaggataaaactgagaaggatttacaaaatcccagtgaccatcatgaagacgggatcaaaagggagagagagattttcagtggctccctaagaacccagacacatccaacagaagaacaagactctaactcatccgaactctcagatgctttttctttggatacaacacaagacagtgaccaagaaaccactaatttgctaaaacaaatcgatggtaaaccagagaagccttcagtaacatatgcaacatatcgaggcccaagacacattgggaaatatttaaagcaacagacaggcttggcaactgtgaataccttggacagagaaaatgaaagttctgactctagtacaaacagacacattgaccctggaagtgagattgaggctggggtactgccactgttgttatcagctagtacagactcatctatgaaaggaaatctacttgaaggcccattagaagactctgattgtagcaaaacaagtttcaacaaggaaaattctttgacaaataacccagaactgcagaatattgcctcttccaataatcttttaaataaaaatgcttgggggagtattgagagaaataggtcatccccttcttctgtgactaactccagctacgatggagaatctgactcacagcaccatttaagttgtgaaccggtttctcagactaacagaaatttggtatgttcagcattgttaacaggaagtaaccatcgcaaagtcccttgcagcccagattttcagagagtaactacaacagaaaatacgataaaagaaaacagcactgtgatgagtaataggacattggtgcaaagagaggagcttgttgagcctcagggccctgctatttctgatttctcttgtagtaaatctgatgggagtgacactactgagcaggaaagtacaaatttgccaagtccaaataaatcaattaggcatgaacatctgcagttgccagagagtgagtgttctgacaagcaaaccatagatagctcatcaaagcaagctgccactcacaccaatatcattgctcttcagagacatgctgtgacagacacagaatttgtaaatgaaggaaagagattgtctgcccaagactcacagaaaaatgtggctgttagagaaatcaggcgagaaacagaaagtgcctcagctggtgaatccatagcttcaagtcatgtaaaagctccagaagataaaattgagtcattacccaaagatactgaccaatactttgaaaccaaagccaaaaagcttgattttaggtcacatgataaaattcctcatattagaatgaataaaaaagacctggcctctttaaattacatcagtgaatcagcagttgtagcaagcttaggaaatgaaaatgcacctgagttgaaatttgaacttaatagaagtcacatttcagaaactcctcttgactctgagagtcctcaacaagctgaagtatcacctgatgctaaaacatctcttagccttgactgtaaaaaactaaatttcagtatttcacctcctacctttgtttctggagttgggatgctgagcaagttggatattcctgatttaatgaatgagggttctcctgtgcccattgaaactgggaatgtcaacattgttggtatttcctatcagcctaggaagtgtaaagaagaaaatgtgaaaaaccatgttgaggctgcaggcaggaagagtcctcctccttccttttgccttgaatatacatctgcaatttttgaattcaaagaagttctttctaatagtgaaaaatgccaggttcttccaggttctgaagccagtggccctcacttaactgggttggagctattgagctttgactctggaaacctctctaaggattgcagttccattttatctcaagaccctaatagagtagagttagtgtcttcaaacactaaagcaaatatgagcataatagagaagtctgattctctttccttggaagccaaaactgctaacattgtatcaaaagctgaaattgatggtcagaacaatgttcttgtggagtcacattctggaagaggaaaaactatatccttgtccaaggtatctctttcaaaagtggagcccagaaacatttctcaggataaaatgtcttcttttccattgaaaattacccatgttccagaaaagcctattttgtcagaattaacctttctagaagttgaacagggcaaacgttttcaatcaattaatcataatgagataggagagaaatgttcagatgctggccttaaagagaattgccaagctgagctttctcctgctgcctccaaatatgaagataagccagaaccagaggtagatgccttaggctctcctcctgctcttcttaaaagtaatatatcttggattttaccacctattcatgatgaaaaaatcagtaggcaaatggcgcagaattgtgaagctcacacttgtgtgtttcatcaatctttggatatttgtgggactaaaaagatttctggtcactcagaaatggcggaactcagcttaactaatatttcccctaaattccaagaaactggcagcatgaaagtaaattcaccttttctggattctgattccagtttggaaaaaaattcttctgcatctgaggactcaagcttccttaaagtaccttctgtgctgaaattggaaaagaaatcctcatcttacagaaagaaagagaacatccattttttaaatggtggtattgatagtgtgtcatcttcctctagttaccctgaagaagttagcatgatagtaaattcacataagccccaaaataatttggattctatacaagttaccaaagatctcacacatgaaggtacctctgtaactaacctgttgtaccctactacctcttatttggaatttgaaacgtctgtctcaattgggacagaagtaaccccatttcaggaacattttgggatttatactgggaagatatccattgatttcccaactgctgcccaatttgacaatctcgtggaagcagagactggagcagttgctgggcctgcagcgtcagttaacagctcaggccaacagtgttctgaagcctctgctgagcacatagaagccaggagaagagcacatgaccaacttttggacctcaaaagtagtttactcaaaaaggccgatacattgattggtgagatttttaattctgtcagggaagaactaaaattcaaacacacagtgagtacctgccaggagcatatagccatagaaggtataatgaatctgggtaccctgaaagaagacatctctgagaaaaacccatcagaagtgacactaacagaaatacaacagacagagggtttggaagagcaaggcatggaaaacatgtcagaagtcaaagagaagccctgtgtttcaccaacagttggtgagaagaatcttcttgttgatcctaatagtatgaatgtatcttgtttgttagaagataaagctagggaattagtcaatgagattatttatgtagcccaagaaaaattgagaaatgatacttttgaagatactgaggatacttgggattctgaacttcaggctaatacttcaaaaattctgaacagtgatagtgttaagccacatgatgtagttagagagttcttggtttcagaacagccagta

SEQ ID NO: 8363 - DNA, 1596 bp, Homo sapiens
atcagcggcagaagggcagcaatggccacacaccgaagcaccttggcgggctattccccttgcagctctcctcagcgcgctgctcccactcgcaatcaaaaggcggaaaaagcgcgaaaccgccaggcatctcccatacccacccggctgccgcgcaacccctccttggcttccactgggagacaggggacgccgatgagcaggaagaagcagggcagtgactgcttagtttatcctggtcacccgccaggtttgtggcctgtgatctcttgtcaccttggtctctcagctttgtcttctgaaatctggacttccaattgtctttgtcttgctgcccttccttgcgacactggcctggaatccctcacggtagtctgctggagtggaatttaggacgcatctcagttgtcaccatctttaattgcatgatgtctagttccttgcaaaccattatttcatgtatttcgctcttttttgtttgttttgttttgttttgttttcaggctaggggaaaatccagtccctgttactccattttggccagaaattcaaggtaatgacttttaatgttcctgactactagttctatcatctctctcacttctggatctgtctctattcactgatgtttctagtcattgtgggtcatattttttccacgttttaaatacttcctgatttttgactagatatcaagctttgttaatttcacaactttgggtgccaaaaatttttacattcctatcaatattcttgagctttgttccagtacgttgttattttacatggaaaccatttcatactttcaaagcttgcatttatttgttaggtgggaccagaacaagggctaatgttgtcccactatggaagcaatactttctgagtagtctccctgatacttcatgaattatgaagttttctagtcggattttggggaactgaaaccattttctgtcctgtatgagcctcagaaattgttacatctgctcctttccgatagttcttttcctgttccttttcaacagtttcattatactcatgcattgaccaagctgaaatctcaagggttgcccactgcacatctctgatcctctgtgctcctgtggcgctcttcatcctagtactctgccatacaggctccagtcatcttggcctcccacaactcccagcttgtcttctcaactcagggaaactgccaggttctgcctgtttcccctccctgagatatgccttggaaatgccatacagtaagctagatagccataggggttaccgcatatgattttcttctcagatatcagagatgagatcccacacagcctgatgtccagtgtttgaaagtggttatttcatagatcttgtttttttgtttttttagacatttaaggtggcagaataaattcaatccttggttctccattttttccactagtagaagttagttatattgtctttgaactcatcatgaattccatgaagactgaagggaacaagtcatttagtgctacagaggatgaccagagggctagacctgaagtttcaaaggcatatctacttttttacaactcctcactggagagatagtctaaccgtggt

SEQ ID NO: 8364 - DNA, 1799 bp, Homo sapiens
aattggatatgggtattgtagctgaaacgtcttgcgagctgagtcagggtcggggaagctgtgatggcaatgagaagtcaacacactgaggatggagagaaagaagatgagtctgggagagaaagagaatgattcttctggccgagggaaagcaagaatatctgttcctgcaactgcactgattctagaaacactctctattcgaactctcatgaggtgctgacctgcttggtgaatgctgggatctctggaagagggaggcagacatcacacaccagctggcaagtgggagctggcatgcaacatgccccaataccactcccctcctgccatccctatctcctaatggtgcctccttttggccaaacccacctttggctggagggcaacagagcccattgacgtggtccccttgcatctgctacctggggagaaaagcaggatggacactgaatctagagaaatgaagaaacccatccagaagaatactgcttctttatgtttttgtaggtgtacaaatcaggcctccccatgatattctaaactccttgaggaaagaagtggagtcctgggcttctgatgtagcctccacagtgctcaggggatagcgacactggcaccctatagatatttaattacatgtggactggaagagaccaaacagcttcctggtatttcaatcaaacccggtgctctagacctgtggctcactctgagcaaactataatgagttgaacttgaatctgattcctgctaagaaaggtttcattttaataggcagtaaggctatgagctaacaccagaattcattcgagttactagactcactgaaactcctcacaggatccatctttcatgttttctagattttggtattcttatctaaactgcagacccagaaaccctatggaccctacctttccaattatatttctgggaagagtcattctctgcagagctgaagcatgtaacagaaagttctcaacctgaaaaatataccttctgcgcccaagccccactttctgccactatttggtaatctcaagtgggtgaggtggtctctgaacttcagcgctctcatggtcagagccacaaggggttactgggaggctaaagggaagtggcaaacgtggctgagattcagaaagaaaagcagcaagtgtagagaggcaaggacttttccatcttttaaattccttaaaggaagccaaagttcattttccagtctccttcagatgcctctccaatccttcacagcagcgcacacataccgcagaaggaactcaccatcacaaaaagatgacagagcactgggggctggggtgccacttgtgttggctgagagcctggatgcatgtgaggtcaagcctgaccttgggaaagctgctctctggacattacttgctgtgccacatacacagcttgggtttctgaggaaacaacacaggctctaaggaggaactggaacggggcccagggtatatcttttacagcccgtacttttgaggaaaatagaagacaaaaggtttttaaaaaacacaaagtgtatacacgtatacacaaagtttacaagtttgtgtgttttaacatctactctccttaagaacaagtagacaggaaagatattacctgatatgggttaaattgtgtccccaaaaacatgttttgaagtgctaacctttggtacctgtggatatgaccttacttggaaataggtttttgcagacgtaaccaagttaagatgaggtcatatttgattaggctgaaccctgaatccagtatgactggggtccttatat

SEQ ID NO: 8365 - DNA, 1187 bp, Homo sapiens
gcttccggtgctaggtggagggaaggaaggagggagccggggagtgggccagggcagcaagagccttgcctcccctgcctcccctcctttttcctgtccacctatatgaccaatccctaattgctgtcctgatgatgagtcattccaatttactggatttaaaacaaaaagttgttacggtttcatggggtggcccctctctctctcaccctctgggtttcgggaggtcgagtggggtattctctttgtttggcagtggttgctgtcctcttggcatctgagtcctttccctgtccccacaagcccttctactccctgtttgcctttcctttgccaccctctccctgttttacatggaaattgcacgggcctctctgtgtttgcgtgcatgtgtgcgcctgtatatacatgtatagagagatatatttgtgggggccggggggagcggggagggggtggagtgaagctcagggcttgcagccaggacactgcccactggagcctgtcatctgccccttccgtgttggtgagattaagggaagaaggtgggagggcattagtcaagccggactgccccagtctttgactggttaccctcctctctgcaggtaggtttttctggatgataggacagatgatggattcttcaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtc

SEQ ID NO: 8366 - DNA, 1174 bp, Homo sapiens
acactacttggggcccctcttctttccagcccttctcctgtgtgcctgcctcctgccgccgccaccatgaccacctccatccgccagttcacctcctccagctccatcaagggctcctctggcctggggggcggctcgtcccgcacctcctgccagctgtctggcggcctgggtgccggctcctgcaggccgggatctgctggtggcctgggcagcgccctcgggggtagcagctactccagctgctacagctttggctctggcggtggctatggcagcagcagctttgagggcgttgatgggctgctggtcggaggtgagaaggccaccatgcagaacctcaatgaccgcctggcctcctacctggacaaggtgcgtgccctggaggaggccgacactgagctggaggtaaagatccgtgactggtaccagaggcaggccccggggcccgcccgtgactacagccagtactacaggataatcgaggagctgcagaacaagccaccgtggacaatgccaacatcctgctacagaatgacaatgcccatctggctgctgctgacttccgcaccaaagtcctggcaaaatgaaggcaggtgagcagccaggacctggacctgcaattccaagcagcctgggctgaagtccctgattcccatggcaggtttgagacagagcaggccctgtgcctgagtgtggaggccgacatcaatggcccgtgcagggtgctggatgagctgaccctggccagagccgacccggagatgcacattgagaacctcaaggaggagctggcctacctgaagaagaaccacgaggagatgaacgccccgcgaggccaggtgggcggtgagatcaatgtggagatgggcgctgccccaggtgtggacctgagccgcatcctgaacgagatgcgtgagcagtatgagaagatggcagagaagaaccgcaaggatgccgaggattggttcttcagcaagacagaggagctgaaccgcgaggtggctaccaacagtgagctggtccagagcggcaagagcgagatttcggagctccggtgcaccatgcaggccttggagatcgagctgcagtcccagctcagcatgaaagcatccctggagggcaacctggcggagacagagaaccgctactgcatgcagctgtcccagatcca

SEQ ID NO: 8367 - DNA, 1103 bp, Homo sapiens
cgcggctccagggccacgttccagggtcgggtttggtggattcctcagtccctgccgccgcggggcgccctgggatagcggcggggcctcctgaacagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatgga

SEQ ID NO: 8368 - DNA, 4073 bp, Homo sapiens
gccagctgctgcgcatgcgccggccggggccccgcccccatgcgccgcgcggctccagggccacgttccagggtcgggtttggtggattcctcagtccctgccgccgcggggcgccctgggatagcggcggggcctcctggtgagcgcgcgccggggcggcctccgggaagtgggagacgctgcgggtcctgggcccaggccttgggatgggcgggaaggcctggccgcgccgggctgtgggcactgcaggaggcccctgtgcaggtggagatcgccgcggccctggcgggactccttgctggctcttgggcgcgctgatgcccatcatctccctgagtttctgagccctatctctcatgtgtcagtggtcaccgccgaatccagacactccggccctgttccggaagagccctgatatccgtggctccatggcgctgtctgtcgataccatgcactctagctctcaaggaggaaaggttttgtggaagggaatagagacttggaataacagacctgtgctaattagagacaggaaagatggaacaaggggagtgacccttctccacccccatatcctaatgtgctctctctctatccagaacagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatggagagcctgatgcagaggttgtggtaggaaccacaaggccagagacgctgcctggagatgtggctgtggccgttcatccagacgactcgcgatacacacatctacacgggcgacagcttcgtcaccccttgatggggcagcctcttcccctcatcacagactatgctgttcagccacatgtgggcacgggggcagtgaaggtgactccagctcacagtcctgccgatgctgagatgggggcccgacatggcttgagccccttgaatgtcattgcggaggatgggaccatgacctctctctgcggggactggctgcagggtcttcaccggtttgtggcccgggaaaagataatgtctgtgctgagtgaacggggcctgttccggggcctccagaaccaccccatggtactgcccatctgcagccgttctggggatgtgatagaatacctgctgaagaaccagtggtttgtccgctgccaggaaatgggggcccgagctgccaaggctgtggagtcgggggccctggagctcagtccctccttccaccagaagaactggcagcactggttttcccatattggggactggtgtgtctcccggcagctgtggtggggccatcagattccagcctacctggttgtagaggaccatgcgcagggagaagaggactgttgggtggtcgggcggtcagaggctgaggccagagaggtagcagcggaactgacagggaggccaggggcagagctgaccctggagagggatcctgatgtcctagacacatggttttcttctgccctgttccccttttctgccctgggctggccccaagagaccccagaccttgctcgtttctaccccctgtcacttttggaaacgggcagcgaccttctgctgttctgggtgggccgcatggtcatgttggggacccagctcacagggcagctgcccttcagcaaggtgcttcttcatcccatggttcgggacaggcagggccggaagatgagcaagtccctggggaatgtgctggacccaagagacatcatcagtggggtggagatgcaggtgctgcaggaaaagctgagaagcggaaatttggaccctgcagagctggccattgtggctgcagcacagaaaaaggactttcctcacgggatccctgagtgtgggacagatgccctgagattcacactctgctcccatggagttcaggcgggcgacttgcacctgtcagtctctgaggtccagagctgccgacatttctgcaacaagatctggaatgctcttcgctttatcctcaatgctttaggggagaaatttgtgccacagcctgctgaggagctgtctccctcctccccgatggatgcctggatcctgagccgccttgccctggctgcccaggagtgtgagcggggcttcctcacccgagagctctcgctcgtcactcatgccctgcaccacttctggcttcacaacctctgtgacgtctacctggaggctgtgaagcccgtgctgtggcactcgccccgccccctggggccccctcaggtcctgttctcctgcgctgacctcggcctccgcctcctggccccactgatgcccttcctggctgaagagctctggcagaggctgccccccaggcctggttgcccccctgcccccagcatctcggttgccccctaccccagcgcctgcagcttggagcactggcgccagccagagctggagcggcgcttctcccgggtccaagaggtcgtgcaggtgctaagggctctccaagccacgtaccagctcaccaaagcccggccccgagtgctgctgcagagctcagagcctggggaccagggcctcttcgaggccttcttggagcccctgggcaccctgggctactgtggggctgtgggcctgttacccccaggcgcagcagctccctccggctgggcccaggctccactcagtgacacggctcaagtctacatggagctgcagggcctggtggacccgcagatccagctacctctgttagccgcccgaaggtacaagttgcagaagcagcttgatagcctcacagccaggaccccatcagaaggggaggcagggactcagaggcaacaaaagctttcttccctccagctggaattgtcaaaactggacaaggcagcctctcacctccggcagctgatggatgagcctccagccccagggagcccggagctctaactcatcatccccatcagttttcctccctctcagacctgtctttgaggacaaacagatttgtcagctgtcagggtgcagtgggacgtcagagactatgtggtccatcgccttcattgtgtaaatgaggacacagactggcttggtcgcagtgactgtggtgtccttgagatgctcacattactgcccggcctgcctcccacctggaagtctgggaatgaggagattgagataaacttttgaaatcccaaa

SEQ ID NO: 8369 - DNA, 460 bp, Homo sapiens
acgctgcgggtcctgggcccaggccttgggatgggcgggaaggcctggccgcgccgggctgtgggcactgcaggaggcccctgtgcagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccg

SEQ ID NO: 8370 - DNA, 3377 bp, Homo sapiens
gccagctgctgcgcatgcgccggccggggccccgcccccatgcgccgcgcggctccagggccacgttccagggtcgggtttggtggattcctcagtccctgccgccgcggggcgccctgggatagcggcggggcctcctgtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatggagagcctgatgcagaggttgtggtaggaaccacaaggccagagacgctgcctggagatgtggctgtggccgttcatccagacgactcgcgatacacacatctacacgggcgacagcttcgtcaccccttgatggggcagcctcttcccctcatcacagactatgctgttcagccacatgtgggcacgggggcagtgaaggtgactccagctcacagtcctgccgatgctgagatgggggcccgacatggcttgagccccttgaatgtcattgcggaggatgggaccatgacctccctctgcggggactggttgcagggtcttcaccggtttgtggcccgggaaaagataatgtctgtgctgagtgaacggggcctattccggggcctccagaaccaccccatggtactgcccatctgcagccgttctggggatgtgatagaatacctgctgaagaaccagtggtttgtccgctgccaggaaatgggggcccgagctgccaaggctgtggagtcgggggccctggagctcagtccctccttccaccagaagaactggcagcactggttttcccatattggggactggtgtgtctcccggcagctgtggtggggccatcagattccagcctacctggttgtagaggaccatgcgcagggagaagaggactgttgggtggttgggcggtcagaggctgaggccagagaggtagcagcggaactgacagggaggccaggggcagagctgaccctggagagggatcctgatgtcctagacacatggttttcttctgccctgttccccttttctgccctgggctggccccaagagaccccagaccttgctcgtttctaccccctgtcacttttggaaacgggcagcgaccttctgctgttctgggtgggccgcatggtcatgttggggacccagctcacagggcagctgcccttcagcaaggtgcttcttcatcccatggttcgggacaggcagggccggaagatgagcaagtccctggggaatgtgctggacccaagagacatcatcagtggggtggagatgcagttgctgcaggaaaagctgagaagcggaaatttggaccctgcagagctggccattgtggctgcagcacagaaaaaggactttcctcacgggatccctgagtgtgggacagatgccctgagattcacactctgctcccatggagttcaggcgggcgacttgcacctgtcagtctctgaggtccagagctgccgacatttctgcaacaagatctggaatgctcttcgctttatcctcaatgctttaggggagaaatttgtgccacagcctgctgaggagctgtctccctcctccccgatggatgcctggatcctgagccgccttgccctggctgcccaggagtgtgagcggggcttcctcacccgagagctctcgctcgtcactcatgccctgcaccacttctggcttcacaacctctgtgacgtctacctggaggctgtgaagcccgtgctgtggcactcgccccgccccctggggccccctcaggtcctgttctcctgcgctgacctcggcctccgcctcctggccccactgatgcccttcctggctgaagagctctggcagaggctgccccccaggcctggttgcccccctgcccccagcatctcggttgccccctaccctagcgcctgcagcttggagcactggcgccagccagagctggagcggcgcttctcccgggtccaagaggtcgtgcaggtgctaagggctctccgagccacgtaccagctcaccaaagcccggccccgagtgctgctgcagagctcagagcctggggaccagggcctcttcgaggccttcttggagcccctgggcaccctgggctactgtggggctgtgggcctgttacccccaggcacagcagctccctccggctgggcccaggctccactcagtgacacggctcaagtctacatggagctgcagggcctggtggacccgcagatccagctacctctgttagccgcccgaaggtacaagttgcagaagcagcttgatagcctcacagccaggaccccatcagaaggggaggcagggactcagaggcaacaaaagctttcttccctccagctggaattgtcaaaactggacaaggcagcctctcacctccggcagctgatggatgagcctccagccccagggagcccggagctctaactcatcatccccatcagttttcctccctctcagacctgtctttgaggacaaacagatttgtcagctgtcagggtgcagtgggacgtcagagactatgtggtccatcgccttcattgtgtaaatgaggacacagactggcttggtcgcagtgactgtggtgtccttgagatgctcacattactgcccggcctgcctcccacctggaagtctgggaatgaggagattgagataaacttttgaaatccc

SEQ ID NO: 8371 - DNA, 3609 bp, Homo sapiens
ggcggggcctcctggtgagcgcgcgccggggcggcctccgggaagtgggagacgctgcgggtcctgggcccaggccttgggatgggcgggaaggcctggccgcgccgggctgtgggcactgcaggaggcccctgtgcagaacagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatggagagcctgatgcagaggttgtggtaggaaccacaaggccagagacgctgcctggagatgtggctgtggccgttcatccagacgactcgcgatacacacatctacacgggcgacagcttcgtcaccccttgatggggcagcctcttcccctcatcacagactatgctgttcagccacatgtgggcacgggggcagtgaaggtgactccagctcacagtcctgccgatgctgagatgggggcccgacatggcttgagccccttgaatgtcattgcggaggatgggaccatgacctctctctgcggggactggctgcagggtcttcaccggtttgtggcccgggaaaagataatgtctgtgctgagtgaacggggcctgttccggggcctccagaaccaccccatggtactgcccatctgcagccgttctggggatgtgatagaatacctgctgaagaaccagtggtttgtccgctgccaggaaatgggggcccgagctgccaaggctgtggagtcgggggccctggagctcagtccctccttccaccagaagaactggcagcactggttttcccatattggggactggtgtgtctcccggcagctgtggtggggccatcagattccagcctacctggttgtagaggaccatgcgcagggagaagaggactgttgggtggtcgggcggtcagaggctgaggccagagaggtagcagcggaactgacagggaggccaggggcagagctgaccctggagagggatcctgatgtcctagacacatggttttcttctgccctgttccccttttctgccctgggctggccccaagagaccccagaccttgctcgtttctaccccctgtcacttttggaaacgggcagcgaccttctgctgttctgggtgggccgcatggtcatgttggggacccagctcacagggcagctgcccttcagcaaggtgcttcttcatcccatggttcgggacaggcagggccggaagatgagcaagtccctggggaatgtgctggacccaagagacatcatcagtggggtggagatgcaggtgctgcaggaaaagctgagaagcggaaatttggaccctgcagagctggccattgtggctgcagcacagaaaaaggactttcctcacgggatccctgagtgtgggacagatgccctgagattcacactctgctcccatggagttcaggcgggcgacttgcacctgtcagtctctgaggtccagagctgccgacatttctgcaacaagatctggaatgctcttcgctttatcctcaatgctttaggggagaaatttgtgccacagcctgctgaggagctgtctccctcctccccgatggatgcctggatcctgagccgccttgccctggctgcccaggagtgtgagcggggcttcctcacccgagagctctcgctcgtcactcatgccctgcaccacttctggcttcacaacctctgtgacgtctacctggaggctgtgaagcccgtgctgtggcactcgccccgccccctggggccccctcaggtcctgttctcctgcgctgacctcggcctccgcctcctggccccactgatgcccttcctggctgaagagctctggcagaggctgccccccaggcctggttgcccccctgcccccagcatctcggttgccccctaccccagcgcctgcagcttggagcactggcgccagccagagctggagcggcgcttctcccgggtccaagaggtcgtgcaggtgctaagggctctccaagccacgtaccagctcaccaaagcccggccccgagtgctgctgcagagctcagagcctggggaccagggcctcttcgaggccttcttggagcccctgggcaccctgggctactgtggggctgtgggcctgttacccccaggcgcagcagctccctccggctgggcccaggctccactcagtgacacggctcaagtctacatggagctgcagggcctggtggacccgcagatccagctacctctgttagccgcccgaaggtacaagttgcagaagcagcttgatagcctcacagccaggaccccatcagaaggggaggcagggactcagaggcaacaaaagctttcttccctccagctggaattgtcaaaactggacaaggcagcctctcacctccggcagctgatggatgagcctccagccccagggagcccggagctctaactcatcatccccatcagttttcctccctctcagacctgtctttgaggacaaacagatttgtcagctgtcagggtgcagtgggacgtcagagactatgtggtccatcgccttcattgtgtaaatgaggacacagactggcttggtcgcagtgactgtggtgtccttgagatgctcacattactgcccggcctgcctcccacctggaagtctgggaatgaggagattgagataaacttttgaaatccc

SEQ ID NO: 8372 - DNA, 3377 bp, Homo sapiens
gccagctgctgcgcatgcgccggccggggccccgcccccatgcgccgcgcggctccagggccacgttccagggtcgggtttggtggattcctcagtccctgccgccgcggggcgccctgggatagcggcggggcctcctgtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatggagagcctgatgcagaggttgtggtaggaaccacaaggccagagacgctgcctggagatgtggctgtggccgttcatccagacgactcgcgatacacacatctacacgggcgacagcttcgtcaccccttgatggggcagcctcttcccctcatcacagactatgctgttcagccacatgtgggcacgggggcagtgaaggtgactccagctcacagtcctgccgatgctgagatgggggcccgacatggcttgagccccttgaatgtcattgcggaggatgggaccatgacctctctctgcggggactggctgcagggtcttcaccggtttgtggcccgggaaaagataatgtctgtgctgagtgaacggggcctgttccggggcctccagaaccaccccatggtactgcccatctgcagccgttctggggatgtgatagaatacctgctgaagaaccagtggtttgtccgctgccaggaaatgggggcccgagctgccaaggctgtggagtcgggggccctggagctcagtccctccttccaccagaagaactggcagcactggttttcccatattggggactggtgtgtctcccggcagctgtggtggggccatcagattccagcctacctggttgtagaggaccatgcgcagggagaagaggactgttgggtggtcgggcggtcagaggctgaggccagagaggtagcagcggaactgacagggaggccaggggcagagctgaccctggagagggatcctgatgtcctagacacatggttttcttctgccctgttccccttttctgccctgggctggccccaagagaccccagaccttgctcgtttctaccccctgtcacttttggaaacgggcagcgaccttctgctgttctgggtgggccgcatggtcatgttggggacccagctcacagggcagctgcccttcagcaaggtgcttcttcatcccatggttcgggacaggcagggccggaagatgagcaagtccctggggaatgtgctggacccaagagacatcatcagtggggtggagatgcaggtgctgcaggaaaagctgagaagcggaaatttggaccctgcagagctggccattgtggctgcagcacagaaaaaggactttcctcacgggatccctgagtgtgggacagatgccctgagattcacactctgctcccatggagttcaggcgggcgacttgcacctgtcagtctctgaggtccagagctgccgacatttctgcaacaagatctggaatgctcttcgctttatcctcaatgctttaggggagaaatttgtgccacagcctgctgaggagctgtctccctcctccccgatggatgcctggatcctgagccgccttgccctggctgcccaggagtgtgagcggggcttcctcacccgagagctctcgctcgtcactcatgccctgcaccacttctggcttcacaacctctgtgacgtctacctggaggctgtgaagcccgtgctgtggcactcgccccgccccctggggccccctcaggtcctgttctcctgcgctgacctcggcctccgcctcctggccccactgatgcccttcctggctgaagagctctggcagaggctgccccccaggcctggttgcccccctgcccccagcatctcggttgccccctaccccagcgcctgcagcttggagcactggcgccagccagagctggagcggcgcttctcccgggtccaagaggtcgtgcaggtgctaagggctctccaagccacgtaccagctcaccaaagcccggccccgagtgctgctgcagagctcagagcctggggaccagggcctcttcgaggccttcttggagcccctgggcaccctgggctactgtggggctgtgggcctgttacccccaggcgcagcagctccctccggctgggcccaggctccactcagtgacacggctcaagtctacatggagctgcagggcctggtggacccgcagatccagctacctctgttagccgcccgaaggtacaagttgcagaagcagcttgatagcctcacagccaggaccccatcagaaggggaggcagggactcagaggcaacaaaagctttcttccctccagctggaattgtcaaaactggacaaggcagcctctcacctccggcagctgatggatgagcctccagccccagggagcccggagctctaactcatcatccccatcagttttcctccctctcagacctgtctttgaggacaaacagatttgtcagctgtcagggtgcagtgggacgtcagagactatgtggtccatcgccttcattgtgtaaatgaggacacagactggcttggtcgcagtgactgtggtgtccttgagatgctcacattactgcccggcctgcctcccacctggaagtctgggaatgaggagattgagataaacttttgaaatccc

SEQ ID NO: 8373 - DNA, 1029 bp, Homo sapiens
gttccagggtcgggtttggtggattcctcagtccctgccgccgcggggcgccctgggatagcggcggggcctcctgaacagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctg

SEQ ID NO: 8374 - DNA, 639 bp, Homo sapiens
atgcccaccacctgccactgtgtggccatcacaccacctgactccgggggcagccctagcagccctgctggagggtcccccagccccgcccctgctgccggggcggctgaactctcacctgccacgcccacaggcagcgccaaccccaccaccagctcctgtgcagggggcacacccgcggcctcactgcttcgatgggtccgctcgtgcttcctcaggctcgacgacaccacaaaggatttcccacatgcgttacagtggaaggggcgctcccccgagtgcacccggctatgcttcgtgaggctggcacgctcggcgaaggctcgcccgcactcctcacagcggaagggccgctggccagagtgcaccagcgcgtgccgcttgaggtcccaggacgccacgaacgtcttgtcacattgcaggcacttgaacggccggtcgcctgtgtgcacacgccggtgcatggccaggtccgccggctgccggaagtccttgccgcacttctcgcagtggtatggcttcaccccttcatgggcgcgctggtggcgacggaagctcgaggggtcggagaacatgcggccgcagcgcgggcacaggaagggcttctcccccgagtgcgtgcgctcgtggctctggtag

SEQ ID NO: 8375 - DNA, 3779 bp, Homo sapiens
gatttagcagagagaggaggcagaggctgggaatgggagcagtaagctgtcggcaggggcagcacacccagcagggggaacacacccgggtggctgtccctcacaagcagggtggcaacatccggggtccctgggcccgaggctggaagagcctctggacaggtttgggaaccatcaggtcagatctggaagaactctgggaactacgggggcaccactatctgcaccaggaatccctaaagccagccccagtactggtagagaagcctctgccagagtggccagtgcctcagttcatcaacctctttctaccagagtttcccattaggcccattagggggcagcagcagctgaagattttaggcctcgtggctaaaggctcctttggaactgtcctcaaggtgctagattgcacccagaaagctgtatttgcagtgaaggtggtgcccaaggtaaaggtcctacagagggataccgtgaggcagtgcaaagaggaggttagcatccagcgacagatcaaccatccctttgtacacagcttgggggacagctggcagggaaaacggcaccttttcattatgtgtagctactgcagcacagatctgtactccctttggtcggctgttggctgctttcctgaggcttccatccgtctctttgctgccgagttggtgctggtactgtgttatctccatgacttgggcatcatgcatcgagatgtgaagatggagaatattcttctagatgaacgaggccatctgaaactgacagactttggtctgtcccgccacgtgccccagggagctcaagcctacactatctgtggcactcttcagtacatggccccagaggtcctaagtggaggaccttacaaccatgctgctgattggtggtccctgggtgtcttgcttttctctctggcgactggaaagtttccagtggctgcagagagagatcatgtggccatgttggcaagtgtgacccacagtgactctgagatcccagcttctcttaaccagggcctctcactcctgctccatgagctcttatgccagaaccccctccatcgtctacgttatctgcatcacttccaggtccaccctttctttcggggtgtggccttcgacccagagctcctacagaagcagccagtgaactttgtcacggagacacaagctacccagcccagttcagcggagaccatgccctttgacgactttgactgtgatctggagtccttcttgctctaccctatccctgcttgagcctctctactgtaaattggggcccggctgggagcctgaagatctccatccctgcctactcagtatgaccaccttgataatccagtttgtttttattttgtagcctcttaccgttctgctctcctaggctttagaccagagttccaacctggacattctgctactggcagccacagctggccctattccttccctatcatacaacctacctctcaattcaacatgtcagatcagggtggtgaccttttccttttctttacttctccagtgctctttaccctcaggctgtcagccagagctgcttctgcttgtttctctgccatgtttcctttcttgagcaataataatacttcatgggctcccagggtgctattgatgtgtttaataggcttgtcagaagcaatatgaattttttttttttttttgagacagagtctcactctgttgcccaggctggagtgcagtggtgcgttctcagctcactgcaacctccgtctcctgggttgaagtgattttcatgcctcagcctcccgagtagctgggattacaaatgcacaccattatgcccagctaatttttgtattttttagtagagacagggttcaccatgttggccaggctgatctcaaactcctgacctcaagtgatcggcctgccttggcctcccaaagtgctggaattacaggtaggtgtgagccactgcaccagaccctttttttttttttttttttttttttttgagatagggtctcactctcgtcacccaggttggagtgcagtggcacgatctcagctcactgcaaccttcacaggcatgagcctccacacccagcctgtgaatttttcaaaagtctcaaaagctggcatttcaacccctaaataatgcagctaaaaaatatagtctgggagcttgaggccagtctgcaataaatctaatttttaaaaattgaaaagtgaataaaataatctagtgaggaagaaaatagaaactgaaacatgggtgggttaaatgtcttctctaggtctataattgcaacagttatccaaaataaaacctctttgaaaagcataggatttttaaactgacaatttctcctagtgagcccatgattcagtttctgatgggcaaaccaagagattaagaggcatgcatcaaccttaagatttaaggttatttgggaggccaaggtgggcagatcagttgaggtcaagagttcgagaccagcgtggccaacatggtgaaaccttgtgtctactaaaaaaatacaaaaattagctgggtgtggtgttgcacacctgtagtcccagctactcagaaggctgaagcaggagaactgcttgaaccctggaggccaaggttgcagtgagccaagattgtgccattgaactcctgggtgacagaggtagactctgtctcaaaaaaaaaaaaaaaaaaaaaaaaaaaagatttaaggttagagacatatctcaataaccttttcctttagtaaggaaaatcatctggaccttaaatttgtatacagttttggcctttatgacttcttttcatttttcttaaactaatttctcacaattttcatttttgtcctgagacttgaagggaaagtaagttttaatctagaccatattatttagttacatctaatctctctagacaaaagacagtctggagagtactctttagttctatttattaattttgtctctagattgagccagatttccccatgcatagctggcattttattggcctctgcagaattgctttttctggattggactttggtaatccatatgaaaatctctatgaaatttaattgctcgccaggtgtggtggctcacacttgtaatcccagcactttgggaggctgaggtgggcggatcaccagaggtcaggagttcgagaccagcctggccaacatggtgaaaccccgtttctccccaaaaaatacaaaaattagctggtcatgagggcacacactgtagtcccagctactcaggaggctgagggggaagaattgcttgaacccaggagatggaggttgcaatgagtgaagatcgtgccactgcatccagcctgagcaacagagtgagatcttgtctcaggaaaaaaataaatttaattgctgtggatactgtaaagggtgtttatcgtaacagttcataatattctatttaagaatgcgtgggagaaattttctctggacccagttatgcttttcctgaattgctgtttggtttttaccttaaggacactaaatattcagctgattgtatttttctgtttgtactgatactagaccatttagagcccaatttgtggtctaccttcagcaagtgtttatgtattttgtatgctagtcatgttcttggttctgtcttccttttctacttttattttccttattctcatttttctaagttttaatcgttttatattactataatatctgcatcttgtaagcctttttgtaataaggttgggatataaataaataaggcaatgtatccttt

SEQ ID NO: 8376 - DNA, 1032 bp, Homo sapiens
agagagaggaggcagaggctgggaatgggagcagtaagctgtcggcaggggcagcacacccagcagggggaacacacccgggtggctgtccctcacaagcagggtggcaacatccggggtccctgggcccgaggctggaagagcctctggacaggtttgggaaccatcaggtcagatctggaagaactctgggaactacgggggcaccactatctgcaccaggaatccctaaagccagccccagtactggtagagaagcctctgccagagtggccagtgcctcagttcatcaacctctttctaccagagtttcccattaggcccattagggggcagcagcagctgaagattttaggcctcgtggctaaaggctcctttggaactgtcctcaaggtgctagattgcacccagaaagctgtatttgcagtgaaggtggtgcccaaggtaaaggtcctacaggggataccgtgaggcagtgcaaagaggaggttagcatccaggtatgcacagagtcctggaaaggattgtgggaagagctaggccacagatggcaaaaggaagagatggcactaaaacacatgcaggcagaactgcagcagcaacaagctgtcctggccaaagaggtgcgggacctgaaagagaccttggagtttgcagaccaggagaatcaggttgctcacctggagctgggtcaggttgagtgtcaattgaaaaccacactggaagtgctccgggagcgcagcttgcagtgtgagaacctcaaggacactgtagagaacctaacggctaaactggccagcaccatagcagataaccaggagcaagatctggagaaaacacggcagtactctcaaaagctagggctgctgactgagcaactacagagcctgactctctttctacagacaaaactaaaggagaagactgaacaagagacccttctgctgagtacagcctgtcctcccacccaggaacaccctctgcctaatgacaggaccttcctgggaagcatcttgacagcagtggcagatg

SEQ ID NO: 8377 - DNA, 1733 bp, Homo sapiens
agagaggaggcagaggctgggaatgggagcagtaagctgtcggcaggggcagcacacccagcagggggaacacacccgggtggctgtccctcacaagcagggtggcaacatccggggtccctgggcccgaggctggaagagcctctggacaggtttgggaaccatcaggtcagatctggaagaactctgggaactacgggggcaccactatctgcaccaggaatccctaaagccagccccagtactggtagagaagcctctgccagagtggccagtgcctcagttcatcaacctctttctaccagagtttcccattaggcccattagggggcagcagcagctgaagattttaggcctcgtggctaaaggctcctttggaactgtcctcaaggtgctagattgcacccagaaagctgtatttgcagtgaaggtggtgcccaaggtaaaggtcctacagagggataccgtgaggcagtgcaaagaggaggttagcatccaggttatctccatgacttgggcatcatgcatcgagatgtgaagatggagaatattcttctagatgaacgagctggactgtgctgctgccatctcggctcactgcaacctccctgcctgattctcctgactcagcctgtcgagtgcctgcgattgcaggcgcgcggcgccatgcctgactggttttcgtatttttttggtggagacggggtttcgctgtgttggccggactggtctccagctcctaactgcgagtgatccgccagcctcggcctcccgaggtgccgggattgcagacggagtctcgttaactcagtgctcagtggtgcccaggctggagtgcagtggcgtgatctcggctcgctacaacctccacctcccagccgcctgccttggccccccaaagtgccgagattgcagcctctgcccggacgccaccccgtctgggaagtgaggagcgtctctgcctggccgcccatcgtctgggatgtgaggagcccctctgcctggctgcccagtctggaaggtgaggagcgtctctgcccggccgccatcccacctaggaagtgaggagcacctcttcccggccaccatcccatctaggaagtgaggagcgtctctgcccggctgcccatcgtctgagatgtggggagcgcctctgccccgccgccccgtctgggatgtgaggagcgccttggcccggccgtgaccccgtctgggaggtgaggagcgtctctgcccggccaccccgtctgagaagtgaggagaccctccgcccggcaactgccccgtctgagaagtgaggagcccctccgcccggcagccgccccgtctgagaagtgaggagcccctccgcccggctgccaccccgtctgggaagtgaggagcgtctccgcccagcagccaccccgtccgggagggaggtgggggtcagcccccgccaggccagctgccccatccgggagggaggtggggtgtcagccccctgcccggccagccgccccgtccgggaggtgaggggcgcctctgcccggctgcccctactgggaagtgaggagcccctctgcccggccagccgccccgtccgggagggaggtgggggagtcagccccccgcccggccagccgccccttccaggagggaggtggggggttcagcccaccgcccggccagccgccccgtccgggagggaggtgggggggtcagccccccgcccggccagccgccccgtctgggag

SEQ ID NO: 8378 - DNA, 3604 bp, Homo sapiens
gatttagcagagagaggaggcagaggctgggaatgggagcagtaagctgtcggcaggggcagcacacccagcagggggaacacacccgggtggctgtccctcacaagcagggtggcaacatccggggtccctgggcccgaggctggaagagcctctggacaggtttgggaaccatcaggtcagatctggaagaactctgggaactacgggggcaccactatctgcaccaggaatccctaaagccagccccagtactggtagagaagcctctgccagagtggccagtgcctcagttcatcaacctctttctaccagagtttcccattaggcccattagggggcagcagcagctgaagattttaggcctcgtggctaaaggctcctttggaactgtcctcaaggtgctagattgcacccagaaagctgtatttgcagtgaaggtggtgcccaaggtaaaggtcctacagagggataccgtgaggcagtgcaaagaggaggttagcatccaggttatctccatgacttgggcatcatgcatcgagatgtgaagatggagaatattcttctagatgaacgaggccatctgaaactgacagactttggtctgtcccgccacgtgccccagggagctcaagcctacactatctgtggcactcttcagtacatggccccagaggtcctaagtggaggaccttacaaccatgctgctgattggtggtccctgggtgtcttgcttttctctctggcgactggaaagtttccagtggctgcagagagagatcatgtggccatgttggcaagtgtgacccacagtgactctgagatcccagcttctcttaaccagggcctctcactcctgctccatgagctcttatgccagaaccccctccatcgtctacgttatctgcatcacttccaggtccaccctttctttcggggtgtggccttcgacccagagctcctacagaagcagccagtgaactttgtcacggagacacaagctacccagcccagttcagcggagaccatgccctttgacgactttgactgtgatctggagtccttcttgctctaccctatccctgcttgagcctctctactgtaaattggggcccggctgggagcctgaagatctccatccctgcctactcagtatgaccaccttgataatccagtttgtttttattttgtagcctcttaccgttctgctctcctaggctttagaccagagttccaacctggacattctgctactggcagccacagctggccctattccttccctatcatacaacctacctctcaattcaacatgtcagatcagggtggtgaccttttccttttctttacttctccagtgctctttaccctcaggctgtcagccagagctgcttctgcttgtttctctgccatgtttcctttcttgagcaataataatacttcatgggctcccagggtgctattgatgtgtttaataggcttgtcagaagcaatatgaattttttttttttttttgagacagagtctcactctgttgcccaggctggagtgcagtggtgcgttctcagctcactgcaacctccgtctcctgggttgaagtgattttcatgcctcagcctcccgagtagctgggattacaaatgcacaccattatgcccagctaatttttgtattttttagtagagacagggttcaccatgttggccaggctgatctcaaactcctgacctcaagtgatcggcctgccttggcctcccaaagtgctggaattacaggtaggtgtgagccactgcaccagaccctttttttttttttttttttttttttttgagatagggtctcactctcgtcacccaggttggagtgcagtggcacgatctcagctcactgcaaccttcacaggcatgagcctccacacccagcctgtgaatttttcaaaagtctcaaaagctggcatttcaacccctaaataatgcagctaaaaaatatagtctgggagcttgaggccagtctgcaataaatctaatttttaaaaattgaaaagtgaataaaataatctagtgaggaagaaaatagaaactgaaacatgggtgggttaaatgtcttctctaggtctataattgcaacagttatccaaaataaaacctctttgaaaagcataggatttttaaactgacaatttctcctagtgagcccatgattcagtttctgatgggcaaaccaagagattaagaggcatgcatcaaccttaagatttaaggttatttgggaggccaaggtgggcagatcagttgaggtcaagagttcgagaccagcgtggccaacatggtgaaaccttgtgtctactaaaaaaatacaaaaattagctgggtgtggtgttgcacacctgtagtcccagctactcagaaggctgaagcaggagaactgcttgaaccctggaggccaaggttgcagtgagccaagattgtgccattgaactcctgggtgacagaggtagactctgtctcaaaaaaaaaaaaaaaaaaaaaaaaaaaagatttaaggttagagacatatctcaataaccttttcctttagtaaggaaaatcatctggaccttaaatttgtatacagttttggcctttatgacttcttttcatttttcttaaactaatttctcacaattttcatttttgtcctgagacttgaagggaaagtaagttttaatctagaccatattatttagttacatctaatctctctagacaaaagacagtctggagagtactctttagttctatttattaattttgtctctagattgagccagatttccccatgcatagctggcattttattggcctctgcagaattgctttttctggattggactttggtaatccatatgaaaatctctatgaaatttaattgctcgccaggtgtggtggctcacacttgtaatcccagcactttgggaggctgaggtgggcggatcaccagaggtcaggagttcgagaccagcctggccaacatggtgaaaccccgtttctccccaaaaaatacaaaaattagctggtcatgagggcacacactgtagtcccagctactcaggaggctgagggggaagaattgcttgaacccaggagatggaggttgcaatgagtgaagatcgtgccactgcatccagcctgagcaacagagtgagatcttgtctcaggaaaaaaataaatttaattgctgtggatactgtaaagggtgtttatcgtaacagttcataatattctatttaagaatgcgtgggagaaattttctctggacccagttatgcttttcctgaattgctgtttggtttttaccttaaggacactaaatattcagctgattgtatttttctgtttgtactgatactagaccatttagagcccaatttgtggtctaccttcagcaagtgtttatgtattttgtatgctagtcatgttcttggttctgtcttccttttctacttttattttccttattctcatttttctaagttttaatcgttttatattactataatatctgcatcttgtaagcctttttgtaataaggttgggatataaataaataaggcaatgtatccttt

SEQ ID NO: 8379 - DNA, 629 bp, Homo sapiens
gggcgataatggcggcgtcgaggctggagctaaacctggtgcggctgctatcccgctgcgaggcgatggcagcggagaaacgggacccggacgagtggcgcctggagaagtacgtgggagccctagaggacatgttgcaggccctgaaggtccacgcgagcaaaccggcctctgaggtgatcaatgaatattcctggaaggtggattttctgaaggggatgctgcaagccgagaagctgacctcctcctcagagaaagcactggccaaccagttcctggcccctggccgtgtgccaaccacagccagagagcgagtgcccgccacaaagacggtgcatctgcagtcacgggcgcggtacaccagcgagatgcggagtgagctactaggcacggctgaggcagagcctgagatggacgtaaggaagagaacaccctgtcacactcactgaaaatggcggaccagaacctggagaaactgaagacggagtcagagcgtctggagcagcacacgcagaagtcagtcaactggctgctctgggccatgctcattatcgtctgcttcatcttcattagcatgatcctcttcattcgaatcatgcctaaactcaaataaagacccccgcccacct

SEQ ID NO: 8380 - DNA, 856 bp, Homo sapiens
gcacttccgccctctcttaacatggagccggcggaaggggtggtgtagggccgggcgataatggcggcgtcgaggctggagctaaacctggtgcggctgctatcccgctgcgaggcgatggcagcggagaaacgggacccggacgagtggcgcctggagaagtacgtgggagccctagaggacatgttgcaggccctgaaggtccacgcgagcaaaccggcctctgaggtgatcaatgaatattcctggaaggtggattttctgaaggggatgctgcaagccgagaagctgacctcctcctcagagaaagcactggccaaccagttcctggcccctggccgtgtgccaaccacagccagagagcgagtgcccgccacaaagacggtgcatctgcagtcacgggcgcggtacaccagcgagatgcggagtgagctactaggcacggctgaggcagagcctgagatggacgtaaggaagagaactggagtggcagggtcccagccagtgagtgagaagcagttggcagctgagctagacctcgtcctgcagcgacatcagaacctccaggaaaagctggcggaagagatgctaggactggcccggagcctcaagaccaataccctggccgcccagagtgtcatcaagaaggacaaccagaccctgtcacactcactgaaaatggcggaccagaacctggagaaactgaagacggagtcagagcgtctggagcagcacacgcagaagtcagtcaactggctgctctgggccatgctcattatcgtctgcttcatcttcattagcatgatcctcttcattcgaatcatgcctaaactcaaataaagacccccgcccacct

SEQ ID NO: 8381 - DNA, 4049 bp, Homo sapiens
atgcgaccggactgcaattcccagaagccgtcgcaggccctcagcatccgggacactagcagcaaggatccctggccggacatagaaccacaactcccagcaacccctgctgccgtgtggggggtcttcacgttctcgtggcgcggcgcaggcgcactgggtcctcggcgcggaccgcgcagactgaataataaaaggggagcggcgaagaggcaggaagacaagaccatgtcgaagggccccgggcccggcggctccgcagcttcctcggcgcccccggccgctaccgctcaggtgctgcaggcacagcccgagaaaccgcagcactacacgtacctgaaagaattccgcacagagcagtgcccactctttgtgcaacacaaatgcacgcagcatcggccctacacctgcttccactggcacttcgtgaaccagcggcgccgccggtccatccgccgtcgggacggcaccttcaattacagccctgacgtctactgcaccaagtacgacgaggctacaggcctctgcccggagggcgacgagtgcccattcctgcacagaaccacaggggacactgagcgcaggtaccaccttcgttactacaaaactggaatctgcatccacgagacagactcgaaaggcaactgcaccaaaaacggcctgcactgcgcttttgcccacgggccccatgacctccgctcccctgtctacgacatcagggagcttcaggccatggaggccttgcagaatggccagaccacggtagaggggagcatagagggccagtcggctggggctgcgagccatgccatgatagaaaagatcctcagcgaggagcctcggtggcaagagactgcttatgtgctggggaactataagacggagccttgcaagaagcccccgcggctgtgccgccaaggctatgcctgtccctactaccacaacagcaaggaccggcggcggagcccccggaagcacaaatacaggtcgtctccatgtccaaacgtcaagcacggggatgagtggggagaccctggcaagtgtgagaacggagacgcctgccagtactgccacacccgcaccgagcagcagttccaccccgagatctacaagtccaccaagtgcaacgacatgcagcagtcgggcagctgtccccgaggacccttctgcgcctttgcccacgtagaacagccacccctgagtgacgacctgcagccttcctcagctgtgtccagccccacccagccaggtcctgtcctgtacatgccatctgccgccggagactcggtgcctgtgagcccctccagcccgcatgcccctgacctcagtgccctcctctgtagaaacagcagcctaggcagcccgtctaacctctgcggctccccaccgggctccatcaggaagcccccaaacctggagggcatcgtcttccctggggagtctggcctggcccctggcagctataagaaggctcccggcttcgagagggaagaccaggtgggagccgagtacctgaaaaatttcaaatgccaggccaaattaaaaccccactcattagagcccaggagtcaagagcagcctctgcttcagcccaaacaggacatgctgggcatcctccccgcaggcagccccctgacctcaagcatctcttctagtatcacctccagcctggcagctaccccccctagcccagtgggcaccagcagcgtccccggcatgaatgcaaacgctctgcccttctaccccaccagcgacacggtagagtcagtcatagagtctgctttggatgacctggacctgaatgagtttggcgtggccgccctggagaagactttcgataacagcacagtgccccacccaggaagcatcaccatcggcggcagcttgctgcagagctctgcacccgtgaacatccccggctccttgggcagctctgcctccttccactcagcatccccgtcccctcccgtcagcctctcctcgcatttcctgcagcagccccagggccacctgagtcagtcggaaaacacatttttgggaacctcagcatcacatggatctttgggtctgaacgggatgaacagcagcatctgggagcattttgcctctggaagcttctccccgggcacttcccccgctttcctatcagggccaggggctgccgagctggcccgacttcggcaagagctggatgaagccaacagcaccatcaagcagtgggaggagtcctggaagcaggccaagcaggcttgtgatgcctggaagaaagaggcggaggaggctggtgagcgggccagtgcggcgggcgccgagtgcgagctggcccgggagcagcgggatgcactggaggtgcaggtgaagaagctccaggaggagctggagcggctacacgcggggcctgagccccaggccctgcccgccttctccgacctggaggcgctctcactctccaccctctactccctccagaaacaactgcgggcccacctggaacaagtggacaaggccgtgttccacatgcagtcggtgaaatgccttaagtgtcaggaacagaagcgggcagtgctgccgtgccaacacgctgcgctgtgtgagctctgcgctgagggcagcgagtgccccatctgccagcctggccgggcccacaccctccagtcgtgaccctgcaggcctggcccagcctggcccagatcttctcacctaggactttttaaagtatatatatatatatgaatatatatatatatgtgtatgtatgtatgtatatgtatatgattatgtatatgtatacatttccgtatgtatgtatatgtatacatttccgtatgtgtgcaggtatgcgtggtggtgtggacagtgtctgtgtgtatatctgtacatagatatagacacacactttaaaagacttaccaagcactttttaaaagaagaaactattttgcagtcctcccctacccactccctgcccttcccactgcagagatgacatcccctcttctcccactggccttttggcagagaatctggttctgtctcttttttaatgtaggaactaactatttttaacttcttcctggggcctgagcagggaagggtgggactggaaggcactaaggggaagggagaagccctcagggcaggccctgctccccctacctccttgccagggcaagggtggagtgtggaagacgtgggtcccccagagcaggcctggcccccagctgtgagggcctcagggaggcccgagggggagtgctgggggtctcagctggcttagctcctaagtttaccaaatgttaatttagtcttggggagaacagcaagggctggaggccagtgctgcagggccagccccactcctgacacctgggcccttgaagctccttgaggggcaaggcccaggagttccagccctcaggttcctgagggtccaccctcagtccttccccccgccgcccctccccggactccccacaagagcctccctggccccagggccgcctaccaggctggtactcattctatgaccaccgcccccaaccagctgcccccagctctccctgccccctcccctctctggcagctagcagggcaattggcggggaggagtgcggactgaggactgaggaccaagggggcccaggccctgccctcctacccggaggggctccgtttgcattccttggtgctctctgagtgcagctggtgtcccgccctgttctgggcggacgcctgtgtgcgtgtgtgtgtgcctgtccagtgtatattgtgtcttagcttccattttaaaaattgttctgtacagagagagatgcagcaggggcgggagggcagagtgggcggaggggagcagccgcacccccagcaccgggtgtctgcggtaggaacaagagggctgagagggtctggtcctggcccaggctcccccttgggctcagcacgaaagggctttcaatgaattaagtgaaaactttttccttttttacaaaaatgcaaaaatcaacaaagctccaaacctattggaaataaaatatgaacttgcagtggta

SEQ ID NO: 8382 - DNA, 510 bp, Homo sapiens
atggtgtcttcaaagggactgtggaaagagaggccttcagcccacacctctgaatgcttttccaccacagcatgccctgtggcctttatcctgctggtgtggaacagtcagacccctgcagggctgcagagcctctgtactgggcggcatcccagcctgagtgccagagctcagagggcaggcccccgagcaagcagagaggagggcaccttttggacagaacgtgtgggacaagagcgatggctcatccgttcaggttcctcacaaaatgagagtcaggaagatcagggcgccggcctgatttcccaggcagggctgaaagcagacaaccggagggagagcagcacctgggccaatgaggtagaagacagaagaccacagtgtactcctgccctcaacctcaccccctcccacccacatcctccacactccctgaccaccttcctcagaagtgtaataggaatccagattccccctggcctggttgctgcaggaggcacagtagcctga

SEQ ID NO: 8383 - DNA, 632 bp, Homo sapiens
accaggcacagagaggacccactgggacacaagagcctgcatgtgaagccaggccttgggccaccttgttcctcaaaggggtgcttacttccatggggtcttcaaagggactgtggaaagagaagccttcagcccacacctctgaatgcttttccaccacagcatgccctgtggcctgtatcctgctggtgtggaacagtcagacccctgcagggctgcagagcctctgtactgggcggcatcccagcctgagtgccagagctcagtgggcaggcccccgagcaagtagagaggagggcaccttttggacagaacctgtgggacaagagcgacgtctcatccgttcaggttcctcacaaaatgagagtcaggaagatcagggtgcagacctgatttcccacgaagggctgaaagcagacaaccagagggagagcagcacctgggccaatgaggtagaagacagaagaccacagtgtacttctgccctcaacctcaccccctcccacctacatcctccacaccccctgaccaccttcttcagaaacgtaataggaatcaagatcccccctggcctggttgctatgggaggcacagtggcctgatggagcctgaggcaggtgtgggaagatgtg

SEQ ID NO: 8384 - DNA, 1354 bp, Homo sapiens
ggaacccgcggcgcagggggcggagtgctcgcgcggcgctgcgtccgggagacgtttttccaggggcattgttatttgtgaccacaatgaaaaatgtagacagtgatgatctggtaactggcacacttcccaagctcaagagctcaaaagaatggttggagcccaagcccctttgttttatggaggttttagctaaagaagatactgaggcagctattcaatcaatattatacaaagaaaattctgtaattaaggaactagataagtatttacaacatcatgccttcttaaatgcaagaagaaaggagatgttatataaaagatgggttgactgtgtggcagatcctcttcagaagaaaattatagaaaaagtttgctcacataagaagattaaaaaaaggaggcaaggggaattagatggctttttaaaacatgtaaataaaaagggaaatgcatttatagaacattatgatccaaaagagtatgatcccttttatatgagcaagaaggaccccaattttctgaaggttaccatcccaccatttcatgaccctttgaaaaaagcacaatatgacaaggataacgaaaaaagaactcttcttcagtgtgagactggcaaaatatattcaataaaggaattcaaagaagttgagaaggttcagctgcattccagattcccacaaatttctaattcaaggcactttataactccaaacgagtggctgaaactgcctacaagatacatagaaagtgaattttgtagaaggagaaggttaaaggtgaaagtgaattttaatgactgtagttttgatttgaaacctttggcaagagctccttatcttttggaatcccaggaagaagaaaaaacagttatttacaaaaacaaagggtcatcctttctagaaagagaaccgctgtgctatcaggagggaaataatccaagtgccaaagaggccatctctgaagggtatttttcttccttgagcctccaggaacgggaggaagaccaggatgggtctccctccccgcgtttggggctgctgaagctggagctataagaaagaagagggaggtttcagcaaccaaggagcacacaccctgatccttgattggtgaaaggatacacaaaatcaggctgcttcagaggaagtcatctgctcacaggaatcagggtgaaggccaaggacggcactcaagaattgtcctgtctctaaaaaaaaagcatctgcaacgaacttcctttaatttttgagttcagtgtctgtgataattaagaaatggcaataccatgtattttccccagaagttaagaaatattgctgaacgaaccaataaaaataattacagctccctc

SEQ ID NO: 8385 - DNA, 2822 bp, Homo sapiens
ggcgcggtacaggagcagcactgccggcgggggcgggtgccagggacttggaggtggaggggacgcggcggtactctggcgtcttccgacttcgactccttaccttaaaagatgctggagtcatatgtaactccaattttaatgagctatgtgaatcgctacatcaagaacttaaagccgtcggatctacagctttcactatggggtggagacgtggtactcagcaagctcgagttaaagttggatgtgctggaacaggaactgaaattaccattcacttttttaagtggacatattcatgaattgaggattcatgtaccatggacaaaactgggttcagaaccagtggtaattaccatcaatactatggaatgcattttgaaacttaaggatgggatacaggatgaccatgaaagctgtggttctaattctaccaaccgtagtactgctgagagcacaaaatcatcaatcaaaccgcggagaatgcagcaggctgctcctacagatcctgacttaccaccaggttatgtgcagagtctgattagacgagttgtaaataatgtaaacattgtgataaataatctcatactaaaatatgttgaagatgatatcgtcctttccgtcaatatcacttctgcagaatgttatacagtaggtgaattatgggatcgtgcattcatggatatttctgcaactgatttggtgctgagaaaggttatcaatttttctgactgtacagtttgtcttgataaacggaatgccagtggtaaaatagaattttaccaggatcctttattatacaaatgttccttcagaactcgtcttcattttacatatgaaaacctaaattccaagatgccatctgttattaaaattcatactttagtggaaagtttgaaactttctatcacagatcaacaactgcctatgtttattcgtataatgcaacttggaattgctctttactatggagaaataggcaattttaaagaaggcgaaatagaggaccttacttgtcataataaagatatgctaggaaacattacaggttctgaagatgaaacaagaatagatatgcaatatcctgctcagcataaaggtcaagagttatattcacagcaagatgaggagcagccacagggatgggtgtcatgggcctggtcctttgtgcctgcaattgtgagttatgacgatggcgaggaagactttgttgggaacgatcctgcatcaaccatgcatcaacaaaaagcacagactttgaaggatcctattgtttctataggattttattgcacaaaggcaacggtgactttcaaactcacagaaatgcaagttgagagtagttattacagtccacagaaagtaaaatctaaagaagtattgtgttgggaacaagaaggaactacagttgaggcccttatgatgggagaacctttctttgattgccagattgggtttgttggttgcagagccatgtgccttaaaggaattatgggtgttaaagattttgaagagaatatgaatagaagtgaaactgaagcctgtttcttcatttgtggtgacaatttgagtacgaaaggtttcacataccttacaaattcattgtttgattaccgaagcccagaaaataatggtactcgcgcagaatttatcttggattcaactcatcataaggagacatacactgagatagctggaatgcaacggtttggggctttttatatggattacctgtatacaatggagaacactagtggcaaaggttccacaaatcaacaagacttttcttcagggaaaagtgaagatttgggaacagttcaggagaagtccaccaaaagccttgttataggtcctcttgattttcgtttggatagcagtgcggtgcataggattttgaaaatgattgtgtgtgccttggaacatgaatatgaaccatatagcaggctaaaatcagatattaaggatgaaaatgaaacaatactgaatcctgaagaggtggctcttctggaggaatatattcctactcgacatacaagtgttactctcctcaaatgtacctgcacaatttccatggctgaattcaacttgctggaccatttactacctgtcattatgggagaaaagaactcaagtaacttcatgaatactacaaacttccagtctcttcggcctttgccatccattcgaatattggtggataaaattaatctggaacattcagtgccaatgtatgctgaacagttggtgcatgtggtcagcagccttactcaaccttctgataacctgcttcattattgttatgtacactgctatcttaagatatttggtttccaggcaggactgacgtctttggattgcagtggatcttactgcttacctgtaccagttattccctctttcagcactgctctttatgggaaacttctgaaactccccacatgctggaccaaaagatctcagattgctataactgaaggtatatttgaacttccaaatctcacaattcaagctacaagagcacagacacttctcttgcaagcaatatatcaaagttggtctcatcttggaaatgtcagctcttccgcagtgattgaagctttgataaatgaaatcttcctaagtatagagattgggtcttgctatgttgcccaggttgatcttgaactcctggcctcaaatgatcctcccacctcaacctcctgaagtgccgggattggaggcccaagccactgtgcctggccctttataaattatgttataatttcatgtaatacataattgtatagtcaaaatggctcacatattaaatattctttatacaa

SEQ ID NO: 8386 - DNA, 14019 bp, Homo sapiens
ggcgcggtacaggagcagcactgccggcgggggcgggtgccagggacttggaggtggaggggacgcggcggtactctggcgtcttccgacttcgactccttaccttaaaagatgctggagtcatatgtaactccaattttaatgagctatgtgaatcgctacatcaagaacttaaagccgtcggatctacagctttcactatggggtggagacgtggtactcagcaagctcgagttaaagttggatgtgctggaacaggaactgaaattaccattcacttttttaagtggacatattcatgaattgaggattcatgtaccatggacaaaactgggttcagaaccagtggtaattaccatcaatactatggaatgcattttgaaacttaaggatgggatacaggatgaccatgaaagctgtggttctaattctaccaaccgtagtactgctgagagcacaaaatcatcaatcaaaccgcggagaatgcagcaggctgctcctacagatcctgacttaccaccaggttatgtgcagagtctgattagacgagttgtaaataatgtaaacattgtgataaataatctcatactaaaatatgttgaagatgatatcgtcctttccgtcaatatcacttctgcagaatgttatacagtaggtgaattatgggatcgtgcattcatggatatttctgcaactgatttggtgctgagaaaggttatcaatttttctgactgtacagtttgtcttgataaacggaatgccagtggtaaaatagaattttaccaggatcctttattatacaaatgttccttcagaactcgtcttcattttacatatgaaaacctaaattccaagatgccatctgttattaaaattcatactttagtggaaagtttgaaactttctatcacagatcaacaactgcctatgtttattcgtataatgcaacttggaattgctctttactatggagaaataggcaattttaaagaaggcgaaatagaggaccttacttgtcataataaagatatgctaggaaacattacaggttctgaagatgaaacaagaatagatatgcaatatcctgctcagcataaaggtcaagagttatattcacagcaagatgaggagcagccacagggatgggtgtcatgggcctggtcctttgtgcctgcaattgtgagttatgacgatggcgaggaagactttgttgggaacgatcctgcatcaaccatgcatcaacaaaaagcacagactttgaaggatcctattgtttctataggattttattgcacaaaggcaacggtgactttcaaactcacagaaatgcaagttgagagtagttattacagtccacagaaagtaaaatctaaagaagtattgtgttgggaacaagaaggaactacagttgaggcccttatgatgggagaacctttctttgattgccagattgggtttgttggttgcagagccatgtgccttaaaggaattatgggtgttaaagattttgaagagaatatgaatagaagtgaaactgaagcctgtttcttcatttgtggtgacaatttgagtacgaaaggtttcacataccttacaaattcattgtttgattaccgaagcccagaaaataatggtactcgcgcagaatttatcttggattcaactcatcataaggagacatacactgagatagctggaatgcaacggtttggggctttttatatggattacctgtatacaatggagaacactagtggcaaaggttccacaaatcaacaagacttttcttcagggaaaagtgaagatttgggaacagttcaggagaagtccaccaaaagccttgttataggtcctcttgattttcgtttggatagcagtgcggtgcataggattttgaaaatgattgtgtgtgccttggaacatgaatatgaaccatatagcaggctaaaatcagatattaaggatgaaaatgaaacaatactgaatcctgaagaggtggctcttctggaggaatatattcctactcgacatacaagtgttactctcctcaaatgtacctgcacaatttccatggctgaattcaacttgctggaccatttactacctgtcattatgggagaaaagaactcaagtaacttcatgaatactacaaacttccagtctcttcggcctttgccatccattcgaatattggtggataaaattaatctggaacattcagtgccaatgtatgctgaacagttggtgcatgtggtcagcagccttactcaaccttctgataacctgcttcattattgttatgtacactgctatcttaagatatttggtttccaggcaggactgacgtctttggattgcagtggatcttactgcttacctgtaccagttattccctctttcagcactgctctttatgggaaacttctgaaactccccacatgctggaccaaaagatctcagattgctataactgaaggtatatttgaacttccaaatctcacaattcaagctacaagagcacagacacttctcttgcaagcaatatatcaaagttggtctcatcttggaaatgtcagctcttccgcagtgattgaagctttgataaatgaaatcttcctaagtataggtgtgaaatctaagaatcccctgccaactcttgagggctcaatccagaatgttgaattgaagtactgcagcacatcattggtcaaatgtgcctctgggaccatgggatcaataaaaatttgtgccaaagccccagttgatagtggaaaagagaagttgattcccttgcttcagggtccttctgacactaaagaccttcatagcaccaagtggctcaatgagagtagaaagccagagtctctcttagctccagatttgatggccttcacaatccaagttccacaatatattgactactgccacaattccggtgctgtacttctttgcagtatacaaggactagcagttaatattgacccaatcttatatacgtggctcatctatcagcctcagaaacgaacaagtagacatatgcaacagcagcctgtggtagctgttcctcttgttatgccagtttgtagaaggaaagaggatgaggtgtctattggaagtgcccccttggcaaagcagcaatcatatcaggcctctgaatatgccagcagccctgtaaaaacaaaaacggtaacagaatcccgcccattgtcagttcctgttaaagccatgttgaatatatctgaaagctgtagaagtcctgaagaaagaatgaaggaatttattggaattgtttggaatgcagtgaagcatctcacactacagcttgaagtacaatcttgttgtgtgtttattccaaatgatagcctgccttccccaagtacaattgtatctggtgacattcctggaacagtaagaagttggtaccatggacaaaccagcatgccgggaacacttgtcctctgtttgcctcaaataaagattattagtgctgggcacaagtatatggaacctctgcaggagattccatttgttatcccacgacccatccttgaagaaggtgatgcttttccttggacgatcagcttgcataatttcagcatatatacccttcttggaaaacaagtgacactttgcctagtggaacctatgggttgcacctccactctagctgtcacgtctcaaaaactgcttgctacgggacctgatacacgacattcatttgttgtctgtctccatgttgacctagagtcactagagataaaatgctctaatccccaggtccagctcttctatgaactaactgatatcatgaataaggtctggaacaagattcagaagagaggcaatctcaacctatctccaacctctccagagaccatggcagggcctgttcctacttctccagttagaagcagtataggcacagctcctccagataccagcacatgcagcccatctgctgacattgggactactactgagggagattctatacaagcaggtgaggaatcaccattctcagattctgtgaccttggaacaaactacaagtaatattggaggaaccagtggacgtgttagtttatggatgcagtgggtgcttcccaaaattactataaagctctttgctccagatcctgaaaataaaggcacagaggtttgtatggtcagtgaactagaagatctcagtgcttccatagatgtccaggatgtatataccaaagtgaaatgtaaaatagagagtttcaatattgatcactatagaagcaggccaggggaaggttggcagtcaggacattttgaaggagtatttctacaatgcaaagaaaaatctgtgacaactacaaaacttctagatggcactcatcagcagcatggattcctctctctgacatacacaaaagctgtaacaaaaaatgtccgccacaagttaacatcaagaaatgagcgaagaagttttcataagttatctgaaggcctaatggatggttctcctcattttcttcatgaaattcttctttcagcacaagcttttgatattgttctttattttcctttacttaatgccattgcaagtatatttcaagcaaaactaccaaagacccaaaaagagaaaagaaaatctcctggtcagcccatgaggacccatacactgacatcccgcaatttacctttgatttatgtcaacacaagtgtaatcagaatttttattccaaaaacagaagaaatgcagccaactgttgaagctaatcaggcagcaaaagaagacactgtggttttgaagattggctctgttgccatggctccccaggctgacaatccccttggcagatctgtccttaggaaagatatttaccagagagccttgaacttaggaattcttcgagatcctggatcagaaatcgaagacagacaataccaaatagatctgcagtccatcaatattggtactgcacagtggcatcaactaaaaccagagaaggaaagtgtctcaggaggggtggtaacagagactgaaaggaattctcaaaatccagcccttgagtggaatatggccagcagcatacggcggcatcaagaaaggagagcaattttgacccccgttttgacagatttttctgtccgaataactggagcacctgctgtcattttcaccaaagtagtttctccagaaaatttgcatactgaggagattttagtgtgtggccattccttagaagtgaatataaccacaaacctggacttcttcctaagtgtggctcaagttcaactcttacatcagttaatagtagcaaatatgactggactggaaccatcaaacaaggctgcagagatctctaaacaagaacagaaaaaagtggatatatttgatggaggcatggctgaaacctcatctcgctacagtggtgctcaggatagtggaattggcagtgacagtgttaaaatcagaatagtgcaaatagagcagcacagtggtgccagtcagcatcgcattgcccgtccctcacgccagtcatcaattgtaaaaaatctaaattttattccctttgacatatttattactgcaagtagaatctcactaatgacctattcctgtatggccttatccaaatcgaaatcacaagaacagaagaataatgaaaaaacagacaagagttcattaaatctcccagaagttgattcagatgttgctaagcccaaccaggcatgtatttccacggtgacagcagaagatctcttaaggagcagcatttcttttccttcagggaaaaaaataggggtcctctctcttgaaagtcttcatgcatccacaaggtcatctgctagacaagcacttggtataactattgttcggcagcctggtcgaagaggaactggtgacttacagctagagccttttctgtactttattgtgtcccagccttccttgcttctgagttgtcaccacagaaagcagcgagtggaagtatccatttttgatgctgtgcttaaaggggtggcctctgattacaaatgtatagatcctgggaagactctgcctgaagcccttgattattgcactgtttggctacagacagtgcctggagaaatagacagcaaaagtggtattccaccttcctttataacactacagattaaagactttctgaatggaccagcggatgtcaatttggatatatcaaagcctttgaaagcaaacctgagtttcaccaaactggatcagataaacctttttttaaagaagataaaaaatgcacacagtttggcacatagtgaagagacttcagccatgtccaacaccatggtgaataaggatgatcttccagtctccaaatattaccgtggaaagttgtctaaacccaaaattcatggtgatggagtgcaaaagatttcagctcaagaaaacatgtggagagctgtttcctgctttcaaaaaatttctgttcaaactactcagattgtgatctccatggaaactgtaccccataccagcaaaccatgcctgttagcatctctctcaaacctcaatggaagccttagtgtcaaggcaacacaaaaagtacctggcataattcttgggtcatcatttctactcagtataaacgattttctccttaaaacaagtctcaaagaaagaagccgcattctgataggaccatgttgtgctactgccaatctggaagctaagtggtgtaaacacagcgggaatccaggcccagaacaatccataccaaaaatatccattgacttaagaggaggtctactacaggtcttctggggtcaagaacatttgaattgtttagttcttctacatgaattactcaatggataccttaatgaggagggaaattttgaagtacaagtttctgaaccagtgcctcaaatgtcatctcctgtggaaaagaatcagacatttaaaagtgaacaaagttcagatgacctacggacaggtctatttcagtatgtacaggatgctgaatctttgaaattgcctggggtctatgaagtcttattttataatgaaactgaagattgcccagggatgatgttatggagatatccagaacctagagtactcacccttgtacgaataactcctgtaccttttaacaccacagaggatccagatattagcacagcagaccttggtgatgtgctacaggttccttgtagcttggaatactgggatgaactccagaaggtttttgttgcatttagagaatttaatctgtctgaaagcaaagtttgtgaactgcagttgccggatatcaatctcgtgaatgaccagaagaaattagtatcttcagatctttggagaattgtcttgaacagcagtcaaaatggagctgatgaccaaagctctgcaagtgagtctggttctcaaagcacttgtgatccacttgtgactccaacagccctggctgcctgtaccagagttgactcctgctttaccccatggtttgtcccatccctttgcgtttctttccagtttgctcacctggaattccatctttgtcatcaccttgaccaactaggcacagctgcaccacagtacctacagccatttgtttccgacagaaatatgccatctgaactagaatacatgattgtttccttcagagaaccacacatgtatcttcgacagtggaataatggttctgtctgtcaggagatccagttcttagctcaagcagactgtaaacttctagagtgcagaaatgtcactatgcaaagtgtggtgaaacccttcagcatcttcgggcagatggcagtttccagcgatgtagtggaaaagctgcttgactgcaccgtgatagttgattctgtatttgtaaaccttggacagcatgtagtccattcactaaacactgcaatacaagcttggcaacagaacaaatgccctgaggtagaggagttggtcttcagccattttgtgatctgtaatgacacacaggagacactgcggtttggccaggtggatactgatgaaaatattctgctggcgagtctccacagtcaccagtacagctggcgctctcacaaatccccacagctgttacacatctgtattgaaggttggggcaactggcgttggtcagagcctttcagtgtggaccatgccgggacttttattagaacaattcagtacaggggtcgaactgcttctctcatcatcaaggttcagcaactcaatggagtacaaaaacagattatcatctgtggaagacagatcatctgtagttacttgtctcaaagcatagaactaaaagtcgttcagcattacattggtcaagatggacaagctgtagttcgggaacattttgactgcctcacagccaaacagaaattgccttcgtacatactagaaaacaatgaactgacggagctgtgtgtgaaggccaaaggagatgaagactggtcaagagatgtgtgcctggaatccaaagcccctgagtacagcattgtcattcaggtgccatcttcaaacagttccattatttatgtctggtgcacagttttgactttagaacccaactctcaagtgcaacaacgaatgattgtgttcagccctctttttatcatgaggagtcatcttccagaccccattatcatacatttggagaaaaggagtctgggattgagtgaaacacaaattattccaggaaaagggcaggaaaaaccactgcaaaacatagaacctgaccttgtacatcacctgacattccaagcaagagaagaatatgatccttcagattgtgcagttcccatctcaacatccctcattaagcaaatagccactaaggtacaccctggaggcacagttaatcagatccttgacgaattctatgggccagaaaagtcgcttcaacccatatggccctataataagaaggattctgacaggaatgaacagctaagtcagtgggatagcccaatgcgagtgaagctgtcaatctggaagccatatgttagaactttgttgatagaacttctgccctgggccctgcttatcaatgaatccaaatgggacctctggctatttgaaggagagaaaattgttctacaggttcctgctggcaaaattattattcctcctaattttcaggaagcttttcaaattggaatatactgggcaaatacaaacactgtgcacaagtcagtagcaattaaactggtccataacctgacatctccaaagtggaaagatggaggtaatggtgaagttgtgacactggatgaagaagcgtttgttgatactgaaataagacttggtgcttttccaggacatcagaagttatgtcagttctgcatttcctccatggtacagcaaggtatacaaattattcagattgaagacaagactacaataatcaataatacaccatatcaaatattttataaaccacagctatctgtctgcaatccccattctggaaaggagtattttcgtgttccagacagtgctacttttagcatttgcccaggtggagagcagcctgctatgaaatccagctcccttccttgctgggacttgatgcctgacatcagtcagtcagtactggatgcatccctgcttcagaaacagatcatgctgggcttttctcctgccccaggtgctgacagctcacagtgctggagcctgccagctatagttagaccagagtttcccagacagagtgtggcagtacccctcgggaatttccgggaaaatggattctgtaccagggctatagtgctgacatatcaagaacacctcggagtgacttatttaaccctctcagaagaccctagtcctcgagtaattatccacaatagatgtccagtaaaaatgcttataaaggaaaacattaaagatattccaaagtttgaggtttattgcaaaaaaattccctccgagtgctcaattcatcatgagctgtatcatcagatttccagttatccggactgcaagaccaaagacttacttccaagcctacttttgagagttgaacctctagatgaagtaacaactgagtggagtgatgccattgacatcaacagtcagggaacacaggttgtgttcctgactggctttggctatgtgtatgtggatgttgtacatcagtgtggcacagtcttcatcactgtggccccagaaggaaaagcaggacctattttaaccaataccaacagagcgccagagaagattgttacatttaaaatgttcatcactcagttaagcctggcagtgtttgatgacctcacccaccacaaagcatcagctgagcttctgagactcacactggacaacatttttctctgtgtggccccgggagctggtcccctccctggggaagagcctgtggctgcgttgtttgaactttactgtgtggagatctgctgtggggacctgcagctagacaaccagctttataacaagtccaatttccactttgctgtcttagtctgccagggagaaaaagcagaacccattcagtgttccaaaatgcagagtctcctcatatccaacaaagagttggaagaatacaaggaaaaatgttttatcaaactttgcatcaccttaaatgaaggcaagagcatcctctgtgatattaatgagttcagctttgaattaaaacctgctcggttatacgtggaagacacatttgtatactacatcaagactttgtttgacacctaccttcctaacagcaggttggctggtcactccacacacctctccgggggtaaacaggtgttgcccatgcaggtcacacagcacgccagggccttggtgaatcctgtgaagttacggaaactggtgatccagccagtaaatttgctcgtcagcatccacgcttccctcaagctgtacatagcctcagaccacactcctctctccttctcggtgtttgaaagaggacccatcttcaccactgcgaggcagcttgtgcacgccctggcaatgcactatgccgctggggccctttttagagcaggctgggtagttgggtctctggatattcttggcagccctgcaagcctggtgagaagcatcgggaacggggtcgccgacttcttcaggcttccgtatgaggggctgacccggggccctggagccttcgtgagtggcgtctccagagggaccacatcgtttgtaaagcacatctccaaaggtaccctcacatccatcaccaacctcgccacaagcctggcccggaacatggaccggctctcactggatgaggagcactacaaccggcaggaggagtggcggcggcagctccccgagagcctgggcgaggggcttcgacagggcctgtcccggctgggcatcagcctgcttggtgcaattgctggtatagttgatcagccgatgcagaacttccagaaaacatctgaggcacaggcttcagcaggacacaaggccaagggtgtcatctcgggtgtggggaaaggaatcatgggggtgttcacaaagcccatcggaggagctgctgagctggtgtcacagactggctatggtattttacatggagctggactttctcagcttcccaaacagcgccatcagccaagtgatctacatgctgaccaggctccaaacagccatgtcaaatatgtctggaaaatgcttcagtctctgggcagaccagaagtccacatggccctggacgtggttctggtgaggggctcaggccaggagcatgaagggtgcttgctgctgacatcagaagtgctcttcgtggtgagtgtcagtgaggacacacagcagcaggccttccccgtcacagaaatcgactgtgcacaggacagcaagcagaacaacttactcacagtgcagctcaagcagccaagagtggcctgtgatgtggaggtagatggagtccgagagagactgtcagagcaacagtacaacagactggtggactacatcacaaagacatcttgtcacctggcccccagctgttcttccatgcaaataccatgccctgtggtggctgcagaacctcccccctccactgttaaaacataccattacctggttgatccacattttgctcaggtcttccttagtaaatttaccatggtgaaaaataaagccctgaggaaagggtttccttgagtcccctctgaggtgtttattcctgcttgtgtgatttagtttttgggtttctttgagacagggtctcactgcattgcccttgctgacctcaaattctggggttcaagcaatcctcccacctcaacccacaagtagctacgactgcaagcacctgccaccataaagggctgcattttgccaccataaagggctgcatttttttaaaaagcctaggcagctctaacatcatctgatatggacacaaggccaacagtttccttatttacatccttacctctaaaagatacttcaaagtgacaaaaacgtgttccttccccacttagagacaatgattaacagggccctatatgttcttaccacatacagaggatgcatttatttttgctctatgacacttgcaaaaatctctactgtaattaatttgggtctattattaactctctgttccatcatagaatgtggccaggccttacaatggagagccagagttaaaacttcaagttgcatctgtttttgggctgagtcaccacctttgcctcatgctcctttgtctgcaaaggcctaggattctttctttaaatgaaatgcttaggactttgtggcttgttacatttgtcatttaactgcagtgctattctttgaaagctgctatgtgtattttctctgaagtctgcattttactaaaatttacaacagtctgatgattgattgattactgtccaggtacattttagaaaaagtgttcttcttccagtttgttttactaagcaaactttgagtaaatcctttgtcctatattgaatccagtcccaaagtgttcaggtgagtttctctagttccataaacaaaacatacatagtgggaactccctggtatgccatagagcacacaagaaccccaatattaatgctaacaattataccagtccattttgtttattctgtggaattgacttgacaaagcatgaagatattcccagtgtctgtctgataatattttgcatctaagaatgggtttgactcaagatcttgggttaccaagatgtcttaaatgttcagtaaatatctttcttacagtccagtagcttagagcatgtttgctgattgatattacatttaaacttggggctacagcttgttacctagaattttgagatactaagagaatgcaattttaaatgcccactggttttatttgttttggagagagggtctcattctgtcacccaggctagagtacagtgggaacagtcatggctcactgcagcttaagctcactgcctgggctcaagtgatcttactccagcctcccaagcagctgggactacaccaccacaggtatgcaccaccatacctggctgatttttaaaattttttctagagatgaggtctcactatgttgcccagctggtctcatactcctcagttcacgcattcctcccacctccacctcccaaactgctgggattacaggtgtgagccaccatgcccaacacccactgatctttaactctcacatgttgggcataagaagtcactatataattgttactggaaagcaagacttaacgaacaattctgactatgaaaaatgtctctttcagtttgttctgtaaatatttagaaaagtgacagctgtcaacctcagagtaactatttctaaaaatgtaaatatgtattaatccttgtatcttttatggtaattttgcatattgatatgaattatataaaattgtttaaaataaaaggtgtccttgaattactgaccacccatagatgtctactgttaccaggttttacaatgcaaattttcactaatacctgggtttaatacagctcacatcactgaatgttacacatgagtttaaatgggtaatatacaggttttgttataataaagttactgattaaatta

SEQ ID NO: 8387 - DNA, 14094 bp, Homo sapiens
ggcgcggtacaggagcagcactgccggcgggggcgggtgccagggacttggaggtggaggggacgcggcggtactctggcgtcttccgacttcgactccttaccttaaaagatgctggagtcatatgtaactccaattttaatgagctatgtgaatcgctacatcaagaacttaaagccgtcggatctacagctttcactatggggtggagacgtggtactcagcaagctcgagttaaagttggatgtgctggaacaggaactgaaattaccattcacttttttaagtggacatattcatgaattgaggattcatgtaccatggacaaaactgggttcagaaccagtggtaattaccatcaatactatggaatgcattttgaaacttaaggatgggatacaggatgaccatgaaagctgtggttctaattctaccaaccgtagtactgctgagagcacaaaatcatcaatcaaaccgcggagaatgcagcaggctgctcctacagatcctgacttaccaccaggttatgtgcagagtctgattagacgagttgtaaataatgtaaacattgtgataaataatctcatactaaaatatgttgaagatgatatcgtcctttccgtcaatatcacttctgcagaatgttatacagtaggtgaattatgggatcgtgcattcatggatatttctgcaactgatttggtgctgagaaaggttatcaatttttctgactgtacagtttgtcttgataaacggaatgccagtggtaaaatagaattttaccaggatcctttattatacaaatgttccttcagaactcgtcttcattttacatatgaaaacctaaattccaagatgccatctgttattaaaattcatactttagtggaaagtttgaaactttctatcacagatcaacaactgcctatgtttattcgtataatgcaacttggaattgctctttactatggagaaataggcaattttaaagaaggcgaaatagaggaccttacttgtcataataaagatatgctaggaaacattacaggttctgaagatgaaacaagaatagatatgcaatatcctgctcagcataaaggtcaagagttatattcacagcaagatgaggagcagccacagggatgggtgtcatgggcctggtcctttgtgcctgcaattgtgagttatgacgatggcgaggaagactttgttgggaacgatcctgcatcaaccatgcatcaacaaaaagcacagactttgaaggatcctattgtttctataggattttattgcacaaaggcaacggtgactttcaaactcacagaaatgcaagttgagagtagttattacagtccacagaaagtaaaatctaaagaagtattgtgttgggaacaagaaggaactacagttgaggcccttatgatgggagaacctttctttgattgccagattgggtttgttggttgcagagccatgtgccttaaaggaattatgggtgttaaagattttgaagagaatatgaatagaagtgaaactgaagcctgtttcttcatttgtggtgacaatttgagtacgaaaggtttcacataccttacaaattcattgtttgattaccgaagcccagaaaataatggtactcgcgcagaatttatcttggattcaactcatcataaggagacatacactgagatagctggaatgcaacggtttggggctttttatatggattacctgtatacaatggagaacactagtggcaaaggttccacaaatcaacaagacttttcttcagggaaaagtgaagatttgggaacagttcaggagaagtccaccaaaagccttgttataggtcctcttgattttcgtttggatagcagtgcggtgcataggattttgaaaatgattgtgtgtgccttggaacatgaatatgaaccatatagcaggctaaaatcagatattaaggatgaaaatgaaacaatactgaatcctgaagaggtggctcttctggaggaatatattcctactcgacatacaagtgttactctcctcaaatgtacctgcacaatttccatggctgaattcaacttgctggaccatttactacctgtcattatgggagaaaagaactcaagtaacttcatgaatactacaaacttccagtctcttcggcctttgccatccattcgaatattggtggataaaattaatctggaacattcagtgccaatgtatgctgaacagttggtgcatgtggtcagcagccttactcaaccttctgataacctgcttcattattgttatgtacactgctatcttaagatatttggtttccaggcaggactgacgtctttggattgcagtggatcttactgcttacctgtaccagttattccctctttcagcactgctctttatgggaaacttctgaaactccccacatgctggaccaaaagatctcagattgctataactgaaggtatatttgaacttccaaatctcacaattcaagctacaagagcacagacacttctcttgcaagcaatatatcaaagttggtctcatcttggaaatgtcagctcttccgcagtgattgaagctttgataaatgaaatcttcctaagtataggtgtgaaatctaagaatcccctgccaactcttgagggctcaatccagaatgttgaattgaagtactgcagcacatcattggtcaaatgtgcctctgggaccatgggatcaataaaaatttgtgccaaagccccagttgatagtggaaaagagaagttgattcccttgcttcagggtccttctgacactaaagaccttcatagcaccaagtggctcaatgagagtagaaagccagagtctctcttagctccagatttgatggccttcacaatccaagttccacaatatattgactactgccacaattccggtgctgtacttctttgcagtatacaaggactagcagttaatattgacccaatcttatatacgtggctcatctatcagcctcagaaacgaacaagtagacatatgcaacagcagcctgtggtagctgttcctcttgttatgccagtttgtagaaggaaagaggatgaggtgtctattggaagtgcccccttggcaaagcagcaatcatatcaggcctctgaatatgccagcagccctgtaaaaacaaaaacggtaacagaatcccgcccattgtcagttcctgttaaagccatgttgaatatatctgaaagctgtagaagtcctgaagaaagaatgaaggaatttattggaattgtttggaatgcagtgaagcatctcacactacagcttgaagtacaatcttgttgtgtgtttattccaaatgatagcctgccttccccaagtacaattgtatctggtgacattcctggaacagtaagaagttggtaccatggacaaaccagcatgccgggaacacttgtcctctgtttgcctcaaataaagattattagtgctgggcacaagtatatggaacctctgcaggagattccatttgttatcccacgacccatccttgaagaaggtgatgcttttccttggacgatcagcttgcataatttcagcatatatacccttcttggaaaacaagtgacactttgcctagtggaacctatgggttgcacctccactctagctgtcacgtctcaaaaactgcttgctacgggacctgatacacgacattcatttgttgtctgtctccatgttgacctagagtcactagagataaaatgctctaatccccaggtccagctcttctatgaactaactgatatcatgaataaggtctggaacaagattcagaagagaggcaatctcaacctatctccaacctctccagagaccatggcagggcctgttcctacttctccagttagaagcagtataggcacagctcctccagataccagcacatgcagcccatctgctgacattgggactactactgagggagattctatacaagcaggtgaggaatcaccattctcagattctgtgaccttggaacaaactacaagtaatattggaggaaccagtggacgtgttagtttatggatgcagtgggtgcttcccaaaattactataaagctctttgctccagatcctgaaaataaaggcacagaggtttgtatggtcagtgaactagaagatctcagtgcttccatagatgtccaggatgtatataccaaagtgaaatgtaaaatagagagtttcaatattgatcactatagaagcagccttggggaagagtgttggtctttggggcaatgtggaggtgtcttcctttcctgtactgacaagctgaacagacgcaccttgttggttcgacccatcagcaagcaggaccctttcagtaattgctctggcttctttccttctacaactacaaaacttctagatggcactcatcagcagcatggattcctctctctgacatacacaaaagctgtaacaaaaaatgtccgccacaagttaacatcaagaaatgagcgaagaagttttcataagttatctgaaggcctaatggatggttctcctcattttcttcatgaaattcttctttcagcacaagcttttgatattgttctttattttcctttacttaatgccattgcaagtatatttcaagcaaaactaccaaagacccaaaaagagaaaagaaaatctcctggtcagcccatgaggacccatacactgacatcccgcaatttacctttgatttatgtcaacacaagtgtaatcagaatttttattccaaaaacagaagaaatgcagccaactgttgaagctaatcaggcagcaaaagaagacactgtggttttgaagattggctctgttgccatggctccccaggctgacaatccccttggcagatctgtccttaggaaagatatttaccagagagccttgaacttaggaattcttcgagatcctggatcagaaatcgaagacagacaataccaaatagatctgcagtccatcaatattggtactgcacagtggcatcaactaaaaccagagaaggaaagtgtctcaggaggggtggtaacagagactgaaaggaattctcaaaatccagcccttgagtggaatatggccagcagcatacggcggcatcaagaaaggagagcaattttgacccccgttttgacagatttttctgtccgaataactggagcacctgctgtcattttcaccaaagtagtttctccagaaaatttgcatactgaggagattttagtgtgtggccattccttagaagtgaatataaccacaaacctggacttcttcctaagtgtggctcaagttcaactcttacatcagttaatagtagcaaatatgactggactggaaccatcaaacaaggctgcagagatctctaaacaagaacagaaaaaagtggatatatttgatggaggcatggctgaaacctcatctcgctacagtggtgctcaggatagtggaattggcagtgacagtgttaaaatcagaatagtgcaaatagagcagcacagtggtgccagtcagcatcgcattgcccgtccctcacgccagtcatcaattgtaaaaaatctaaattttattccctttgacatatttattactgcaagtagaatctcactaatgacctattcctgtatggccttatccaaatcgaaatcacaagaacagaagaataatgaaaaaacagacaagagttcattaaatctcccagaagttgattcagatgttgctaagcccaaccaggcatgtatttccacggtgacagcagaagatctcttaaggagcagcatttcttttccttcagggaaaaaaataggggtcctctctcttgaaagtcttcatgcatccacaaggtcatctgctagacaagcacttggtataactattgttcggcagcctggtcgaagaggaactggtgacttacagctagagccttttctgtactttattgtgtcccagccttccttgcttctgagttgtcaccacagaaagcagcgagtggaagtatccatttttgatgctgtgcttaaaggggtggcctctgattacaaatgtatagatcctgggaagactctgcctgaagcccttgattattgcactgtttggctacagacagtgcctggagaaatagacagcaaaagtggtattccaccttcctttataacactacagattaaagactttctgaatggaccagcggatgtcaatttggatatatcaaagcctttgaaagcaaacctgagtttcaccaaactggatcagataaacctttttttaaagaagataaaaaatgcacacagtttggcacatagtgaagagacttcagccatgtccaacaccatggtgaataaggatgatcttccagtctccaaatattaccgtggaaagttgtctaaacccaaaattcatggtgatggagtgcaaaagatttcagctcaagaaaacatgtggagagctgtttcctgctttcaaaaaatttctgttcaaactactcagattgtgatctccatggaaactgtaccccataccagcaaaccatgcctgttagcatctctctcaaacctcaatggaagccttagtgtcaaggcaacacaaaaagtacctggcataattcttgggtcatcatttctactcagtataaacgattttctccttaaaacaagtctcaaagaaagaagccgcattctgataggaccatgttgtgctactgccaatctggaagctaagtggtgtaaacacagcgggaatccaggcccagaacaatccataccaaaaatatccattgacttaagaggaggtctactacaggtcttctggggtcaagaacatttgaattgtttagttcttctacatgaattactcaatggataccttaatgaggagggaaattttgaagtacaagtttctgaaccagtgcctcaaatgtcatctcctgtggaaaagaatcagacatttaaaagtgaacaaagttcagatgacctacggacaggtctatttcagtatgtacaggatgctgaatctttgaaattgcctggggtctatgaagtcttattttataatgaaactgaagattgcccagggatgatgttatggagatatccagaacctagagtactcacccttgtacgaataactcctgtaccttttaacaccacagaggatccagatattagcacagcagaccttggtgatgtgctacaggttccttgtagcttggaatactgggatgaactccagaaggtttttgttgcatttagagaatttaatctgtctgaaagcaaagtttgtgaactgcagttgccggatatcaatctcgtgaatgaccagaagaaattagtatcttcagatctttggagaattgtcttgaacagcagtcaaaatggagctgatgaccaaagctctgcaagtgagtctggttctcaaagcacttgtgatccacttgtgactccaacagccctggctgcctgtaccagagttgactcctgctttaccccatggtttgtcccatccctttgcgtttctttccagtttgctcacctggaattccatctttgtcatcaccttgaccaactaggcacagctgcaccacagtacctacagccatttgtttccgacagaaatatgccatctgaactagaatacatgattgtttccttcagagaaccacacatgtatcttcgacagtggaataatggttctgtctgtcaggagatccagttcttagctcaagcagactgtaaacttctagagtgcagaaatgtcactatgcaaagtgtggtgaaacccttcagcatcttcgggcagatggcagtttccagcgatgtagtggaaaagctgcttgactgcaccgtgatagttgattctgtatttgtaaaccttggacagcatgtagtccattcactaaacactgcaatacaagcttggcaacagaacaaatgccctgaggtagaggagttggtcttcagccattttgtgatctgtaatgacacacaggagacactgcggtttggccaggtggatactgatgaaaatattctgctggcgagtctccacagtcaccagtacagctggcgctctcacaaatccccacagctgttacacatctgtattgaaggttggggcaactggcgttggtcagagcctttcagtgtggaccatgccgggacttttattagaacaattcagtacaggggtcgaactgcttctctcatcatcaaggttcagcaactcaatggagtacaaaaacagattatcatctgtggaagacagatcatctgtagttacttgtctcaaagcatagaactaaaagtcgttcagcattacattggtcaagatggacaagctgtagttcgggaacattttgactgcctcacagccaaacagaaattgccttcgtacatactagaaaacaatgaactgacggagctgtgtgtgaaggccaaaggagatgaagactggtcaagagatgtgtgcctggaatccaaagcccctgagtacagcattgtcattcaggtgccatcttcaaacagttccattatttatgtctggtgcacagttttgactttagaacccaactctcaagtgcaacaacgaatgattgtgttcagccctctttttatcatgaggagtcatcttccagaccccattatcatacatttggagaaaaggagtctgggattgagtgaaacacaaattattccaggaaaagggcaggaaaaaccactgcaaaacatagaacctgaccttgtacatcacctgacattccaagcaagagaagaatatgatccttcagattgtgcagttcccatctcaacatccctcattaagcaaatagccactaaggtacaccctggaggcacagttaatcagatccttgacgaattctatgggccagaaaagtcgcttcaacccatatggccctataataagaaggattctgacaggaatgaacagctaagtcagtgggatagcccaatgcgagtgaagctgtcaatctggaagccatatgttagaactttgttgatagaacttctgccctgggccctgcttatcaatgaatccaaatgggacctctggctatttgaaggagagaaaattgttctacaggttcctgctggcaaaattattattcctcctaattttcaggaagcttttcaaattggaatatactgggcaaatacaaacactgtgcacaagtcagtagcaattaaactggtccataacctgacatctccaaagtggaaagatggaggtaatggtgaagttgtgacactggatgaagaagcgtttgttgatactgaaataagacttggtgcttttccaggacatcagaagttatgtcagttctgcatttcctccatggtacagcaaggtatacaaattattcagattgaagacaagactacaataatcaataatacaccatatcaaatattttataaaccacagctatctgtctgcaatccccattctggaaaggagtattttcgtgttccagacagtgctacttttagcatttgcccaggtggagagcagcctgctatgaaatccagctcccttccttgctgggacttgatgcctgacatcagtcagtcagtactggatgcatccctgcttcagaaacagatcatgctgggcttttctcctgccccaggtgctgacagctcacagtgctggagcctgccagctatagttagaccagagtttcccagacagagtgtggcagtacccctcgggaatttccgggaaaatggattctgtaccagggctatagtgctgacatatcaagaacacctcggagtgacttatttaaccctctcagaagaccctagtcctcgagtaattatccacaatagatgtccagtaaaaatgcttataaaggaaaacattaaagatattccaaagtttgaggtttattgcaaaaaaattccctccgagtgctcaattcatcatgagctgtatcatcagatttccagttatccggactgcaagaccaaagacttacttccaagcctacttttgagagttgaacctctagatgaagtaacaactgagtggagtgatgccattgacatcaacagtcagggaacacaggttgtgttcctgactggctttggctatgtgtatgtggatgttgtacatcagtgtggcacagtcttcatcactgtggccccagaaggaaaagcaggacctattttaaccaataccaacagagcgccagagaagattgttacatttaaaatgttcatcactcagttaagcctggcagtgtttgatgacctcacccaccacaaagcatcagctgagcttctgagactcacactggacaacatttttctctgtgtggccccgggagctggtcccctccctggggaagagcctgtggctgcgttgtttgaactttactgtgtggagatctgctgtggggacctgcagctagacaaccagctttataacaagtccaatttccactttgctgtcttagtctgccagggagaaaaagcagaacccattcagtgttccaaaatgcagagtctcctcatatccaacaaagagttggaagaatacaaggaaaaatgttttatcaaactttgcatcaccttaaatgaaggcaagagcatcctctgtgatattaatgagttcagctttgaattaaaacctgctcggttatacgtggaagacacatttgtatactacatcaagactttgtttgacacctaccttcctaacagcaggttggctggtcactccacacacctctccgggggtaaacaggtgttgcccatgcaggtcacacagcacgccagggccttggtgaatcctgtgaagttacggaaactggtgatccagccagtaaatttgctcgtcagcatccacgcttccctcaagctgtacatagcctcagaccacactcctctctccttctcggtgtttgaaagaggacccatcttcaccactgcgaggcagcttgtgcacgccctggcaatgcactatgccgctggggccctttttagagcaggctgggtagttgggtctctggatattcttggcagccctgcaagcctggtgagaagcatcgggaacggggtcgccgacttcttcaggcttccgtatgaggggctgacccggggccctggagccttcgtgagtggcgtctccagagggaccacatcgtttgtaaagcacatctccaaaggtaccctcacatccatcaccaacctcgccacaagcctggcccggaacatggaccggctctcactggatgaggagcactacaaccggcaggaggagtggcggcggcagctccccgagagcctgggcgaggggcttcgacagggcctgtcccggctgggcatcagcctgcttggtgcaattgctggtatagttgatcagccgatgcagaacttccagaaaacatctgaggcacaggcttcagcaggacacaaggccaagggtgtcatctcgggtgtggggaaaggaatcatgggggtgttcacaaagcccatcggaggagctgctgagctggtgtcacagactggctatggtattttacatggagctggactttctcagcttcccaaacagcgccatcagccaagtgatctacatgctgaccaggctccaaacagccatgtcaaatatgtctggaaaatgcttcagtctctgggcagaccagaagtccacatggccctggacgtggttctggtgaggggctcaggccaggagcatgaagggtgcttgctgctgacatcagaagtgctcttcgtggtgagtgtcagtgaggacacacagcagcaggccttccccgtcacagaaatcgactgtgcacaggacagcaagcagaacaacttactcacagtgcagctcaagcagccaagagtggcctgtgatgtggaggtagatggagtccgagagagactgtcagagcaacagtacaacagactggtggactacatcacaaagacatcttgtcacctggcccccagctgttcttccatgcaaataccatgccctgtggtggctgcagaacctcccccctccactgttaaaacataccattacctggttgatccacattttgctcaggtcttccttagtaaatttaccatggtgaaaaataaagccctgaggaaagggtttccttgagtcccctctgaggtgtttattcctgcttgtgtgatttagtttttgggtttctttgagacagggtctcactgcattgcccttgctgacctcaaattctggggttcaagcaatcctcccacctcaacccacaagtagctacgactgcaagcacctgccaccataaagggctgcattttgccaccataaagggctgcatttttttaaaaagcctaggcagctctaacatcatctgatatggacacaaggccaacagtttccttatttacatccttacctctaaaagatacttcaaagtgacaaaaacgtgttccttccccacttagagacaatgattaacagggccctatatgttcttaccacatacagaggatgcatttatttttgctctatgacacttgcaaaaatctctactgtaattaatttgggtctattattaactctctgttccatcatagaatgtggccaggccttacaatggagagccagagttaaaacttcaagttgcatctgtttttgggctgagtcaccacctttgcctcatgctcctttgtctgcaaaggcctaggattctttctttaaatgaaatgcttaggactttgtggcttgttacatttgtcatttaactgcagtgctattctttgaaagctgctatgtgtattttctctgaagtctgcattttactaaaatttacaacagtctgatgattgattgattactgtccaggtacattttagaaaaagtgttcttcttccagtttgttttactaagcaaactttgagtaaatcctttgtcctatattgaatccagtcccaaagtgttcaggtgagtttctctagttccataaacaaaacatacatagtgggaactccctggtatgccatagagcacacaagaaccccaatattaatgctaacaattataccagtccattttgtttattctgtggaattgacttgacaaagcatgaagatattcccagtgtctgtctgataatattttgcatctaagaatgggtttgactcaagatcttgggttaccaagatgtcttaaatgttcagtaaatatctttcttacagtccagtagcttagagcatgtttgctgattgatattacatttaaacttggggctacagcttgttacctagaattttgagatactaagagaatgcaattttaaatgcccactggttttatttgttttggagagagggtctcattctgtcacccaggctagagtacagtgggaacagtcatggctcactgcagcttaagctcactgcctgggctcaagtgatcttactccagcctcccaagcagctgggactacaccaccacaggtatgcaccaccatacctggctgatttttaaaattttttctagagatgaggtctcactatgttgcccagctggtctcatactcctcagttcacgcattcctcccacctccacctcccaaactgctgggattacaggtgtgagccaccatgcccaacacccactgatctttaactctcacatgttgggcataagaagtcactatataattgttactggaaagcaagacttaacgaacaattctgactatgaaaaatgtctctttcagtttgttctgtaaatatttagaaaagtgacagctgtcaacctcagagtaactatttctaaaaatgtaaatatgtattaatccttgtatcttttatggtaattttgcatattgatatgaattatataaaattgtttaaaataaaaggtgtccttgaattactgaccacccatagatgtctactgttaccaggttttacaatgcaaattttcactaatacctgggtttaatacagctcacatcactgaatgttacacatgagtttaaatgggtaatatacaggttttgttataataaagttactgattaaatta

SEQ ID NO: 8388 - DNA, 14160 bp, Homo sapiens
ggcgcggtacaggagcagcactgccggcgggggcgggtgccagggacttggaggtggaggggacgcggcggtactctggcgtcttccgacttcgactccttaccttaaaagatgctggagtcatatgtaactccaattttaatgagctatgtgaatcgctacatcaagaacttaaagccgtcggatctacagctttcactatggggtggagacgtggtactcagcaagctcgagttaaagttggatgtgctggaacaggaactgaaattaccattcacttttttaagtggacatattcatgaattgaggattcatgtaccatggacaaaactgggttcagaaccagtggtaattaccatcaatactatggaatgcattttgaaacttaaggatgggatacaggatgaccatgaaagctgtggttctaattctaccaaccgtagtactgctgagagcacaaaatcatcaatcaaaccgcggagaatgcagcaggctgctcctacagatcctgacttaccaccaggttatgtgcagagtctgattagacgagttgtaaataatgtaaacattgtgataaataatctcatactaaaatatgttgaagatgatatcgtcctttccgtcaatatcacttctgcagaatgttatacagtaggtgaattatgggatcgtgcattcatggatatttctgcaactgatttggtgctgagaaaggttatcaatttttctgactgtacagtttgtcttgataaacggaatgccagtggtaaaatagaattttaccaggatcctttattatacaaatgttccttcagaactcgtcttcattttacatatgaaaacctaaattccaagatgccatctgttattaaaattcatactttagtggaaagtttgaaactttctatcacagatcaacaactgcctatgtttattcgtataatgcaacttggaattgctctttactatggagaaataggcaattttaaagaaggcgaaatagaggaccttacttgtcataataaagatatgctaggaaacattacaggttctgaagatgaaacaagaatagatatgcaatatcctgctcagcataaaggtcaagagttatattcacagcaagatgaggagcagccacagggatgggtgtcatgggcctggtcctttgtgcctgcaattgtgagttatgacgatggcgaggaagactttgttgggaacgatcctgcatcaaccatgcatcaacaaaaagcacagactttgaaggatcctattgtttctataggattttattgcacaaaggcaacggtgactttcaaactcacagaaatgcaagttgagagtagttattacagtccacagaaagtaaaatctaaagaagtattgtgttgggaacaagaaggaactacagttgaggcccttatgatgggagaacctttctttgattgccagattgggtttgttggttgcagagccatgtgccttaaaggaattatgggtgttaaagattttgaagagaatatgaatagaagtgaaactgaagcctgtttcttcatttgtggtgacaatttgagtacgaaaggtttcacataccttacaaattcattgtttgattaccgaagcccagaaaataatggtactcgcgcagaatttatcttggattcaactcatcataaggagacatacactgagatagctggaatgcaacggtttggggctttttatatggattacctgtatacaatggagaacactagtggcaaaggttccacaaatcaacaagacttttcttcagggaaaagtgaagatttgggaacagttcaggagaagtccaccaaaagccttgttataggtcctcttgattttcgtttggatagcagtgcggtgcataggattttgaaaatgattgtgtgtgccttggaacatgaatatgaaccatatagcaggctaaaatcagatattaaggatgaaaatgaaacaatactgaatcctgaagaggtggctcttctggaggaatatattcctactcgacatacaagtgttactctcctcaaatgtacctgcacaatttccatggctgaattcaacttgctggaccatttactacctgtcattatgggagaaaagaactcaagtaacttcatgaatactacaaacttccagtctcttcggcctttgccatccattcgaatattggtggataaaattaatctggaacattcagtgccaatgtatgctgaacagttggtgcatgtggtcagcagccttactcaaccttctgataacctgcttcattattgttatgtacactgctatcttaagatatttggtttccaggcaggactgacgtctttggattgcagtggatcttactgcttacctgtaccagttattccctctttcagcactgctctttatgggaaacttctgaaactccccacatgctggaccaaaagatctcagattgctataactgaaggtatatttgaacttccaaatctcacaattcaagctacaagagcacagacacttctcttgcaagcaatatatcaaagttggtctcatcttggaaatgtcagctcttccgcagtgattgaagctttgataaatgaaatcttcctaagtataggtgtgaaatctaagaatcccctgccaactcttgagggctcaatccagaatgttgaattgaagtactgcagcacatcattggtcaaatgtgcctctgggaccatgggatcaataaaaatttgtgccaaagccccagttgatagtggaaaagagaagttgattcccttgcttcagggtccttctgacactaaagaccttcatagcaccaagtggctcaatgagagtagaaagccagagtctctcttagctccagatttgatggccttcacaatccaagttccacaatatattgactactgccacaattccggtgctgtacttctttgcagtatacaaggactagcagttaatattgacccaatcttatatacgtggctcatctatcagcctcagaaacgaacaagtagacatatgcaacagcagcctgtggtagctgttcctcttgttatgccagtttgtagaaggaaagaggatgaggtgtctattggaagtgcccccttggcaaagcagcaatcatatcaggcctctgaatatgccagcagccctgtaaaaacaaaaacggtaacagaatcccgcccattgtcagttcctgttaaagccatgttgaatatatctgaaagctgtagaagtcctgaagaaagaatgaaggaatttattggaattgtttggaatgcagtgaagcatctcacactacagcttgaagtacaatcttgttgtgtgtttattccaaatgatagcctgccttccccaagtacaattgtatctggtgacattcctggaacagtaagaagttggtaccatggacaaaccagcatgccgggaacacttgtcctctgtttgcctcaaataaagattattagtgctgggcacaagtatatggaacctctgcaggagattccatttgttatcccacgacccatccttgaagaaggtgatgcttttccttggacgatcagcttgcataatttcagcatatatacccttcttggaaaacaagtgacactttgcctagtggaacctatgggttgcacctccactctagctgtcacgtctcaaaaactgcttgctacgggacctgatacacgacattcatttgttgtctgtctccatgttgacctagagtcactagagataaaatgctctaatccccaggtccagctcttctatgaactaactgatatcatgaataaggtctggaacaagattcagaagagaggcaatctcaacctatctccaacctctccagagaccatggcagggcctgttcctacttctccagttagaagcagtataggcacagctcctccagataccagcacatgcagcccatctgctgacattgggactactactgagggagattctatacaagcaggtgaggaatcaccattctcagattctgtgaccttggaacaaactacaagtaatattggaggaaccagtggacgtgttagtttatggatgcagtgggtgcttcccaaaattactataaagctctttgctccagatcctgaaaataaaggcacagaggtttgtatggtcagtgaactagaagatctcagtgcttccatagatgtccaggatgtatataccaaagtgaaatgtaaaatagagagtttcaatattgatcactatagaagcaggccaggggaaggttggcagtcaggacattttgaaggagtatttctacaatgcaaagaaaaatctgtgccttggggaagagtgttggtctttggggcaatgtggaggtgtcttcctttcctgtactgacaagctgaacagacgcaccttgttggttcgacccatcagcaagcaggaccctttcagtaattgctctggcttctttccttctacaactacaaaacttctagatggcactcatcagcagcatggattcctctctctgacatacacaaaagctgtaacaaaaaatgtccgccacaagttaacatcaagaaatgagcgaagaagttttcataagttatctgaaggcctaatggatggttctcctcattttcttcatgaaattcttctttcagcacaagcttttgatattgttctttattttcctttacttaatgccattgcaagtatatttcaagcaaaactaccaaagacccaaaaagagaaaagaaaatctcctggtcagcccatgaggacccatacactgacatcccgcaatttacctttgatttatgtcaacacaagtgtaatcagaatttttattccaaaaacagaagaaatgcagccaactgttgaagctaatcaggcagcaaaagaagacactgtggttttgaagattggctctgttgccatggctccccaggctgacaatccccttggcagatctgtccttaggaaagatatttaccagagagccttgaacttaggaattcttcgagatcctggatcagaaatcgaagacagacaataccaaatagatctgcagtccatcaatattggtactgcacagtggcatcaactaaaaccagagaaggaaagtgtctcaggaggggtggtaacagagactgaaaggaattctcaaaatccagcccttgagtggaatatggccagcagcatacggcggcatcaagaaaggagagcaattttgacccccgttttgacagatttttctgtccgaataactggagcacctgctgtcattttcaccaaagtagtttctccagaaaatttgcatactgaggagattttagtgtgtggccattccttagaagtgaatataaccacaaacctggacttcttcctaagtgtggctcaagttcaactcttacatcagttaatagtagcaaatatgactggactggaaccatcaaacaaggctgcagagatctctaaacaagaacagaaaaaagtggatatatttgatggaggcatggctgaaacctcatctcgctacagtggtgctcaggatagtggaattggcagtgacagtgttaaaatcagaatagtgcaaatagagcagcacagtggtgccagtcagcatcgcattgcccgtccctcacgccagtcatcaattgtaaaaaatctaaattttattccctttgacatatttattactgcaagtagaatctcactaatgacctattcctgtatggccttatccaaatcgaaatcacaagaacagaagaataatgaaaaaacagacaagagttcattaaatctcccagaagttgattcagatgttgctaagcccaaccaggcatgtatttccacggtgacagcagaagatctcttaaggagcagcatttcttttccttcagggaaaaaaataggggtcctctctcttgaaagtcttcatgcatccacaaggtcatctgctagacaagcacttggtataactattgttcggcagcctggtcgaagaggaactggtgacttacagctagagccttttctgtactttattgtgtcccagccttccttgcttctgagttgtcaccacagaaagcagcgagtggaagtatccatttttgatgctgtgcttaaaggggtggcctctgattacaaatgtatagatcctgggaagactctgcctgaagcccttgattattgcactgtttggctacagacagtgcctggagaaatagacagcaaaagtggtattccaccttcctttataacactacagattaaagactttctgaatggaccagcggatgtcaatttggatatatcaaagcctttgaaagcaaacctgagtttcaccaaactggatcagataaacctttttttaaagaagataaaaaatgcacacagtttggcacatagtgaagagacttcagccatgtccaacaccatggtgaataaggatgatcttccagtctccaaatattaccgtggaaagttgtctaaacccaaaattcatggtgatggagtgcaaaagatttcagctcaagaaaacatgtggagagctgtttcctgctttcaaaaaatttctgttcaaactactcagattgtgatctccatggaaactgtaccccataccagcaaaccatgcctgttagcatctctctcaaacctcaatggaagccttagtgtcaaggcaacacaaaaagtacctggcataattcttgggtcatcatttctactcagtataaacgattttctccttaaaacaagtctcaaagaaagaagccgcattctgataggaccatgttgtgctactgccaatctggaagctaagtggtgtaaacacagcgggaatccaggcccagaacaatccataccaaaaatatccattgacttaagaggaggtctactacaggtcttctggggtcaagaacatttgaattgtttagttcttctacatgaattactcaatggataccttaatgaggagggaaattttgaagtacaagtttctgaaccagtgcctcaaatgtcatctcctgtggaaaagaatcagacatttaaaagtgaacaaagttcagatgacctacggacaggtctatttcagtatgtacaggatgctgaatctttgaaattgcctggggtctatgaagtcttattttataatgaaactgaagattgcccagggatgatgttatggagatatccagaacctagagtactcacccttgtacgaataactcctgtaccttttaacaccacagaggatccagatattagcacagcagaccttggtgatgtgctacaggttccttgtagcttggaatactgggatgaactccagaaggtttttgttgcatttagagaatttaatctgtctgaaagcaaagtttgtgaactgcagttgccggatatcaatctcgtgaatgaccagaagaaattagtatcttcagatctttggagaattgtcttgaacagcagtcaaaatggagctgatgaccaaagctctgcaagtgagtctggttctcaaagcacttgtgatccacttgtgactccaacagccctggctgcctgtaccagagttgactcctgctttaccccatggtttgtcccatccctttgcgtttctttccagtttgctcacctggaattccatctttgtcatcaccttgaccaactaggcacagctgcaccacagtacctacagccatttgtttccgacagaaatatgccatctgaactagaatacatgattgtttccttcagagaaccacacatgtatcttcgacagtggaataatggttctgtctgtcaggagatccagttcttagctcaagcagactgtaaacttctagagtgcagaaatgtcactatgcaaagtgtggtgaaacccttcagcatcttcgggcagatggcagtttccagcgatgtagtggaaaagctgcttgactgcaccgtgatagttgattctgtatttgtaaaccttggacagcatgtagtccattcactaaacactgcaatacaagcttggcaacagaacaaatgccctgaggtagaggagttggtcttcagccattttgtgatctgtaatgacacacaggagacactgcggtttggccaggtggatactgatgaaaatattctgctggcgagtctccacagtcaccagtacagctggcgctctcacaaatccccacagctgttacacatctgtattgaaggttggggcaactggcgttggtcagagcctttcagtgtggaccatgccgggacttttattagaacaattcagtacaggggtcgaactgcttctctcatcatcaaggttcagcaactcaatggagtacaaaaacagattatcatctgtggaagacagatcatctgtagttacttgtctcaaagcatagaactaaaagtcgttcagcattacattggtcaagatggacaagctgtagttcgggaacattttgactgcctcacagccaaacagaaattgccttcgtacatactagaaaacaatgaactgacggagctgtgtgtgaaggccaaaggagatgaagactggtcaagagatgtgtgcctggaatccaaagcccctgagtacagcattgtcattcaggtgccatcttcaaacagttccattatttatgtctggtgcacagttttgactttagaacccaactctcaagtgcaacaacgaatgattgtgttcagccctctttttatcatgaggagtcatcttccagaccccattatcatacatttggagaaaaggagtctgggattgagtgaaacacaaattattccaggaaaagggcaggaaaaaccactgcaaaacatagaacctgaccttgtacatcacctgacattccaagcaagagaagaatatgatccttcagattgtgcagttcccatctcaacatccctcattaagcaaatagccactaaggtacaccctggaggcacagttaatcagatccttgacgaattctatgggccagaaaagtcgcttcaacccatatggccctataataagaaggattctgacaggaatgaacagctaagtcagtgggatagcccaatgcgagtgaagctgtcaatctggaagccatatgttagaactttgttgatagaacttctgccctgggccctgcttatcaatgaatccaaatgggacctctggctatttgaaggagagaaaattgttctacaggttcctgctggcaaaattattattcctcctaattttcaggaagcttttcaaattggaatatactgggcaaatacaaacactgtgcacaagtcagtagcaattaaactggtccataacctgacatctccaaagtggaaagatggaggtaatggtgaagttgtgacactggatgaagaagcgtttgttgatactgaaataagacttggtgcttttccaggacatcagaagttatgtcagttctgcatttcctccatggtacagcaaggtatacaaattattcagattgaagacaagactacaataatcaataatacaccatatcaaatattttataaaccacagctatctgtctgcaatccccattctggaaaggagtattttcgtgttccagacagtgctacttttagcatttgcccaggtggagagcagcctgctatgaaatccagctcccttccttgctgggacttgatgcctgacatcagtcagtcagtactggatgcatccctgcttcagaaacagatcatgctgggcttttctcctgccccaggtgctgacagctcacagtgctggagcctgccagctatagttagaccagagtttcccagacagagtgtggcagtacccctcgggaatttccgggaaaatggattctgtaccagggctatagtgctgacatatcaagaacacctcggagtgacttatttaaccctctcagaagaccctagtcctcgagtaattatccacaatagatgtccagtaaaaatgcttataaaggaaaacattaaagatattccaaagtttgaggtttattgcaaaaaaattccctccgagtgctcaattcatcatgagctgtatcatcagatttccagttatccggactgcaagaccaaagacttacttccaagcctacttttgagagttgaacctctagatgaagtaacaactgagtggagtgatgccattgacatcaacagtcagggaacacaggttgtgttcctgactggctttggctatgtgtatgtggatgttgtacatcagtgtggcacagtcttcatcactgtggccccagaaggaaaagcaggacctattttaaccaataccaacagagcgccagagaagattgttacatttaaaatgttcatcactcagttaagcctggcagtgtttgatgacctcacccaccacaaagcatcagctgagcttctgagactcacactggacaacatttttctctgtgtggccccgggagctggtcccctccctggggaagagcctgtggctgcgttgtttgaactttactgtgtggagatctgctgtggggacctgcagctagacaaccagctttataacaagtccaatttccactttgctgtcttagtctgccagggagaaaaagcagaacccattcagtgttccaaaatgcagagtctcctcatatccaacaaagagttggaagaatacaaggaaaaatgttttatcaaactttgcatcaccttaaatgaaggcaagagcatcctctgtgatattaatgagttcagctttgaattaaaacctgctcggttatacgtggaagacacatttgtatactacatcaagactttgtttgacacctaccttcctaacagcaggttggctggtcactccacacacctctccgggggtaaacaggtgttgcccatgcaggtcacacagcacgccagggccttggtgaatcctgtgaagttacggaaactggtgatccagccagtaaatttgctcgtcagcatccacgcttccctcaagctgtacatagcctcagaccacactcctctctccttctcggtgtttgaaagaggacccatcttcaccactgcgaggcagcttgtgcacgccctggcaatgcactatgccgctggggccctttttagagcaggctgggtagttgggtctctggatattcttggcagccctgcaagcctggtgagaagcatcgggaacggggtcgccgacttcttcaggcttccgtatgaggggctgacccggggccctggagccttcgtgagtggcgtctccagagggaccacatcgtttgtaaagcacatctccaaaggtaccctcacatccatcaccaacctcgccacaagcctggcccggaacatggaccggctctcactggatgaggagcactacaaccggcaggaggagtggcggcggcagctccccgagagcctgggcgaggggcttcgacagggcctgtcccggctgggcatcagcctgcttggtgcaattgctggtatagttgatcagccgatgcagaacttccagaaaacatctgaggcacaggcttcagcaggacacaaggccaagggtgtcatctcgggtgtggggaaaggaatcatgggggtgttcacaaagcccatcggaggagctgctgagctggtgtcacagactggctatggtattttacatggagctggactttctcagcttcccaaacagcgccatcagccaagtgatctacatgctgaccaggctccaaacagccatgtcaaatatgtctggaaaatgcttcagtctctgggcagaccagaagtccacatggccctggacgtggttctggtgaggggctcaggccaggagcatgaagggtgcttgctgctgacatcagaagtgctcttcgtggtgagtgtcagtgaggacacacagcagcaggccttccccgtcacagaaatcgactgtgcacaggacagcaagcagaacaacttactcacagtgcagctcaagcagccaagagtggcctgtgatgtggaggtagatggagtccgagagagactgtcagagcaacagtacaacagactggtggactacatcacaaagacatcttgtcacctggcccccagctgttcttccatgcaaataccatgccctgtggtggctgcagaacctcccccctccactgttaaaacataccattacctggttgatccacattttgctcaggtcttccttagtaaatttaccatggtgaaaaataaagccctgaggaaagggtttccttgagtcccctctgaggtgtttattcctgcttgtgtgatttagtttttgggtttctttgagacagggtctcactgcattgcccttgctgacctcaaattctggggttcaagcaatcctcccacctcaacccacaagtagctacgactgcaagcacctgccaccataaagggctgcattttgccaccataaagggctgcatttttttaaaaagcctaggcagctctaacatcatctgatatggacacaaggccaacagtttccttatttacatccttacctctaaaagatacttcaaagtgacaaaaacgtgttccttccccacttagagacaatgattaacagggccctatatgttcttaccacatacagaggatgcatttatttttgctctatgacacttgcaaaaatctctactgtaattaatttgggtctattattaactctctgttccatcatagaatgtggccaggccttacaatggagagccagagttaaaacttcaagttgcatctgtttttgggctgagtcaccacctttgcctcatgctcctttgtctgcaaaggcctaggattctttctttaaatgaaatgcttaggactttgtggcttgttacatttgtcatttaactgcagtgctattctttgaaagctgctatgtgtattttctctgaagtctgcattttactaaaatttacaacagtctgatgattgattgattactgtccaggtacattttagaaaaagtgttcttcttccagtttgttttactaagcaaactttgagtaaatcctttgtcctatattgaatccagtcccaaagtgttcaggtgagtttctctagttccataaacaaaacatacatagtgggaactccctggtatgccatagagcacacaagaaccccaatattaatgctaacaattataccagtccattttgtttattctgtggaattgacttgacaaagcatgaagatattcccagtgtctgtctgataatattttgcatctaagaatgggtttgactcaagatcttgggttaccaagatgtcttaaatgttcagtaaatatctttcttacagtccagtagcttagagcatgtttgctgattgatattacatttaaacttggggctacagcttgttacctagaattttgagatactaagagaatgcaattttaaatgcccactggttttatttgttttggagagagggtctcattctgtcacccaggctagagtacagtgggaacagtcatggctcactgcagcttaagctcactgcctgggctcaagtgatcttactccagcctcccaagcagctgggactacaccaccacaggtatgcaccaccatacctggctgatttttaaaattttttctagagatgaggtctcactatgttgcccagctggtctcatactcctcagttcacgcattcctcccacctccacctcccaaactgctgggattacaggtgtgagccaccatgcccaacacccactgatctttaactctcacatgttgggcataagaagtcactatataattgttactggaaagcaagacttaacgaacaattctgactatgaaaaatgtctctttcagtttgttctgtaaatatttagaaaagtgacagctgtcaacctcagagtaactatttctaaaaatgtaaatatgtattaatccttgtatcttttatggtaattttgcatattgatatgaattatataaaattgtttaaaataaaaggtgtccttgaattactgaccacccatagatgtctactgttaccaggttttacaatgcaaattttcactaatacctgggtttaatacagctcacatcactgaatgttacacatgagtttaaatgggtaatatacaggttttgttataataaagttactgattaaatt

SEQ ID NO: 8389 - DNA, 1626 bp, Homo sapiens
acaggagcagcactgccggcgggggcgggtgccagggacttggaggtggaggggacgcggcggtactctggcgtcttccgacttcgactccttaccttaaaagatgctggagtcatatgtaactccaattttaatgagctatgtgaatcgctacatcaagaacttaaagccgtcggatctacagctttcactatggggtggagacgtggtactcagcaagctcgagttaaagttggatgtgctggaacaggaactgaaattaccattcacttttttaagtggacatattcatgaattgaggattcatgtaccatggacaaaactgggttcagaaccagtggtaattaccatcaatactatggaatgcattttgaaacttaaggatgggatacaggatgaccatgaaagctgtggttctaattctaccaaccgtagtactgctgagagcacaaaatcatcaatcaaaccgcggagaatgcagcaggctgctcctacagatcctgacttaccaccaggttatgtgcagagtctgattagacgagttgtaaataatgtaaacattgtgataaataatctcatactaaaatatgttgaagatgatatcgtcctttccgtcaatatcacttctgcagaatgttatacagtaggtgaattatgggatcgtgcattcatggatatttctgcaactgatttggtgctgagaaaggttatcaatttttctgactgtacagtttgtcttgataaacggaatgccagtggtaaaatagaattttaccaggatcctttattatacaaatgttccttcagaactcgtcttcattttacatatgaaaacctaaattccaagatgccatctgttattaaaattcatactttagtggaaagtttgaaactttctatcacagatcaacaactgcctatgtttattcgtataatgcaacttggaattgctctttactatggagaaataggcaattttaaagaaggcgaaatagaggaccttacttgtcataataaagatatgctaggaaacattacaggttctgaagatgaaacaagaatagatatgcaatatcctgctcagcataaaggtcaagagttatattcacagcaagatgaggagcagccacagggatgggtgtcatgggcctggtcctttgtgcctgcaattgtgagttatgacgatggcgaggaagactttgttgggaacgatcctgcatcaaccatgcatcaacaaaaagcacagactttgaaggatcctattgtttctataggattttattgcacaaaggcaacggtgactttcaaagtaggtcttttctcttgctgtttatatctctatcaactttaatgcttaaatttggattgttagtacaattctagctttattcaagtttgctttgcattcagtagatgtgagatagagtctaacagttcttacttcataaaattacatggctcctccacttgaaatctttgaattctgatcccttcctgtcttcttagggcattctccacatttcttttttattagcttcatggatagttttttgccctattgaatcattcagttggtgtacaaacatgccttaatattgtcattaaaaaagaaaggaacagcaaaaa

SEQ ID NO: 8390 - DNA, 13300 bp, Homo sapiens
ggcctgcgccggaggggctgtcatttgcagcgctggtcgcagccctcagctgcgccgggcggttccggctcctccctctccttgtgcctcagcgccaccatggtgctggagtcggtggtcgcggacttgctgaaccgcttcctgggggactatgtggagaacctgaacaagtcccagctgaagctgggcatctggggcggaaatgtggctttagataatctacagataaaagaaaatgccctgagtgaattggatgttccttttaaagtcaaggctggccaaattgataaattaactttgaagattccttggaagaacctttatggagaagcagttgttgcgaccctggaaggattatacctgcttgttgtccctggagcaagtattaagtatgatgctgtaaaagaagaaaaatccttgcaggatgttaaacagaaagagctatcccgaattgaagaagcccttcaaaaagcagcagaaaaagataagccaaaagaagccaaaaaggatacatttgtggaaaaattggcaactcaagtaataaaaaatgtacaagtaaaaatcacagatattcacattaaatatgaagatgatgtcactgatccaaagcggcctctttcatttggtgtcacactgggagagcttagtctactgactgcaaatgaacactggactccatgcatattaaatgaagcagacaaaattatatacaagcttatacgacttgatagtcttagcgcctactggaatgtaaattgcagcatgtcttaccagagatcaagggaacagattttggatcagctgaaaaatgaaattcttacaagtggaaatatacccccaaattatcaatacattttccagccaatatcagcctctgcaaaactctacatgaatccttatgcagaatcagagctcaaaacgcccaaactggattgcaacatagaaatacaaaatattgccattgaactgaccaaacctcagtacttaagtatgattgaccttttggagtcagtggattatatggttaggaatgcgccttataggaaatacaagccttatttaccacttcataccaatggtcgacgatggtggaaatatgcaattgattctgttcttgaagttcatataagaaggtatacacagatgtggtcatggagtaacataaaaaagcacaggcagttactcaagagttataaaattgcctacaaaaacaagttaacacagtctaaagtctcagaagaaatacagaaagaaattcaggacttggagaagactctagatgtttttaacataattttagcaaggcaacaagcacaagttgaggtgattcggtctgggcaaaaattaaggaaaaagtctgctgacacaggcgagaaacgtggaggctggtttagtgggttgtggggtaagaaagagtctaagaaaaaggacgaagaatcattgattcctgaaactattgatgaccttatgactccagaggaaaaagataaactcttcactgccattggttatagtgagagtacccacaacctaactttacctaagcagtatgttgcccatattatgaccctgaagttagtaagcacctctgttacgataagagaaaacaagaatattccagaaatactaaaaattcagataattggcctgggcactcaagtatctcagcgaccaggagcacaagcacttaaggtagaagcgaaattagaacactggtatataacaggtttgagacagcaggatattgtgccatcacttgtggcttcaattggtgacactacatcatccttgcttaaaattaaatttgaaaccaatccggaggatagtcctgctgaccagactctgattgttcagtcccagcctgtggaggtcatctatgatgctaaaactgtcaatgcagtggttgaattctttcaatcaaataagggattggatcttgagcaaataacatcagcaacattgatgaagctggaagaaattaaggagagaacagctacaggacttacacatattattgaaactcgaaaagtccttgatttaaggataaatctgaagccttcttatctagtagttccacagacgggtttccaccatgaaaagtcagatcttctgattttagattttggtacatttcagctcaacagtaaagatcaaggtttacagaagactactaattcatctctggaagaaataatggataaggcatatgacaagtttgatgttgaaataaaaaatgtacaactactttttgcaagagcagaggaaacctggaaaaagtgtcgatttcagcatccatcaactatgcatatattgcaacccatggatattcatgttgagttggctaaggccatggtagaaaaagacattagaatggccagatttaaagtgtcaggaggacttcctttgatgcatgtgagaatttctgaccagaagatgaaagatgtgctatatttgatgaacagtatacctttgccacagaaatcatcagcccagtctccagagagacaggtatcctcaattcctattatttcaggtggtacaaaaggtctacttggtacttcactattgctagacactgtggaatcagagtctgatgatgagtattttgatgctgaagatggagaaccacagacttgtaaaagtatgaaaggatcagaacttaaaaaagctgcagaggtcccaaatgaggagctcatcaatcttctactcaagtttgaaattaaagaagtgattttggaatttactaaacagcagaaagaagaagatacaattctagtatttaatgttactcagttaggaacagaggccacaatgagaacatttgacttaactgtggtatcttatttaaagaaaatcagcttggattatcatgaaattgaaggatccaaaaggaagccccttcacttgattagctcttctgacaaacctggattagatcttttgaaagtggagtatattaaggctgataagaatggacctagttttcaaactgcttttggaaaaactgaacaaacagttaaggtggccttttcatctttaaatctgttgctgcaaacacaagctcttgtcgcttctattaattacctcacaaccattattccatctgatgatcaaagcataagtgttgctaaggaggtacaaatttcaactgaaaaacaacaaaaaaattcaactctgccaaaagcgattgtatcctccagagatagtgacattattgatttcaggctatttgccaagttgaatgctttctgtgtcattgtttgcaacgaaaagaacaatatcgccgaaatcaagattcaaggactggattcctccctttctctccagtcaagaaagcagtcactttttgcccgactagaaaatattattgtcacagatgttgatccaaagacagttcataagaaagctgtgtcaataatgggaaatgaagttttccgttttaatttggatttgtatccagatgctactgagggggatttgtatactgacatgtccaaagtggatggtgtgctgtctctgaatgttggctgtattcagattgtctatcttcataaattccttatgtcacttctgaacttcctgaataatttccagacagccaaagagtctctgagtgctgccactgcccaggctgcagaaagggctgccacaagtgtgaaagatcttgcccagaggagttttcgtgtttccatcaatattgatttgaaagcaccggttatagtcatcccacagtcttctatttccaccaatgcagtagtggtagatcttgggttaatcagagttcataatcagttcagtctggtgtctgatgaagactacttaaatcctccagtaattgatagaatggatgtgcagctaacaaagcttacactttataggacagtgatccagccaggcatctaccatcctgatattcagctgttgcacccaattaacttggaatttcttgtaaatcggaatctagctgcatcttggtaccacaaggtgcctgttgtggaaattaaaggacatcttgattcaatgaatgttagtctaaatcaagaagatcttaatcttttatttaggatactaacagaaaatctctgtgagggtactgaagacttggataaagtgaaaccaagagtacaagagacaggtgaaattaaagagccccttgaaatctctatatcacaagatgtacatgattcaaaaaatactttaacaactggagtggaagaaattaggtctgtagacatcattaatatgctgctgaattttgaaattaaagaggttgtggttactttgatgaaaaaatcagaaaagaaaggaaggcctttacatgagctaaatgtcctgcaacttggaatggaagctaaagttaaaacctatgacatgactgctaaagcttatctaaaaaaaattagtatgcagtgctttgatttcactgactctaaaggggaacctcttcacattattaactcttctaatgtgactgacgaaccccttctgaaaatgttactgacaaaggcagacagtgatggaccagaatttaaaactattcatgacagtaccaaacagagactgaaggtttcatttgcatccttagacttagtacttcatttggaagctttactttccttcatggattttttatcatctgctgctccattctctgagccttcctcttctgagaaggaatccgagctgaaaccacttgtgggggagtccagaagtatcgctgtcaaagctgtatccagcaacatttcccaaaaggatgtgtttgatttaaagatcacagctgaattaaatgcatttaatgtctttgtctgtgatcagaagtgtaacattgcagatattaaaatacatggaatggatgcctctatttctgtgaagcctaagcagactgatgtgtttgccagacttaaagatattatagttatgaatgtagatttgcagtccattcacaaaaaggctgtctctattttgggagatgaagtctttaggttccaactgactctttatccagatgccacagaaggagaggcctatgctgatatgtccaaagtagacggcaaacttagttttaaagtgggttgtattcagattgtttatgttcataaattcttcatgtctcttttgaacttcctcaacaatttccaaactgctaaagaagctttgagtacagccacagtccaggctgcagaaagagctgcttccagcatgaaagacttggctcaaaagagtttccgccttttgatggatattaatttgaaagcaccagttattattattcctcagtcttcagtatcacctaatgctgttatagcagatctgggtttaatcagagttgaaaacaagtttagcttggttcctatggaacattattctcttcctccagtcattgataaaatgaacatcgaactcactcagttgaagctgtcaagaactattttgcaggctagcttgccacaaaatgacattgaaattttaaaaccagtcaacatgcttttgtccatacagcgaaacttagcagcagcatggtatgtgcaaattccagggatggagataaaaggaaaactaaaacctatgcaggttgctctcagtgaagatgacttgacagttttaatgaaaattttgctagaaaatcttggagaagcttcctcacaaccaagccctacacagtctgtgcaggagactgtaagagtgagaaaagttgatgtttcaagtgtacctgaccatctcaaagaacaagaagattggacagactcaaagctctctatgaaccagattgtcagtctccaatttgactttcactttgaatctctttccattatcctttataacaatgatatcaaccaggaatctggagttgcatttcataatgacagtttccaacttggtgaactcagactacatcttatggcctcctcagggaagatgtttaaggatggctcaatgaatgtcagcgttaaacttaagacatgcacccttgatgatctcagagaaggaattgagagagcaacatcgagaatgattgacagaaagaatgaccaagataacaacagttctatgattgatataagttacaaacaagacaaaaatggaagtcaaattgatgctgttcttgacaagctgtatgtatgtgccagtgtggaatttctgatgactgtggcagatttctttatcaaagctgtgcctcagagtccagaaaatgtggcaaaagaaacacagattttaccaagacagactgccacagggaaggtcaagatagagaaagatgactctgttagaccaaatatgactttaaaggccatgatcacagatccagaagtggtatttgttgccagcctgacaaaggctgatgctcctgctctgacagcctcgtttcagtgcaacctttctctgtcaacatccaaactcgaacagatgatggaagcttctgtgagagatctgaaagtgctcgcttgcccttttctcagagaaaagagagggaaaaacattaccacagtcttgcagccctgttctttatttatggaaaaatgtacgtgggcttcaggaaagcaaaatataaatattatggttaaagaatttataattaagatttcacccataattcttaatactgtgttgacaatcatggctgcattgtctccaaaaacaaaagaagatggatccaaagatacgtctaaggaaatggaaaatctttggggtatcaaatcgattaatgattataacacttggtttcttggtgttgacacggcaacagaaataacggaaagcttcaaaggcattgaacattcactgatagaggaaaattgtggtgttgttgtagaatccattcaagttaccttagaatgtggccttggacatcgaactgtacctttattattggcagagtctaagttttcaggaaatattaaaaattggacttctctaatggctgctgttgctgacgtgacactacaggtgcactattacaatgagatccatgctgtctgggagccactgattgagagagtggaggggaagagacaatggaatttaaggcttgatgtaaagaagaacccagttcaggataaaagtttgctgccaggagatgattttattcctgagccacaaatggcaattcatatttcttcaggaaatacaatgaatataacaatatccaaaagttgtcttaatgttttcaacaatttagcaaaaggtttttcagagggcactgcttctacttttgactactctttaaaggacagagctccttttacggtaaaaaatgctgtaggtgttcccattaaggtgaagcccaattgtaatctcagagtaatgggcttccctgagaaaagtgatatttttgatgttgatgctggccagaatttggaactggagtatgccagcatggtaccttcaagtcaagggaacctatctatattgagccgtcaagaaagctccttcttcactctgaccattgtacctcatggatatacagaagttgcaaatatccctgtggccagacctggacggcgattgtataatgtacggaatcccaatgccagtcattctgactctgtcttggtacaaattgatgcaactgaagggaataaagtaattacccttcgctctcctctacagatcaaaaaccatttctccattgcatttatcatctataaatttgttaagaatgttaagctattggagcgcattgggatagccagacctgaagaggagttccatgttcctttagattcatatagatgtcaattgtttatccagccagctggaatcttagagcatcagtacaaagaatctaccacttatatttcctggaaggaagaacttcataggagcagggaagtcagatgcatgttgcagtgtccatcagtagaagtcagcttcttacctctcatagtgaatacagttgctctgcctgatgaattgagctacatatgtacacatggggaagactgggatgtagcttacattattcatctttatccttctctcactttgcggaatcttctcccatattccctaagatatttacttgagggaacagcagaaactcatgagctggcagaaggcagtactgctgatgttctgcattcgagaatcagtggtgaaataatggaattagtcctggtgaaataccagggcaaaaactggaatggacatttccgcatacgtgatacactaccagaattctttcctgtgtgtttttcttctgactccacagaagtgacgacagtcgacctgtcagtccacgtcaggagaattggcagccggatggtgctgtctgtctttagtccctattggttaatcaacaagactacccgggttctccagtatcgttcagaagatattcatgtgaaacatccagctgatttcagggatattattttattttctttcaagaagaagaacatttttactaaaaataaggtacaattaaaaatttcaaccagtgcctggtccagtagtttctcattggatacagtgggaagttatgggtgtgtgaagtgtcctgccaacaatatggagtacctggttggtgttagcatcaaaatgagcagtttcaacctttcacgaatagttaccctgactcccttttgtaccattgcaaacaagtcatcattagaactagaagttggcgagattgcatctgatggctcaatgccaactaataaatggaactatattgcttcttcagagtgccttccattttggccagaaagtttgtcaggcaaactttgtgtgagagtggtgggctgtgaaggatcttccaaaccattcttttataaccgacaggataatggcactttattgagcttagaagatctgaatgggggtatcttggtggatgtaaacactgccgaacattcaactgtcataactttttctgattaccatgagggatctgcacctgccttgataatgaaccatacaccatgggacatcctcacatacaaacagagtgggtcaccagaagaaatggtcttgctgccaagacaggctcgactttttgcctgggcagatcctactggtaccagaaaacttacatggacatatgcagcaaatgttggggaacatgatctgttaaaggatggatgtggacagtttccatatgatgcaaacatccagatacactgggtatcatttctggatgggcgccagagagttttgcttttcaccgatgatgttgccttggtttccaaagcactgcaggcagaagaaatggaacaggctgattatgaaataaccttgtctctccacagtcttgggctttcactggttaacaatgaaagcaagcaggaagtttcctatattgggataaccagttctggtgttgtttgggaggtgaaaccaaagcagaaatggaagccatttagtcaaaagcagataatcttattggaacaatcctatcagaaacatcaaatatcaagagaccatggctggattaagctagataataattttgaggtcaattttgataaagatccaatggaaatgcgcctccctattcgtagccctattaaacgagactttttatcaggaattcagattgaatttaagcagtcttctcaccagagaagtttaagggccaggttgtactggcttcaggttgataatcagttaccaggtgcaatgttccctgttgtatttcatcctgttgcccctccaaaatctattgctttagattcagagcccaagcctttcattgatgtgagtgtcatcacaagatttaatgagtacagtaaagtcttacagttcaagtattttatggtcctcattcaggaaatggccttaaaaattgatcaagggtttctaggagctattattgcactgtttaccccaacaacagaccctgaagctgaaagaagacggacaaagttaatccaacaagatattgatgctctaaatgcagaattaatggagacttcaatgactgatatgtcaattcttagtttctttgaacatttccatatttctcctgtgaagttgcatttgagtttgtctttgggttccggaggtgaagaatcagacaaagaaaaacaggaaatgtttgcagttcattctgtcaacttgctgttgaaaagcataggtgctactctgactgatgtggatgaccttatattcaaacttgcttattatgaaattcgatatcagttctacaagagagatcagcttatatggagtgttgttaggcattacagtgaacagttcttgaaacagatgtatgtccttgtattggggttagatgtacttggaaacccatttggattaattagaggtctgtctgaaggagttgaagctttattctatgaacccttccagggtgctgttcaaggccctgaagaatttgcagaggggttagtgattggagtgagaagcctctttggacacacagtaggtggtgcagcaggagttgtatctcgaatcaccggttctgttgggaaaggtttggcagcaattacaatggacaaggaatatcagcaaaaaagaagagaagagttgagtcgacagcccagagattttggagacagcctggccagaggaggaaagggctttctgcgaggagttgttggtggagtgactggaataataacaaaacctgtggaaggtgccaaaaaggaaggagctgctggattctttaaaggaattggaaaagggcttgtgggtgctgtggcccgtccaactggtggaatcgtagatatggccagtagtaccttccaaggcattcagagggcagcagaatcaactgaggaagtatctagcctccgtccccctcgcctgatccatgaagatggcatcattcgtccttatgacagacaggaatctgagggctctgacttacttgagaatcatatcaaaaagttggaaggagagacttaccgataccactgtgctattcctggaagcaagaagacaatccttatggttacaaataggcgagtgttgtgtataaaggaagttgaaatcctgggccttatgtgtgtagactggcaatgtccatttgaagattttgtatttcctcctagtgtcagtgaaaatgtgctaaaaatttcagttaaggaacagggtctgttccacaaaaaagacagtgccaatcaaggctgtgttcgaaaagtttacctgaaggacaccgccacagcagagagagcatgtaatgccattgaggatgcacagtcaacgagacagcagcaaaaattgatgaagcagtcatcagtgagacttctcagaccccaattgccatcttaatcacagacctcaggggctccaacagggagaaaaaacaatcactggtcttgtctataagtcactctgctttatcttgctaaagacaatttttcaagcaatcctttagttttagttttctggaatagctagtattgggttttctagttttttcaccttttagtttttactctaattttgtaaccatgtatatgctagcagtccacttctacgccaccacccaaatgggtcagacccttgaagaaacgtcacttcaaactcagaatgaaattttcattaatattaaaattgtgaagcaaaggtcaataggcttatatttaattaaagccttactgaagaataagaaatgagcttagaatgactagtgttctttgaaaggtttttttatttttgtttttttggggttttttttttttttgagaccgagtcttgctctgtcgcccaggctggaatgcagtggtgcgatcttggctcactgcaatctctgcctctcgggttcaagctgttctactgcctcagcctcctgagtagctgggattacaggtgtgtgccaccacgcctgggtaattttttttttttttgtatttttagtagagatgagtttcaccatgttggtcagtctagtctcgaactcctgaccttgtgatccgcatgcctcagcctcccaaagtgctgggattacaggcatgagccaccacggcccgccaaaaggctttaacccatgaacaaatgttggatcctgacattttgtttaagagtgatttgttcaataattgaactgagttaacattcttggtaaaccaggtaattgaatgaagaaaggtcactaaagggagaaatgacatgttttctattttcttttcatgaaaacactgtttttccccctaataaagcatattttactttggtgcttatttttcctccttgcagtctaataaaaaaatctggacaatcaaaccttaaaatagctacactctgccctctgtaatgtagcattcataaaaatttggaagtatttacatcctctttcaagatgagcttatatgacacaattattatttgctgatacatgaaaatactgcactttaagtttctcaagactctgaaatatgtaaaattcaatatttttatattcccagaaattgtttcttacaggttgaaagtcttttaagggcatcacaaattaacatttactcctaatgcacgcctagaatgtattttaaatacttactaagaagaatgaaaattctttggttgttttatatataaataaggcatatataatgacactgtgttctgtgagggagcaggccctgtgagaatcaattcaggacagtatttttttttgtcctttctccatccttgatcagagataaactattaaaactttaaaaaatactcaaaaatatgtaagttttttggttgaacctttagatttgctcataatgtttaacataacaacatttatttcaaatcactgaattcatggagatgtggacacgcttggtttgctctatttttgtttatgtgtgatagtggttctgtcatcatcattcatgttttttaaggcctggtcataaaactttaaattttactagtgttacttaatgtatattctaaaaagagaatgcagtaactaatgccctaaatgtttgatctctgtttgtcattactttttcaaaattatttttttctgtaaagtataatatataaaacttcttgcttaaattgaatttctatattagtggttaattgcagtttattaaagggatcattatcagtaatttcatagcaactgttctagtgttttgtgtttttaaaacagaattaggaatttgagatatctgattatatttttcatatgaatcacagctgttgacaatgtcccatatatttaagaaattatatcatactgatactatttgtaacattttgatttgatttaatctccagggacagaaataattcattggtaaagtgtaataatgcgttttttaaaaatgctttgagaggtaattacttgcatatgagagaaataaaacatttggcacattgtttacaggtgtgaaaa

SEQ ID NO: 8391 - DNA, 13400 bp, Homo sapiens
tgcagcgctggtcgcagccctcagctgcgccgggcggttccggctcctccctctccttgtgcctcagcgccaccatggtgctggagtcggtggtcgcggacttgctgaaccgcttcctgggggactatgtggagaacctgaacaagtcccagctgaagctgggcatctggggcggaaatgtggctttagataatctacagataaaagaaaatgccctgagtgaattggatgttccttttaaagtcaaggctggccaaattgataaattaactttgaagattccttggaagaacctttatggagaagcagttgttgcgaccctggaaggattatacctgcttgttgtccctggagcaagtattaagtatgatgctgtaaaagaagaaaaatccttgcaggatgttaaacagaaagagctatcccgaattgaagaagcccttcaaaaagcagcagaaaaaggcacacattcaggggagttcatatatggcttggagaactttgtttacaaggacatcaagcctggacgtaaacgtaaaaagcacaaaaaacattttaagaaaccttttaaaggtcttgatcgttcaaaagataagccaaaagaagccaaaaaggatacatttgtggaaaaattggcaactcaagtaataaaaaatgtacaagtaaaaatcacagatattcacattaaatatgaagatgatgtcactgatccaaagcggcctctttcatttggtgtcacactgggagagcttagtctactgactgcaaatgaacactggactccatgcatattaaatgaagcagacaaaattatatacaagcttatacgacttgatagtcttagcgcctactggaatgtaaattgcagcatgtcttaccagagatcaagggaacagattttggatcagctgaaaaatgaaattcttacaagtggaaatatacccccaaattatcaatacattttccagccaatatcagcctctgcaaaactctacatgaatccttatgcagaatcagagctcaaaacgcccaaactggattgcaacatagaaatacaaaatattgccattgaactgaccaaacctcagtacttaagtatgattgaccttttggagtcagtggattatatggttaggaatgcgccttataggaaatacaagccttatttaccacttcataccaatggtcgacgatggtggaaatatgcaattgattctgttcttgaagttcatataagaaggtatacacagatgtggtcatggagtaacataaaaaagcacaggcagttactcaagagttataaaattgcctacaaaaacaagttaacacagtctaaagtctcagaagaaatacagaaagaaattcaggacttggagaagactctagatgtttttaacataattttagcaaggcaacaagcacaagttgaggtgattcggtctgggcaaaaattaaggaaaaagtctgctgacacaggcgagaaacgtggaggctggtttagtgggttgtggggtaagaaagagtctaagaaaaaggacgaagaatcattgattcctgaaactattgatgaccttatgactccagaggaaaaagataaactcttcactgccattggttatagtgagagtacccacaacctaactttacctaagcagtatgttgcccatattatgaccctgaagttagtaagcacctctgttacgataagagaaaacaagaatattccagaaatactaaaaattcagataattggcctgggcactcaagtatctcagcgaccaggagcacaagcacttaaggtagaagcgaaattagaacactggtatataacaggtttgagacagcaggatattgtgccatcacttgtggcttcaattggtgacactacatcatccttgcttaaaattaaatttgaaaccaatccggaggatagtcctgctgaccagactctgattgttcagtcccagcctgtggaggtcatctatgatgctaaaactgtcaatgcagtggttgaattctttcaatcaaataagggattggatcttgagcaaataacatcagcaacattgatgaagctggaagaaattaaggagagaacagctacaggacttacacatattattgaaactcgaaaagtccttgatttaaggataaatctgaagccttcttatctagtagttccacagacgggtttccaccatgaaaagtcagatcttctgattttagattttggtacatttcagctcaacagtaaagatcaaggtttacagaagactactaattcatctctggaagaaataatggataaggcatatgacaagtttgatgttgaaataaaaaatgtacaactactttttgcaagagcagaggaaacctggaaaaagtgtcgatttcagcatccatcaactatgcatatattgcaacccatggatattcatgttgagttggctaaggccatggtagaaaaagacattagaatggccagatttaaagtgtcaggaggacttcctttgatgcatgtgagaatttctgaccagaagatgaaagatgtgctatatttgatgaacagtatacctttgccacagaaatcatcagcccagtctccagagagacaggtatcctcaattcctattatttcaggtggtacaaaaggtctacttggtacttcactattgctagacactgtggaatcagagtctgatgatgagtattttgatgctgaagatggagaaccacagacttgtaaaagtatgaaaggatcagaacttaaaaaagctgcagaggtcccaaatgaggagctcatcaatcttctactcaagtttgaaattaaagaagtgattttggaatttactaaacagcagaaagaagaagatacaattctagtatttaatgttactcagttaggaacagaggccacaatgagaacatttgacttaactgtggtatcttatttaaagaaaatcagcttggattatcatgaaattgaaggatccaaaaggaagccccttcacttgattagctcttctgacaaacctggattagatcttttgaaagtggagtatattaaggctgataagaatggacctagttttcaaactgcttttggaaaaactgaacaaacagttaaggtggccttttcatctttaaatctgttgctgcaaacacaagctcttgtcgcttctattaattacctcacaaccattattccatctgatgatcaaagcataagtgttgctaaggaggtacaaatttcaactgaaaaacaacaaaaaaattcaactctgccaaaagcgattgtatcctccagagatagtgacattattgatttcaggctatttgccaagttgaatgctttctgtgtcattgtttgcaacgaaaagaacaatatcgccgaaatcaagattcaaggactggattcctccctttctctccagtcaagaaagcagtcactttttgcccgactagaaaatattattgtcacagatgttgatccaaagacagttcataagaaagctgtgtcaataatgggaaatgaagttttccgttttaatttggatttgtatccagatgctactgagggggatttgtatactgacatgtccaaagtggatggtgtgctgtctctgaatgttggctgtattcagattgtctatcttcataaattccttatgtcacttctgaacttcctgaataatttccagacagccaaagagtctctgagtgctgccactgcccaggctgcagaaagggctgccacaagtgtgaaagatcttgcccagaggagttttcgtgtttccatcaatattgatttgaaagcaccggttatagtcatcccacagtcttctatttccaccaatgcagtagtggtagatcttgggttaatcagagttcataatcagttcagtctggtgtctgatgaagactacttaaatcctccagtaattgatagaatggatgtgcagctaacaaagcttacactttataggacagtgatccagccaggcatctaccatcctgatattcagctgttgcacccaattaacttggaatttcttgtaaatcggaatctagctgcatcttggtaccacaaggtgcctgttgtggaaattaaaggacatcttgattcaatgaatgttagtctaaatcaagaagatcttaatcttttatttaggatactaacagaaaatctctgtgagggtactgaagacttggataaagtgaaaccaagagtacaagagacaggtgaaattaaagagccccttgaaatctctatatcacaagatgtacatgattcaaaaaatactttaacaactggagtggaagaaattaggtctgtagacatcattaatatgctgctgaattttgaaattaaagaggttgtggttactttgatgaaaaaatcagaaaagaaaggaaggcctttacatgagctaaatgtcctgcaacttggaatggaagctaaagttaaaacctatgacatgactgctaaagcttatctaaaaaaaattagtatgcagtgctttgatttcactgactctaaaggggaacctcttcacattattaactcttctaatgtgactgacgaaccccttctgaaaatgttactgacaaaggcagacagtgatggaccagaatttaaaactattcatgacagtaccaaacagagactgaaggtttcatttgcatccttagacttagtacttcatttggaagctttactttccttcatggattttttatcatctgctgctccattctctgagccttcctcttctgagaaggaatccgagctgaaaccacttgtgggggagtccagaagtatcgctgtcaaagctgtatccagcaacatttcccaaaaggatgtgtttgatttaaagatcacagctgaattaaatgcatttaatgtctttgtctgtgatcagaagtgtaacattgcagatattaaaatacatggaatggatgcctctatttctgtgaagcctaagcagactgatgtgtttgccagacttaaagatattatagttatgaatgtagatttgcagtccattcacaaaaaggctgtctctattttgggagatgaagtctttaggttccaactgactctttatccagatgccacagaaggagaggcctatgctgatatgtccaaagtagacggcaaacttagttttaaagtgggttgtattcagattgtttatgttcataaattcttcatgtctcttttgaacttcctcaacaatttccaaactgctaaagaagctttgagtacagccacagtccaggctgcagaaagagctgcttccagcatgaaagacttggctcaaaagagtttccgccttttgatggatattaatttgaaagcaccagttattattattcctcagtcttcagtatcacctaatgctgttatagcagatctgggtttaatcagagttgaaaacaagtttagcttggttcctatggaacattattctcttcctccagtcattgataaaatgaacatcgaactcactcagttgaagctgtcaagaactattttgcaggctagcttgccacaaaatgacattgaaattttaaaaccagtcaacatgcttttgtccatacagcgaaacttagcagcagcatggtatgtgcaaattccagggatggagataaaaggaaaactaaaacctatgcaggttgctctcagtgaagatgacttgacagttttaatgaaaattttgctagaaaatcttggagaagcttcctcacaaccaagccctacacagtctgtgcaggagactgtaagagtgagaaaagttgatgtttcaagtgtacctgaccatctcaaagaacaagaagattggacagactcaaagctctctatgaaccagattgtcagtctccaatttgactttcactttgaatctctttccattatcctttataacaatgatatcaaccaggaatctggagttgcatttcataatgacagtttccaacttggtgaactcagactacatcttatggcctcctcagggaagatgtttaaggatggctcaatgaatgtcagcgttaaacttaagacatgcacccttgatgatctcagagaaggaattgagagagcaacatcgagaatgattgacagaaagaatgaccaagataacaacagttctatgattgatataagttacaaacaagacaaaaatggaagtcaaattgatgctgttcttgacaagctgtatgtatgtgccagtgtggaatttctgatgactgtggcagatttctttatcaaagctgtgcctcagagtccagaaaatgtggcaaaagaaacacagattttaccaagacagactgccacagggaaggtcaagatagagaaagatgactctgttagaccaaatatgactttaaaggccatgatcacagatccagaagtggtatttgttgccagcctgacaaaggctgatgctcctgctctgacagcctcgtttcagtgcaacctttctctgtcaacatccaaactcgaacagatgatggaagcttctgtgagagatctgaaagtgctcgcttgcccttttctcagagaaaagagagggaaaaacattaccacagtcttgcagccctgttctttatttatggaaaaatgtacgtgggcttcaggaaagcaaaatataaatattatggttaaagaatttataattaagatttcacccataattcttaatactgtgttgacaatcatggctgcattgtctccaaaaacaaaagaagatggatccaaagatacgtctaaggaaatggaaaatctttggggtatcaaatcgattaatgattataacacttggtttcttggtgttgacacggcaacagaaataacggaaagcttcaaaggcattgaacattcactgatagaggaaaattgtggtgttgttgtagaatccattcaagttaccttagaatgtggccttggacatcgaactgtacctttattattggcagagtctaagttttcaggaaatattaaaaattggacttctctaatggctgctgttgctgacgtgacactacaggtgcactattacaatgagatccatgctgtctgggagccactgattgagagagtggaggggaagagacaatggaatttaaggcttgatgtaaagaagaacccagttcaggataaaagtttgctgccaggagatgattttattcctgagccacaaatggcaattcatatttcttcaggaaatacaatgaatataacaatatccaaaagttgtcttaatgttttcaacaatttagcaaaaggtttttcagagggcactgcttctacttttgactactctttaaaggacagagctccttttacggtaaaaaatgctgtaggtgttcccattaaggtgaagcccaattgtaatctcagagtaatgggcttccctgagaaaagtgatatttttgatgttgatgctggccagaatttggaactggagtatgccagcatggtaccttcaagtcaagggaacctatctatattgagccgtcaagaaagctccttcttcactctgaccattgtacctcatggatatacagaagttgcaaatatccctgtggccagacctggacggcgattgtataatgtacggaatcccaatgccagtcattctgactctgtcttggtacaaattgatgcaactgaagggaataaagtaattacccttcgctctcctctacagatcaaaaaccatttctccattgcatttatcatctataaatttgttaagaatgttaagctattggagcgcattgggatagccagacctgaagaggagttccatgttcctttagattcatatagatgtcaattgtttatccagccagctggaatcttagagcatcagtacaaagaatctaccacttatatttcctggaaggaagaacttcataggagcagggaagtcagatgcatgttgcagtgtccatcagtagaagtcagcttcttacctctcatagtgaatacagttgctctgcctgatgaattgagctacatatgtacacatggggaagactgggatgtagcttacattattcatctttatccttctctcactttgcggaatcttctcccatattccctaagatatttacttgagggaacagcagaaactcatgagctggcagaaggcagtactgctgatgttctgcattcgagaatcagtggtgaaataatggaattagtcctggtgaaataccagggcaaaaactggaatggacatttccgcatacgtgatacactaccagaattctttcctgtgtgtttttcttctgactccacagaagtgacgacagtcgacctgtcagtccacgtcaggagaattggcagccggatggtgctgtctgtctttagtccctattggttaatcaacaagactacccgggttctccagtatcgttcagaagatattcatgtgaaacatccagctgatttcagggatattattttattttctttcaagaagaagaacatttttactaaaaataaggtacaattaaaaatttcaaccagtgcctggtccagtagtttctcattggatacagtgggaagttatgggtgtgtgaagtgtcctgccaacaatatggagtacctggttggtgttagcatcaaaatgagcagtttcaacctttcacgaatagttaccctgactcccttttgtaccattgcaaacaagtcatcattagaactagaagttggcgagattgcatctgatggctcaatgccaactaataaatggaactatattgcttcttcagagtgccttccattttggccagaaagtttgtcaggcaaactttgtgtgagagtggtgggctgtgaaggatcttccaaaccattcttttataaccgacaggataatggcactttattgagcttagaagatctgaatgggggtatcttggtggatgtaaacactgccgaacattcaactgtcataactttttctgattaccatgagggatctgcacctgccttgataatgaaccatacaccatgggacatcctcacatacaaacagagtgggtcaccagaagaaatggtcttgctgccaagacaggctcgactttttgcctgggcagatcctactggtaccagaaaacttacatggacatatgcagcaaatgttggggaacatgatctgttaaaggatggatgtggacagtttccatatgatgcaaacatccagatacactgggtatcatttctggatgggcgccagagagttttgcttttcaccgatgatgttgccttggtttccaaagcactgcaggcagaagaaatggaacaggctgattatgaaataaccttgtctctccacagtcttgggctttcactggttaacaatgaaagcaagcaggaagtttcctatattgggataaccagttctggtgttgtttgggaggtgaaaccaaagcagaaatggaagccatttagtcaaaagcagataatcttattggaacaatcctatcagaaacatcaaatatcaagagaccatggctggattaagctagataataattttgaggtcaattttgataaagatccaatggaaatgcgcctccctattcgtagccctattaaacgagactttttatcaggaattcagattgaatttaagcagtcttctcaccagagaagtttaagggccaggttgtactggcttcaggttgataatcagttaccaggtgcaatgttccctgttgtatttcatcctgttgcccctccaaaatctattgctttagattcagagcccaagcctttcattgatgtgagtgtcatcacaagatttaatgagtacagtaaagtcttacagttcaagtattttatggtcctcattcaggaaatggccttaaaaattgatcaagggtttctaggagctattattgcactgtttaccccaacaacagaccctgaagctgaaagaagacggacaaagttaatccaacaagatattgatgctctaaatgcagaattaatggagacttcaatgactgatatgtcaattcttagtttctttgaacatttccatatttctcctgtgaagttgcatttgagtttgtctttgggttccggaggtgaagaatcagacaaagaaaaacaggaaatgtttgcagttcattctgtcaacttgctgttgaaaagcataggtgctactctgactgatgtggatgaccttatattcaaacttgcttattatgaaattcgatatcagttctacaagagagatcagcttatatggagtgttgttaggcattacagtgaacagttcttgaaacagatgtatgtccttgtattggggttagatgtacttggaaacccatttggattaattagaggtctgtctgaaggagttgaagctttattctatgaacccttccagggtgctgttcaaggccctgaagaatttgcagaggggttagtgattggagtgagaagcctctttggacacacagtaggtggtgcagcaggagttgtatctcgaatcaccggttctgttgggaaaggtttggcagcaattacaatggacaaggaatatcagcaaaaaagaagagaagagttgagtcgacagcccagagattttggagacagcctggccagaggaggaaagggctttctgcgaggagttgttggtggagtgactggaataataacaaaacctgtggaaggtgccaaaaaggaaggagctgctggattctttaaaggaattggaaaagggcttgtgggtgctgtggcccgtccaactggtggaatcgtagatatggccagtagtaccttccaaggcattcagagggcagcagaatcaactgaggaagtatctagcctccgtccccctcgcctgatccatgaagatggcatcattcgtccttatgacagacaggaatctgagggctctgacttacttgagaatcatatcaaaaagttggaaggagagacttaccgataccactgtgctattcctggaagcaagaagacaatccttatggttacaaataggcgagtgttgtgtataaaggaagttgaaatcctgggccttatgtgtgtagactggcaatgtccatttgaagattttgtatttcctcctagtgtcagtgaaaatgtgctaaaaatttcagttaaggaacagggtctgttccacaaaaaagacagtgccaatcaaggctgtgttcgaaaagtttacctgaaggacaccgccacagcagagagagcatgtaatgccattgaggatgcacagtcaacgagacagcagcaaaaattgatgaagcagtcatcagtgagacttctcagaccccaattgccatcttaatcacagacctcaggggctccaacagggagaaaaaacaatcactggtcttgtctataagtcactctgctttatcttgctaaagacaatttttcaagcaatcctttagttttagttttctggaatagctagtattgggttttctagttttttcaccttttagtttttactctaattttgtaaccatgtatatgctagcagtccacttctacgccaccacccaaatgggtcagacccttgaagaaacgtcacttcaaactcagaatgaaattttcattaatattaaaattgtgaagcaaaggtcaataggcttatatttaattaaagccttactgaagaataagaaatgagcttagaatgactagtgttctttgaaaggtttttttatttttgtttttttggggttttttttttttttgagaccgagtcttgctctgtcgcccaggctggaatgcagtggtgcgatcttggctcactgcaatctctgcctctcgggttcaagctgttctactgcctcagcctcctgagtagctgggattacaggtgtgtgccaccacgcctgggtaattttttttttttttgtatttttagtagagatgagtttcaccatgttggtcagtctagtctcgaactcctgaccttgtgatccgcatgcctcagcctcccaaagtgctgggattacaggcatgagccaccacggcccgccaaaaggctttaacccatgaacaaatgttggatcctgacattttgtttaagagtgatttgttcaataattgaactgagttaacattcttggtaaaccaggtaattgaatgaagaaaggtcactaaagggagaaatgacatgttttctattttcttttcatgaaaacactgtttttccccctaataaagcatattttactttggtgcttatttttcctccttgcagtctaataaaaaaatctggacaatcaaaccttaaaatagctacactctgccctctgtaatgtagcattcataaaaatttggaagtatttacatcctctttcaagatgagcttatatgacacaattattatttgctgatacatgaaaatactgcactttaagtttctcaagactctgaaatatgtaaaattcaatatttttatattcccagaaattgtttcttacaggttgaaagtcttttaagggcatcacaaattaacatttactcctaatgcacgcctagaatgtattttaaatacttactaagaagaatgaaaattctttggttgttttatatataaataaggcatatataatgacactgtgttctgtgagggagcaggccctgtgagaatcaattcaggacagtatttttttttgtcctttctccatccttgatcagagataaactattaaaactttaaaaaatactcaaaaatatgtaagttttttggttgaacctttagatttgctcataatgtttaacataacaacatttatttcaaatcactgaattcatggagatgtggacacgcttggtttgctctatttttgtttatgtgtgatagtggttctgtcatcatcattcatgttttttaaggcctggtcataaaactttaaattttactagtgttacttaatgtatattctaaaaagagaatgcagtaactaatgccctaaatgtttgatctctgtttgtcattactttttcaaaattatttttttctgtaaagtataatatataaaacttcttgcttaaattgaatttctatattagtggttaattgcagtttattaaagggatcattatcagtaatttcatagcaactgttctagtgttttgtgtttttaaaacagaattaggaatttgagatatctgattatatttttcatatgaatcacagctgttgacaatgtcccatatatttaagaaattatatcatactgatactatttgtaacattttgatttgatttaatctccagggacagaaataattcattggtaaagtgtaataatgcgttttttaaaaatgctttgagaggtaattacttgcatatgagagaaataaaacatttggcacattgtttacaggtgtg

SEQ ID NO: 8392 - DNA, 11923 bp, Homo sapiens
tgcagcgctggtcgcagccctcagctgcgccgggcggttccggctcctccctctccttgtgcctcagcgccaccatggtgctggagtcggtggtcgcggacttgctgaaccgcttcctgggggactatgtggagaacctgaacaagtcccagctgaagctgggcatctggggcggaaatgtggctttagataatctacagataaaagaaaatgccctgagtgaattggatgttccttttaaagtcaaggctggccaaattgataaattaactttgaagattccttggaagaacctttatggagaagcagttgttgcgaccctggaaggattatacctgcttgttgtccctggagcaagtattaagtatgatgctgtaaaagaagaaaaatccttgcaggatgttaaacagaaagagctatcccgaattgaagaagcccttcaaaaagcagcagaaaaaggcacacattcaggggagttcatatatggcttggagaactttgtttacaaggacatcaagcctggacgtaaacgtaaaaagcacaaaaaacattttaagaaaccttttaaaggtcttgatcgttcaaaagataagccaaaagaagccaaaaaggatacatttgtggaaaaattggcaactcaagtaataaaaaatgtacaagtaaaaatcacagatattcacattaaatatgaagatgatgtcactgatccaaagcggcctctttcatttggtgtcacactgggagagcttagtctactgactgcaaatgaacactggactccatgcatattaaatgaagcagacaaaattatatacaagcttatacgacttgatagtcttagcgcctactggaatgtaaattgcagcatgtcttaccagagatcaagggaacagattttggatcagctgaaaaatgaaattcttacaagtggaaatatacccccaaattatcaatacattttccagccaatatcagcctctgcaaaactctacatgaatccttatgcagaatcagagctcaaaacgcccaaactggattgcaacatagaaatacaaaatattgccattgaactgaccaaacctcagtacttaagtatgattgaccttttggagtcagtggattatatggttaggaatgcgccttataggaaatacaagccttatttaccacttcataccaatggtcgacgatggtggaaatatgcaattgattctgttcttgaagttcatataagaaggtatacacagatgtggtcatggagtaacataaaaaagcacaggcagttactcaagagttataaaattgcctacaaaaacaagttaacacagtctaaagtctcagaagaaatacagaaagaaattcaggacttggagaagactctagatgtttttaacataattttagcaaggcaacaagcacaagttgaggtgattcggtctgggcaaaaattaaggaaaaagtctgctgacacaggcgagaaacgtggaggctggtttagtgggttgtggggtaagaaagagtctaagaaaaaggacgaagaatcattgattcctgaaactattgatgaccttatgactccagaggaaaaagataaactcttcactgccattggttatagtgagagtacccacaacctaactttacctaagcagtatgttgcccatattatgaccctgaagttagtaagcacctctgttacgataagagaaaacaagaatattccagaaatactaaaaattcagataattggcctgggcactcaagtatctcagcgaccaggagcacaagcacttaaggtagaagcgaaattagaacactggtatataacaggtttgagacagcaggatattgtgccatcacttgtggcttcaattggtgacactacatcatccttgcttaaaattaaatttgaaaccaatccggaggatagtcctgctgaccagactctgattgttcagtcccagcctgtggaggtcatctatgatgctaaaactgtcaatgcagtggttgaattctttcaatcaaataagggattggatcttgagcaaataacatcagcaacattgatgaagctggaagaaattaaggagagaacagctacaggacttacacatattattgaaactcgaaaagtccttgatttaaggataaatctgaagccttcttatctagtagttccacagacgggtttccaccatgaaaagtcagatcttctgattttagattttggtacatttcagctcaacagtaaagatcaaggtttacagaagactactaattcatctctggaagaaataatggataaggcatatgacaagtttgatgttgaaataaaaaatgtacaactactttttgcaagagcagaggaaacctggaaaaagtgtcgatttcagcatccatcaactatgcatatattgcaacccatggatattcatgttgagttggctaaggccatggtagaaaaagacattagaatggccagatttaaagtgtcaggaggacttcctttgatgcatgtgagaatttctgaccagaagatgaaagatgtgctatatttgatgaacagtatacctttgccacagaaatcatcagcccagtctccagagagacaggtatcctcaattcctattatttcaggtggtacaaaaggtctacttggtacttcactattgctagacactgtggaatcagagtctgatgatgagtattttgatgctgaagatggagaaccacagacttgtaaaagtatgaaaggatcagaacttaaaaaagctgcagaggtcccaaatgaggagctcatcaatcttctactcaagtttgaaattaaagaagtgattttggaatttactaaacagcagaaagaagaagatacaattctagtatttaatgttactcagttaggaacagaggccacaatgagaacatttgacttaactgtggtatcttatttaaagaaaatcagcttggattatcatgaaattgaaggatccaaaaggaagccccttcacttgattagctcttctgacaaacctggattagatcttttgaaagtggagtatattaaggctgataagaatggacctagttttcaaactgcttttggaaaaactgaacaaacagttaaggtggccttttcatctttaaatctgttgctgcaaacacaagctcttgtcgcttctattaattacctcacaaccattattccatctgatgatcaaagcataagtgttgctaaggaggtacaaatttcaactgaaaaacaacaaaaaaattcaactctgccaaaagcgattgtatcctccagagatagtgacattattgatttcaggctatttgccaagttgaatgctttctgtgtcattgtttgcaacgaaaagaacaatatcgccgaaatcaagattcaaggactggattcctccctttctctccagtcaagaaagcagtcactttttgcccgactagaaaatattattgtcacagatgttgatccaaagacagttcataagaaagctgtgtcaataatgggaaatgaagttttccgttttaatttggatttgtatccagatgctactgagggggatttgtatactgacatgtccaaagtggatggtgtgctgtctctgaatgttggctgtattcagattgtctatcttcataaattccttatgtcacttctgaacttcctgaataatttccagacagccaaagagtctctgagtgctgccactgcccaggctgcagaaagggctgccacaagtgtgaaagatcttgcccagaggagttttcgtgtttccatcaatattgatttgaaagcaccggttatagtcatcccacagtcttctatttccaccaatgcagtagtggtagatcttgggttaatcagagttcataatcagttcagtctggtgtctgatgaagactacttaaatcctccagtaattgatagaatggatgtgcagctaacaaagcttacactttataggacagtgatccagccaggcatctaccatcctgatattcagctgttgcacccaattaacttggaatttcttgtaaatcggaatctagctgcatcttggtaccacaaggtgcctgttgtggaaattaaaggacatcttgattcaatgaatgttagtctaaatcaagaagatcttaatcttttatttaggatactaacagaaaatctctgtgagggtactgaagacttggataaagtgaaaccaagagtacaagagacaggtgaaattaaagagccccttgaaatctctatatcacaagatgtacatgattcaaaaaatactttaacaactggagtggaagaaattaggtctgtagacatcattaatatgctgctgaattttgaaattaaagaggttgtggttactttgatgaaaaaatcagaaaagaaaggaaggcctttacatgagctaaatgtcctgcaacttggaatggaagctaaagttaaaacctatgacatgactgctaaagcttatctaaaaaaaattagtatgcagtgctttgatttcactgactctaaaggggaacctcttcacattattaactcttctaatgtgactgacgaaccccttctgaaaatgttactgacaaaggcagacagtgatggaccagaatttaaaactattcatgacagtaccaaacagagactgaaggtttcatttgcatccttagacttagtacttcatttggaagctttactttccttcatggattttttatcatctgctgctccattctctgagccttcctcttctgagaaggaatccgagctgaaaccacttgtgggggagtccagaagtatcgctgtcaaagctgtatccagcaacatttcccaaaaggatgtgtttgatttaaagatcacagctgaattaaatgcatttaatgtctttgtctgtgatcagaagtgtaacattgcagatattaaaatacatggaatggatgcctctatttctgtgaagcctaagcagactgatgtgtttgccagacttaaagatattatagttatgaatgtagatttgcagtccattcacaaaaaggctgtctctattttgggagatgaagtctttaggttccaactgactctttatccagatgccacagaaggagaggcctatgctgatatgtccaaagtagacggcaaacttagttttaaagtgggttgtattcagattgtttatgttcataaattcttcatgtctcttttgaacttcctcaacaatttccaaactgctaaagaagctttgagtacagccacagtccaggctgcagaaagagctgcttccagcatgaaagacttggctcaaaagagtttccgccttttgatggatattaatttgaaagcaccagttattattattcctcagtcttcagtatcacctaatgctgttatagcagatctgggtttaatcagagttgaaaacaagtttagcttggttcctatggaacattattctcttcctccagtcattgataaaatgaacatcgaactcactcagttgaagctgtcaagaactattttgcaggctagcttgccacaaaatgacattgaaattttaaaaccagtcaacatgcttttgtccatacagcgaaacttagcagcagcatggtatgtgcaaattccagggatggagataaaaggaaaactaaaacctatgcaggttgctctcagtgaagatgacttgacagttttaatgaaaattttgctagaaaatcttggagaagcttcctcacaaccaagccctacacagtctgtgcaggagactgtaagagtgagaaaagttgatgtttcaagtgtacctgaccatctcaaagaacaagaagattggacagactcaaagctctctatgaaccagattgtcagtctccaatttgactttcactttgaatctctttccattatcctttataacaatgatatcaaccaggaatctggagttgcatttcataatgacagtttccaacttggtgaactcagactacatcttatggcctcctcagggaagatgtttaaggatggctcaatgaatgtcagcgttaaacttaagacatgcacccttgatgatctcagagaaggaattgagagagcaacatcgagaatgattgacagaaagaatgaccaagataacaacagttctatgattgatataagttacaaacaagacaaaaatggaagtcaaattgatgctgttcttgacaagctgtatgtatgtgccagtgtggaatttctgatgactgtggcagatttctttatcaaagctgtgcctcagagtccagaaaatgtggcaaaagaaacacagattttaccaagacagactgccacagggaaggtcaagatagagaaagatgactctgttagaccaaatatgactttaaaggccatgatcacagatccagaagtggtatttgttgccagcctgacaaaggctgatgctcctgctctgacagcctcgtttcagtgcaacctttctctgtcaacatccaaactcgaacagatgatggaagcttctgtgagagatctgaaagtgctcgcttgcccttttctcagagaaaagagagggaaaaacattaccacagtcttgcagccctgttctttatttatggaaaaatgtacgtgggcttcaggaaagcaaaatataaatattatggttaaagaatttataattaagatttcacccataattcttaatactgtgttgacaatcatggctgcattgtctccaaaaacaaaagaagatggatccaaagatacgtctaaggaaatggaaaatctttggggtatcaaatcgattaatgattataacacttggtttcttggtgttgacacggcaacagaaataacggaaagcttcaaaggcattgaacattcactgatagaggaaaattgtggtgttgttgtagaatccattcaagttaccttagaatgtggccttggacatcgaactgtacctttattattggcagagtctaagttttcaggaaatattaaaaattggacttctctaatggctgctgttgctgacgtgacactacaggtgcactattacaatgagatccatgctgtctgggagccactgattgagagagtggaggggaagagacaatggaatttaaggcttgatgtaaagaagaacccagttcaggataaaagtttgctgccaggagatgattttattcctgagccacaaatggcaattcatatttcttcaggaaatacaatgaatataacaatatccaaaagttgtcttaatgttttcaacaatttagcaaaaggtttttcagagggcactgcttctacttttgactactctttaaaggacagagctccttttacggtaaaaaatgctgtaggtgttcccattaaggtgaagcccaattgtaatctcagagtaatgggcttccctgagaaaagtgatatttttgatgttgatgctggccagaatttggaactggagtatgccagcatggtaccttcaagtcaagggaacctatctatattgagccgtcaagaaagctccttcttcactctgaccattgtacctcatggatatacagaagttgcaaatatccctgtggccagacctggacggcgattgtataatgtacggaatcccaatgccagtcattctgactctgtcttggtacaaattgatgcaactgaagggaataaagtaattacccttcgctctcctctacagatcaaaaaccatttctccattgcatttatcatctataaatttgttaagaatgttaagctattggagcgcattgggatagccagacctgaagaggagttccatgttcctttagattcatatagatgtcaattgtttatccagccagctggaatcttagagcatcagtacaaagaatctaccacttatatttcctggaaggaagaacttcataggagcagggaagtcagatgcatgttgcagtgtccatcagtagaagtcagcttcttacctctcatagtgaatacagttgctctgcctgatgaattgagctacatatgtacacatggggaagactgggatgtagcttacattattcatctttatccttctctcactttgcggaatcttctcccatattccctaagatatttacttgagggaacagcagaaactcatgagctggcagaaggcagtactgctgatgttctgcattcgagaatcagtggtgaaataatggaattagtcctggtgaaataccagggcaaaaactggaatggacatttccgcatacgtgatacactaccagaattctttcctgtgtgtttttcttctgactccacagaagtgacgacagtcgacctgtcagtccacgtcaggagaattggcagccggatggtgctgtctgtctttagtccctattggttaatcaacaagactacccgggttctccagtatcgttcagaagatattcatgtgaaacatccagctgatttcagggatattattttattttctttcaagaagaagaacatttttactaaaaataaggtacaattaaaaatttcaaccagtgcctggtccagtagtttctcattggatacagtgggaagttatgggtgtgtgaagtgtcctgccaacaatatggagtacctggttggtgttagcatcaaaatgagcagtttcaacctttcacgaatagttaccctgactcccttttgtaccattgcaaacaagtcatcattagaactagaagttggcgagattgcatctgatggctcaatgccaactaataaatggaactatattgcttcttcagagtgccttccattttggccagaaagtttgtcaggcaaactttgtgtgagagtggtgggctgtgaaggatcttccaaaccattcttttataaccgacaggataatggcactttattgagcttagaagatctgaatgggggtatcttggtggatgtaaacactgccgaacattcaactgtcataactttttctgattaccatgagggatctgcacctgccttgataatgaaccatacaccatgggacatcctcacatacaaacagagtgggtcaccagaagaaatggtcttgctgccaagacaggctcgactttttgcctgggcagatcctactggtaccagaaaacttacatggacatatgcagcaaatgttggggaacatgatctgttaaaggatggatgtggacagtttccatatgatgcaaacatccagatacactgggtatcatttctggatgggcgccagagagttttgcttttcaccgatgatgttgccttggtttccaaagcactgcaggcagaagaaatggaacaggctgattatgaaataaccttgtctctccacagtcttgggctttcactggttaacaatgaaagcaagcaggaagtttcctatattgggataaccagttctggtgttgtttgggaggtgaaaccaaagcagaaatggaagccatttagtcaaaagcagataatcttattggaacaatcctatcagaaacatcaaatatcaagagaccatggctggattaagctagataataattttgaggtcaattttgataaagatccaatggaaatgcgcctccctattcgtagccctattaaacgagactttttatcaggaattcagattgaatttaagcagtcttctcaccagagaagtttaagggccaggttgtactggcttcaggttgataatcagttaccaggtgcaatgttccctgttgtatttcatcctgttgcccctccaaaatctattgctttagattcagagcccaagcctttcattgatgtgagtgtcatcacaagatttaatgagtacagtaaagtcttacagttcaagtattttatggtcctcattcaggaaatggccttaaaaattgatcaagggtttctaggagctattattgcactgtttaccccaacaacagaccctgaagctgaaagaagacggacaaagttaatccaacaagatattgatgctctaaatgcagaattaatggagacttcaatgactgatatgtcaattcttagtttctttgaacatttccatatttctcctgtgaagttgcatttgagtttgtctttgggttccggaggtgaagaatcagacaaagaaaaacaggaaatgtttgcagttcattctgtcaacttgctgttgaaaagcataggtgctactctgactgatgtggatgaccttatattcaaacttgcttattatgaaattcgatatcagttctacaagagagatcagcttatatggagtgttgttaggcattacagtgaacagttcttgaaacagatgtatgtccttgtattggggttagatgtacttggaaacccatttggattaattagaggtctgtctgaaggagttgaagctttattctatgaacccttccagggtgctgttcaaggccctgaagaatttgcagaggggttagtgattggagtgagaagcctctttggacacacagtaggtggtgcagcaggagttgtatctcgaatcaccggttctgttgggaaaggtttggcagcaattacaatggacaaggaatatcagcaaaaaagaagagaagagttgagtcgacagcccagagattttggagacagcctggccagaggaggaaagggctttctgcgaggagttgttggtggagtgactggaataataacaaaacctgtggaaggtgccaaaaaggaaggagctgctggattctttaaaggaattggaaaagggcttgtgggtgctgtggcccgtccaactggtggaatcgtagatatggccagtagtaccttccaaggcattcagagggcagcagaatcaactgaggaagtatctagcctccgtccccctcgcctgatccatgaagatggcatcattcgtccttatgacagacaggaatctgagggctctgacttacttgagcaagaactggaaatacaggaataaatgtttcctaaactactacttgatttcatccttaaaaatcaaaacaaactgtggtgttaattgactgtgtgtgaattccattgtcaattttaatgaaattttctttaaaactctcacctccatctgaacttttcatagtagtgggattgactacaaataaaaacttgtggtattcctggtaatactgtccagaaataagagattagtataaaatattaaaggatgcagagaatcagctctcttctgcgtttaatagatgaaagcctttattgagctcagaagcagatactgttactatcatttcgaaaattttatcttatggtgttcatgtgcatttcaggtaaaattgaaaaacaggacaattattatgtccaattaatatgtttatgtttgtgagtcttgatgatggaattacatagctttctgtttcacaaatggctctaaatttgcttaagttacgggactattacctggagcatctgctttaataattgaattgtcagttgctctgagcctgcccttagacctcaagtaataaatagttggcacatgaattttgaggatatgtttcctcttccctctttttcctatttaaccccttggtactgttgctaaataaatgatagccattttataattatgttatatacattttcagcctttagcatttctgcttttcaaaaattgaatctccttgttggttatgcttatttcataattattagttttaattaatgtagatagaagttgaacatgtaattaggcaaattgctgtgtggcacttgaatacatagatttctttattttcaaaaaccaaccttttgcttttaaatccttagagagggtttattatcttagagaaaaaataattataatcattatttttgaaattagtatcctcttaattctcaacataagttatgtttcaatttcttttttttgtaataaatgatggaaatgtt

SEQ ID NO: 8393 - DNA, 11012 bp, Homo sapiens
tgcagcgctggtcgcagccctcagctgcgccgggcggttccggctcctccctctccttgtgcctcagcgccaccatggtgctggagtcggtggtcgcggacttgctgaaccgcttcctgggggactatgtggagaacctgaacaagtcccagctgaagctgggcatctggggcggaaatgtggctttagataatctacagataaaagaaaatgccctgagtgaattggatgttccttttaaagtcaaggctggccaaattgataaattaactttgaagattccttggaagaacctttatggagaagcagttgttgcgaccctggaaggattatacctgcttgttgtccctggagcaagtattaagtatgatgctgtaaaagaagaaaaatccttgcaggatgttaaacagaaagagctatcccgaattgaagaagcccttcaaaaagcagcagaaaaagataagccaaaagaagccaaaaaggatacatttgtggaaaaattggcaactcaagtaataaaaaatgtacaagtaaaaatcacagatattcacattaaatatgaagatgatgtcactgatccaaagcggcctctttcatttggtgtcacactgggagagcttagtctactgactgcaaatgaacactggactccatgcatattaaatgaagcagacaaaattatatacaagcttatacgacttgatagtcttagcgcctactggaatgtaaattgcagcatgtcttaccagagatcaagggaacagattttggatcagctgaaaaatgaaattcttacaagtggaaatatacccccaaattatcaatacattttccagccaatatcagcctctgcaaaactctacatgaatccttatgcagaatcagagctcaaaacgcccaaactggattgcaacatagaaatacaaaatattgccattgaactgaccaaacctcagtacttaagtatgattgaccttttggagtcagtggattatatggttaggaatgcgccttataggaaatacaagccttatttaccacttcataccaatggtcgacgatggtggaaatatgcaattgattctgttcttgaagttcatataagaaggtatacacagatgtggtcatggagtaacataaaaaagcacaggcagttactcaagagttataaaattgcctacaaaaacaagttaacacagtctaaagtctcagaagaaatacagaaagaaattcaggacttggagaagactctagatgtttttaacataattttagcaaggcaacaagcacaagttgaggtgattcggtctgggcaaaaattaaggaaaaagtctgctgacacaggcgagaaacgtggaggctggtttagtgggttgtggggtaagaaagagtctaagaaaaaggacgaagaatcattgattcctgaaactattgatgaccttatgactccagaggaaaaagataaactcttcactgccattggttatagtgagagtacccacaacctaactttacctaagcagtatgttgcccatattatgaccctgaagttagtaagcacctctgttacgataagagaaaacaagaatattccagaaatactaaaaattcagataattggcctgggcactcaagtatctcagcgaccaggagcacaagcacttaaggtagaagcgaaattagaacactggtatataacaggtttgagacagcaggatattgtgccatcacttgtggcttcaattggtgacactacatcatccttgcttaaaattaaatttgaaaccaatccggaggatagtcctgctgaccagactctgattgttcagtcccagcctgtggaggtcatctatgatgctaaaactgtcaatgcagtggttgaattctttcaatcaaataagggattggatcttgagcaaataacatcagcaacattgatgaagctggaagaaattaaggagagaacagctacaggacttacacatattattgaaactcgaaaagtccttgatttaaggataaatctgaagccttcttatctagtagttccacagacgggtttccaccatgaaaagtcagatcttctgattttagattttggtacatttcagctcaacagtaaagatcaaggtttacagaagactactaattcatctctggaagaaataatggataaggcatatgacaagtttgatgttgaaataaaaaatgtacaactactttttgcaagagcagaggaaacctggaaaaagtgtcgatttcagcatccatcaactatgcatatattgcaacccatggatattcatgttgagttggctaaggccatggtagaaaaagacattagaatggccagatttaaagtgtcaggaggacttcctttgatgcatgtgagaatttctgaccagaagatgaaagatgtgctatatttgatgaacagtatacctttgccacagaaatcatcagcccagtctccagagagacaggtatcctcaattcctattatttcaggtggtacaaaaggtctacttggtacttcactattgctagacactgtggaatcagagtctgatgatgagtattttgatgctgaagatggagaaccacagacttgtaaaagtatgaaaggatcagaacttaaaaaagctgcagaggtcccaaatgaggagctcatcaatcttctactcaagtttgaaattaaagaagtgattttggaatttactaaacagcagaaagaagaagatacaattctagtatttaatgttactcagttaggaacagaggccacaatgagaacatttgacttaactgtggtatcttatttaaagaaaatcagcttggattatcatgaaattgaaggatccaaaaggaagccccttcacttgattagctcttctgacaaacctggattagatcttttgaaagtggagtatattaaggctgataagaatggacctagttttcaaactgcttttggaaaaactgaacaaacagttaaggtggccttttcatctttaaatctgttgctgcaaacacaagctcttgtcgcttctattaattacctcacaaccattattccatctgatgatcaaagcataagtgttgctaaggaggtacaaatttcaactgaaaaacaacaaaaaaattcaactctgccaaaagcgattgtatcctccagagatagtgacattattgatttcaggctatttgccaagttgaatgctttctgtgtcattgtttgcaacgaaaagaacaatatcgccgaaatcaagattcaaggactggattcctccctttctctccagtcaagaaagcagtcactttttgcccgactagaaaatattattgtcacagatgttgatccaaagacagttcataagaaagctgtgtcaataatgggaaatgaagttttccgttttaatttggatttgtatccagatgctactgagggggatttgtatactgacatgtccaaagtggatggtgtgctgtctctgaatgttggctgtattcagattgtctatcttcataaattccttatgtcacttctgaacttcctgaataatttccagacagccaaagagtctctgagtgctgccactgcccaggctgcagaaagggctgccacaagtgtgaaagatcttgcccagaggagttttcgtgtttccatcaatattgatttgaaagcaccggttatagtcatcccacagtcttctatttccaccaatgcagtagtggtagatcttgggttaatcagagttcataatcagttcagtctggtgtctgatgaagactacttaaatcctccagtaattgatagaatggatgtgcagctaacaaagcttacactttataggacagtgatccagccaggcatctaccatcctgatattcagctgttgcacccaattaacttggaatttcttgtaaatcggaatctagctgcatcttggtaccacaaggtgcctgttgtggaaattaaaggacatcttgattcaatgaatgttagtctaaatcaagaagatcttaatcttttatttaggatactaacagaaaatctctgtgagggtactgaagacttggataaagtgaaaccaagagtacaagagacaggtgaaattaaagagccccttgaaatctctatatcacaagatgtacatgattcaaaaaatactttaacaactggagtggaagaaattaggtctgtagacatcattaatatgctgctgaattttgaaattaaagaggttgtggttactttgatgaaaaaatcagaaaagaaaggaaggcctttacatgagctaaatgtcctgcaacttggaatggaagctaaagttaaaacctatgacatgactgctaaagcttatctaaaaaaaattagtatgcagtgctttgatttcactgactctaaaggggaacctcttcacattattaactcttctaatgtgactgacgaaccccttctgaaaatgttactgacaaaggcagacagtgatggaccagaatttaaaactattcatgacagtaccaaacagagactgaaggtttcatttgcatccttagacttagtacttcatttggaagctttactttccttcatggattttttatcatctgctgctccattctctgagccttcctcttctgagaaggaatccgagctgaaaccacttgtgggggagtccagaagtatcgctgtcaaagctgtatccagcaacatttcccaaaaggatgtgtttgatttaaagatcacagctgaattaaatgcatttaatgtctttgtctgtgatcagaagtgtaacattgcagatattaaaatacatggaatggatgcctctatttctgtgaagcctaagcagactgatgtgtttgccagacttaaagatattatagttatgaatgtagatttgcagtccattcacaaaaaggctgtctctattttgggagatgaagtctttaggttccaactgactctttatccagatgccacagaaggagaggcctatgctgatatgtccaaagtagacggcaaacttagttttaaagtgggttgtattcagattgtttatgttcataaattcttcatgtctcttttgaacttcctcaacaatttccaaactgctaaagaagctttgagtacagccacagtccaggctgcagaaagagctgcttccagcatgaaagacttggctcaaaagagtttccgccttttgatggatattaatttgaaagcaccagttattattattcctcagtcttcagtatcacctaatgctgttatagcagatctgggtttaatcagagttgaaaacaagtttagcttggttcctatggaacattattctcttcctccagtcattgataaaatgaacatcgaactcactcagttgaagctgtcaagaactattttgcaggctagcttgccacaaaatgacattgaaattttaaaaccagtcaacatgcttttgtccatacagcgaaacttagcagcagcatggtatgtgcaaattccagggatggagataaaaggaaaactaaaacctatgcaggttgctctcagtgaagatgacttgacagttttaatgaaaattttgctagaaaatcttggagaagcttcctcacaaccaagccctacacagtctgtgcaggagactgtaagagtgagaaaagttgatgtttcaagtgtacctgaccatctcaaagaacaagaagattggacagactcaaagctctctatgaaccagattgtcagtctccaatttgactttcactttgaatctctttccattatcctttataacaatgatatcaaccaggaatctggagttgcatttcataatgacagtttccaacttggtgaactcagactacatcttatggcctcctcagggaagatgtttaaggatggctcaatgaatgtcagcgttaaacttaagacatgcacccttgatgatctcagagaaggaattgagagagcaacatcgagaatgattgacagaaagaatgaccaagataacaacagttctatgattgatataagttacaaacaagacaaaaatggaagtcaaattgatgctgttcttgacaagctgtatgtatgtgccagtgtggaatttctgatgactgtggcagatttctttatcaaagctgtgcctcagagtccagaaaatgtggcaaaagaaacacagattttaccaagacagactgccacagggaaggtcaagatagagaaagatgactctgttagaccaaatatgactttaaaggccatgatcacagatccagaagtggtatttgttgccagcctgacaaaggctgatgctcctgctctgacagcctcgtttcagtgcaacctttctctgtcaacatccaaactcgaacagatgatggaagcttctgtgagagatctgaaagtgctcgcttgcccttttctcagagaaaagagagggaaaaacattaccacagtcttgcagccctgttctttatttatggaaaaatgtacgtgggcttcaggaaagcaaaatataaatattatggttaaagaatttataattaagatttcacccataattcttaatactgtgttgacaatcatggctgcattgtctccaaaaacaaaagaagatggatccaaagatacgtctaaggaaatggaaaatctttggggtatcaaatcgattaatgattataacacttggtttcttggtgttgacacggcaacagaaataacggaaagcttcaaaggcattgaacattcactgatagaggaaaattgtggtgttgttgtagaatccattcaagttaccttagaatgtggccttggacatcgaactgtacctttattattggcagagtctaagttttcaggaaatattaaaaattggacttctctaatggctgctgttgctgacgtgacactacaggtgcactattacaatgagatccatgctgtctgggagccactgattgagagagtggaggggaagagacaatggaatttaaggcttgatgtaaagaagaacccagttcaggataaaagtttgctgccaggagatgattttattcctgagccacaaatggcaattcatatttcttcaggaaatacaatgaatataacaatatccaaaagttgtcttaatgttttcaacaatttagcaaaaggtttttcagagggcactgcttctacttttgactactctttaaaggacagagctccttttacggtaaaaaatgctgtaggtgttcccattaaggtgaagcccaattgtaatctcagagtaatgggcttccctgagaaaagtgatatttttgatgttgatgctggccagaatttggaactggagtatgccagcatggtaccttcaagtcaagggaacctatctatattgagccgtcaagaaagctccttcttcactctgaccattgtacctcatggatatacagaagttgcaaatatccctgtggccagacctggacggcgattgtataatgtacggaatcccaatgccagtcattctgactctgtcttggtacaaattgatgcaactgaagggaataaagtaattacccttcgctctcctctacagatcaaaaaccatttctccattgcatttatcatctataaatttgttaagaatgttaagctattggagcgcattgggatagccagacctgaagaggagttccatgttcctttagattcatatagatgtcaattgtttatccagccagctggaatcttagagcatcagtacaaagaatctaccacttatatttcctggaaggaagaacttcataggagcagggaagtcagatgcatgttgcagtgtccatcagtagaagtcagcttcttacctctcatagtgaatacagttgctctgcctgatgaattgagctacatatgtacacatggggaagactgggatgtagcttacattattcatctttatccttctctcactttgcggaatcttctcccatattccctaagatatttacttgagggaacagcagaaactcatgagctggcagaaggcagtactgctgatgttctgcattcgagaatcagtggtgaaataatggaattagtcctggtgaaataccagggcaaaaactggaatggacatttccgcatacgtgatacactaccagaattctttcctgtgtgtttttcttctgactccacagaagtgacgacagtcgacctgtcagtccacgtcaggagaattggcagccggatggtgctgtctgtctttagtccctattggttaatcaacaagactacccgggttctccagtatcgttcagaagatattcatgtgaaacatccagctgatttcagggatattattttattttctttcaagaagaagaacatttttactaaaaataaggtacaattaaaaatttcaaccagtgcctggtccagtagtttctcattggatacagtgggaagttatgggtgtgtgaagtgtcctgccaacaatatggagtacctggttggtgttagcatcaaaatgagcagtttcaacctttcacgaatagttaccctgactcccttttgtaccattgcaaacaagtcatcattagaactagaagttggcgagattgcatctgatggctcaatgccaactaataaatggaactatattgcttcttcagagtgccttccattttggccagaaagtttgtcaggcaaactttgtgtgagagtggtgggctgtgaaggatcttccaaaccattcttttataaccgacaggataatggcactttattgagcttagaagatctgaatgggggtatcttggtggatgtaaacactgccgaacattcaactgtcataactttttctgattaccatgagggatctgcacctgccttgataatgaaccatacaccatgggacatcctcacatacaaacagagtgggtcaccagaagaaatggtcttgctgccaagacaggctcgactttttgcctgggcagatcctactggtaccagaaaacttacatggacatatgcagcaaatgttggggaacatgatctgttaaaggatggatgtggacagtttccatatgatgcaaacatccagatacactgggtatcatttctggatgggcgccagagagttttgcttttcaccgatgatgttgccttggtttccaaagcactgcaggcagaagaaatggaacaggctgattatgaaataaccttgtctctccacagtcttgggctttcactggttaacaatgaaagcaagcaggaagtttcctatattgggataaccagttctggtgttgtttgggaggtgaaaccaaagcagaaatggaagccatttagtcaaaagcagataatcttattggaacaatcctatcagaaacatcaaatatcaagagaccatggctggattaagctagataataattttgaggtcaattttgataaagatccaatggaaatgcgcctccctattcgtagccctattaaacgagactttttatcaggaattcagattgaatttaagcagtcttctcaccagagaagtttaagggccaggttgtactggcttcaggttgataatcagttaccaggtgcaatgttccctgttgtatttcatcctgttgcccctccaaaatctattgctttagattcagagcccaagcctttcattgatgtgagtgtcatcacaagatttaatgagtacagtaaagtcttacagttcaagtattttatggtcctcattcaggaaatggccttaaaaattgatcaagggtttctaggagctattattgcactgtttaccccaacaacagaccctgaagctgaaagaagacggacaaagttaatccaacaagatattgatgctctaaatgcagaattaatggagacttcaatgactgatatgtcaattcttagtttctttgaacatttccatatttctcctgtgaagttgcatttgagtttgtctttgggttccggaggtgaagaatcagacaaagaaaaacaggaaatgtttgcagttcattctgtcaacttgctgttgaaaagcataggtgctactctgactgatgtggatgaccttatattcaaacttgcttattatgaaattcgatatcagttctacaagagagatcagcttatatggagtgttgttaggcattacagtgaacagttcttgaaacagatgtatgtccttgtattggggttagatgtacttggaaacccatttggattaattagaggtctgtctgaaggagttgaagctttattctatgaacccttccagggtgctgttcaaggccctgaagaatttgcagaggggttagtgattggagtgagaagcctctttggacacacagtaggtggtgcagcaggagttgtatctcgaatcaccggttctgttgggaaaggtttggcagcaattacaatggacaaggaatatcagcaaaaaagaagagaagagttgagtcgacagcccagagattttggagacagcctggccagaggaggaaagggctttctgcgaggagttgttggtggagtgactggaataataacaaaacctgtggaaggtgccaaaaaggaaggagctgctggattctttaaaggaattggaaaagggcttgtgggtgctgtggcccgtccaactggtggaatcgtagatatggccagtagtaccttccaaggcattcagagggcagcagaatcaactgaggaagtatctagcctccgtccccctcgcctgatccatgaagatggcatcattcgtccttatgacagacaggaatctgagggctctgacttacttgagcaagaactggaaatacaggaataaatgtttcctaaactactacttgatttcatccttaaaaatcaaaacaaactgtggtgttaattgactgtgtgtgaattccattgtcaattttaatgaaattttctttaaaactctcacctccatctgaacttttcatagtagtgggattgactacaaataaaaacttgtggtattcctggt

SEQ ID NO: 8394 - DNA, 16243 bp, Homo sapiens
ggaggaaacgccgcgcagcgccgggctggggcgggcggcccgggacaccgacagatttttctgtgaccatgaaagagagaaataaagaatgatccatgatttctaaacaccttttcctgaggatatagtcatgttggaaggccttgtagcctgggttctcaatacctatttgggaaaatatgtcaataacctgaacactgaccagctctcagttgcacttctcaaaggtgctgttgaattagaaaacttgccattaaagaaagatgccttgaaagaattggaattaccatttgaagtcaaagctggcttcattgggaaagtaacccttcagattcccttttatcgcccccatgtggacccttgggtgatctccatctccagccttcacttaattggagccccagagaaaatacaggatttcaatgatgaaaaggagaagctgttggaaagggaacgtaagaaagcactacttcaagccctggaggagaaatggaagaatgaccgccagcagaaaggggagtcctattggtattcagttaccgcctccgtagttacaaggattgtggagaatattgaattaaaaattcaagatgtccatttacgctttgaagatggtgtcaccaatccctcccatccttttgcttttggcatctgcattaagaatgtgtccatgcaaaatgctgtgaatgagcctgtacagaaactaatgcggaaaaagcaattagacgtagcagaatttagcatctattgggatgtcgattgcactttactgggggatttgcctcagatggagttacaggaggccatggccaggagcatggagagtcgcagccatcactacgtcctggagcctgtgtttgcatctgctcttttgaagagaaactgctccaagaagcccctgcggtctcggcacagtccccgtattgattgtgatattcagctggagaccattcccttgaaactctctcagctgcaataccggcaaatcatggaattcctcaaggagctggaacgaaaggagaggcaggtgaagttccgaaggtggaaacccaaggtggcgatatctaagaactgccgagaatggtggtattttgctttgaatgctaacttgtatgagatcagagagcagaggaaacgttgcacctgggactttatgttgcaccgcgctcgtgatgctgtatcttacactgacaaatatttcaacaagttaaaaggaggcctgctgtccacagatgacaaggaggaaatgtgtcggattgaagaggaacagagctttgaggaattgaagattttgcgtgaactggttcatgatcgatttcacaaacaggaagaactagcagagagtctgcgggagcctcagtttgattctccaggagcctgtccgggagccccagaacccggtggaggcagtgggatgctgcagtatctccagtcctggtttcctggatggggtggctggtacgggcagcagaccccagaagggaatgtggttgagggactgtcagcagagcaacaggagcagtggattcctgaagagatcctgggcactgaggagttttttgaccccactgcagatgcctcgtgtatgaacacgtatacaaagcgagatcatgtctttgccaaactgaatttgcagttgcagcgaggtacagtgactctgttacacaaggagcaaggaactcctcaaatgaatgaaagtgctttcatgcagctcgagttttcagatgtaaaacttctagcagagtctcttcctcgaagaaattcctcgttgctttcagtccggttgggtggactgtttcttcgagacctggctacagaaggaactatgtttcctcttctagtcttccctaatccacaaaaagaagttggcagagtctcacaatcttttggtctacaaactacatctgcagacagaagtgatcattacccagctgcagatccagatggccccgtttttgagatgctgtatgagagaaatccggcgcacagccactttgagaggcggctcaatgtcagcacaaggcccttgaacatcatatacaatccgcaggccattaaaaaagtagcagactttttctacaagggaaaggttcatacctcaggttttggttatcagtctgaacttgagctgagagtggctgaagctgcccgaagacaatataacaagctgaagatgcagaccaaggcagaaatccggcaaactcttgatcgtttgctagtgggtgatttcattgaggagagtaaacgatggaccgtgcggctggatatttctgcccctcaggtgatatttcctgatgatttcaaattcaagaatcctgtgttagttgtcgtggatctaggaagaatgcttttgacgaacacccaagataactccaggaggaaaagtagggatgggtcagcatctgaagagacccagtttagtgatgatgaatataagacccccctggccacacctcctaacaccccacctcccgagtcaagcagcagcaacggagagaaaacacctcccttttctggagttgagttcagtgaagaacagcttcaagcacatttaatgagcacaaagatgtatgagaggtactcgctgtcatttatggacctccagatcatggttggacgagtgaaagacaattggaagcatgtccaggatattgacgtgggaccaacacatgtggtagagaagttcaacgttcacctacagttagagcgtcgattgatttatacttcagatcccaaatatccaggagccgtgctctcaggcaacttaccagacttaaaaatccacattaatgaagataaaatatctgcactaaagaattgctttgctctcctcaccaccccagaaatgaaaacttctgacactcagattaaagaaaagatttttccccaggaggagcagcggggaagtttgcaagactccgtaatgaatttaacccagagcattgtgttgttggagcagcatacccgcgaggttctggtggagtcgcagctcctcctggcggaatttaaagtgaactgtatgcagcttggtgttgagagcaatggccggtacatttctgtgctcaaggtgtttggtaccaatgctcactttgtgaagaggccttatgatgctgaagtctccctaactgttcatggtttgctcctggtggataccatgcagacatatggtgctgattttgaccttttgatggcttcacataagaacttgagctttgatattccaacgggaagccttcgggatagcagggcccagtctcctgtctctggaccgaatgtggcccacttaactgatggagctacactgaacgaccgatcagctactagtgtttcacttgacaaaattcttaccaaagagcaagagtcccttattaagttggaatatcagtttgtgagttcagagtgcccatcgatgaatttagacagtactcttcaggtgatttccctacaggtgaataatttagatattatcctcaatccagagacgattgtggagctaattggttttcttcaaaaatcctttcccaaggaaaaagatgatttaagtcctcaacctttaatgactgattttgaaagaagcttcagagaacaaggaacttaccagtctacatatgaacaaaacactgaggttgcagtggaaatccataggctgaacttactgcttcttcggacagtgggcatggcaaatagagagaaatatggcagaaaaattgcaactgcaagtataggtggcaccaaagttaatgtctcaatgggtagcacgtttgacatgaatggttctcttggctgtttacagcttatggatttgacacaagataacgttaaaaaccagtatgttgtcagcattgggaattctgtaggctatgaaaatatcatcagtgatattggctactttgaatctgtgtttgtcagaatggaagatgcagccctcactgaagctttgagtttcacgtttgttgagagatctaaacaggagtgttttctcaacctgaagatggcttctttacattataaccactctgctaagtttttgaaggagttgacgttatccatggatgaactggaagaaaattttcgaggtatgctgaaaagcgcagccaccaaagtcaccacagtactagctaccaagactgccgagtatagcgagatggtatcgctctttgaaactccaaggaagactcgggaaccctttatcttagaggaaaatgaaatatatgggtttgacctagcttcgtctcatttggacactgtaaagctaatcttgaacataaacattgaatcaccagttgtttctatccctcggaagccggggagtcctgagttgttggtgggacacttgggacagatattcatccagaattttgtggcgggagatgatgaatccagaagtgaccgtctgcaggtggaaatcaaggacattaaactgtattctttgaattgcacccagttggcaggtagagaagctgttgggtctgaaggaagccggatgttttgcccaccttccgggtctggcagtgccaacagtcaggaggaagctcatttcacacgacatgatttctttgaatctttgcatagaggtcaagcttttcacatcctgaacaacaccaccattcagtttaaactggagaagatccctatagagagagaatctgaattgactttttctcttagcccagatgacctgggaacttctagcatcatgaagattgaaggaaaatttgtcaatccagttcaggtggtgttagcaaagcatgtatatgagcaggttttacaaaccctggacaatctcgtgtacagtgaagatctgaataagtatccagccagtgctacctcctccccttgccctgattctcctctgcctcccctcagtacctgtggagaatcttctgttgaaaggaaggagaatggattgttcagccactccagcctttctaacacctctcagaagtcattgtcagtgaaggaagtcaaatcctttactcagattcaagccaccttttgtatatcagagcttcaggttcagctaagtggagatctgactttgggggcccaaggtcttgtgagcttaaagtttcaggactttgaggtggaattcagtaaagaccatccccagactttatctattcagattgccctgcattctctgctgatggaggacttattggagaagaatccagattctaaatataagaacctgatggtgtctcgaggagcccctaagccatctagtttagcacaaaaagaatacctttctcagtcttgcccctcagtgtccaatgtggaatatcctgatatgcctcggtctctcccttcccacatggaagaagctcctaatgtcttccagttgtatcaaaggcccacctctgcgtcccggaaaaagcaaaaggaagtccaagacaaggactatcccttgaccccacctccttctccaacagtggatgagcccaagatacttgttggaaagagtaaatttgatgattccttagtccacatcaacatattcttggtagataagaaacatccagaattctcttccagttacaatcgagttaaccggagcattgatgttgattttaattgcttggatgtgctgatcacactgcaaacctgggttgtgatattagacttttttggaatcggctccactgcagacaaccacgcaatgaggctgcctcctgagggcattctgcacaacgtgaagttggagccacatgcctccatggagtctggacttcaggatccagtgaacaccaaactggatctcaaggttcattcactttctctagtgctgaataagaccaccagtgagcttgccaaagcaaatgtgtccaaattagtagcacacctggaaatgattgagggagacctggccttacagggcagcattgggagtctgtctctaagtgacctcacatgccatggagagttctacagagaacggttcactaccagtggtgaagaagcactcatcttccagacttttaaatacggacggcctgaccctctgctccggagagaacacgacattcgcgtgagcctccggatggcctctgtgcagtatgtgcatactcagcgtttccaggcagaggtggtggccttcattcagcatttcactcagctgcaggatgtcttagggcgccagcgagctgctattgaggggcagacggtgagagatcaagcccagcgctgttcacgggttctcctggatattgaggctggtgctcccgttctcttgatcccagaaagttccagatcaaataatctgattgtagcaaatttggggaagttgaaagtcaaaaataagtttctgtttgctggttttcctggcaccttttccctacaagataaggaatctgtgccttcagcttccccaacgggtattcccaaacacagtctgaggaaaacgacaagcacggaggagcccaggggaacccattcccaggggcagttcacgatgcctcttgctggaatgagcctaggaagcctgaagagtgagtttgtgcccagtacctccaccaagcagcaagggccgcaacccacactgtctgttggccaagagtccagtagtccagaagaccatgtctgcctgctggattgcgttgtcgtggatctccaggacatggacatctttgctgcagagagacatccgagagaatactcgaaggcaccagaggatagtagtggagatctgatcttcccttcctattttgtgcgacagacaggaggaagcctcttaaccgagccttgtaggctgaaattgcaggtggaaaggaatttggacaaagaaataagtcatactgtgccagacatatctatccatggcaatctctcctcagtccactgctctctggatctgtataaatacaagctgatccgcggcttattagagaacaacctgggagaacccatagaggaatttatgcggccttatgatttacaagatccaagaattcatactgtcctgagtggagaagtgtacacctgtatgtgcttcctcattgatatggtgaatgtaagtctggagcttaaagatccaaaaagaaaagaaggtgctgggtccctagccagatttgacttcaagaaatgcaaactgctctatgaaagtttttccaaccaaaccaagtccattaacttggtttcccattccatgatggcttttgacacccgttatgctgggcagaagaccagccctggcatgacgaatgtgttcagctgtatctttcagcccgctaagaacagcagcaccacccaagggtccattcagattgaactacatttcagatctaccaaggattcctcctgctttacagtagttctcaacaatctccgtgtgtttctcatatttgactggctactgttagtccatgattttctccacactcccagtgatattaagaaacaaaatcatgttactccttctcgccaccgtaactctagcagcgaatctgctatagttcccaaaactgtgaagagtggagtagttaccaagcggtcttcccttcctgtgtccaatgaaaggcacctggaggtcaaggtcaatgtaacaggtacggagtttgtggtcattgaagatgtgtcctgcttcgacaccaatgccattattctgaaaggcaccacagtgctcacctataagccccggtttgttgatcgccccttttcaggaagtttgtttggcattgaggtgttttcatgccgactagggaatgagcatgatacagctctttcaattgtggatcccgtacaaattcaaatggagttggtggggaattcttcttatcaaaatagttcaggattgatggatgcattcaatagtgaagatttcccacctgtcctggagattcagttacaagccctggatatcagactctcctataatgatgttcagctgtttcttgccattgcaaaatccatcccagagcaagctaatgctgcagtgccagactcagtggccctggagtcagactccgttggcacttaccttccaggtgcatctcgcgttggagaggaaatcagagaagggacaagacacaccttagatcctgtcttggagttacagctggctaggctgcaggagctgggattcagcatggatgattgtcgcaaagctcttttggcgtgtcaaggccaattgaaaaaggcagcaagttggttgtttaagaatgcggaacctctgaagtctctttccttggcctccaccagccgagatagcccaggggctgtggcagcgccattgatctctggcgtggagatcaaagctgagagtgtgtgcatctgtttcatcgatgactgcatggattgtgatgttcctctcgctgaactcaccttttcccgtctgaattttcttcagcgtgtaagaactagccctgaaggctatgcccacttcaccctttctggagattattataaccgtgctctttcaggctgggagccatttattgagccttggccatgctctgtatcctggcaacagcaggcagctagtcgtctccatcctcctcgactgaagctagaagccaaggccaaacctcgtttggatatcaatatcacttctgtgctaattgaccagtatgtaagtaccaaggaatcgtggatggcagattactgtaaagatgacaaggacatagagtcagctaaatcagaagactggatgggctcttcggtggatcctccatgttttggacaaacagaggtgaaaacccccaagcgccggcagccatttgtcccctttgctctgaggaaccacacggggtgcactttgtggtttgccaccctgaccaccacacccaccagagctgcactctctcacagtgggagtccaggggtagttccagaagggaacggaacatttctcgatgatactcacaatgttagtgaatggcgagaagtccttacaggtgaagagattccctttgaatttgaagcaagaggaaagttaagacacagacacacccatgacctccggattcatcaactgcaagtgagagtaaatggctgggagcaagtgagcccagtgtctgtggacaaagtcgggaccttttttcgatatgcagcaccagataaaaattcatcttcctctacgattggcagcccaagcagcagaacaaatattatacatccccaggtttatttctcttcactcccaccagtgcgggtggtctttgcagtgactatggaaggcagtgcacggaaagtcatcactgtccggtcagccctcattgtgaggaacagacttgagacaccaatggaactaagactggatagcccatcagctccagacaagccagtggtgcttcctgctatcatgccaggggattcgtttgctgtgcctttacacctcacttcttggcggctacaggcccggcccaaaggattgggtgtatttttctgtaaggctcccattcattggaccaatgtagtgaagactgcagaaattagtagcagtaaacgagagtgccactctatggacacagaaaaaagccgatttttcaggttttgtgtggctataaagaaagagaattatccagattatatgccctcaaacatattttctgacagtgcaaaacagattttcagacagcctgggcataccatatatctcctgccaactgtggtaatctgcaacttgctaccctgtgaacttgatttttatgttaaaggaatgccaattaatgggacgctgaaacctggcaaggaggcagctctccatacagctgatacatcccagaacattgagctgggggtatcactggagaatttccccctctgtaaagaattgctcattccacctggaacccaaaactatatggtgagaatgcgactctatgacgtcaaccgtcggcagctgaacctcaccatccggattgtgtgtcgagcagaaggatccttaaagatcttcatttctgctccatattggctgattaacaaaacagggttgccactgatcttcagacaggacaatgccaagacagatgctgcaggccagtttgaggagcatgagctggcccgtagcctgagtcctctcttattctgctatgctgacaaagagcagccaaacctctgcacgatgagaatcggaagggggattcatccagaaggcatgccgggctggtgtcagggcttctccctggatggtggtagtggtgtccgagctttgaaagtcatccagcaaggaaaccgcccagggctgatctataacattggtattgatgtcaagaaaggccgaggtcgatacattgatacctgcatggtcatctttgccccccgttacctgttagataataaatcatctcacaagcttgcatttgcacagagggaatttgccaggggacagggaacagccaatcccgaaggttacatttccacccttcctggttccagtgtggtgttccactggcctcggaatgactatgatcagctattgtgtgtcagactgatggacgttcccaattgtatttggtctggaggctttgaagtcaacaagaataattccttccatatcaacatgagggataccttgggaaaatgcttcttcctacgagtggaaattactctccgaggagctacgtataggatctcatttagtgacacagatcagttacctcctcctttccgaattgacaacttttctaaggtcccggttgtctttactcagcatggcgtagctgaacccaggctccggactgaagtgaagcccatgacttcattggattatgcctgggacgaacccaccttgccaccttttatcactctgactgttaaaggggcagggtcctctgagatcaactgcaacatgaatgatttccaggataatcggcagctttattatgaaaatttcatttacattgctgctacatatacattctctggcttgcaggagggaacaggcaggcctgtggcttccaacaaggccattacctgtgcggagctcgttttggatgtctcacccaagacacaaagagtcattttaaaaaagaaggaaccaggaaagcgttctcagctgtggaggatgacaggaacaggaatgctggcccatgagggctcctcagttcctcacaatcccaataagccctcagccgcccgctccaccgaggggtctgccatcttagatattgctggtctcgctgcagtgactgacaacagatacgagccactgatgctgagaaagcctgaccgcaggcgaagcacaactcagacgtggagtttccgagaaggaaaactgacctgtgggttacatgggttggtcgtccaggccaaaggaggactttctggtttgtttgatggagctgaagttgttcttggtcctgacacttccatggagcttttggggccagttccacctgaacaacaatttattaatcaaaaaatgagacctggttctggaatgttatccatcagagtcatcccagatggaccaactagagcactccagataacagatttctgccaccggaaaagcagccgttcatatgaagtggatgaacttcctgtcaccgaacaagagctgcagaaattaaagaatccagatacagagcaggaattggaagtgcttgtgaggttagaaggtggaattgggttgtccttaattaataaagtcccagaagaactggtctttgcaagtcttacaggaatcaatgtgcactatacacagctggcaaccagtcacatgcttgaactcagcatacaggatgtacaggtggacaatcagctcattggtaccacgcagcccttcatgctctatgtgactcccctgagcaatgagaatgaggtcatcgagaccggcccagctgtgcaagtcaacgcagtgaagttccccagtaagagtgcactgaccaacatctacaagcatctgatgatcacagctcagagattcacagtgcaaattgaggagaaactgctcctcaagctgctaagtttctttggctacgatcaagcagaatcagaggtggaaaaatatgatgaaaacctccatgaaaagacagctgagcaaggtggaacaccaattcgatactactttgaaaatctcaaaatcagcattcctcagatcaagctaagtgtgttcacctccaacaagctcccattggatcttaaggccctaaaaagcaccttggggtttcctttgatacggtttgaagacgctgtgattaatctagatccattcactcgggtacatccctatgagaccaaggagttcatcatcaatgatatcctcaaacatttccaggaggaactcctcagccaggcagctcgaatcctgggatcagtggattttcttggcaatcctatggggcttttgaatgatgtttctgaaggggttactggactgataaaatatggaaatgtcgggggcctcatcagaaatgttacacacggagtatcaaactctgctgccaagtttgctggaacattatcagatggcttagggaagacgatggacaatcggcatcagtcagagcgggagtacatcaggtaccatgcagccacaagtggtgaacaccttgtagccggcatccatggcctggctcatggtatcattggtggactgaccagtgttataacttcgacagtggaaggtgtgaaaacagaagggggtgtcagcggtttcatatctggccttggaaaagggcttgttggcactgtaaccaagccagtggcaggcgccctggattttgcatcagaaacagcccaggcggtgagagacacagccacactcagcggccccaggactcaagcacagagggttcggaaaccgcgttgctgcacggggccccaggggctgcttccccgatattctgagagccaggcggaaggacaggagcagctcttcaaactcacagacaacatacaggacgaattcttcatcgctgtggagaacattgacagctactgcgtgctcatctcctccaaagctgtttacttcctgaaaagtggagactacgtggatcgagaagccattttcctagaagtcaaatacgatgacctctaccactgccttgtctccaaagaccatgggaaggtgtatgtgcaggtgaccaagaaagccgtgagcacgagcagtggagtgtccatccccggcccctcccaccagaagcccatggtccatgtgaaatctgaggtccttgctgtcaagttgtcacaagaaataaactacgcaaagagcctctactatgaacagcagcttatgttaagactcagcgaaaaccgagagcagctggagctggactcctgaagccccgctgctgagatgggcgctcccgacacagcgcagacccaccaggaggaaagaggcccagctctcagctgacgatggaggcagaaccggagtcgggtttggggaagttgtcaaggaatgagggaaagtaaatcctcatgaggaaaagtacaaatggaaatcgtattaatttgtgaggcagggagttattttagattatgggaaataatttttaaaggtattggttaaataacgtttaaaaacatgtactgagatgaatctaatttttagattgccctgtattttgttaacatgtatatatgtacaacagtgtgtttgtaaatatataggaacgtttctgaacagggtctgtgctatgtgtaaaggtttgttaactgtaaagtaatataaagttatattggatcttctattgcactaattctagatgtctaattcaggatactgtctatagaaaggcattcttaaaagttaaagaatgttacgtcttagttttggagactaaagtattcccagtaaagtgggttgaggtgagggctgtggtcctgaaagggacgcctttgacatcgtggctgtccagttgggctgtgagctgtggcacccaggactggcgctggcccttcagaaggatctaggagaggggcttgggagcccacttttaatttctcacccccattttacaaagagtgcttagattcttacaaattatgatgtaagttatccatttggctttttcctaactagtcttaccaaacttagggggaaacctgtgctccattaccacatgggtgcaagtcagcattgtaagttttctcaggttattattattagagaggttggaaacattggtaaactctgttgattgagaaggaaaaaaaaagtcccattgaactgttgcaacaaatcagaaatccacataaaagtgctctcctgcctgggcagcaacaaccaagaacaaagccccgggactgttttctttttaataaagccacaggcaggcatcgtagctccacagcccgaggggacacaggatggaaaccccaggatgagaagggagcagggagagttccagaaagggggatgaaataggagtattaaaaagctgcgttggtaagtttttcatggaaccaagatttgacaaaggcatctcttatccttggttttaaattcctgctgggagcaaggcctggtatgagcgccctgggtcttgtttttggtgtttcgcttttctgtaaggattaagcagatagggagaagggaaaaggggcctcactttagaatgaatgagtcaccttgtgatttttaaatttttattttaataaagctaatcaatttctacaaccttgtcacatgtagctgagtctgggatgactcagtggatcagtggatgcgtggaaggttttggtgtttataactcatgacccaaatccttccaagacacaaatgaagctaatcttcttcccctccctttcctctcccacttcccctctgtgtctgtgtctgtgtgtgtgtgtgtgtgtgtgtgtgtgcgcgcgcgcgcgtgcatgcagagaggaaggaagggagctttagcacaagtagctacatagtgttcaaggatcagctttcttgaactccgaggcttggttgcctttgctgaactccaagttagtggattgcagaatggaaacttggcttttgcggcactgggtgagttttagtttgtgtgtgtcttgctggggggtggtgatgattgtctcagcactcacgcactgcacaagatggcagcaggatacagcactgcacaagatggcagctcctctgcagcttcctcctcagcctccctccttgcacccccacaggtttggcttgtggtttttgtcatcagtaacctactgcctgagatcatgatctcttaaaagatgagactctcggaagggttgattgtatgcgtcagtgagccttctatcaccttctggaacaaagtcacttgaaatctcttgatgagattaaggagtttagtgttactaagaaaatctgctttgggccgcagcagtgctgggtgttctcagacctgactgaggaagttagctgcgggctgccctgtgggctggtgcttcaggaggaatccagagaagtgttcagatgccccccttgggctcctttctaattttaatcagctctttaaatagctgcccatctcctgtgattgcacaaccaagcactttgacatttgcaccttaggagaggcagatgttaaaatggaatccaaagaccacctagggcggggctgggtgggagatgggagggccaactgcgagctgctccacttctcagctctcccctgccctgcagccctgggccagacaaggccagaaggtttcaggggcatttgacatcccctcctggttctcaccaggaaaacatccaaagctttggaggaaacaggccctgcccctggctccttaaatgccccgtctctttgtaaactgatattcagccagcaatgcctaagactttgttaagatcatttctactgcttttctttctgcttcaaacacacagttcgtctctgaggaaagtaaaataaatggaataagagtaaattgggtaaggagatatccaaagctacccagtcccttgacccagcacagttggccgacccgtgtcactccctggctgtcgctgcttctctgtgctcactgaagggtgagccaggccagtgcttccccagcccctgggcctggtcactacacagtggaaaacagacaagcggccccttccccaaatcccaagagtgtcttgctgcttggtgggtgctcatcgcaatgttctgaaggctccagggccactttgtttgtaagtatgatctgggcctcaaaataccatagtagctgcttgataaaattctaaaaatatctggttctctattatgtaaacactattacagtcaccagtgtgtgaagactcttgagtctggttctcatatcagagtcatcatttttcttcctgtggaataaaatgccttgtggacttcccaaa

SEQ ID NO: 8395 - DNA, 16318 bp, Homo sapiens
ggaggaaacgccgcgcagcgccgggctggggcgggcggcccgggacaccgacagatttttctgtgaccatgaaagagagaaataaagaatgatccatgatttctaaacaccttttcctgaggatatagtcatgttggaaggccttgtagcctgggttctcaatacctatttgggaaaatatgtcaataacctgaacactgaccagctctcagttgcacttctcaaaggtgctgttgaattagaaaacttgccattaaagaaagatgccttgaaagaattggaattaccatttgaagtcaaagctggcttcattgggaaagtaacccttcagattcccttttatcgcccccatgtggacccttgggtgatctccatctccagccttcacttaattggagccccagagaaaatacaggatttcaatgatgaaaaggagaagctgttggaaagggaacgtaagaaagcactacttcaagccctggaggagaaatggaagaatgaccgccagcagaaaggggagtcctattggtattcagttaccgcctccgtagttacaaggattgtggagaatattgaattaaaaattcaagatgtccatttacgctttgaagatggtgtcaccaatccctcccatccttttgcttttggcatctgcattaagaatgtgtccatgcaaaatgctgtgaatgagcctgtacagaaactaatgcggaaaaagcaattagacgtagcagaatttagcatctattgggatgtcgattgcactttactgggggatttgcctcagatggagttacaggaggccatggccaggagcatggagagtcgcagccatcactacgtcctggagcctgtgtttgcatctgctcttttgaagagaaactgctccaagaagcccctgcggtctcggcacagtccccgtattgattgtgatattcagctggagaccattcccttgaaactctctcagctgcaataccggcaaatcatggaattcctcaaggagctggaacgaaaggagaggcaggtgaagttccgaaggtggaaacccaaggtggcgatatctaagaactgccgagaatggtggtattttgctttgaatgctaacttgtatgagatcagagagcagaggaaacgttgcacctgggactttatgttgcaccgcgctcgtgatgctgtatcttacactgacaaatatttcaacaagttaaaaggaggcctgctgtccacagatgacaaggaggaaatgtgtcggattgaagaggaacagagctttgaggaattgaagattttgcgtgaactggttcatgatcgatttcacaaacaggaagaactagcagagagtctgcgggagcctcagtttgattctccaggagcctgtccgggagccccagaacccggtggaggcagtgggatgctgcagtatctccagtcctggtttcctggatggggtggctggtacgggcagcagaccccagaagggaatgtggttgagggactgtcagcagagcaacaggagcagtggattcctgaagagatcctgggcactgaggagttttttgaccccactgcagatgcctcgtgtatgaacacgtatacaaagcgagatcatgtctttgccaaactgaatttgcagttgcagcgaggtacagtgactctgttacacaaggagcaaggaactcctcaaatgaatgaaagtgctttcatgcagctcgagttttcagatgtaaaacttctagcagagtctcttcctcgaagaaattcctcgttgctttcagtccggttgggtggactgtttcttcgagacctggctacagaaggaactatgtttcctcttctagtcttccctaatccacaaaaagaagttggcagagtctcacaatcttttggtctacaaactacatctgcagacagaagtgatcattacccagctgcagatccagatggccccgtttttgagatgctgtatgagagaaatccggcgcacagccactttgagaggcggctcaatgtcagcacaaggcccttgaacatcatatacaatccgcaggccattaaaaaagtagcagactttttctacaagggaaaggttcatacctcaggttttggttatcagtctgaacttgagctgagagtggctgaagctgcccgaagacaatataacaagctgaagatgcagaccaaggcagaaatccggcaaactcttgatcgtttgctagtgggtgatttcattgaggagagtaaacgatggaccgtgcggctggatatttctgcccctcaggtgatatttcctgatgatttcaaattcaagaatcctgtgttagttgtcgtggatctaggaagaatgcttttgacgaacacccaagataactccaggaggaaaagtagggatgggtcagcatctgaagagacccagtttagtgatgatgaatataagacccccctggccacacctcctaacaccccacctcccgagtcaagcagcagcaacggagagaaaacacctcccttttctggagttgagttcagtgaagaacagcttcaagcacatttaatgagcacaaagatgtatgagaggtactcgctgtcatttatggacctccagatcatggttggacgagtgaaagacaattggaagcatgtccaggatattgacgtgggaccaacacatgtggtagagaagttcaacgttcacctacagttagagcgtcgattgatttatacttcagatcccaaatatccaggagccgtgctctcaggcaacttaccagacttaaaaatccacattaatgaagataaaatatctgcactaaagaattgctttgctctcctcaccaccccagaaatgaaaacttctgacactcagattaaagaaaagatttttccccaggaggagcagcggggaagtttgcaagactccgtaatgaatttaacccagagcattgtgttgttggagcagcatacccgcgaggttctggtggagtcgcagctcctcctggcggaatttaaagtgaactgtatgcagcttggtgttgagagcaatggccggtacatttctgtgctcaaggtgtttggtaccaatgctcactttgtgaagaggccttatgatgctgaagtctccctaactgttcatggtttgctcctggtggataccatgcagacatatggtgctgattttgaccttttgatggcttcacataagaacttgagctttgatattccaacgggaagccttcgggatagcagggcccagtctcctgtctctggaccgaatgtggcccacttaactgatggagctacactgaacgaccgatcagctactagtgtttcacttgacaaaattcttaccaaagagcaagagtcccttattaagttggaatatcagtttgtgagttcagagtgcccatcgatgaatttagacagtactcttcaggtgatttccctacaggtgaataatttagatattatcctcaatccagagacgattgtggagctaattggttttcttcaaaaatcctttcccaaggaaaaagatgatttaagtcctcaacctttaatgactgattttgaaagaagcttcagagaacaaggaacttaccagtctacatatgaacaaaacactgaggttgcagtggaaatccataggctgaacttactgcttcttcggacagtgggcatggcaaatagagagaaatatggcagaaaaattgcaactgcaagtataggtggcaccaaagttaatgtctcaatgggtagcacgtttgacatgaatggttctcttggctgtttacagcttatggatttgacacaagataacgttaaaaaccagtatgttgtcagcattgggaattctgtaggctatgaaaatatcatcagtgatattggctactttgaatctgtgtttgtcagaatggaagatgcagccctcactgaagctttgagtttcacgtttgttgagagatctaaacaggagtgttttctcaacctgaagatggcttctttacattataaccactctgctaagtttttgaaggagttgacgttatccatggatgaactggaagaaaattttcgaggtatgctgaaaagcgcagccaccaaagtcaccacagtactagctaccaagactgccgagtatagcgagatggtatcgctctttgaaactccaaggaagactcgggaaccctttatcttagaggaaaatgaaatatatgggtttgacctagcttcgtctcatttggacactgtaaagctaatcttgaacataaacattgaatcaccagttgtttctatccctcggaagccggggagtcctgagttgttggtgggacacttgggacagatattcatccagaattttgtggcgggagatgatgaatccagaagtgaccgtctgcaggtggaaatcaaggacattaaactgtattctttgaattgcacccagttggcaggtagagaagctgttgggtctgaaggaagccggatgttttgcccaccttccgggtctggcagtgccaacagtcaggaggaagctcatttcacacgacatgatttctttgaatctttgcatagaggtcaagcttttcacatcctgaacaacaccaccattcagtttaaactggagaagatccctatagagagagaatctgaattgactttttctcttagcccagatgacctgggaacttctagcatcatgaagattgaaggaaaatttgtcaatccagttcaggtggtgttagcaaagcatgtatatgagcaggttttacaaaccctggacaatctcgtgtacagtgaagatctgaataagtatccagccagtgctacctcctccccttgccctgattctcctctgcctcccctcagtacctgtggagaatcttctgttgaaaggaaggagaatggattgttcagccactccagcctttctaacacctctcagaagtcattgtcagtgaaggaagtcaaatcctttactcagattcaagccaccttttgtatatcagagcttcaggttcagctaagtggagatctgactttgggggcccaaggtcttgtgagcttaaagtttcaggactttgaggtggaattcagtaaagaccatccccagactttatctattcagattgccctgcattctctgctgatggaggacttattggagaagaatccagattctaaatataagaacctgatggtgtctcgaggagcccctaagccatctagtttagcacaaaaagaatacctttctcagtcttgcccctcagtgtccaatgtggaatatcctgatatgcctcggtctctcccttcccacatggaagaagctcctaatgtcttccagttgtatcaaaggcccacctctgcgtcccggaaaaagcaaaaggaagtccaagacaaggactatcccttgaccccacctccttctccaacagtggatgagcccaagatacttgttggaaagagtaaatttgatgattccttagtccacatcaacatattcttggtagataagaaacatccagaattctcttccagttacaatcgagttaaccggagcattgatgttgattttaattgcttggatgtgctgatcacactgcaaacctgggttgtgatattagacttttttggaatcggctccactgcagacaaccacgcaatgaggctgcctcctgagggcattctgcacaacgtgaagttggagccacatgcctccatggagtctggacttcaggatccagtgaacaccaaactggatctcaaggttcattcactttctctagtgctgaataagaccaccagtgagcttgccaaagcaaatgtgtccaaattagtagcacacctggaaatgattgagggagacctggccttacagggcagcattgggagtctgtctctaagtgacctcacatgccatggagagttctacagagaacggttcactaccagtggtgaagaagcactcatcttccagacttttaaatacggacggcctgaccctctgctccggagagaacacgacattcgcgtgagcctccggatggcctctgtgcagtatgtgcatactcagcgtttccaggcagaggtggtggccttcattcagcatttcactcagctgcaggatgtcttagggcgccagcgagctgctattgaggggcagacggtgagagatcaagcccagcgctgttcacgggttctcctggatattgaggctggtgctcccgttctcttgatcccagaaagttccagatcaaataatctgattgtagcaaatttggggaagttgaaagtcaaaaataagtttctgtttgctggttttcctggcaccttttccctacaagataaggaatctgtgccttcagcttccccaacgggtattcccaaacacagtctgaggaaaacgacaagcacggaggagcccaggggaacccattcccaggggcagttcacgatgcctcttgctggaatgagcctaggaagcctgaagagtgagtttgtgcccagtacctccaccaagcagcaagggccgcaacccacactgtctgttggccaagagtccagtagtccagaagaccatgtctgcctgctggattgcgttgtcgtggatctccaggacatggacatctttgctgcagagagacatccgagagaatactcgaaggcaccagaggatagtagtggagatctgatcttcccttcctattttgtgcgacagacaggaggaagcctcttaaccgagccttgtaggctgaaattgcaggtggaaaggaatttggacaaagaaataagtcatactgtgccagacatatctatccatggcaatctctcctcagtccactgctctctggatctgtataaatacaagctgatccgcggcttattagagaacaacctgggagaacccatagaggaatttatgcggccttatgatttacaagatccaagaattcatactgtcctgagtggagaagtgtacacctgtatgtgcttcctcattgatatggtgaatgtaagtctggagcttaaagatccaaaaagaaaagaaggtgctgggtccctagccagatttgacttcaagaaatgcaaactgctctatgaaagtttttccaaccaaaccaagtccattaacttggtttcccattccatgatggcttttgacacccgttatgctgggcagaagaccagccctggcatgacgaatgtgttcagctgtatctttcagcccgctaagaacagcagcaccacccaagggtccattcagattgaactacatttcagatctaccaaggattcctcctgctttacagtagttctcaacaatctccgtgtgtttctcatatttgactggctactgttagtccatgattttctccacactcccagtgatattaagaaacaaaatcatgttactccttctcgccaccgtaactctagcagcgaatctgctatagttcccaaaactgtgaagagtggagtagttaccaagcggtcttcccttcctgtgtccaatgaaaggcacctggaggtcaaggtcaatgtaacaggtacggagtttgtggtcattgaagatgtgtcctgcttcgacaccaatgccattattctgaaaggcaccacagtgctcacctataagccccggtttgttgatcgccccttttcaggaagtttgtttggcattgaggtgttttcatgccgactagggaatgagcatgatacagctctttcaattgtggatcccgtacaaattcaaatggagttggtggggaattcttcttatcaaaatagttcaggattgatggatgcattcaatagtgaagatttcccacctgtcctggagattcagttacaagccctggatatcagactctcctataatgatgttcagctgtttcttgccattgcaaaatccatcccagagcaagctaatgctgcagtgccagactcagtggccctggagtcagactccgttggcacttaccttccaggtgcatctcgcgttggagaggaaatcagagaagggacaagacacaccttagatcctgtcttggagttacagctggctaggctgcaggagctgggattcagcatggatgattgtcgcaaagctcttttggcgtgtcaaggccaattgaaaaaggcagcaagttggttgtttaagaatgcggaacctctgaagtctctttccttggcctccaccagccgagatagcccaggggctgtggcagcgccattgatctctggcgtggagatcaaagctgagagtgtgtgcatctgtttcatcgatgactgcatggattgtgatgttcctctcgctgaactcaccttttcccgtctgaattttcttcagcgtgtaagaactagccctgaaggctatgcccacttcaccctttctggagattattataaccgtgctctttcaggctgggagccatttattgagccttggccatgctctgtatcctggcaacagcaggcagctagtcgtctccatcctcctcgactgaagctagaagccaaggccaaacctcgtttggatatcaatatcacttctgtgctaattgaccagtatgtaagtaccaaggaatcgtggatggcagattactgtaaagatgacaaggacatagagtcagctaaatcagaagactggatgggctcttcggtggatcctccatgttttggacaaagcctcccccttgtctaccttagaactaggagtacagccagtctgactaacctagagcaccagatctatgctagagcagaggtgaaaacccccaagcgccggcagccatttgtcccctttgctctgaggaaccacacggggtgcactttgtggtttgccaccctgaccaccacacccaccagagctgcactctctcacagtgggagtccaggggtagttccagaagggaacggaacatttctcgatgatactcacaatgttagtgaatggcgagaagtccttacaggtgaagagattccctttgaatttgaagcaagaggaaagttaagacacagacacacccatgacctccggattcatcaactgcaagtgagagtaaatggctgggagcaagtgagcccagtgtctgtggacaaagtcgggaccttttttcgatatgcagcaccagataaaaattcatcttcctctacgattggcagcccaagcagcagaacaaatattatacatccccaggtttatttctcttcactcccaccagtgcgggtggtctttgcagtgactatggaaggcagtgcacggaaagtcatcactgtccggtcagccctcattgtgaggaacagacttgagacaccaatggaactaagactggatagcccatcagctccagacaagccagtggtgcttcctgctatcatgccaggggattcgtttgctgtgcctttacacctcacttcttggcggctacaggcccggcccaaaggattgggtgtatttttctgtaaggctcccattcattggaccaatgtagtgaagactgcagaaattagtagcagtaaacgagagtgccactctatggacacagaaaaaagccgatttttcaggttttgtgtggctataaagaaagagaattatccagattatatgccctcaaacatattttctgacagtgcaaaacagattttcagacagcctgggcataccatatatctcctgccaactgtggtaatctgcaacttgctaccctgtgaacttgatttttatgttaaaggaatgccaattaatgggacgctgaaacctggcaaggaggcagctctccatacagctgatacatcccagaacattgagctgggggtatcactggagaatttccccctctgtaaagaattgctcattccacctggaacccaaaactatatggtgagaatgcgactctatgacgtcaaccgtcggcagctgaacctcaccatccggattgtgtgtcgagcagaaggatccttaaagatcttcatttctgctccatattggctgattaacaaaacagggttgccactgatcttcagacaggacaatgccaagacagatgctgcaggccagtttgaggagcatgagctggcccgtagcctgagtcctctcttattctgctatgctgacaaagagcagccaaacctctgcacgatgagaatcggaagggggattcatccagaaggcatgccgggctggtgtcagggcttctccctggatggtggtagtggtgtccgagctttgaaagtcatccagcaaggaaaccgcccagggctgatctataacattggtattgatgtcaagaaaggccgaggtcgatacattgatacctgcatggtcatctttgccccccgttacctgttagataataaatcatctcacaagcttgcatttgcacagagggaatttgccaggggacagggaacagccaatcccgaaggttacatttccacccttcctggttccagtgtggtgttccactggcctcggaatgactatgatcagctattgtgtgtcagactgatggacgttcccaattgtatttggtctggaggctttgaagtcaacaagaataattccttccatatcaacatgagggataccttgggaaaatgcttcttcctacgagtggaaattactctccgaggagctacgtataggatctcatttagtgacacagatcagttacctcctcctttccgaattgacaacttttctaaggtcccggttgtctttactcagcatggcgtagctgaacccaggctccggactgaagtgaagcccatgacttcattggattatgcctgggacgaacccaccttgccaccttttatcactctgactgttaaaggggcagggtcctctgagatcaactgcaacatgaatgatttccaggataatcggcagctttattatgaaaatttcatttacattgctgctacatatacattctctggcttgcaggagggaacaggcaggcctgtggcttccaacaaggccattacctgtgcggagctcgttttggatgtctcacccaagacacaaagagtcattttaaaaaagaaggaaccaggaaagcgttctcagctgtggaggatgacaggaacaggaatgctggcccatgagggctcctcagttcctcacaatcccaataagccctcagccgcccgctccaccgaggggtctgccatcttagatattgctggtctcgctgcagtgactgacaacagatacgagccactgatgctgagaaagcctgaccgcaggcgaagcacaactcagacgtggagtttccgagaaggaaaactgacctgtgggttacatgggttggtcgtccaggccaaaggaggactttctggtttgtttgatggagctgaagttgttcttggtcctgacacttccatggagcttttggggccagttccacctgaacaacaatttattaatcaaaaaatgagacctggttctggaatgttatccatcagagtcatcccagatggaccaactagagcactccagataacagatttctgccaccggaaaagcagccgttcatatgaagtggatgaacttcctgtcaccgaacaagagctgcagaaattaaagaatccagatacagagcaggaattggaagtgcttgtgaggttagaaggtggaattgggttgtccttaattaataaagtcccagaagaactggtctttgcaagtcttacaggaatcaatgtgcactatacacagctggcaaccagtcacatgcttgaactcagcatacaggatgtacaggtggacaatcagctcattggtaccacgcagcccttcatgctctatgtgactcccctgagcaatgagaatgaggtcatcgagaccggcccagctgtgcaagtcaacgcagtgaagttccccagtaagagtgcactgaccaacatctacaagcatctgatgatcacagctcagagattcacagtgcaaattgaggagaaactgctcctcaagctgctaagtttctttggctacgatcaagcagaatcagaggtggaaaaatatgatgaaaacctccatgaaaagacagctgagcaaggtggaacaccaattcgatactactttgaaaatctcaaaatcagcattcctcagatcaagctaagtgtgttcacctccaacaagctcccattggatcttaaggccctaaaaagcaccttggggtttcctttgatacggtttgaagacgctgtgattaatctagatccattcactcgggtacatccctatgagaccaaggagttcatcatcaatgatatcctcaaacatttccaggaggaactcctcagccaggcagctcgaatcctgggatcagtggattttcttggcaatcctatggggcttttgaatgatgtttctgaaggggttactggactgataaaatatggaaatgtcgggggcctcatcagaaatgttacacacggagtatcaaactctgctgccaagtttgctggaacattatcagatggcttagggaagacgatggacaatcggcatcagtcagagcgggagtacatcaggtaccatgcagccacaagtggtgaacaccttgtagccggcatccatggcctggctcatggtatcattggtggactgaccagtgttataacttcgacagtggaaggtgtgaaaacagaagggggtgtcagcggtttcatatctggccttggaaaagggcttgttggcactgtaaccaagccagtggcaggcgccctggattttgcatcagaaacagcccaggcggtgagagacacagccacactcagcggccccaggactcaagcacagagggttcggaaaccgcgttgctgcacggggccccaggggctgcttccccgatattctgagagccaggcggaaggacaggagcagctcttcaaactcacagacaacatacaggacgaattcttcatcgctgtggagaacattgacagctactgcgtgctcatctcctccaaagctgtttacttcctgaaaagtggagactacgtggatcgagaagccattttcctagaagtcaaatacgatgacctctaccactgccttgtctccaaagaccatgggaaggtgtatgtgcaggtgaccaagaaagccgtgagcacgagcagtggagtgtccatccccggcccctcccaccagaagcccatggtccatgtgaaatctgaggtccttgctgtcaagttgtcacaagaaataaactacgcaaagagcctctactatgaacagcagcttatgttaagactcagcgaaaaccgagagcagctggagctggactcctgaagccccgctgctgagatgggcgctcccgacacagcgcagacccaccaggaggaaagaggcccagctctcagctgacgatggaggcagaaccggagtcgggtttggggaagttgtcaaggaatgagggaaagtaaatcctcatgaggaaaagtacaaatggaaatcgtattaatttgtgaggcagggagttattttagattatgggaaataatttttaaaggtattggttaaataacgtttaaaaacatgtactgagatgaatctaatttttagattgccctgtattttgttaacatgtatatatgtacaacagtgtgtttgtaaatatataggaacgtttctgaacagggtctgtgctatgtgtaaaggtttgttaactgtaaagtaatataaagttatattggatcttctattgcactaattctagatgtctaattcaggatactgtctatagaaaggcattcttaaaagttaaagaatgttacgtcttagttttggagactaaagtattcccagtaaagtgggttgaggtgagggctgtggtcctgaaagggacgcctttgacatcgtggctgtccagttgggctgtgagctgtggcacccaggactggcgctggcccttcagaaggatctaggagaggggcttgggagcccacttttaatttctcacccccattttacaaagagtgcttagattcttacaaattatgatgtaagttatccatttggctttttcctaactagtcttaccaaacttagggggaaacctgtgctccattaccacatgggtgcaagtcagcattgtaagttttctcaggttattattattagagaggttggaaacattggtaaactctgttgattgagaaggaaaaaaaaagtcccattgaactgttgcaacaaatcagaaatccacataaaagtgctctcctgcctgggcagcaacaaccaagaacaaagccccgggactgttttctttttaataaagccacaggcaggcatcgtagctccacagcccgaggggacacaggatggaaaccccaggatgagaagggagcagggagagttccagaaagggggatgaaataggagtattaaaaagctgcgttggtaagtttttcatggaaccaagatttgacaaaggcatctcttatccttggttttaaattcctgctgggagcaaggcctggtatgagcgccctgggtcttgtttttggtgtttcgcttttctgtaaggattaagcagatagggagaagggaaaaggggcctcactttagaatgaatgagtcaccttgtgatttttaaatttttattttaataaagctaatcaatttctacaaccttgtcacatgtagctgagtctgggatgactcagtggatcagtggatgcgtggaaggttttggtgtttataactcatgacccaaatccttccaagacacaaatgaagctaatcttcttcccctccctttcctctcccacttcccctctgtgtctgtgtctgtgtgtgtgtgtgtgtgtgtgtgtgtgcgcgcgcgcgcgtgcatgcagagaggaaggaagggagctttagcacaagtagctacatagtgttcaaggatcagctttcttgaactccgaggcttggttgcctttgctgaactccaagttagtggattgcagaatggaaacttggcttttgcggcactgggtgagttttagtttgtgtgtgtcttgctggggggtggtgatgattgtctcagcactcacgcactgcacaagatggcagcaggatacagcactgcacaagatggcagctcctctgcagcttcctcctcagcctccctccttgcacccccacaggtttggcttgtggtttttgtcatcagtaacctactgcctgagatcatgatctcttaaaagatgagactctcggaagggttgattgtatgcgtcagtgagccttctatcaccttctggaacaaagtcacttgaaatctcttgatgagattaaggagtttagtgttactaagaaaatctgctttgggccgcagcagtgctgggtgttctcagacctgactgaggaagttagctgcgggctgccctgtgggctggtgcttcaggaggaatccagagaagtgttcagatgccccccttgggctcctttctaattttaatcagctctttaaatagctgcccatctcctgtgattgcacaaccaagcactttgacatttgcaccttaggagaggcagatgttaaaatggaatccaaagaccacctagggcggggctgggtgggagatgggagggccaactgcgagctgctccacttctcagctctcccctgccctgcagccctgggccagacaaggccagaaggtttcaggggcatttgacatcccctcctggttctcaccaggaaaacatccaaagctttggaggaaacaggccctgcccctggctccttaaatgccccgtctctttgtaaactgatattcagccagcaatgcctaagactttgttaagatcatttctactgcttttctttctgcttcaaacacacagttcgtctctgaggaaagtaaaataaatggaataagagtaaattgggtaaggagatatccaaagctacccagtcccttgacccagcacagttggccgacccgtgtcactccctggctgtcgctgcttctctgtgctcactgaagggtgagccaggccagtgcttccccagcccctgggcctggtcactacacagtggaaaacagacaagcggccccttccccaaatcccaagagtgtcttgctgcttggtgggtgctcatcgcaatgttctgaaggctccagggccactttgtttgtaagtatgatctgggcctcaaaataccatagtagctgcttgataaaattctaaaaatatctggttctctattatgtaaacactattacagtcaccagtgtgtgaagactcttgagtctggttctcatatcagagtcatcatttttcttcctgtggaataaaatgccttgtggacttcccaaa

SEQ ID NO: 8396 - DNA, 1505 bp, Homo sapiens
ctctcacactgcatgtaatagaaccagctgccattcagaacttgcccatctgaggtcataaaggaaagcctgcacgtttcttttcttcaaacagcttttcaggactggggagaggaagaaacgctgtctagagagggtcaaggcacggtgatgtttctctctggagaagcaaagcagtctgcctccctccccccggccagaaacgggacaccttagtgctttcttcagagtagctctctgtttgtggtataatgttgctggaggaaacagggctgacaccacaggaaacctgcctgtctccaaggaggccgcatcggtggcagaggactcaagcacagagggttcggaaaccgcgttgctgcacggggccccaggggctgcttccccgatattctgagagccaggcggaaggacaggagcagctcttcaaactcacagacaacatacaggacgaattcttcatcgctgtggagaacattgacagctactgcgtgctcatctcctccaaagctgtttacttcctgaaaagtggagactacgtggatcgagaagccattttcctagaagtcaaatacgatgacctctaccactgccttgtctccaaagaccatgggaaggtgtatgtgcaggtgaccaagaaagccgtgagcacgagcagtggagtgtccatccccggcccctcccaccagaagcccatggtccatgtgaaatctgaggtccttgctgtcaagttgtcacaagaaataaactacgcaaagagcctctactatgaacagcagcttatgttaagactcagcgaaaaccgagagcagctggagctggactcctgaagccccgctgctgagatgggcgctcccgacacagcgcagacccaccaggaggaaagaggcccagctctcagctgacgatggaggcagaaccggagtcgggtttggggaagttgtcaaggaatgagggaaagtaaatcctcatgaggaaaagtacaaatggaaatcgtattaatttgtgaggcagggagttattttagattatgggaaataatttttaaaggtattggttaaataacgtttaaaaacatgtactgagatgaatctaatttttagattgccctgtattttgttaacatgtatatatgtacaacagtgtgtttgtaaatatataggaacgtttctgaacagggtctgtgctatgtgtaaaggtttgttaactgtaaagtaatataaagttatattggatcttctattgcactaattctagatgtctaattcaggatactgtctatagaaaggcattcttaaaagttaaagaatgttacgtcttagttttggagactaaagtattcccagtaaagtgggttgaggtgagggctgtggtcctgaaagggacgcctttgacatcgtggctgtccagttgggctgtgagctgtggcacccaggactggcgctggcccttcagaaggatctaggagaggggcttgggagcccacttttaatttctcaccccca

SEQ ID NO: 8397 - DNA, 2498 bp, Homo sapiens
atgagaggagagaaactcagtaaggccctaaaaagcaccttggggtttcctttgatacggtttgaagacgctgtgattaatctagatccattcactcgggtacatccctatgagaccaaggagttcatcatcaatgatatcctcaaacatttccaggaggaactcctcagccaggcagctcgaatcctgggatcagtggattttcttggcaatcctatggggcttttgaatgatgtttctgaaggggttactggactgataaaatatggaaatgtcgggggcctcatcagaaatgttacacacggagtatcaaactctgctgccaagtttgctggaacattatcagatggcttagggaagacgatggacaatcggcatcagtcagagcgggagtacatcaggtaccatgcagccacaagtggtgaacaccttgtagccggcatccatggcctggctcatggtatcattggtggactgaccagtgttataacttcgacagtggaaggtgtgaaaacagaagggggtgtcagcggtttcatatctggccttggaaaagggcttgttggcactgtaaccaagccagtggcaggcgccctggattttgcatcagaaacagcccaggcggtgagagacacagccacactcagcggccccaggactcaagcacagagggttcggaaaccgcgttgctgcacggggccccaggggctgcttccccgatattctgagagccaggcggaaggacaggagcagctcttcaaactcacagacaacatacaggacgaattcttcatcgctgtggagaacattgacagctactgcgtgctcatctcctccaaagctgtttacttcctgaaaagtggagactacgtggatcgagaagccattttcctagaagtcaaatacgatgacctctaccactgccttgtctccaaagaccatgggaaggtgtatgtgcaggtgaccaagaaagccgtgagcacgagcagtggagtgtccatccccggcccctcccaccagaagcccatggtccatgtgaaatctgaggtccttgctgtcaagttgtcacaagaaataaactacgcaaagagcctctactatgaacagcagcttatgttaagactcagcgaaaaccgagagcagctggagctggactcctgaagccccgctgctgagatgggcgctcccgacacagcgcagacccaccaggaggaaagaggcccagctctcagctgacgatggaggcagaaccggagtcgggtttggggaagttgtcaaggaatgagggaaagtaaatcctcatgaggaaaagtacaaatggaaatcgtattaatttgtgaggcagggagttattttagattatgggaaataatttttaaaggtattggttaaataacgtttaaaaacatgtactgagatgaatctaatttttagattgccctgtattttgttaacatgtatatatgtacaacagtgtgtttgtaaatatataggaacgtttctgaacagggtctgtgctatgtgtaaaggtttgttaactgtaaagtaatataaagttatattggatcttctattgcactaattctagatgtctaattcaggatactgtctatagaaaggcattcttaaaagttaaagaatgttacgtcttagttttggagactaaagtattcccagtaaagtgggttgaggtgagggctgtggtcctgaaagggacgcctttgacatcgtggctgtccagttgggctgtgagctgtggcacccaggactggcgctggcccttcagaaggatctaggagaggggcttgggagcccacttttaatttctcacccccattttacaaagagtgcttagattcttacaaattatgatgtaagttatccatttggctttttcctaactagtcttaccaaacttagggggaaacctgtgctccattaccacatgggtgcaagtcagcattgtaagttttctcaggttattattattagagaggttggaaacattggtaaactctgttgattgagaaggaaaaaaaaagtcccattgaactgttgcaacaaatcagaaatccacataaaagtgctctcctgcctgggcagcaacaaccaagaacaaagccccgggactgttttctttttaataaagccacaggcaggcatcgtagctccacagcccgaggggacacaggatggaaaccccaggatgagaagggagcagggagagttccagaaagggggatgaaataggagtattaaaaagctgcgttggtaagtttttcatggaaccaagatttgacaaaggcatctcttatccttggttttaaattcctgctgggagcaaggcctggtatgagcgccctgggtcttgtttttggtgtttcgcttttctgtaaggattaagcagatagggagaagggaaaaggggcctcactttagaatgaatgagtcaccttgtgatttttaaatttttattttaataaagctaatcaatttct

SEQ ID NO: 8398 - DNA, 947 bp, Homo sapiens
gaattcattgaagagttgctgtctcccccttttgggggtttagtggcatttgtgaaggaggctgaggctttgattgagcgtggacaggctgagcgacttcgaggggaagaagcccgggtaactcagctgatccgtggctttggtagttcctggaaatcatcagtggaatctctgagtcaggatgtaatgcggagtttcaccaacttcagaaatggcaccagtatcattcagggagcgctgacccagctgatccagctctatcatcgcttccaccgggtgctgtcccagccgcagctccgagccctccctgcccgggctgagctcatcaacattcaccaccttatggtggagctcaagaagcataagcccaacttctgatgtgccagaaaccgccctgagatctgccggtcatctccatggacttctgcaccccattccatacccttcttcacctggggtaccccttccagttttccccttgcttcccaggcccttgacatggcttacctgccttcactcccagcaccttgcccaacaggataagctggatccccttggccttctgaatatcccagtgtcttcaggtttcccaagaccacttccctgtgggcttccaaaatggcctttatcatttctccagtctgtcaccctcctttcctgctcccatacacccaaggcttgtttcttcccctgtaaaaaccactgcctcaatctctggttcactcaactagtcaccatgtcctgaggcatgaagcctcctcagctcttggaattgctggcaaggggtgactgcctctgagtcattgtgtttttcaaagtgatttcttttctgtagctttttgacctaagatctcagcaatttgaacactaacctctcccctcctggctcaagaattactccgaagtcagtctgcagaaaataaatatttagtatgacatgacactta

SEQ ID NO: 8399 - DNA, 947 bp, Homo sapiens; identical to SEQ ID NO: 8398

SEQ ID NO: 8400 - DNA, 2355 bp, Homo sapiens
cggtgcgcctttctttacagttcgtaaggttcataggcgggtggtcctgggctccaggaaccactgcaacttggggagttggatatcacttctgatgaattcatcctggatgaagtggatgttcacattcaggcaaatctggaggatgagttagtaaaggaagctcttaaaacgggtgtagatctccgtcactattcaaagcaagttgagctggagctacagcagattgaacagaaatccattcgggattatattcaagagagtgagaatatagcatctctacacaaccagatcacagcctgtgatgctgtcctggagcgaatggagcagatgttgggagcttttcagagtgacctcagctccatcagctctgagatccggacactgcaggaacagtcaggagccatgaacattcgacttcgaaatcgccaggcagttcgggggaaacttggggagcttgttgatggtctggtggtgccttctgctctggtcacggcaattctggaggctccagtgacagagcccaggttcttggagcagctacaggagctggatgccaaggcagccgcagtcagagagcaggaagctagaggcacagcagcctgcgcagatgtcagaggcgtgctcgatcggctccgggtcaaggcagtgacgaagatccgagagtttatcctccagaagatttattccttcaggaaacccatgaccaactatcagatcccccagacggccctgctgaagtacaggttcttctatcagtttctgctgggcaatgaacgagcaacagcaaaggagatcagggatgaatatgtggagacgctgagcaagatttacctgtcttactaccgctcttacctggggcggctcatgaaggtgcagtatgaggaagtcgctgagaaagatgatctaatgggtgtggaagatacagcaaagaaaggattcttctcaaagccatcgctccgcagcaggaacaccattttcaccctaggaacccgcggctctgtcatctcccccactgaacttgaggcccccatcctggtgcctcacacagcgcagcgcggagagcagaggtatccatttgaggccctcttccgcagccagcactacgccctcctagacaattcctgccgcgaataccttttcatctgtgaattttttgttgtgtctggcccagctgcacacgacctgttccatgctgtcatgggccgtacactcagcatgaccctgaaacacctggattcttatctagctgactgctacgatgccattgctgtttttctctgtatccacattgttctccggttccgtaacattgcagcaaagagggatgttcctgccctggacaggtactgggaacaggtgcttgccttgctatggccacggtttgaactgatcctggagatgaatgttcagagcgtccgaagcactgacccccagcgcctaggggggttggatactcggccccactatatcacacgccgctatgcagagttctcctccgctcttgtcagtatcaaccagacaattcctaatgaacggaccatgcaattgctgggacagctgcaggtggaggtggagaattttgtcctccgagtggcagctgagttctcctcaaggaaggagcagcttgtgtttctgatcaacaactatgacatgatgctgggtgtgctgatggagcgggctgcagatgacagcaaagaggttgagagcttccagcagctgctcaatgctcggacacaggaattcattgaagagttgctgtctcccccttttgggggtttagtggcatttgtgaaggaggctgaggctttgattgagcgtggacaggctgagcgacttcgaggggaagaagcccgggtaactcagctgatccgtggctttggtagttcctggaaatcatcagtggaatctctgagtcaggatgtaatgcggagtttcaccaacttcagaaatggcaccagtatcattcagggagcgctgacccagctgatccagctctatcatcgcttccaccgggtgctgtcccagccgcagctccgagccctccctgcccgggctgagctcatcaacattcaccaccttatggtggagctcaagaagcataagcccaacttctgatgtgccagaaaccgccctgagatctgccggtcatctccatggacttctgcaccccattccatacccttcttcacctggggtaccccttccagttttccccttgcttcccaggcccttgacatggcttacctgccttcactcccagcaccttgcccaacaggataagctggatccccttggccttctgaatatcccagtgtcttcaggtttcccaagaccacttccctgtgggcttcc

SEQ ID NO: 8401 - DNA, 2355 bp, Homo sapiens; identical to SEQ ID NO: 8400

SEQ ID NO: 8402 - DNA, 2687 bp, Homo sapiens
tttcagacttccatatttccatttgcagttgggtgaagtggttagagctgaaaggggacagctggagtcaaacaacttaactcaaatatctgggaacgatttcgcgctgaggaagaccctttgggacttgtagctccactccggggaacggactcgccgggaactggtgttgcgggctgggacctcagatatggaggaggaagagggcccgctggcgggtggtcctgggctccaggaaccactgcaacttggggagttggatatcacttctgatgaattcatcctggatgaagtggatgttcacattcaggcaaatctggaggatgagttagtaaaggaagctcttaaaacgggtgtagatctccgtcactattcaaagcaagttgagctggagctacagcagattgaacagaaatccattcgggattatattcaagagagtgagaatatagcatctctacacaaccagatcacagcctgtgatgctgtcctggagcgaatggagcagatgttgggagcttttcagagtgacctcagctccatcagctctgagatccggacactgcaggaacagtcaggagccatgaacattcgacttcgaaatcgccaggcagttcgggggaaacttggggagcttgttgatggtctggtggtgccttctgctctggtcacggcaattctggaggctccagtgacagagcccaggttcttggagcagctacaggagctggatgccaaggcagccgcagtcagagagcaggaagctagaggcacagcagcctgcgcagatgtcagaggcgtgctcgatcggctccgggtcaaggcagtgacgaagatccgagagtttatcctccagaagatttattccttcaggaaacccatgaccaactatcagatcccccagacggccctgctgaagtacaggttcttctatcagtttctgttgggcaatgaacgagcaacagcaaaggagatcagggatgaatatgtggagacgctgagcaagatttacctgtcttactaccgctcttacctggggcggctcatgaaggtgcagtatgaggaagtcgctgagaaagatgatctaatgggtgtggaagatacagcaaagaaaggattcttctcaaagccatcgctccgcagcaggaacaccattttcaccctaggaacccgcggctctgtcatctcccccactgaacttgaggcccccatcctggtgcctcacacagcgcagcgcggagagcagaggtatccatttgaggccctcttccgcagccagcactacgccctcctagacaattcctgccgcgaataccttttcatctgtgaattttttgttgtgtctggcccagctgcacacgacctgttccatgctgtcatgggccgtacactcagcatgaccctgaaacacctggattcttatctagctgactgctacgatgccattgctgtttttctctgtatccacattgttctccggttccgtaacattgcagcaaagagggatgttcctgccctggacaggtactgggaacaggtgcttgccttgctatggccacggtttgaactgatcctggagatgaatgttcagagcgtccgaagcactgacccccagcgcctaggggggttggatactcggccccactatatcacacgccgctatgcagagttctcctccgctcttgtcagtatcaaccagacaattcctaatgaacggaccatgcaattgctgggacagctgcaggtggaggtggagaattttgtcctccgagtggcagctgagttctcctcaaggaaggagcagcttgtgtttctgatcaacaactatgacatgatgctgggtgtgctgatggagcgggctgcagatgacagcaaagaggttgagagcttccagcagctgctcaatgctcggacacaggaattcattgaagagttgctgtctcccccttttgggggtttagtggcatttgtgaaggaggctgaggctttgattgagcgtggacaggctgagcgacttcgaggggaagaagcccgggtaactcagctgatccgtggctttggtagttcctggaaatcatcagtggaatctctgagtcaggatgtaatgcggagtttcaccaacttcagaaatggcaccagtatcattcagggagcgctgacccagctgatccagctctatcatcgcttccaccgggtgctgtcccagccgcagctccgagccctccctgcccgggctgagctcatcaacattcaccaccttatggtggagctcaagaagcataagcccaacttctgatgtgccagaaaccgccctgagatctgccggtcatctccatggacttctgcaccccattccatacccttcttcacctggggtaccccttccagttttccccttgcttcccaggcccttgacatggcttacctgccttcactcccagcaccttgcccaacaggataagctggatccccttggccttctgaatatcccagtgtcttcaggtttcccaagaccacttccctgtgggcttccaaaatggcctttatcatttctccagtctgtcaccctcctttcctgctcccatacacccaaggcttgtttcttcccctgtaaaaaccactgcctcaatctctggttcactcaactagtcaccatgtcctgaggcatgaagcctcctcagctcttg

SEQ ID NO: 8403 - DNA, 2687 bp, Homo sapiens
tttcagacttccatatttccatttgcagttgggtgaagtggttagagctgaaaggggacagctggagtcaaacaacttaactcaaatatctgggaacgatttcgcgctgaggaagaccctttgggacttgtagctccactccggggaacggactcgccgggaactggtgttgcgggctgggacctcagatatggaggaggaagagggcccgctggcgggtggtcctgggctccaggaaccactgcaacttggggagttggatatcacttctgatgaattcatcctggatgaagtggatgttcacattcaggcaaatctggaggatgagttagtaaaggaagctcttaaaacgggtgtagatctccgtcactattcaaagcaagttgagctggagctacagcagattgaacagaaatccattcgggattatattcaagagagtgagaatatagcatctctacacaaccagatcacagcctgtgatgctgtcctggagcgaatggagcagatgttgggagcttttcagagtgacctcagctccatcagctctgagatccggacactgcaggaacagtcaggagccatgaacattcgacttcgaaatcgccaggcagttcgggggaaacttggggagcttgttgatggtctggtggtgccttctgctctggtcacggcaattctggaggctccagtgacagagcccaggttcttggagcagctacaggagctggatgccaaggcagccgcagtcagagagcaggaagctagaggcacagcagcctgcgcagatgtcagaggcgtgctcgatcggctccgggtcaaggcagtgacgaagatccgagagtttatcctccagaagatttattccttcaggaaacccatgaccaactatcagatcccccagacggccctgctgaagtacaggttcttctatcagtttctgctgggcaatgaacgagcaacagcaaaggagatcagggatgaatatgtggagacgctgagcaagatttacctgtcttactaccgctcttacctggggcggctcatgaaggtgcagtatgaggaagtcgctgagaaagatgatctaatgggtgtggaagatacagcaaagaaaggattcttctcaaagccatcgctccgcagcaggaacaccattttcaccctaggaacccgcggctctgtcatctcccccactgaacttgaggcccccatcctggtgcctcacacagcgcagcgcggagagcagaggtatccatttgaggccctcttccgcagccagcactacgccctcctagacaattcctgccgcgaataccttttcatctgtgaattttttgttgtgtctggcccagctgcacacgacctgttccatgctgtcatgggccgtacactcagcatgaccctgaaacacctggattcttatctagctgactgctacgatgccattgctgtttttctctgtatccacattgttctccggttccgtaacattgcagcaaagagggatgttcctgccctggacaggtactgggaacaggtgcttgccttgctatggccacggtttgaactgatcctggagatgaatgttcagagcgtccgaagcactgacccccagcgcctaggggggttggatactcggccccactatatcacacgccgctatgcagagttctcctccgctcttgtcagtatcaaccagacaattcctaatgaacggaccatgcaattgctgggacagctgcaggtggaggtggagaattttgtcctccgagtggcagctgagttctcctcaaggaaggagcagcttgtgtttctgatcaacaactatgacatgatgctgggtgtgctgatggagcgggctgcagatgacagcaaagaggttgagagcttccagcagctgctcaatgctcggacacaggaattcattgaagagttgctgtctcccccttttgggggtttagtggcatttgtgaaggaggctgaggctttgattgagcgtggacaggctgagcgacttcgaggggaagaagcccgggtaactcagctgatccgtggctttggtagttcctggaaatcatcagtggaatctctgagtcaggatgtaatgcggagtttcaccaacttcagaaatggcaccagtatcattcagggagcgctgacccagctgatccagctctatcatcgcttccaccgggtgctgtcccagccgcagctccgagccctccctgcccgggctgagctcatcaacattcaccaccttatggtggagctcaagaagcataagcccaacttctgatgtgccagaaaccgccctgagatctgccggtcatctccatggacttctgcaccccattccatacccttcttcacctggggtaccccttccagttttccccttgcttcccaggcccttgacatggcttacctgccttcactcccagcaccttgcccaacaggataagctggatccccttggccttctgaatatcccagtgtcttcaggtttcccaagaccacttccctgtgggcttccaaaatggcctttatcatttctccagtctgtcaccctcctttcctgctcccatacacccaaggcttgtttcttcccctgtaaaaaccactgcctcaatctctggttcactcaactagtcaccatgtcctgaggcatgaagcctcctcagctcttg

SEQ ID NO: 8404 - DNA, 2355 bp, Homo sapiens
cggtgcgcctttctttacagttcgtaaggttcataggcgggtggtcctgggctccaggaaccactgcaacttggggagttggatatcacttctgatgaattcatcctggatgaagtggatgttcacattcaggcaaatctggaggatgagttagtaaaggaagctcttaaaacgggtgtagatctccgtcactattcaaagcaagttgagctggagctacagcagattgaacagaaatccattcgggattatattcaagagagtgagaatatagcatctctacacaaccagatcacagcctgtgatgctgtcctggagcgaatggagcagatgttgggagcttttcagagtgacctcagctccatcagctctgagatccggacactgcaggaacagtcaggagccatgaacattcgacttcgaaatcgccaggcagttcgggggaaacttggggagcttgttgatggtctggtggtgccttctgctctggtcacggcaattctggaggctccagtgacagagcccaggttcttggagcagctacaggagctggatgccaaggcagccgcagtcagagagcaggaagctagaggcacagcagcctgcgcagatgtcagaggcgtgctcgatcggctccgggtcaaggcagtgacgaagatccgagagtttatcctccagaagatttattccttcaggaaacccatgaccaactatcagatcccccagacggccctgctgaagtacaggttcttctatcagtttctgttgggcaatgaacgagcaacagcaaaggagatcagggatgaatatgtggagacgctgagcaagatttacctgtcttactaccgctcttacctggggcggctcatgaaggtgcagtatgaggaagtcgctgagaaagatgatctaatgggtgtggaagatacagcaaagaaaggattcttctcaaagccatcgctccgcagcaggaacaccattttcaccctaggaacccgcggctctgtcatctcccccactgaacttgaggcccccatcctggtgcctcacacagcgcagcgcggagagcagaggtatccatttgaggccctcttccgcagccagcactacgccctcctagacaattcctgccgcgaataccttttcatctgtgaattttttgttgtgtctggcccagctgcacacgacctgttccatgctgtcatgggccgtacactcagcatgaccctgaaacacctggattcttatctagctgactgctacgatgccattgctgtttttctctgtatccacattgttctccggttccgtaacattgcagcaaagagggatgttcctgccctggacaggtactgggaacaggtgcttgccttgctatggccacggtttgaactgatcctggagatgaatgttcagagcgtccgaagcactgacccccagcgcctaggggggttggatactcggccccactatatcacacgccgctatgcagagttctcctccgctcttgtcagtatcaaccagacaattcctaatgaacggaccatgcaattgctgggacagctgcaggtggaggtggagaattttgtcctccgagtggcagctgagttctcctcaaggaaggagcagcttgtgtttctgatcaacaactatgacatgatgctgggtgtgctgatggagcgggctgcagatgacagcaaagaggttgagagcttccagcagctgctcaatgctcggacacaggaattcattgaagagttgctgtctcccccttttgggggtttagtggcatttgtgaaggaggctgaggctttgattgagcgtggacaggctgagcgacttcgaggggaagaagcccgggtaactcagctgatccgtggctttggtagttcctggaaatcatcagtggaatctctgagtcaggatgtaatgcggagtttcaccaacttcagaaatggcaccagtatcattcagggagcgctgacccagctgatccagctctatcatcgcttccaccgggtgctgtcccagccgcagctccgagccctccctgcccgggctgagctcatcaacattcaccaccttatggtggagctcaagaagcataagcccaacttctgatgtgccagaaaccgccctgagatctgccggtcatctccatggacttctgcaccccattccatacccttcttcacctggggtaccccttccagttttccccttgcttcccaggcccttgacatggcttacctgccttcactcccagcaccttgcccaacaggataagctggatccccttggccttctgaatatcccagtgtcttcaggtttcccaagaccacttccctgtgggcttcc

SEQ ID NO: 8405 - DNA, 2687 bp, Homo sapiens; identical to SEQ ID NO: 8403

SEQ ID NO: 8406 - DNA, 2694 bp, Homo sapiens
gaagtgccggagcggctgacagagcggctgacggagccgggctcaccaggtcgctgccgcgagggagttgctgtgctggggcctgggtggcggctggaggcctgagttgggctcgcggcgggggtcggcagggggccgggtggcggaatgatggaggaggaggaactggagttcgtggaggagctggaagccgtgctgcagctcacgcccgaggtgcagctggccatcgagcaggtgtttccaagccaggaccctctagatcgagcagatttcaatgctgttgagtatatcaataccctgttcccaaccgagcaatctctggcgaacatagacgaagtcgtgaacaaaattaggctgaaaataaggagactggatgacaatattcgaactgttgtaagaggtcagacgaacgtggggcaggatggacggcaagtgaaagaaatcacccgtgatattaagcaattagatcacgccaaacgccacctgaccacctcaatcaccacactgaaccacctgcacatgctggcaggaggtgtcgactccctcgaagccatgaccaggcgaagacaatacggagaagttgctaatctccttcagggtgtgatgaatgtcctggagcacttccacaagtatatggggattccgcagatccggcagctttccgaaagagtgaaggctgcacagactgagttaggacagcaaatcctggcagattttgaagaagcgtttccttcccagggcaccaagagaccaggaggacccagcaatgttctacgagatgcatgtctggttgctaatattctagatcccaggatcaaacaggaaatcatcaaaaagtttattaaacagcatctgtcagagtatctggtactttttcaagaaaaccaagatgttgcctggctggacaaaatcgacagacgctatgcctggataaaacgccagcttgtggactatgaggagaaatacggccgcatgtttccacgtgagtggtgcatggctgagaggattgcggtggaattttgccatgtgacaagggcagaacttgccaagattatgcgtaccagagcgaaggaaattgaagtgaaattgcttctttttgctattcaaagaacaactaactttgaggggtttcttgcaaaacgcttctccggctgcaccctgaccgatgggaccctgaaaaagcttgagtctccacccccatctaccaatcccttcctggaagatgagccaacaccagagatggaggaactggcaacggagaaaggagatttagatcaaccaaagaagcctaaagccccagacaatccatttcatggcattgtttccaagtgttttgagcctcatctctacgtgtatatcgaatcccaagacaagaacctcggagagctgatagatcggtttgtggctgatttcaaagcccaggggccacctaagcccaacactgatgaagggggtgccgtgctccccagctgcgccgacctctttgtctactacaagaagtgcatggtgcaatgctctcagctcagtactggggagcccatgatcgccctgaccaccattttccagaagtacctccgagaatacgcctggaaaatcctctctggcaacctgcccaaaaccacaaccagcagtggaggactgactatcagcagcctcctcaaggaaaaggagggctcagaagtagccaagttcactctggaggagctctgcctcatctgtaacatcctgagcacggcagagtactgtctggccaccacccagcagctagaagaaaaactcaaagaaaaagtggatgtaagtctgattgaacgaatcaatctgactggagagatggacacgttcagcaccgtcatctccagcagtattcagctgctggttcaggatctggatgctgcctgtgatcctgccctgactgccatgagcaagatgcagtggcagaacgtggagcacgttggtgaccagagcccctacgtcacctctgtcattctgcacatcaagcagaacgtccccatcatccgtgacaacctggcttccacacgcaagtacttcactcagttctgcgttaaatttgcaaactccttcattcccaaattcatcacccacctcttcaagtgcaagccaattagcatggtgggagcagaacaggtgagatggacgtagtatcaggcatttgcctggcagcttttgttgtagatcaagcacatattcttctagtccagatctacttggcaggaataaaattgatgatgtcccctgtttggggacagtataatgactcacccggaaggtttcttaattcgttcttccatttatttttaaaaattttgtttgaacgcctactaagttctgggtgcagggtataacacagcaagcaccatggaaaggtccctgctcctagtgctcacactccaataagaagaagtggctgggccgggcacagcggctcacgctgtaaccccagcatttcgggaggcctgggcaggcagatcacctggggtaaggaatttgagagcagcctggccaacatggtgaaatcccatctctactaaaaatacaaaaattagctgggcatgggggcaggctactggggaggctgaggcaggagaatcacttgaacccgggaggtggaggttgcagtgagccgatatcacaccactgcactccagcctgggtgacaaagtgagactccatctc

SEQ ID NO: 8407 - DNA, 1903 bp, Homo sapiens
atgatggaggaggaggaactggagttcgtggaggagctggaagccgtgctgcagctcacgcccgaggtgcagctggccatcgagcaggtgtttccaagccaggaccctctagatcgagcagatttcaatgctgttgagtatatcaataccctgttcccaaccgagcaatctctggcgaacatagacgaagtcgtgaacaaaattaggctgaaaataaggagactggatgacaatattcgaactgttgtaagaggtcagacgaacgtggggcaggatggacggcaagcgcttgaagaggctcagaaagctatccaacaactctttggcaaaatcaaagatatcaaagacaaagctgaaaaatcagagcaaatggtgaaagaaatcacccgtgatattaagcaattagatcacgccaaacgccacctgaccacctcaatcaccacactgaaccacctgcacatgctggcaggaggtgtcgactccctcgaagccatgaccaggcgaagacaatacggagaagttgctaatctccttcagggtgtgatgaatgtcctggagcacttccacaagtatatggggattccgcagatccggcagctttccgaaagagtgaaggctgcacagactgagttaggacagcaaatcctggcagattttgaagaagcgtttccttcccagggcaccaaggttgcctggctggacaaaatcgacagacgctatgcctggataaaacgccagcttgtggactatgaggagaaatacggccgcatgtttccacgtgagtggtgcatggctgagaggattgcggtggaattttgccatgtgacaagggcagaacttgccaagattatgcgtaccagagcgaaggaaattgaagtgaaattgcttctttttgctattcaaagaacaactaactttgaggggtttcttgcaaaacgcttctccggctgcaccctgaccgatgggaccctgaaaaagcttgagtctccacccccatctaccaatcccttcctggaagatgagccaacaccagagatggaggaactggcaacggagaaaggagatttagatcaaccaaagaagcctaaagccccagacaatccatttcatggcattgtttccaagtgttttgagcctcatctctacgtgtatatcgaatcccaagacaagaacctcggagagctgatagatcggtttgtggctgatttcaaagcccaggggccacctaagcccaacactgatgaagggggtgccgtgctccccagctgcgccgacctctttgtctactacaagaagtgcatggtgcaatgctctcagctcagtactggggagcccatgatcgccctgaccaccattttccagaagtacctccgagaatacgcctggaaaatcctctctggcaacctgcccaaaaccacaaccagcagtggaggactgactatcagcagcctcctcaaggaaaaggagggctcagaagtagccaagttcactctggaggagctctgcctcatctgtaacatcctgagcacggcagagtactgtctggccaccacccagcagctagaagaaaaactcaaagaaaaagtggatcgtcatctccagcagtattcagctgctggttcaggatctggatgctgcctgtgatcctgccctgactgccatgagcaagatgcagtggcagaacgtggagcacgttggtgaccagagcccctacgtcacctctgtcattctgcacatcaagcagaacgtccccatcatccgtgacaacctggcttccacacgcaagtacttcactcagttctgcgttaaatttgcaaactccttcattcccaaattcatcacccacctcttcaagtgcaagccaattagcatggtgggagcagaacaggtgagatggacgtag

SEQ ID NO: 8408 - DNA, 1269 bp, Homo sapiens
atgatggaggaggaggaactggagttcgtggaggagctggaagccgtgctgcagctcacgcccgaggtgcagctggccatcgagcaggtgtttccaagccaggaccctctagatcgagcagatttcaatgctgttgagtatatcaataccctgttcccaaccgagcaatctctggcgaacatagacgaagtcgtgaacaaaattaggctgaaaataaggagactggatgacaatattcgaactgttgtaagaggtcagacgaacgtggggcaggatggacggcaaaaaaagcttgagtctccacccccatctaccaatcccttcctggaagatgagccaacaccagagatggaggaactggcaacggagaaaggagatttagatcaaccaaagaagcctaaagccccagacaatccatttcatggcattgtttccaagtgttttgagcctcatctctacgtgtatatcgaatcccaagacaagaacctcggagagctgatagatcggtttgtggctgatttcaaagcccaggggccacctaagcccaacactgatgaagggggtgccgtgctccccagctgcgccgacctctttgtctactacaagaagtgcatggtgcaatgctctcagctcagtactggggagcccatgatcgccctgaccaccattttccagaagtacctccgagaatacgcctggaaaatcctctctggcaacctgcccaaaaccacaaccagcagtggaggactgactatcagcagcctcctcaaggaaaaggagggctcagaagtagccaagttcactctggaggagctctgcctcatctgtaacatcctgagcacggcagagtactgtctggccaccacccagcagctagaagaaaaactcaaagaaaaagtggatgtaagtctgattgaacgaatcaatctgactggagagatggacacgttcagcaccgtcatctccagcagtattcagctgctggttcaggatctggatgctgcctgtgatcctgccctgactgccatgagcaagatgcagtggcagaacgtggagcacgttggtgaccagagcccctacgtcacctctgtcattctgcacatcaagcagaacgtccccatcatccgtgacaacctggcttccacacgcaagtacttcactcagttctgcgttaaatttgcaaactccttcattcccaaattcatcacccacctcttcaagtgcaagccaattagcatggtgggagcagaacaggtgagatggacgtag

SEQ ID NO: 8409 - DNA, 13106 bp, Homo sapiens
gaagtgccggagcggctgacagagcggctgacggagccgggctcaccaggtcgctgccgcgagggagttgctgtgctggggcctgggtggcggctggaggcctgagttgggctcgcggcgggggtcggcagggggccgggtggcggaatgatggaggaggaggaactggagttcgtggaggagctggaagccgtgctgcagctcacgcccgaggtgcagctggccatcgagcaggtgtttccaagccaggaccctctagatcgagcagatttcaatgctgttgagtatatcaataccctgttcccaaccgagcaatctctggcgaacatagacgaagtcgtgaacaaaattaggctgaaaataaggagactggatgacaatattcgaactgttgtaagaggtcagacgaacgtggggcaggatggacggcaagcgcttgaagaggctcagaaagctatccaacaactctttggcaaaatcaaagatatcaaagacaaagctgaaaaatcagagcaaatggtgaaagaaatcacccgtgatattaagcaattagatcacgccaaacgccacctgaccacctcaatcaccacactgaaccacctgcacatgctggcaggaggtgtcgactccctcgaagccatgaccaggcgaagacaatacggagaagttgctaatctccttcagggtgtgatgaatgtcctggagcacttccacaagtatatggggattccgcagatccggcagctttccgaaagagtgaaggctgcacagactgagttaggacagcaaatcctggcagattttgaagaagcgtttccttcccagggcaccaagagaccaggaggacccagcaatgttctacgagatgcatgtctggttgctaatattctagatcccaggatcaaacaggaaatcatcaaaaagtttattaaacagcatctgtcagagtatctggtactttttcaagaaaaccaagatgttgcctggctggacaaaatcgacagacgctatgcctggataaaacgccagcttgtggactatgaggagaaatacggccgcatgtttccacgtgagtggtgcatggctgagaggattgcggtggaattttgccatgtgacaagggcagaacttgccaagattatgcgtaccagagcgaaggaaattgaagtgaaattgcttctttttgctattcaaagaacaactaactttgaggggtttcttgcaaaacgcttctccggctgcaccctgaccgatgggaccctgaaaaagcttgagtctccacccccatctaccaatcccttcctggaagatgagccaacaccagagatggaggaactggcaacggagaaaggagatttagatcaaccaaagaagcctaaagccccagacaatccatttcatggcattgtttccaagtgttttgagcctcatctctacgtgtatatcgaatcccaagacaagaacctcggagagctgatagatcggtttgtggctgatttcaaagcccaggggccacctaagcccaacactgatgaagggggtgccgtgctccccagctgcgccgacctctttgtctactacaagaagtgcatggtgcaatgctctcagctcagtactggggagcccatgatcgccctgaccaccattttccagaagtacctccgagaatacgcctggaaaatcctctctggcaacctgcccaaaaccacaaccagcagtggaggactgactatcagcagcctcctcaaggaaaaggagggctcagaagtagccaagttcactctggaggagctctgcctcatctgtaacatcctgagcacggcagagtactgtctggccaccacccagcagctagaagaaaaactcaaagaaaaagtggatgtaagtctgattgaacgaatcaatctgactggagagatggacacgttcagcaccgtcatctccagcagtattcagctgctggttcaggatctggatgctgcctgtgatcctgccctgactgccatgagcaagatgcagtggcagaacgtggagcacgttggtgaccagagcccctacgtcacctctgtcattctgcacatcaagcagaacgtccccatcatccgtgacaacctggcttccacacgcaagtacttcactcagttctgcgttaaatttgcaaactccttcattcccaaattcatcacccacctcttcaagtgcaagccaattagcatggtgggagcagaacagctgctgctggacacccactcgctgaagatggtcctgctcgatctcccctccatcagctcgcaggtggtgaggaaggcacccgccagctacaccaagatcgttgtcaaaggcatgacccgggctgagatgatcctcaaggtagtgatggcccctcatgaaccgttggtggtgtttgttgacaactacatcaaacttctcacagactgcaacacagaaacctttcagaagatactggacatgaaggggctgaagaggagtgagcagagcagcatgctggaactcctgcgccagcggctccccgcaccgccctcgggggcagaaagctccggctcactgtccctgacggcgccaacaccagagcaagagtcgtcacgcatccgcaagctcgagaaactcattaaaaagagactgtagcagcagcaaggggccctttgctcctggctggagaccctcagcgcccgttccccagaagcccccaacctctcctgtgctccccggcactctcacatcgtcggtcttcaaacttcctgggacatgtgggttgttactgagtctctcccatgccctgtcttacttcctgccctaatcggagacgctgagtaagggctgggctctaagagggcgatttaggtgatctctggttcgtgaagcagaggcagcagtggaggataggtccctgagctgcccttgactcatgtagcctccccatggcagtcacaccctcttgacacgtgggccccacccgtcctttttttttttttttttttttttttttgagacagagtctcgctctgtcacccaggctggagtgcagtggcgtgatctcggctcactgcaacctccgcctcccaggttcaagcaattctcctgcctcagcctcctgagtatcggattacaggcgtgagccaccgagcccagccccttcctccatttctttactcccaccctgctcctggtttctagggaagggaaaccaggaagttcacttggaagacgtttcctaggttttctcatcagatgaagccatgggaacgcccaggaagtccatactctcaaacccctttctgcccactcaccttcaggtccacagcactttccagcgtcatctgaaatagcaaaggtgatgtgcagcatcccagtgatgtgttcctgtgttatgagaaggagtctggggttctggatgcctcaggaacagaatatggaccttaaagaccaggctgagagcctggcctggcacgcagcctgcccgccccccccgcccttcctgtccaccgcgggctctctgcagcagggcttgccgaagagactgctcccgacctctcatgtcatcctgcatccagagaatggcagcatatcaagccgttaaccctgattcactcggttcccttgaaaccaggcctcagttaaccatgaccacagctacaggcaaaccgctgctgttgctgcctgcttttgctgaagaatgatatcttgccaggcacggcggctcatgcctgtagtcgcaacactttgggagaccaaggcaggaggatcacttgagtccaggagtttgagaccagcctgggcaacatacagatgtctacaaaaataaaaatttgcaaggtgtggtggcatgcacctgtagtcccaactgctagggaggctgaggtgggcagattgcttgagctcaggagtttgagaccagtctgggcaacctggcaaaaccaaaaatacaaaaaattggctgggtgtggtggctcatgcctgtaatcacagcactttgggaggctgaggcaggtggatcacctgaggtcaggaattcgagaccagcctgcccaacatggcgaaaccctgtctcaactaaaaataaaaaaaattagccgggtgtcatggcgagtgcctgtaatcccagctactggggaggctgaggcaggagaatcacttaaacccgggaggtggaggctgcagtgagccaagatttcaccactgcactccagcctgggtgacagagcaagaccccttctcaaaaagttttcaggatagaggaaatttccttaaaatccataaaacttgtaacagccgtacagtaggaataaggtttggaaatctgcctggaaacctgatttcctcatccccaccttgtttcccaacataaccactgctctgtgcccctgccctctctgccaggctttctccccgatgccgtccagctctgatcctgagtgtcatttcttcatcggcttccaggctgtccttgctagctggtttgactctcacgcatcaagcgtctcaaatttgagaatgcggaggagaaaagaagtgttgcgagaaggagatgcggccttcagttgaggtctattaggaaaagattccaaataagacaagggcggggggcggcagtcgggagagcccccaggaagccctgtagatgcccccaccccagcccatggagttgctatggttaagcagcctgagccgtacagttgaaaaggggcggtggggcccatctccaaatagcacagccagttcagccgtctgtcctcaacccaggagagctgggaaagccagtggactcctgcacctggttcttgtcactcctggcgtttgtgtacagatcaccacttctctttttggttcattgttgaggagtcgttttccggacggctccatcacagcattgagctatcaagctgctgttttccacagttggtggtcacagccagggaagttgctgtcttgatttgttacattgtcagtaatccccaaggaaccaatggatgtcagtaggagtttctgttaaatgtctccttgatggggactcagtactgtgtagagacgctgtgtttctcttctgggggtgtgcatcagaaccactggggccttttaaaatctacagatgccggccgggcgccgtggctcacgcctggaatcccagcacttggggaggctgaggcgggcggatcacaagcgcaggaaattgagaccatccttgccaatatggtgaaaccccatctctacaaaaaatacaaaaattaccggggtgtggtggcgtgcacacctcccagctacttgggaggctgaggcaggagaatcgcttgaacccgggaggcaaagattgcagtgagccgagatcacgccactgcactccagcctggcgacagagtgagactctatctcaaaacaaacaaaaaaacagatgcccggagattttgagtcagtaagtttggatggggcctggcatacaggtttaaaagttccataggtagttataacgtttacaccttgttaagaaccactgcaacagagagatttgctttatggaagggctcctgccacgcattttcatacatgtctatttttctgactctaagctaaaagtgcgccgacactacacttgagctggtgccaacgtggtgaagattctctactgataacagctttcattttaaacttgtgttgggtcaggcgcggtggctcacgcctgtaatcccagcactttgggaggccgaggtgggcggatcacatgaggtcacgagtttgagaccagcctggccaacatggcaaaatcccatctctactaaaaatacaaaaaaaaaaaaaaaaaaagcaggcaggtggcgggtgcctgtaatcccagctacttgggaggctgaggcaggggaatcagttgaatccgggaggcggaggttgcagtgagccgaggtcccgccactgcactccagcctgggagacagagtgagactcagttaaaaaaaaaagacttttggtggtggtggggaccatgcccaggattgggctctctccatactgatgaggattcttcttgttttgatgaccaacccccaagcagaagctttatttattaacatcacttcaaaaataacgtatcaaaggggcaccctaggccgggtactgtggcatcacacctgtaatgccagtgctttgagaggctgaggtgggaagattgcttgagcccaggacttcaagacaagcctgggcaacagagtgagaccccatctctattaaaaaataggccgggcatggtggctcacactggtaatcccagcactttgggaggccgaggcaggtggatcatgtgaggtcaggagttcgagaccagcctggccgacatggtgaaaccctgtctttactaaaaatacaaaattagccaggcgtggtggtgggcgcctgtaatcccagctactcaggaggctgaagcaggaggatcgcttgaacccaggaggcagaggctgcagtgagccgagatcatgccattgcactcctgcctgggtgacggagcaagactctctaaaaaataataaggtaaaaggagtacctgtggatgaaagcagcagctaacagctctgtgattcagctagacctagatattgtgcccattccttcccctcagtccattttctgtagcccctttaaaaaccaaaaaacaactttgaagtcactttgggtttaaaataaatagtggtaatttgtataatcaataaagagttcactctgctcttactgaggggacttgtctgaaagctggcttagcggtgtccaggccagagaacatcctgtgtggactcttaacaatgaaacaggagccgcaatggacaaggtgttctgatctccaaacccagctcagggattgaagctaactaccgccactccttcctctctcgaagaacaaagagccagtacccagggctctgcccacccccgagaaggggtgcctgatttcttatgtctagggtggctcctctgtgcagatcagacaggactgagagcagacaagctgagaccagcatgaccagtacagggcacgcagagcgtgggggcaggtccgaggctgctgctcgatgcagggtatgacaccaacccttcctgaattgccatcggatgaggagacctggttccctgttgaaagaatgccaggggaaatgctgcatgtgcacagctggaaatggggttccttctctaggaagagcactcggaataacctgctggaaatggggttccttccctaggaagagcactcagaataacctgctggaaatgggattccttggctaggaagagcactcagaataacctgctggaaatgggattccttggctaggaagagcactcagaataacctgctggaaatgggattccttacctaggaagagcactcggaataacctgctggaaatgggattccttacctaggaagagcactcggaataacctgctggaaatggggttccttccctaggaagagcactcggaataacctgctggaaatggggttccttccctaggaagagcactcggaataacctgctggaaatggggttccttcgctaggaagagcactcggaataacctgctggaaatgggattccttcgctaggaagagcactcggaataacctgctggaaatgggattccttcgctaggaagagcactcggaataacctgctggaaatgagattccttccctaggaagagcactcggaataacctgctggaaatgggattccttcgctaggaagagcactcggaataacctgctggaaatgagattccttcgctaggaagagcactcggaataacctgctggaaatgggattccttcgctaggaagagcactcggaataacctgctggaaatgagattccttcgctaggaagagcactcggaataacctgctggaaatgggattccttcgctaggaagagcactcggaataacctgctggaaatgggattccttcgctaggaagagcactcggaataacctgctggaaatgggattccttccctaggaagagcactcggaataacctgctggaaatgagattccttccctaggaagagcactcggaataacctgctggaaatgggattccttcgctaggaagagcactcggaataacctgctggaaatgggattccttcgctaggaagagcactcagaacaacctgcctgcttgagggtgacagcaagtgtctcacacttctcgtctactccaagtcagattcctaaaaataaaatagagctccaatgggcaatttaagcaaaagccttagaaacatggacacctgaaatgctggcctacatgaagggtacgatgacattttatatattaaataaaaattcccagtcctgttttagtattcatcagaatagcctcttggaccctcgaagttctacacctttgggagatataaatttccttaaaataaagggattgcttctttgtgtaaatagctttcattttctccatctggaagtgatttctgcctgcatgttggagcacaaaatactgcagttaattaaagcattactggatgtcatttgctagaatgtatttccttactgctgacagaaaacagaacagactctaggaaagaagtagcaagtccgtgaccctggccgctcctggtggctgcccttctcccttccctgacagtctaaggaagcaacgcgtgggagcagaatgtggccgactgagcccagtcctgacctgcccagttgcagtggagcctgtctgtaatgttgtgtaaagtgttttgcttctgacttggaaccctacttgccctgtgaatttctatcctgtgaaccttcccttctctgtccttaccgttcccatcacagcctgctcttccagtgacggccaagtgatttctctcctgcacgcatgagtccatcctgtttccttagtagctggatggacgttttgccatgaaaactctttgggaagtcttgtgtcctttagtgatttctctcctgcacgcatgagtccatcctgtttccttagtagctggttggacgtttttgccatgaaaactcttcgggaagtcctgtgtcctttcaacaggggaaaactggctgcggcccttccattaggctccaggatcattacctcgtttccattctttcttttcaacagctccccactttactagggaagccaagggatcaacctaatgagaaaagaaccttccctgtagcccacctggaagggcattgcctgccagctccttccttctcacctatgtgaacaggagggaagatgccggcgatccatggatctgtgggacatgaaggacgtgtccatcagaaatgaaagcagcctgggattggaagcatccacagaagacttgatctgcaggtcttgatttggacctggcactttgacaccaggcgagtcactgatcccctgagcatccattttcaatattggtgagaggggattataatgaatattggctgtgaaggtcacacaagaccgggctatatgcacttgctctgccataaggcagtgtgaagtgtgttcgtgatcacttgtgggcgggagcctgtggctgtcttgcctggactggcttttttaaacatggatgagtggtgacaaatcctgcggccgtgtgcaggctacatccgcagcgagctccgcatatctggtctttgcctttttaggtcatgactgtaatatcaagcttacacgagagttttaaaagactgagcagtatccccttcccctggcagctgctgcttccgtagcatttagggataaacctgcagacactgagaagagagcttcctccctcctggggctggtggcgaggctgcctgttgtggaaaatagggcatgtctcctgtgaatgcgaattgcgagggttgccaaagcctcccttccaagaaacttgcttaggtgtctggtgtccacagaccagactcttctcccgacagggacaaaaattcttgcctgcctttctttttcttttttttccttttacttattcttgccttttttcttcttcttcttctttaggtatgatgccccccaaaaaactaagcaagattaacttgggacaggcagttctaactgggaagcctgagctcacaggctgtttggattactttccaattgtgtttcaaagatgtttagacttttcccaaggccagctgaatccttataatcagcccaaaagttcctttctgtttctgtctgtcccctttgagggtgttgactcagagaacctggggcaatatgagatgttaaaataaaaatagcgtccaacgtcccgcctcctgggaatgctgctcacttcatccgagggttctgggagcttctgctcagtcatcaaatggaatttgcacaattgtcttgcctcctgttttgggtaatttttcaacaagtgagaaattaagaacagcttctcaacaaacttccctctacttccagggccaagaaaagtatttgcagtgtgggctgcagctttcaggggtctcaggtgaaatggtggcaagaaaccccagctcccttcatgtgtttgccttgcgctgatggaaaaggaaggcacttctcagctgccagagaccacattccacagggttcttcacaaaatcaagcactgcagtggaccaactggagcagccactggagggctttagaaggcaaatggaatacatatcaaatgctatataaagaaaacatctgtttacacagagtcccccacagcctcatacctacacccaatatcaaatgctgtataaagaaacatcagtttacacacagagccccccacaacctcatacccacaccgaatatcaaatgctatacaaagaaacatcagtttacacacagagtcccccacagcctcatacccatgcctgtcacatctttgcacagccctaaaggatccagagctttggatcagcagctggctagctcggaggccagaggagggtgctgaggggagtggaggtcagttggggtagccctgggccctggctgcacagtccagctgctgtgtggcctgcatgtggtatcttaggtcatgagagggcctgggcaattcagtgctatctgtacatgttggtggggtgggaaggaaaaggtaactgtgtatttactgtgtcctggatacattatctcatcggatgaaattcctgctaagttaagctccgtttagtggacgggacttggaggctcaaagagggtaagtgacaggcccaaggatatgtgcctagtgaggggtgagccaggattcgatgtgtgactagtaaggggtcagccaggattcaatatgtgactagtaaggggtcagccaggatttcatatgggactagtaaggggtcggccaggatttgatacgtgactagcaaggggacaagccaggatttgatatgtgactagtgaggggcgagccaggattcgatatgtgactagtaaggggtcagccaagatttgatatgtgactagtgaggggcgagacaggatttgatatgtgactagtgaggggcgagccaggatttgatatgtgactggtgaggggcgagccaggatttgatatgtgactggtgaggggcgagccaggatttgatatgtgactggtgaggggcgagccaggatttgatatgtgactggtgaggggcgagccaggatttgatatgtgactggtgaggggcgagccaggatttgatatgtgactggtgaggggcgagccaggatttgatatgtgactggtgaggggcgagccaggatttgatatgtgactggtgaggggcgagccaggatttgatatgtgactggtgaggggcgagccaggatttgatatgtgactggtgaggggcgagccaggatttgatatgtgactggtgaggggcgagccaggatttgatatgtgactggtgaggggtggagccagtcaggatttgatatgtggttagtgaggggttagccagtcaggatttgatatgtggctagtgaggggcgagccaggatttgatatgtgactagtaagggggtgagccaggattcaatacgtgacaagtgaggggtgagccaggattcaatacgtgaccagtgaggggcgagccaggattcgatacgtgaccagtgaggggcgagccaggatgcgatacgtgaccagtgaggggcgagccaggattccatacgtgactagtgaggggtgagccaggattcgatatgtgagtagtgaggagtgagccaggatttgatatgtggctactgaggggcgagccaggatttgatatgtgactagtaaggggtcagccaggatttgatacgtgactagtcagggggtcagccaggattcgatacgtgactagtaaggggtcagccaggatttgatatgtgactagtgaggggtgagccaggatttgacatgtgactagtgaggggtgagccaggattcaatatgtgactagtgaggggtgagccaggattcgatatgtacctagtgaggggtcagccaggatttgatatgtggctagtaaggggtgagccagccaggatttgatatgtgactagtgacgagtgagccaggatttgatatgtgactagtaagggggtgaggcaggatttgatatgtgactagtaagggggtgaggcaggatttgatatgtgactggtgaggggtgagacaggatttgatatgtgactagtgaggggtgagccaggatttgctatgtgactagtaagggggcgagccaggatttggctccagccttcattccaacatccatgccttttgtacttcaccagcagttttcaaatttatgggacaaaattttacattggattccctctatacaaaatagataaaagtattttatgaatacattttatgagttcaaatatttttcagaagaaatcagtaaaagcattgaaaactattccagcaaataggaagcactttaaaccaaggttatggatgaaaatgtgtgtgtatcaaccccagtttacttctgggttgcacagaatagagaaatcttgatttaatccagctaagaattttcaaatagtatccattttgttttgttttaaacagctcttcttgcaatggtagaggctcttcaattaaacagagatggtaacaggc

SEQ ID NO: 8410 - DNA, 3204 bp, Homo sapiens
gaagtgccggagcggctgacagagcggctgacggagccgggctcaccaggtcgctgccgcgagggagttgctgtgctggggcctgggtggcggctggaggcctgagttgggctcgcggcgggggtcggcagggggccgggtggcggaatgatggaggaggaggaactggagttcgtggaggagctggaagccgtgctgcagctcacgcccgaggtgcagctggccatcgagcaggtgtttccaagccaggaccctctagatcgagcagatttcaatgctgttgagtatatcaataccctgttcccaaccgagcaatctctggcgaacatagacgaagtcgtgaacaaaattaggctgaaaataaggagactggatgacaatattcgaactgttgtaagaggtcagacgaacgtggggcaggatggacggcaagcgcttgaagaggctcagaaagctatccaacaactctttggcaaaatcaaagatatcaaagacaaagctgaaaaatcagagcaaatggtgaaagaaatcacccgtgatattaagcaattagatcacgccaaacgccacctgaccacctcaatcaccacactgaaccacctgcacatgctggcaggaggtgtcgactccctcgaagccatgaccaggcgaagacaatacggagaagttgctaatctccttcagggtgtgatgaatgtcctggagcacttccacaagtatatggggattccgcagatccggcagctttccgaaaggaaacccaaaacactgcagctgcatggattgaactggacgtgatgtgaaatgaaataagccagacacgggaagacagattcctcatgttctcactcatagtgaaggctgcacagactgagttaggacagcaaatcctggcagattttgaagaagcgtttccttcccagggcaccaagagaccaggaggacccagcaatgttctacgagatgcatgtctggttgctaatattctagatcccaggatcaaacaggaaatcatcaaaaagtttattaaacagcatctgtcagagtatctggtactttttcaagaaaaccaagatgttgcctggctggacaaaatcgacagacgctatgcctggataaaacgccagcttgtggactatgaggagaaatacggccgcatgtttccacgtgagtggtgcatggctgagaggattgcggtggaattttgccatgtgacaagggcagaacttgccaagattatgcgtaccagagcgaaggaaattgaagtgaaattgcttctttttgctattcaaagaacaactaactttgaggggtttcttgcaaaacgcttctccggctgcaccctgaccgatgggaccctgaaaaagcttgagtctccacccccatctaccaatcccttcctggaagatgagccaacaccagagatggaggaactggcaacggagaaaggagatttagatcaaccaaagaagcctaaagccccagacaatccatttcatggcattgtttccaagtgttttgagcctcatctctacgtgtatatcgaatcccaagacaagaacctcggagagctgatagatcggtttgtggctgatttcaaagcccaggggccacctaagcccaacactgatgaagggggtgccgtgctccccagctgcgccgacctctttgtctactacaagaagtgcatggtgcaatgctctcagctcagtactggggagcccatgatcgccctgaccaccattttccagaagtacctccgagaatacgcctggaaaatcctctctggcaacctgcccaaaaccacaaccagcagtggaggactgactatcagcagcctcctcaaggaaaaggagggctcagaagtagccaagttcactctggaggagctctgcctcatctgtaacatcctgagcacggcagagtactgtctggccaccacccagcagctagaagaaaaactcaaagaaaaagtggatgtaagtctgattgaacgaatcaatctgactggagagatggacacgttcagcaccgtcatctccagcagtattcagctgctggttcaggatctggatgctgcctgtgatcctgccctgactgccatgagcaagatgcagtggcagaacgtggagcacgttggtgaccagagcccctacgtcacctctgtcattctgcacatcaagcagaacgtccccatcatccgtgacaacctggcttccacacgcaagtacttcactcagttctgcgttaaatttgcaaactccttcattcccaaattcatcacccacctcttcaagtgcaagccaattagcatggtgggagcagaacaggtgagatggacgtagtatcaggcatttgcctggcagcttttgttgtagatcaagcacatattcttctagtccagatctacttggcaggaataaaattgatgatgtcccctgtttggggacagtataatgactcacccggaaggtttcttaattcgttcttccatttatttttaaaaattttgtttgaacgcctactaagttctgggtgcagggtataacacagcaagcaccatggaaaggtccctgctcctagtgctcacactccaataagaagaagtggctgggccgggcacagcggctcacgctgtaaccccagcatttcgggaggcctgggcaggcagatcacctggggtaaggaatttgagagcagcctggccaacatggtgaaatcccatctctactaaaaatacaaaaattagctgggcatgggggcaggctactggggaggctgaggcaggagaatcacttgaacccgggaggtggaggttgcagtgagccgatatcacaccactgcactccagcctgggtgacaaagtgagactccatctcaaaaaaacaaacaaacaaaaaaactagcaaaaaacttggaatattggccgggcatggtggctcacgtctgtaatcctagcactttgggaggcccaggcaggcggatcatctgaggtcaggagttcgagaccagcctggctaacatggtgaaccctgtctctactaataatacaaaaaattagccgggcgtgatggtgggcgcctgtaatcccagctactcgggaggctgaggcagaattgcttcaacccaggaggtggaggttgcagtgagctgagatcacaccactgtactccagcctgggcaacaagagcgaaactccatctc

SEQ ID NO: 8411 - DNA, 487 bp, Homo sapiens
aaccggaaatgaattccagcttcccgtccaacttttgtctaaccccgtccgttgcatgagatgagtttgctgctgctggacacccactcgctgaagatggtcctgctcgatctcccctccatcagctcgcaggtggtgaggaaggcacccgccagctacaccaagatcgttgtcaaaggcatgacccgggctgagatgatcctcaaggtagtgatggcccctcatgaaccgttggtggtgtttgttgacaactacatcaaacttctcacagactgcaacacagaaacctttcagaagatactggacatgaaggggctgaagaggagtgagcagagcagcatgctggaactcctgcgccagcggctccccgcaccgccctcgggggcagaaagctccggctcactgtccctgacggcgccaacaccagagcaagagtcgtcacgcatccgcaagctcgagaaactcattaaaaagagactgtagcagc

SEQ ID NO: 8412 - DNA, 3463 bp, Homo sapiens
gggaacccgggctcgggcccggccgggcgccgggcggcggcggccgtggagcagcagcctcggtgcgacgtggagggctggaggcggcggcgatgcactaggcctcgctcagggcggctgccccgggacccgcagttgagtggtgattttatgcaatggcttcaagccacagttcttcaccagtgcctcaaggaagcagcagtgatgttttctttaaaatagaggtagatccgtcaaaacacattcgacctgtgccatcactgccagatgtgtgtcccaaggaacccacaggtgattcacatagtttatatgttgccccatctctagttacagatcaacatagatggactgtatatcattccaaagtaaatctcccagcagcattaaacgatcctagattagcaaaaagagaatctgacttcttcacaaaaacatggggattggactttgtggacactgaagtcataccttcattctacctcccacagatcagcaaggaacattttacagtatatcaacaggaaatctctcagagagagaagattcatgagagatgcaagaatatttgtcctcctaaagataccttcgaaaggactcttttacatactcatgataaatccaggacagatctggagcaagtacctaagatttttatgaaaccagattttgccttggatgattccttaacttttaattcagttttaccatggtctcattttaatactgctggtggaaaaggaaatcgtgatgcagcttcctcaaagttgcttcaagaaaagctgagccattatctggatattgtggaagtaaacattgctcaccagatctctctacgttcagaagcattttttcatgcaatgacctctcaacacgagttgcaggactacctcaggaaaacttcccaggctgtaaaaatgcttcgagataaaattgcacagattgataaagtaatgtgtgaaggatcactccacattttaagactggcacttaccagaaataattgtgttaaagtatacaataagctgaagttaatggccactgtacaccagactcagcctacagtacaggtgttattatctacttctgaatttgttggagcattggacttaatagcaacaacacaagaggttctacagcaggaacttcagggcattcacagtttccggcatttgggatcacagctttgtgaattagaaaaactgatagataaaatgatgattgcagaattttctacttattctcacagtgacttaaatagaccactggaagatgactgtcaagttttagaagaggaaagactaatatctcttgtatttggacttttaaaacaaagaaagcttaattttttagaaatctatggtgaaaaaatggttattacagcaaagaatatcattaaacagtgtgtgattaataaagtttcacaaacagaagaaatagacacagatgttgttgtgaagcttgcagatcagatgagaatgttgaattttccccagtggtttgatctgctcaaggatattttctctaagtttacaattttcctacagagagtgaaggcaacattaaatatcattcacagtgttgttctctcagttcttgacaaaaaccaaaggactagagaattggaagagatttcacaacagaagaatgctgcaaaagataattcactggacacagaggtggcttatttaatccatgaaggcatgtttataagtgatgcattcggtgagggtgagctaacacctatagcagttgacactacctctcaaagaaatgcatctccaaatagtgagccctgcagcagtgattctgtatccgagccagaatgtactactgattcttcatccagcaaagagcacacatcatcatctgctattccaggaggtgtggatattatggtcagtgaagatatgaaattaactgactcagagctaggaaagctggcaaataatatccaggaattattatatagtgcctcagatatatgccatgatcgagctgtcaaatttctcatgtcaagagcaaaggatggttttcttgagaagctaaattccatggaattcataacactttctagattaatggaaacattcattttagacaccgaacagatctgtggaagaaaaagcacgtcattacttggagcacttcagagccaagctattaagtttgtaaataggtttcatgaagagagaaaaaccaagctcagcctcctcttagacaatgagcgctggaagcaagcagatgttcctgcagaatttcaggatcttgttgattctctgtcagatgggaagattgctttacctgaaaaaaaatcaggagccacagaagaaaggaaaccagctgaagttcttattgtcgagggacaacagtatgcagttgttggaaccgtattgctgttaataagaattatccttgaatattgccagtgtgtggataacatcccatctgttactactgacatgcttactcgtctgtcagatttattgaagtacttcaattcaagaagttgccagttagttcttggagctggtgcactgcaagttgttggactaaaaacgataactacaaaaaatttggctctttcttcacgatgtttgcagttaattgtgcactacattcctgtgatccgggctcattttgaagctcgactaccacctaagcaatatagcatgcttaggcattttgatcatatcactaaggactaccatgatcacatagctgaaatatcagctaagcttgtagcgataatggatagcttatttgacaagctgttatctaagtatgaagtgaaggctcctgttccttctgcctgtttcaggaatatttgtaagcaaatgacaaaaatgcacgaagctatatttgatctccttccagaagaacaaacacagatgttatttttaagaattaatgcaagttataaactccacttgaaaaagcagttatctcacttaaatgtgataaatgatggaggacctcaaaatgggttggtcacagcagatgtagctttttacactggaaatcttcaagccttaaaaggccttaaagatttggacctaaatatggccgaaatttgggagcagaagaggtgatgtcatcctggaaaactgggtagttcatctgaccatgggatgtgtttgttatgaagaaaatctggatgcctgtgattcgagaattgaacctgaaacccaaagtgaactggggtgggggaagggaaaaaggaaagtatcaagtgttgggaaactggattcagtgggatctacaaggaatgtcatttttgtgcatcctacagtgaggagtaactgatcaggtgtctataacatttttcattctctctggaaacagactcaggtttctttggaccaaatccaaaagaacacatagctgtaacacagctgtagttgactagaatgctctgtatactttatattaaaaaatgctttgcatttcttccagtgcaatgaaa

SEQ ID NO: 8413 - DNA, 3061 bp, Homo sapiens
gcgggggcgggaacccgggctcgggcccggccgggcgccgggcggcggcggccgtggagcagcagcctcggtgcgacgtggagggctggaggcggcggcgatgcactaggcctcgctcagggcggctgccccgggacccgcagttgagtggtgattttatgcaatggcttcaagccacagttcttcaccagtgcctcaaggaagcagcagtgatgttttctttaaaatagaggtagatccgtcaaaacacattcgacctgtgccatcactgccagatgtgtgtcccaaggaacccacaggtgattcacatagtttatatgttgccccatctctagttacagatcaacatagatggactgtatatcattccaaagtaaatctcccagcagcattaaacgatcctagattagcaaaaagagaatctgacttcttcacaaaaacatggggattggactttgtggacactgaagtcataccttcattctacctcccacagatcagcaaggaacattttacagtatatcaacaggaaatctctcagagagagaagattcatgagagatgcaagaatatttgtcctcctaaagataccttcgaaaggactcttttacatactcatgataaatccaggacagatctggagcaagtacctaagatttttatgaaaccagattttgccttggatgattccttaacttttaattcagttttaccatggtctcattttaatactgctggtggaaaaggaaatcgtgatgcagcttcctcaaagttgcttcaagaaaagctgagccattatctggatattgtggaagtaaacattgctcaccagatctctctacgttcagaagcattttttcatgcaatgacctctcaacacgagttgcaggactacctcaggaaaacttcccaggctgtaaaaatgcttcgagataaaattgcacagattgataaagtaatgtgtgaaggatcactccacattttaagactggcacttaccagaaataattgtgttaaagtatacaataagctgaagttaatggccactgtacaccagactcagcctacagtacaggtgttattatctacttctgaatttgttggagcattggacttaatagcaacaacacaagaggttctacagcaggaacttcagggcattcacagtttccggcatttgggatcacagctttgtgaattagaaaaactgatagataaaatgatgattgcagaattttctacttattctcacagtgacttaaatagaccactggaagatgactgtcaagttttagaagaggaaagactaatatctcttgtatttggacttttaaaacaaagaaagcttaattttttagaaatctatggtgaaaaaatggttattacagcaaagaatatcattaaacagtgtgtgattaataaagtttcacaaacagaagaaatagacacagatgttgttgtgaagcttgcagatcagatgagaatgttgaattttccccagtggtttgatctgctcaaggatattttctctaagtttacaattttcctacagagagtgaaggcaacattaaatatcattcacagtgttgttctctcagttcttgacaaaaaccaaaggactagagaattggaagagatttcacaacagaagaatgctgcaaaagataattcactggacacagaggtggcttatttaatccatgaaggcatgtttataagtgatgcattcggtgagggtgagctaacacctatagcagttgacactacctctcaaagaaatgcatctccaaatagtgagccctgcagcagtgattctgtatccgagccagaatgtactactgattcttcatccagcaaagagcacacatcatcatctgctattccaggaggtgtggatattatggtcagtgaagatatgaaattaactgactcagagctaggaaagctggcaaataatatccaggaattattatatagtgcctcagatatatgccatgatcgagctgtcaaatttctcatgtcaagagcaaaggatggttttcttgagaagctaaattccatggaattcataacactttctagattaatggaaacattcattttagacaccgaacagatctgtggaagaaaaagcacgtcattacttggagcacttcagagccaagctattaagtttgtaaataggtttcatgaagagagaaaaaccaagctcagcctcctcttagacaatgagcgctggaagcaagcagatgttcctgcagaatttcaggatcttgttgattctctgtcagatgggaagattgctttacctgaaaaaaaatcaggagccacagaagaaaggaaaccagctgaagttcttattgtcgagggacaacagtatgcagttgttggaaccgtattgctgttaataagaattatccttgaatattgccagtgtgtggataacatcccatctgttactactgacatgcttactcgtctgtcagatttattgaagtacttcaattcaagaagttgccagttagttcttggagctggtgcactgcaagttgttggactaaaaacgataactacaaaaaatttggctctttcttcacgatgtttgcagttaattgtgcactacattcctgtgatccgggctcattttgaagctcgactaccacctaagcaatatagcatgcttaggcattttgatcatatcactaaggactaccatgatcacatagctgaaatatcagctaagcttgtagcgataatggatagcttatttgacaagctgttatctaagtatgaagtgaaggctcctgttccttctgcctgtttcaggaatatttgtaagcaaatgacaaaaatgcacgaagctatatttgatctccttccagaagaacaaacacagatgttatttttaagaattaatgcaagttataaactccacttgaaaaagcagttatctcacttaaatgtgataaatgatggaggacctcaaaatgggttggtcacagcagatgtagctttttacactggaaatcttcaagccttaaaaggccttaaaatctggatg

SEQ ID NO: 8414 - DNA, 3427 bp, Homo sapiens
gggaacccgggctcgggcccggccgggcgccgggcggcggcggccgtggagcagcagcctcggtgcgacgtggagggctggaggcggcggcgatgcactaggcctcgctcagggcggctgccccgggacccgcagttgagtggtgattttatgcaatggcttcaagccacagttcttcaccagtgcctcaaggaagcagcagtgatgttttctttaaaatagaggtagatccgtcaaaacacattcgacctgtgccatcactgccagatgtgtgtcccaaggaacccacagttacagatcaacatagatggactgtatatcattccaaagtaaatctcccagcagcattaaacgatcctagattagcaaaaagagaatctgacttcttcacaaaaacatggggattggactttgtggacactgaagtcataccttcattctacctcccacagatcagcaaggaacattttacagtatatcaacaggaaatctctcagagagagaagattcatgagagatgcaagaatatttgtcctcctaaagataccttcgaaaggactcttttacatactcatgataaatccaggacagatctggagcaagtacctaagatttttatgaaaccagattttgccttggatgattccttaacttttaattcagttttaccatggtctcattttaatactgctggtggaaaaggaaatcgtgatgcagcttcctcaaagttgcttcaagaaaagctgagccattatctggatattgtggaagtaaacattgctcaccagatctctctacgttcagaagcattttttcatgcaatgacctctcaacacgagttgcaggactacctcaggaaaacttcccaggctgtaaaaatgcttcgagataaaattgcacagattgataaagtaatgtgtgaaggatcactccacattttaagactggcacttaccagaaataattgtgttaaagtatacaataagctgaagttaatggccactgtacaccagactcagcctacagtacaggtgttattatctacttctgaatttgttggagcattggacttaatagcaacaacacaagaggttctacagcaggaacttcagggcattcacagtttccggcatttgggatcacagctttgtgaattagaaaaactgatagataaaatgatgattgcagaattttctacttattctcacagtgacttaaatagaccactggaagatgactgtcaagttttagaagaggaaagactaatatctcttgtatttggacttttaaaacaaagaaagcttaattttttagaaatctatggtgaaaaaatggttattacagcaaagaatatcattaaacagtgtgtgattaataaagtttcacaaacagaagaaatagacacagatgttgttgtgaagcttgcagatcagatgagaatgttgaattttccccagtggtttgatctgctcaaggatattttctctaagtttacaattttcctacagagagtgaaggcaacattaaatatcattcacagtgttgttctctcagttcttgacaaaaaccaaaggactagagaattggaagagatttcacaacagaagaatgctgcaaaagataattcactggacacagaggtggcttatttaatccatgaaggcatgtttataagtgatgcattcggtgagggtgagctaacacctatagcagttgacactacctctcaaagaaatgcatctccaaatagtgagccctgcagcagtgattctgtatccgagccagaatgtactactgattcttcatccagcaaagagcacacatcatcatctgctattccaggaggtgtggatattatggtcagtgaagatatgaaattaactgactcagagctaggaaagctggcaaataatatccaggaattattatatagtgcctcagatatatgccatgatcgagctgtcaaatttctcatgtcaagagcaaaggatggttttcttgagaagctaaattccatggaattcataacactttctagattaatggaaacattcattttagacaccgaacagatctgtggaagaaaaagcacgtcattacttggagcacttcagagccaagctattaagtttgtaaataggtttcatgaagagagaaaaaccaagctcagcctcctcttagacaatgagcgctggaagcaagcagatgttcctgcagaatttcaggatcttgttgattctctgtcagatgggaagattgctttacctgaaaaaaaatcaggagccacagaagaaaggaaaccagctgaagttcttattgtcgagggacaacagtatgcagttgttggaaccgtattgctgttaataagaattatccttgaatattgccagtgtgtggataacatcccatctgttactactgacatgcttactcgtctgtcagatttattgaagtacttcaattcaagaagttgccagttagttcttggagctggtgcactgcaagttgttggactaaaaacgataactacaaaaaatttggctctttcttcacgatgtttgcagttaattgtgcactacattcctgtgatccgggctcattttgaagctcgactaccacctaagcaatatagcatgcttaggcattttgatcatatcactaaggactaccatgatcacatagctgaaatatcagctaagcttgtagcgataatggatagcttatttgacaagctgttatctaagtatgaagtgaaggctcctgttccttctgcctgtttcaggaatatttgtaagcaaatgacaaaaatgcacgaagctatatttgatctccttccagaagaacaaacacagatgttatttttaagaattaatgcaagttataaactccacttgaaaaagcagttatctcacttaaatgtgataaatgatggaggacctcaaaatgggttggtcacagcagatgtagctttttacactggaaatcttcaagccttaaaaggccttaaagatttggacctaaatatggccgaaatttgggagcagaagaggtgatgtcatcctggaaaactgggtagttcatctgaccatgggatgtgtttgttatgaagaaaatctggatgcctgtgattcgagaattgaacctgaaacccaaagtgaactggggtgggggaagggaaaaaggaaagtatcaagtgttgggaaactggattcagtgggatctacaaggaatgtcatttttgtgcatcctacagtgaggagtaactgatcaggtgtctataacatttttcattctctctggaaacagactcaggtttctttggaccaaatccaaaagaacacatagctgtaacacagctgtagttgactagaatgctctgtatactttatattaaaaaatgctttgcatttcttccagtgcaatgaaa

SEQ ID NO: 8415 - DNA, 3414 bp, Homo sapiens
gcggtggattgtgggctgggggctgcggcggcctccggcgctgtctccccgcacccgaccgggccgagccggctgggccggcggggtgagggaaagcagtggagtcgggagcagaagcgctagaggcagtggtcgtggcgcggcggccgtggagcagcagcctcggtgcgacgtggagggctggaggcggcggcgatgcactaggcctcgctcagggcggctgccccgggacccgcagttgagtggtgattttatgcaatggcttcaagccacagttcttcaccagtgcctcaaggaagcagcagtgatgttttctttaaaatagaggtagatccgtcaaaacacattcgacctgtgccatcactgccagatgtgtgtcccaaggaacccacagttacagatcaacatagatggactgtatatcattccaaagtaaatctcccagcagcattaaacgatcctagattagcaaaaagagaatctgacttcttcacaaaaacatggggattggactttgtggacactgaagtcataccttcattctacctcccacagatcagcaaggaacattttacagtatatcaacaggaaatctctcagagagagaagattcatgagagatgcaagaatatttgtcctcctaaagataccttcgaaaggactcttttacatactcatgataaatccaggacagatctggagcaagtacctaagatttttatgaaaccagattttgccttggatgattccttaacttttaattcagttttaccatggtctcattttaatactgctggtggaaaaggaaatcgtgatgcagcttcctcaaagttgcttcaagaaaagctgagccattatctggatattgtggaagtaaacattgctcaccagatctctctacgttcagaagcattttttcatgcaatgacctctcaacacgagttgcaggactacctcaggaaaacttcccaggctgtaaaaatgcttcgagataaaattgcacagattgataaagtaatgtgtgaaggatcactccacattttaagactggcacttaccagaaataattgtgttaaagtatacaataagctgaagttaatggccactgtacaccagactcagcctacagtacaggtgttattatctacttctgaatttgttggagcattggacttaatagcaacaacacaagaggttctacagcaggaacttcagggcattcacagtttccggcatttgggatcacagctttgtgaattagaaaaactgatagataaaatgatgattgcagaattttctacttattctcacagtgacttaaatagaccactggaagatgactgtcaagttttagaagaggaaagactaatatctcttgtatttggacttttaaaacaaagaaagcttaattttttagaaatctatggtgaaaaaatggttattacagcaaagaatatcattaaacagtgtgtgattaataaagtttcacaaacagaagaaatagacacagatgttgttgtgaagcttgcagatcagatgagaatgttgaattttccccagtggtttgatctgctcaaggatattttctctaagtttacaattttcctacagagagtgaaggcaacattaaatatcattcacagtgttgttctctcagttcttgacaaaaaccaaaggactagagaattggaagagatttcacaacagaagaatgctgcaaaagataattcactggacacagaggtggcttatttaatccatgaaggcatgtttataagtgatgcattcggtgagggtgagctaacacctatagcagttgacactacctctcaaagaaatgcatctccaaatagtgagccctgcagcagtgattctgtatccgagccagaatgtactactgattcttcatccagcaaagagcacacatcatcatctgctattccaggaggtgtggatattatggtcagtgaagatatgaaattaactgactcagagctaggaaagctggcaaataatatccaggaattattatatagtgcctcagatatatgccatgatcgagctgtcaaatttctcatgtcaagagcaaaggatggttttcttgagaagctaaattccatggaattcataacactttctagattaatggaaacattcattttagacaccgaacagatctgtggaagaaaaagcacgtcattacttggagcacttcagagccaagctattaagtttgtaaataggtttcatgaagagagaaaaaccaagctcagcctcctcttagacaatgagcgctggaagcaagcagatgttcctgcagaatttcaggatcttgttgattctctgtcagatgggaagattgctttacctgaaaaaaaatcaggagccacagaagaaaggaaaccagctgaagttcttattgtcgagggacaacagtatgcagttgttggaaccgtattgctgttaataagaattatccttgaatattgccagtgtgtggataacatcccatctgttactactgacatgcttactcgtctgtcagatttattgaagtacttcaattcaagaagttgccagttagttcttggagctggtgcactgcaagttgttggactaaaaacgataactacaaaaaatttggctctttcttcacgatgtttgcagttaattgtgcactacattcctgtgatccgggctcattttgaagctcgactaccacctaagcaatatagcatgcttaggcattttgatcatatcactaaggactaccatgatcacatagctgaaatatcagctaagcttgtagcgataatggatagcttatttgacaagctgttatctaagtatgaagtgaaggctcctgttccttctgcctgtttcaggaatatttgtaagcaaatgacaaaaatgcacgaagctatatttgatctccttccagaagaacaaacacagatgttatttttaagaattaatgcaagttataaactccacttgaaaaagcagttatctcacttaaatgtgataaatgatggaggacctcaaaatgggttggtcacagcagatgtagctttttacactggaaatcttcaagccttaaaaggccttaaagatttggacctaaatatggccgaaatttgggagcagaagaggtgatgtcatcctggaaaactgggtagttcatctgaccatgggatgtgtttgttatgaagaaaatctggatgcctgtgattcgagaattgaacctgaaacccaaagtgaactggggtgggggaagggaaaaaggaaagtatcaagtgttgggaaactggattcagtgggatctacaaggaatgtcatttttgtgcatcctacagtgaggagtaactgatcaggtgtctataacatttttcattctctctggaaacagactca

SEQ ID NO: 8416 - DNA, 5047 bp, Homo sapiens
aggtagtgcgcgtgcgtgaggctagagcagtgggtgcggtcacgtgggccggcggtccacggccggaatggcagcaagctcagagataatcattcaggtcttcgtgagctaaggccaaacaaacaaaaaacacttgctttgatggactgaatactgttattagaagtaaatatggaaaatgaaccagaccatgaaaatgtggaacagagcctctgtgccaagacgagcgaagaagagctgaataagtctttcaatctagaagcttcactttcaaaattctcttacatagatatggacaaggaactggagttcaaaaatgatctgattgatgacaaggagtttgatattcctcaagttgatactcctccaacactggaaagcatactaaatgagactgatgatgaagatgagtcttttattcttgaggatcctacattgttaaacattgatactattgattctcactcctatgatacttcatctgtggcaagctcagatagtggtgacaggaccaacttaaaaaggaagaagaaattacctgattctttttcacttcatggatcagttatgcgccattcacttttgaagggaatttctgcccagatagtgtctgcagctgacaaagtagatgctggcttgcctacagcaattgcagtatccagtctgatagcagtgggtacatctcatggattggctttaatatttggtaaatatcagaatcaagctttgcgactctgtctgggtagcactagtgttggaggtcagtatggcgctatctctgccctcagtatcaacaatgattgctcaagacttctttgtggctttgctaaaggacagatcaccatgtgggatttggccagtggaaaacttctaagatcaataacagatgctcatcctccaggaacagcaatattgcatatcaagtttacagatgatccaactcttgcaatttgcaacgacagcggaggctctgtttttgaattgacatttaagagagtgatgggagtgagaacctgtgaatctagatgtctgttcagtggttccaagggtgaagtctgctgtattgagcctctgcattctaagcctgagttgaaagatcatcccatcacacagttttcattattggccatggcatccttgacaaaaatactggtcattggattgaaaccatccttgaaagtatggatgacttttccctatggccggatggatccttccagtgtgccactgctggcctggcactttgtagcagtacaaaattacgtgaatcccatgcttgccttctgcagaggagatgttgttcattttctattggtaaagagagatgaatctggagcaatacatgttactaagcaaaagcatcttcacctatactatgacctcatcaactttacctggataaattcacgcacagttgtgctcttagacagcgtagagaagttgcatgtgattgatcggcaaacacaagaggaattggagacagtggagatctcagaagttcagctggtctacaatagcagccatttcaaatcactagccactggaggaaatgttagccaggcactggctttggttggagagaaggcttgttatcaatccatcagtagctatggtggtcagatcttttatttggggacaaaatctgtttatgtgatgatgctgaggagctggagagagagagtggatcatctcctgaaacaagattgtcttacagaagcgttggctcttgcgtggtctttccatgaaggaaaagcaaaagcagtagtgggattatcaggggatgccagtaagcgaaaggctattgttgcagaccggatggtagaaatcctattccattatgcagatcgagctctgaaaaagtgcccagaccaaggaaaaatccaagtgatggagcagcattttcaggatatggtgcctgtcatagttgattactgccttctgctgcagcgaaaggatcttttatttagtcagatgtatgataaattaagtgagaattcagtggccaaaggagtatttttggagtgccttgagccatatattttaagtgataaattggtgggaatcacaccccaagtaatgaaagacttgattgttcatttccaagataaaaaattaatggaaaatgtggaagcgctcattgtacatatggatatcaccagcctagatattcagcaggtagttctcatgtgttgggaaaatcgtttatatgatgctatgatctatgtctacaacagaggcatgaatgaatttattagtccaatggagaaacttttcagagtcattgctcctcctctgaatgcaggaaaaacactaacagatgaacaagttgttatgggcaataagctccttgtatatattagctgttgtctagcaggtcgtgcctatccccttggtgacatccctgaagatctggttcccttggttaaaaaccaggtttttgaatttctaattcgcctgcattcagcagaggcttctcctgaggaagaaatctatccttacattcggactttgctacattttgacacaagagaatttctaaatgtattggcactgacttttgaagattttaaaaatgacaagcaagctgtggaatatcaacagcgaattgtggatattttgttgaaagttatggtggagaattcagactttaccccctcacaagtaggatgtctctttaccttccttgctcggcagcttgcaaagcctgacaacaccttgtttgtaaacagaacactttttgatcaggtccttgaattcctttgtagtcctgacgatgactcccgacactctgaaagacagcaggtccttttagaattgctgcaggctggaggcatagttcaatttgaagagagtcgactcatccggatggcagaaaaagctgagttctatcaaatttgtgaatttatgtatgaaagagaacaccaatatgataaaattattgattgctacttacgtgaccctctgcgagaggaagaagtctttaattacattcacaatatcttatccattcccggacacagtgcagaggagaagcagtctgtatggcagaaagcaatggatcatattgaggaactcgtgtccctgaagccttgtaaagctgcggagctggttgccacccacttttctggacatattgaaacggtcattaaaaaacttcagaaccaggttttgcttttcaaatttttgaggagtcttcttgacccaagggaaggtattcatgtaaatcaagaattactgcaaatatctccttgtatcacagagcagttcattgagctgttgtgtcagttcaacccaacccaagttatagagactctgcaagtccttgagtgctaccgtctggaagaaactattcagattactcagaagtatcaacttcatgaagtcaccgcttatctattggaaaagaaaggagatattcatggtgccttcctaataatgttagagagactacaaagcaaacttcaagaggtaacacatcaaggtgaaaataccaaagaggatccctcattgaaggatgttgaagatactatggtggagaccattgctctttgccagagaaattcacataatttgaaccagcagcaacgtgaggcactttggtttccgttattggaggcaatgatggcccctcagaagctgtccagttcagccattcctcatctacactctgaagctctgaagtctttgaccatgcaagttttaaatagcatggcagcatttattgcccttccatcaatcttgcaaagaatcttacaggatccagtttatggaaaaggaaaacttggagaaatccagggacttatcttgggaatgttagatacctttaactatgaacaaaccctgctggaaacaacaaccagccttctaaaccaagatctccattggtcattgtgtaacctgagagcttcggtcaccagaggactgaatcccaaacaagattactgctctatatgtttgcagcagtacaagagacgccaagaaatggctgatgaaataattgtctttagctgtggccatttgtatcactcattctgcctacaaaacaaagaatgcactgtggaatttgagggccaaacaagatggacatgctacaaatgcagttcaagtaacaaagtaggaaaactcagtgaaaattcatctgaaattaaaaagggaaggataaccccatcacaggtaaaaatgtctccatcgtatcatcagtccaaaggggatcccactgctaaaaagggaacctcagaacctgttctggatccacagcaaatccaagcatttgatcagctttgccgtctctaccgaggaagctccaggctggctctcctcacggaactctcccagaatcgcagcagcgagagctataggccattcagtggctcgcagagtgctcctgctttcaacagcatcttccagaatgagaacttccagctgcagctcattcctccacctgtgactgaggattgatgactccatggagcctggcccaggagaaccagagatgatcccgaggcagctggggagaggccccgcctctggtgggcttggcctccaccacctcccacgcttctgagaagaggttccaaattgggcttctgtgcccagagcgtccacagcaccattcccagtgtagactcccagtcttctccacattgctgtcatggcgtcagttcaccagactcattgattttgttttgcttgttaagcaaaggaatgtcacatacctctgtccagctttttaggaaatacatttcgcctattgcgactttttccatttaccctgaagcctagaaagtaggtggaactcacacaaatggcattccagagtctgccatactccgtctcctccagctgctggataatacagaggaacttcaacttctacagggaacagtggttggccaggctgcagtataactgaagcatgccttggagagagcagacactgtgggggccagggccatctccctttaatgtgttcatgttaaaacctatttgagtgtaagacttgccctttctaacaataaatgctccgtgtttaagttctgcaggtctc

SEQ ID NO: 8417 - DNA, 811 bp, Homo sapiens
cggtccacggccggaatggcagcaagctcaggggaactggagcactaccctggggtttggaatgtaaagaaggcattaattgcagcttttggcaccgatttacccttatgctgttagagataatcattcaggtcttcgtgagctaaggccaaacaaacaaaaaacacttgctttgatggactgaatactgttattagaagtaaatatggaaaatgaaccagaccatgaaaatgtggaacagagcctctgtgccaagacgagcgaagaagagctgaataagtctttcaatctagaagcttcactttcaaaattctcttacatagatatggacaaggaactggagttcaaaaatgatctgattgatgacaaggagtttgatattcctcaagttgatactcctccaacactggaaagcatactaaatgagactgatgatgaagatgagtcttttattcttgaggatcctacattgttaaacattgatactattgattctcactcctatgatacttcatctgtggcaagctcagatagtggtgacaggaccaacttaaaaaggaagaagaaattacctgattctttttcacttcatggatcagttatgcgccattcacttttgaagggaatttctgcccagatagtgtctgcagctgacaaagtagatgctggcttgcctacagcaattgcagtatccagtctgatagcagtgggtacatctcatggattggctttaatatttgatcagaatcaagctttgcgactctgtctgggtagcactagtgttggaggtcagtatggcgctatctctgcc

SEQ ID NO: 8418 - DNA, 5011 bp, Homo sapiens
agtgggtgcggtcacgtgggccggcggtccacggccggaatggcagcaagctcagagataatcattcaggtcttcgtgagctaaggccaaacaaacaaaaaacacttgctttgatggactgaatactgttattagaagtaaatatggaaaatgaaccagaccatgaaaatgtggaacagagcctctgtgccaagacgagcgaagaagagctgaataagtctttcaatctagaagcttcactttcaaaattctcttacatagatatggacaaggaactggagttcaaaaatgatctgattgatgacaaggagtttgatattcctcaagttgatactcctccaacactggaaagcatactaaatgagactgatgatgaagatgagtcttttattcttgaggatcctacattgttaaacattgatactattgattctcactcctatgatacttcatctgtggcaagctcagatagtggtgacaggaccaacttaaaaaggaagaagaaattacctgattctttttcacttcatggatcagttatgcgccattcacttttgaagggaatttctgcccagatagtgtctgcagctgacaaagtagatgctggcttgcctacagcaattgcagtatccagtctgatagcagtgggtacatctcatggattggctttaatatttgatcagaatcaagctttgcgactctgtctgggtagcactagtgttggaggtcagtatggcgctatctctgccctcagtatcaacaatgattgctcaagacttctttgtggctttgctaaaggacagatcaccatgtgggatttggccagtggaaaacttctaagatcaataacagatgctcatcctccaggaacagcaatattgcatatcaagtttacagatgatccaactcttgcaatttgcaacgacagcggaggctctgtttttgaattgacatttaagagagtgatgggagtgagaacctgtgaatctagatgtctgttcagtggttccaagggtgaagtctgctgtattgagcctctgcattctaagcctgagttgaaagatcatcccatcacacagttttcattattggccatggcatccttgacaaaaatactggtcattggattgaaaccatccttgaaagtatggatgacttttccctatggccggatggatccttccagtgtgccactgctggcctggcactttgtagcagtacaaaattacgtgaatcccatgcttgccttctgcagaggagatgttgttcattttctattggtaaagagagatgaatctggagcaatacatgttactaagcaaaagcatcttcacctatactatgacctcatcaactttacctggataaattcacgcacagttgtgctcttagacagcgtagagaagttgcatgtgattgatcggcaaacacaagaggaattggagacagtggagatctcagaagttcagctggtctacaatagcagccatttcaaatcactagccactggaggaaatgttagccaggcactggctttggttggagagaaggcttgttatcaatccatcagtagctatggtggtcagatcttttatttggggacaaaatctgtttatgtgatgatgctgaggagctggagagagagagtggatcatctcctgaaacaagattgtcttacagaagcgttggctcttgcgtggtctttccatgaaggaaaagcaaaagcagtagtgggattatcaggggatgccagtaagcgaaaggctattgttgcagaccggatggtagaaatcctattccattatgcagatcgagctctgaaaaagtgcccagaccaaggaaaaatccaagtgatggagcagcattttcaggatatggtgcctgtcatagttgattactgccttctgctgcagcgaaaggatcttttatttagtcagatgtatgataaattaagtgagaattcagtggccaaaggagtatttttggagtgccttgagccatatattttaagtgataaattggtgggaatcacaccccaagtaatgaaagacttgattgttcatttccaagataaaaaattaatggaaaatgtggaagcgctcattgtacatatggatatcaccagcctagatattcagcaggtagttctcatgtgttgggaaaatcgtttatatgatgctatgatctatgtctacaacagaggcatgaatgaatttattagtccaatggagaaacttttcagagtcattgctcctcctctgaatgcaggaaaaacactaacagatgaacaagttgttatgggcaataagctccttgtatatattagctgttgtctagcaggtcgtgcctatccccttggtgacatccctgaagatctggttcccttggttaaaaaccaggtttttgaatttctaattcgcctgcattcagcagaggcttctcctgaggaagaaatctatccttacattcggactttgctacattttgacacaagagaatttctaaatgtattggcactgacttttgaagattttaaaaatgacaagcaagctgtggaatatcaacagcgaattgtggatattttgttgaaagttatggtggagaattcagactttaccccctcacaagtaggatgtctctttaccttccttgctcggcagcttgcaaagcctgacaacaccttgtttgtaaacagaacactttttgatcaggtccttgaattcctttgtagtcctgacgatgactcccgacactctgaaagacagcaggtccttttagaattgctgcaggctggaggcatagttcaatttgaagagagtcgactcatccggatggcagaaaaagctgagttctatcaaatttgtgaatttatgtatgaaagagaacaccaatatgataaaattattgattgctacttacgtgaccctctgcgagaggaagaagtctttaattacattcacaatatcttatccattcccggacacagtgcagaggagaagcagtctgtatggcagaaagcaatggatcatattgaggaactcgtgtccctgaagccttgtaaagctgcggagctggttgccacccacttttctggacatattgaaacggtcattaaaaaacttcagaaccaggttttgcttttcaaatttttgaggagtcttcttgacccaagggaaggtattcatgtaaatcaagaattactgcaaatatctccttgtatcacagagcagttcattgagctgttgtgtcagttcaacccaacccaagttatagagactctgcaagtccttgagtgctaccgtctggaagaaactattcagattactcagaagtatcaacttcatgaagtcaccgcttatctattggaaaagaaaggagatattcatggtgccttcctaataatgttagagagactacaaagcaaacttcaagaggtaacacatcaaggtgaaaataccaaagaggatccctcattgaaggatgttgaagatactatggtggagaccattgctctttgccagagaaattcacataatttgaaccagcagcaacgtgaggcactttggtttccgttattggaggcaatgatggcccctcagaagctgtccagttcagccattcctcatctacactctgaagctctgaagtctttgaccatgcaagttttaaatagcatggcagcatttattgcccttccatcaatcttgcaaagaatcttacaggatccagtttatggaaaaggaaaacttggagaaatccagggacttatcttgggaatgttagatacctttaactatgaacaaaccctgctggaaacaacaaccagccttctaaaccaagatctccattggtcattgtgtaacctgagagcttcggtcaccagaggactgaatcccaaacaagattactgctctatatgtttgcagcagtacaagagacgccaagaaatggctgatgaaataattgtctttagctgtggccatttgtatcactcattctgcctacaaaacaaagaatgcactgtggaatttgagggccaaacaagatggacatgctacaaatgcagttcaagtaacaaagtaggaaaactcagtgaaaattcatctgaaattaaaaagggaaggataaccccatcacaggtaaaaatgtctccatcgtatcatcagtccaaaggggatcccactgctaaaaagggaacctcagaacctgttctggatccacagcaaatccaagcatttgatcagctttgccgtctctaccgaggaagctccaggctggctctcctcacggaactctcccagaatcgcagcagcgagagctataggccattcagtggctcgcagagtgctcctgctttcaacagcatcttccagaatgagaacttccagctgcagctcattcctccacctgtgactgaggattgatgactccatggagcctggcccaggagaaccagagatgatcccgaggcagctggggagaggccccgcctctggtgggcttggcctccaccacctcccacgcttctgagaagaggttccaaattgggcttctgtgcccagagcgtccacagcaccattcccagtgtagactcccagtcttctccacattgctgtcatggcgtcagttcaccagactcattgattttgttttgcttgttaagcaaaggaatgtcacatacctctgtccagctttttaggaaatacatttcgcctattgcgactttttccatttaccctgaagcctagaaagtaggtggaactcacacaaatggcattccagagtctgccatactccgtctcctccagctgctggataatacagaggaacttcaacttctacagggaacagtggttggccaggctgcagtataactgaagcatgccttggagagagcagacactgtgggggccagggccatctccctttaatgtgttcatgttaaaacctatttgagtgtaagacttgccctttctaacaataaatgctccgtgtttaagttctgcaggtc

SEQ ID NO: 8419 - DNA, 5047 bp, Homo sapiens
aggtagtgcgcgtgcgtgaggctagagcagtgggtgcggtcacgtgggccggcggtccacggccggaatggcagcaagctcagagataatcattcaggtcttcgtgagctaaggccaaacaaacaaaaaacacttgctttgatggactgaatactgttattagaagtaaatatggaaaatgaaccagaccatgaaaatgtggaacagagcctctgtgccaagacgagcgaagaagagctgaataagtctttcaatctagaagcttcactttcaaaattctcttacatagatatggacaaggaactggagttcaaaaatgatctgattgatgacaaggagtttgatattcctcaagttgatactcctccaacactggaaagcatactaaatgagactgatgatgaagatgagtcttttattcttgaggatcctacattgttaaacattgatactattgattctcactcctatgatacttcatctgtggcaagctcagatagtggtgacaggaccaacttaaaaaggaagaagaaattacctgattctttttcacttcatggatcagttatgcgccattcacttttgaagggaatttctgcccagatagtgtctgcagctgacaaagtagatgctggcttgcctacagcaattgcagtatccagtctgatagcagtgggtacatctcatggattggctttaatatttggaaaagatcagaatcaagctttgcgactctgtctgggtagcactagtgttggaggtcagtatggcgctatctctgccctcagtatcaacaatgattgctcaagacttctttgtggctttgctaaaggacagatcaccatgtgggatttggccagtggaaaacttctaagatcaataacagatgctcatcctccaggaacagcaatattgcatatcaagtttacagatgatccaactcttgcaatttgcaacgacagcggaggctctgtttttgaattgacatttaagagagtgatgggagtgagaacctgtgaatctagatgtctgttcagtggttccaagggtgaagtctgctgtattgagcctctgcattctaagcctgagttgaaagatcatcccatcacacagttttcattattggccatggcatccttgacaaaaatactggtcattggattgaaaccatccttgaaagtatggatgacttttccctatggccggatggatccttccagtgtgccactgctggcctggcactttgtagcagtacaaaattacgtgaatcccatgcttgccttctgcagaggagatgttgttcattttctattggtaaagagagatgaatctggagcaatacatgttactaagcaaaagcatcttcacctatactatgacctcatcaactttacctggataaattcacgcacagttgtgctcttagacagcgtagagaagttgcatgtgattgatcggcaaacacaagaggaattggagacagtggagatctcagaagttcagctggtctacaatagcagccatttcaaatcactagccactggaggaaatgttagccaggcactggctttggttggagagaaggcttgttatcaatccatcagtagctatggtggtcagatcttttatttggggacaaaatctgtttatgtgatgatgctgaggagctggagagagagagtggatcatctcctgaaacaagattgtcttacagaagcgttggctcttgcgtggtctttccatgaaggaaaagcaaaagcagtagtgggattatcaggggatgccagtaagcgaaaggctattgttgcagaccggatggtagaaatcctattccattatgcagatcgagctctgaaaaagtgcccagaccaaggaaaaatccaagtgatggagcagcattttcaggatatggtgcctgtcatagttgattactgccttctgctgcagcgaaaggatcttttatttagtcagatgtatgataaattaagtgagaattcagtggccaaaggagtatttttggagtgccttgagccatatattttaagtgataaattggtgggaatcacaccccaagtaatgaaagacttgattgttcatttccaagataaaaaattaatggaaaatgtggaagcgctcattgtacatatggatatcaccagcctagatattcagcaggtagttctcatgtgttgggaaaatcgtttatatgatgctatgatctatgtctacaacagaggcatgaatgaatttattagtccaatggagaaacttttcagagtcattgctcctcctctgaatgcaggaaaaacactaacagatgaacaagttgttatgggcaataagctccttgtatatattagctgttgtctagcaggtcgtgcctatccccttggtgacatccctgaagatctggttcccttggttaaaaaccaggtttttgaatttctaattcgcctgcattcagcagaggcttctcctgaggaagaaatctatccttacattcggactttgctacattttgacacaagagaatttctaaatgtattggcactgacttttgaagattttaaaaatgacaagcaagctgtggaatatcaacagcgaattgtggatattttgttgaaagttatggtggagaattcagactttaccccctcacaagtaggatgtctctttaccttccttgctcggcagcttgcaaagcctgacaacaccttgtttgtaaacagaacactttttgatcaggtccttgaattcctttgtagtcctgacgatgactcccgacactctgaaagacagcaggtccttttagaattgctgcaggctggaggcatagttcaatttgaagagagtcgactcatccggatggcagaaaaagctgagttctatcaaatttgtgaatttatgtatgaaagagaacaccaatatgataaaattattgattgctacttacgtgaccctctgcgagaggaagaagtctttaattacattcacaatatcttatccattcccggacacagtgcagaggagaagcagtctgtatggcagaaagcaatggatcatattgaggaactcgtgtccctgaagccttgtaaagctgcggagctggttgccacccacttttctggacatattgaaacggtcattaaaaaacttcagaaccaggttttgcttttcaaatttttgaggagtcttcttgacccaagggaaggtattcatgtaaatcaagaattactgcaaatatctccttgtatcacagagcagttcattgagctgttgtgtcagttcaacccaacccaagttatagagactctgcaagtccttgagtgctaccgtctggaagaaactattcagattactcagaagtatcaacttcatgaagtcaccgcttatctattggaaaagaaaggagatattcatggtgccttcctaataatgttagagagactacaaagcaaacttcaagaggtaacacatcaaggtgaaaataccaaagaggatccctcattgaaggatgttgaagatactatggtggagaccattgctctttgccagagaaattcacataatttgaaccagcagcaacgtgaggcactttggtttccgttattggaggcaatgatggcccctcagaagctgtccagttcagccattcctcatctacactctgaagctctgaagtctttgaccatgcaagttttaaatagcatggcagcatttattgcccttccatcaatcttgcaaagaatcttacaggatccagtttatggaaaaggaaaacttggagaaatccagggacttatcttgggaatgttagatacctttaactatgaacaaaccctgctggaaacaacaaccagccttctaaaccaagatctccattggtcattgtgtaacctgagagcttcggtcaccagaggactgaatcccaaacaagattactgctctatatgtttgcagcagtacaagagacgccaagaaatggctgatgaaataattgtctttagctgtggccatttgtatcactcattctgcctacaaaacaaagaatgcactgtggaatttgagggccaaacaagatggacatgctacaaatgcagttcaagtaacaaagtaggaaaactcagtgaaaattcatctgaaattaaaaagggaaggataaccccatcacaggtaaaaatgtctccatcgtatcatcagtccaaaggggatcccactgctaaaaagggaacctcagaacctgttctggatccacagcaaatccaagcatttgatcagctttgccgtctctaccgaggaagctccaggctggctctcctcacggaactctcccagaatcgcagcagcgagagctataggccattcagtggctcgcagagtgctcctgctttcaacagcatcttccagaatgagaacttccagctgcagctcattcctccacctgtgactgaggattgatgactccatggagcctggcccaggagaaccagagatgatcccgaggcagctggggagaggccccgcctctggtgggcttggcctccaccacctcccacgcttctgagaagaggttccaaattgggcttctgtgcccagagcgtccacagcaccattcccagtgtagactcccagtcttctccacattgctgtcatggcgtcagttcaccagactcattgattttgttttgcttgttaagcaaaggaatgtcacatacctctgtccagctttttaggaaatacatttcgcctattgcgactttttccatttaccctgaagcctagaaagtaggtggaactcacacaaatggcattccagagtctgccatactccgtctcctccagctgctggataatacagaggaacttcaacttctacagggaacagtggttggccaggctgcagtataactgaagcatgccttggagagagcagacactgtgggggccagggccatctccctttaatgtgttcatgttaaaacctatttgagtgtaagacttgccctttctaacaataaatgctccgtgtttaagttctgcaggtctc

SEQ ID NO: 8420 - DNA, 549 bp, Homo sapiens
atttgagattctggaagccagtgatgcagtcttgcttggagataatcattcaggtcttcgtgagctaaggccaaacaaacaaaaaacacttgctttgatggactgaatactgttattagaagtaaatatggaaaatgaaccagaccatgaaaatgtggaacagagcctctgtgccaagacgagcgaagaagagctgaataagtctttcaatctagaagcttcactttcaaaattctcttacatagatatggacaaggaactggagttcaaaaatgatctgattgatgacaaggagtttgatattcctcaagttgatactcctccaacactggaaagcatactaaatgagactgatgatgaagatgagtcttttattcttgaggatcctacattgttaaacattgatactattgattctcactcctatgatacttcatctgtggcaagctcagatagtggtgacaggaccaacttaaaaaggaagaagaaattacctgattctttttcacttcatggatcagttatgcgccattcacttttgaagggaat

SEQ ID NO: 8421 - DNA, 592 bp, Homo sapiens
gatcagctgctgtgtcatatcggcacggggaatagaatggtgaacaaggcagatctggtctttgctctctcatggaacctgcattccaactgggggcaaggaatggtggtttagacaatgaggaaatcattacaatgtgagataatcattcaggtcttcgtgagctaaggccaaacaaacaaaaaacacttgctttgatggactgaatactgttattagaagtaaatatggaaaatgaaccagaccatgaaaatgtggaacagagcctctgtgccaagacgagcgaagaagagctgaataagtctttcaatctagaagcttcactttcaaaattctcttacatagatatggacaaggaactggagttcaaaaatgatctgattgatgacaaggagtttgatattcctcaagttgatactcctccaacactggaaagcatactaaatgagactgatgatgaagatgagtcttttattcttgaggatcctacattgttaaacattgatactattgattctcactcctatgatacttcatctgtggcaagctcagatagtggtgacaggaccaacttaaaaaggaagaagaaatt

SEQ ID NO: 8422 - DNA, 4721 bp, Homo sapiens
cacgtgggccggcggtccacggccggaatggcagcaagctcagagataatcattcaggtcttcgtgagctaaggccaaacaaacaaaaaacacttgctttgatggactgaatactgttattagaagtaaatatggaaaatgaaccagaccatgaaaatgtggaacagagcctctgtgccaagacgagcgaagaagagctgaataagtctttcaatctagaagcttcactttcaaaattctcttacatagatatggacaaggaactggagttcaaaaatgatctgattgatgacaaggagtttgatattcctcaagttgatactcctccaacactggaaagcatactaaatgagactgatgatgaagatgagtcttttattcttgaggatcctacattgttaaacattgatactattgattctcactcctatgatacttcatctgtggcaagctcagatagtggtgacaggaccaacttaaaaaggaagaagaaattacctgattctttttcacttcatggatcagttatgcgccattcacttttgaagggaatttctgcccagatagtgtctgcagctgacaaagtagatgctggcttgcctacagcaattgcagtatccagtctgatagcagtgggtacatctcatggattggctttaatatttgatcagaatcaagctttgcgactctgtctgggtagcactagtgttggaggtcagtatggcgctatctctgccctcagtatcaacaatgattgctcaagacttctttgtggctttgctaaaggacagatcaccatgtgggatttggccagtggaaaacttctaagatcaataacagatgctcatcctccaggaacagcaatattgcatatcaagtttacagatgatccaactcttgcaatttgcaacgacagcggaggctctgtttttgaattgacatttaagagagtgatgggagtgagaacctgtgaatctagatgtctgttcagtggttccaagggtgaagtctgctgtattgagcctctgcattctaagcctgagttgaaagatcatcccatcacacagttttcattattggccatggcatccttgacaaaaatactggtcattggattgaaaccatccttgaaagtatggatgacttttccctatggccggatggatccttccagtgtgccactgctggcctggcactttgtagcagtacaaaattacgtgaatcccatgcttgccttctgcagaggagatgttgttcattttctattggtaaagagagatgaatctggagcaatacatgttactaagcaaaagcatcttcacctatactatgacctcatcaactttacctggataaattcacgcacagttgtgctcttagacagcgtagagaagttgcatgtgattgatcggcaaacacaagaggaattggagacagtggagatctcagaagttcagctggtctacaatagcagccatttcaaatcactagccactggaggaaatgttagccaggcactggctttggttggagagaaggcttgttatcaatccatcagtagctatggtggtcagatcttttatttggggacaaaatctgtttatgtgatgatgctgaggagctggagagagagagtggatcatctcctgaaacaagattgtcttacagaagcgttggctcttgcgtggtctttccatgaaggaaaagcaaaagcagtagtgggattatcaggggatgccagtaagcgaaaggctattgttgcagaccggatggtagaaatcctattccattatgcagatcgagctctgaaaaagtgcccagaccaaggaaaaatccaagtgatggagcagcattttcaggtagttctcatgtgttgggaaaatcgtttatatgatgctatgatctatgtctacaacagaggcatgaatgaatttattagtccaatggagaaacttttcagagtcattgctcctcctctgaatgcaggaaaaacactaacagatgaacaagttgttatgggcaataagctccttgtatatattagctgttgtctagcaggtcgtgcctatccccttggtgacatccctgaagatctggttcccttggttaaaaaccaggtttttgaatttctaattcgcctgcattcagcagaggcttctcctgaggaagaaatctatccttacattcggactttgctacattttgacacaagagaatttctaaatgtattggcactgacttttgaagattttaaaaatgacaagcaagctgtggaatatcaacagcgaattgtggatattttgttgaaagttatggtggagaattcagactttaccccctcacaagtaggatgtctctttaccttccttgctcggcagcttgcaaagcctgacaacaccttgtttgtaaacagaacactttttgatcaggtccttgaattcctttgtagtcctgacgatgactcccgacactctgaaagacagcaggtccttttagaattgctgcaggctggaggcatagttcaatttgaagagagtcgactcatccggatggcagaaaaagctgagttctatcaaatttgtgaatttatgtatgaaagagaacaccaatatgataaaattattgattgctacttacgtgaccctctgcgagaggaagaagtctttaattacattcacaatatcttatccattcccggacacagtgcagaggagaagcagtctgtatggcagaaagcaatggatcatattgaggaactcgtgtccctgaagccttgtaaagctgcggagctggttgccacccacttttctggacatattgaaacggtcattaaaaaacttcagaaccaggttttgcttttcaaatttttgaggagtcttcttgacccaagggaaggtattcatgtaaatcaagaattactgcaaatatctccttgtatcacagagcagttcattgagctgttgtgtcagttcaacccaacccaagttatagagactctgcaagtccttgagtgctaccgtctggaagaaactattcagattactcagaagtatcaacttcatgaagtcaccgcttatctattggaaaagaaaggagatattcatggtgccttcctaataatgttagagagactacaaagcaaacttcaagaggtaacacatcaaggtgaaaataccaaagaggatccctcattgaaggatgttgaagatactatggtggagaccattgctctttgccagagaaattcacataatttgaaccagcagcaacgtgaggcactttggtttccgttattggaggcaatgatggcccctcagaagctgtccagttcagccattcctcatctacactctgaagctctgaagtctttgaccatgcaagttttaaatagcatggcagcatttattgcccttccatcaatcttgcaaagaatcttacaggatccagtttatggaaaaggaaaacttggagaaatccagggacttatcttgggaatgttagatacctttaactatgaacaaaccctgctggaaacaacaaccagccttctaaaccaagatctccattggtcattgtgtaacctgagagcttcggtcaccagaggactgaatcccaaacaagattactgctctatatgtttgcagcagtacaagagacgccaagaaatggctgatgaaataattgtctttagctgtggccatttgtatcactcattctgcctacaaaacaaagaatgcactgtggaatttgagggccaaacaagatggacatgctacaaatgcagttcaagtaacaaagtaggaaaactcagtgaaaattcatctgaaattaaaaagggaaggataaccccatcacaggtaaaaatgtctccatcgtatcatcagtccaaaggggatcccactgctaaaaagggaacctcagaacctgttctggatccacagcaaatccaagcatttgatcagctttgccgtctctaccgaggaagctccaggctggctctcctcacggaactctcccagaatcgcagcagcgagagctataggccattcagtggctcgcagagtgctcctgctttcaacagcatcttccagaatgagaacttccagctgcagctcattcctccacctgtgactgaggattgatgactccatggagcctggcccaggagaaccagagatgatcccgaggcagctggggagaggccccgcctctggtgggcttggcctccaccacctcccacgcttctgagaagaggttccaaattgggcttctgtgcccagagcgtccacagcaccattcccagtgtagactcccagtcttctccacattgctgtcatggcgtcagttcaccagactcattgattttgttttgcttgttaagcaaaggaatgtcacatacctctgtccagctttttaggaaatacatttcgcctattgcgactttttccatttaccctgaagcctagaaagtaggtggaactcacacaaatggcattccagagtctgccatactccgtctcctccagctgctggataatacagaggaacttcaacttctacagggaacagtggttggccaggctgcagtataactgaagcatgccttggagagagcagacactgtgggggccagggccatctccctttaatgtgttcatgttaaaacctatttgagtgtaagacttgccctttctaacaataaatgctccgtgtttaagttc

SEQ ID NO: 8423 - DNA, 661 bp, Homo sapiens
gtgtcgtacgttggcccggaactgggtcgggcaatttccacttactggttccaaatgaatgtgaaaattcaaatgggcttaagtaaaaagggatttattggctccaaacctggaaggggctgaggtatcactaaatccagtgactccggtgatgtatttgtgtatctctccctttctgcaaagggccagtaacccctcagttccctatctactttgcgactataattgcaagcctcattctgtcctgttacagtcgtgcggcaattaggctgagggactggcgcgcccgctcccccgactgtgagcctaggcggcgggtgtcatgcccctccccactcccgggcggaacagagataatcattcaggtcttcgtgagctaaggccaaacaaacaaaaaacacttgctttgatggactgaatactgttattagaagtaaatatggaaaatgaaccagaccatgaaaatgtggaacagagcctctgtgccaagacgagcgaagaagagctgaataagtctttcaatctagaagcttcactttcaaaattctcttacatagatatggacaaggaactggagttcaaaaatgatctgattgatgacaaggagtttgatattcctcaagttgatactcctccaacactggaaagcatactaaatgag

SEQ ID NO: 8424 - DNA, 1171 bp, Homo sapiens
atgtggatgctgggagaagtatgtgagatggaaaagttgtttcatggcatccaagaagtgaatgatcctcaaggtgtagcagaggaatttgtaggagagagggatgattgacatcttcgtgtagccctccatccatcccagttagcatggagggattttagggctaccattggctgggtagtggagtgttgaccaatcacagctcaggggcgtgattgtctcgtcctgggatcgcgagaggtgtatatacagggaggccaggcagcctggagttagtcgaccgttgcgagacgttgagctgcggaagatgagtccaaagccgagagcctcgggacctccggccaaggccaaggaggcaggaaagaggaagtcctcctctcagccgagccccagtgacccgaagaagaagactaccaaggtggccaagaagggaaaagcagttcgtagagggagacgcgggaagaaaggggctgcgacaaagatggcggccgtgacggcacctgaggcggagagcgggccagcggcacccggccccagcgaccagcccagccaggagctccctcagcacgagctgccgccggaggagccagtgagcgaggggacccagcacgaccccctgagtcaggagagcgagctggaggaaccactgagtcaggagagcgaggtggaagaaccactgagtcaggagagccaggtggaggaaccactgagtcaggagagcgaggtggaagaaccactgagtcaggagagccaggtggaggaaccactgagtcaggagagcgaggtggaggaaccactgagtcaggagagcgaggtggaagaaccactgagtcaggagagccaggtggaggaaccactgagtcaggagagcgaggtggaagaaccactgagtcaggagagccaggtggaggaaccactgagtcaggagagcgagatggaagaaccactgagtcaggagagccaggtggaggaaccactgagtcaggagagcgagatggaagaaccactgagtcaggagagcgagatggaagaactaccgagtgtgtagacggccaagtactcccctatctccgagagcagcgactaagttcaggcccagccgccagacctcagagatctcaccagcggggtgcttgccattctgatgataataaaatgaatgtgttgcaaa

SEQ ID NO: 8425 - DNA, 550 bp, Homo sapiens
cgagaggggtatacacagggaggccaggcagcctggagttagtcgaccgttgcgagacgttgagctgcggcagatgagtccaaagccgagagcctcgggacctccggccaaggccaaggagacaggaaagaggaagtcctcctctcagccgagccccagtggcccgaagaagaagactaccaaggtggccgagaagggagaagcagttcgtggagggagacgcgggaagaaaggggctgcgacaaagatggcggccgtgacggcacctgaggcggagagcgggccagcggcacccggccccagcgaccagcccagccaggagctccctcagcacgagctgccgccggaggagccagtgagcgaggggacccagcacgaccccctgagtcaggagagcgagctggaggaaccactgagtaaggggcgcccatctactcccctatctccctgagcagcaactaagtttaggcccagctgccagacctcagagatctcaccagcagggtgcttcccatgttgatgacaataaaatgaatgtgttgcaaaccga

SEQ ID NO: 8426 - DNA, 3466 bp, Homo sapiens
gcacttgagggtgggcgatttcctggggggagtggcttaagccgcttccccaccggccagttggctgtagacggtccatgctcaatggtcctctacagatatgaaactggttctggagtgagacgagctcggctggggacgctacttgagaaggcctttccccacagggtgacttaaatgtcccaggctggaaggtggagcgagaagtggatgcccccagggctctgggtcacactccaggatgacttctcggaaccagctggtgcagaaggtgctgcaggagctgcaggaagcagtggagtgcgaaggcctggagggtctcataggtgcttccttggaggccaagcaggtcctgtcttccttcactctccccacctgccgggagggaggccctggcctccaggtgctggaagtggactcggtggccctgagcctgtatccagaagatgctccacggaacatgctgccgctggtgtgcaagggggagggcagcctgctgttcgaggcggccagcatgctgctgtggggtgacgcaggcctcagcctggagctgcgggcccgcaccgtggtagagatgctgctgcacagacactactacctccagggcatgatcgactccaaagtgatgctgcaggccgtgcgctactccctatgctctgaggagtcccctgagatgaccagcttgccccccgccacgctggaggccatcttcgatgccgacgtcaaggcctcctgtttccccagcagcttctccaacgtgtggcacttgtatgctctcgcctctgtcctccagcggaacatctactccatctaccccatgcgcaacctcaagatccggccctacttcaaccgtgtcatccggccccgccgctgcgaccacgtgccctccacgctgcacatcatgtgggctggccagcccctcaccagccacttcttccgccaccagtactttgcccctgtggtggggctggaagaggtggaggctgaaggtgcccctggcgtggccccagctcttccagccctggccccactctcatcgccggccaagaccctggagctgctcaaccgtgaacctggcctcagctactctcacctctgtgagcgctacagcgtcaccaaaagcaccttctaccgctggcggcggcagtcccaggagcaccggcagaaggttgctgcccgcttctccgccaagcacttcctgcaggacagcttccaccgggggggcgtcgtgccacttcagcagttcctccagcggttcccggagatctcccgctcaacctactatgcctggaagcatgagctgctgggctctggcacctgcccggccttgccccccagggaggtgctgggcatggaggagctagagaagctgccggaggagcaggtggctgaggaggagctggagtgctccgcactggcggtgtcaagccctggaatggtcttaatgcagcgggccaagttgtacctggagcattgcatctccctgaacacactggtaccctatcgctgcttcaaacgcaggttccctggcatctcacggtccacttattataattggcggcgaaaggccctccggaggaaccccagcttcaagccggcaccagccctctctgctgctgggactccccagctagcatctgttggggaaggggctgtaattccttggaagagtgaggcggaagagggggcagggaatgccacaggtgaggaccctcccgcccccggggagctcctgccactaaggatgcccctgtcccgttggcagaggcgtctgcgcagggctgcccgcaggcaggtgctgagtgggcatctccctttctgccgcttccgcctccgctaccccagcctgtcaccttctgccttttgggtctggaagagtcttgctcggggttggcccagaggcctgtccaaacttcaggtgccggtccccaccttgggcaaaggggggcaggaggctgaggagaagcaggagaaggaggctggcagggatgtgacagctgtgatggccccacctgtgggggcttcttcagaagatgtagagggagggccttccagagagggggccctgcaggagggggccacagcccagggccagccccacagtgggcccttgctgagccaacctgtggtggcagcagcgggtggcagggatggccggatgctggtgatggacatgatcgctaccacgaagttcaaggcccaggccaagctgttcttgcagaagcgcttccagtccaagagctttccctcctacaaggagttcagtgccctctttcccctcactgcccgctccacatactacatgtggaagcgagccctctatgacggcctgaccctggtagatggctgacagggaggtacaaaaggggctgggaagaagggggaccagtttggagagggtcagggacctgagctgaccccaggcttggccaggatgtcctttgctctgggtcccacagtgtctaccctaagtccaagggtatatttgtgttattttctggctccaggacagagaatgccagaaatcagccatctggtctcccgtaggaaactgtgggaccagagatatcctctttcgttgtttgctggtcatatttttactgttatgatttagtttttggttttgatttgagtgggttggttggcccccttgctggagttggaagccgtatgtatgtcagggggtttagaggggggttggttagctagagctgctttcagcttttcctggagacaaaaggagtgttatagcatgatcatcggtcccactgggcagaacgttatcttcagtttcttttgggggttggcatcctctttactcagttgtttcccaaaggaacattaggctcgaatatgggggccaggtgtggtggcttatgcctgtaatcctagcgctttgggaggccaaggcaggaggatcacttgaggctaggagttagagaccaccctgggcaatgtagtgagacctcatctcttagaaaaaaaaaaagaaagaaaatcaaatgtagagctgatcagcagcttgtgcctggcatccccaagggagaaggtgccaggtcagcaggagcagcagcagggatgtatagaaagaaccacagctggcctctaaaggatggcactgaggcaccggagatcttgaggcactggagatcactgaggggctggcctgtcccctgcaaggagtgtgggaccaggtggggcaaggctgggagatgcaggctctgtttgcagattatggcccagagtctctgcttgtgggtgcttgatccacctgctgggaccctgcagtcctcggccagcctggctgtcagttggggattccacctttctgctgagcgtcttctcggagctggaggcccatcttcagtgagagatcacaaagcggccaggcaggtgggagactgaatttgccttgttcgagagtaacgtttgaaaaccaaagaaataaagtgatgcagtgcccaca

SEQ ID NO: 8427 - DNA, 521 bp, Homo sapiens
aaaagtaccagagagtggactcggctgacccggcggctacagcgcccccatattttctgggagacttcccttttgacaataggtatccgagagtgtaactactttatggtacgtttcctgaggacagctgctctgtgaagcccactgccccaaaggcacctatcaaagaccctgcaaacaagcagatggcaatccaggttgccaatgacattgcccatcccaggtacctgggctgcctgcttttccctgaagtgggagcctggcttgcaggatgacttctcggaaccagctggtgcagaaggtgctgcaggagctgcaggaagcagtggagtgcgaaggcctggagggtctcataggtgcttccttggaggccaagcaggtcctgtcttccttcactctccccacctgccgggagggaggccctggcctccaggtgctggaagtggactcggtggccctgagcctgtatccagaagatgctccacggaacatgctgccgctggtgtgcaagggggagggca

SEQ ID NO: 8428 - DNA, 3768 bp, Homo sapiens
attcaacaggaggaacccgcgggagaggagccccactcccccagcgccgcagccaccgcagccaccgcagcccgtgcgccccgcgccctcgagcgccatggccaaggaaggcgtggagaaggcggaggagacggagcaaatgatcgagaaggaggcaggcaaggagccggcggagggcggcggcggcgacggctcgcaccgcctcggggacgcccaggagatgcgcgcggtggtgctggctggcttcggggggctcaacaagctgcggctcttcaggaaggccatgcccgagcctcaggacggcgagctcaagatccgcgtcaaagcctgtggattaaacttcattgacttgatggtgcgacaagggaatattgacaaccctcccaagactcccctggtgccaggatttgagtgttctgggattgttgaagctctgggggacagcgtgaaaggatatgagattggagaccgtgtcatggcatttgtcaattacaatgcctgggcagaggtggtctgcacaccagtggagtttgtctacaagatcccggatgacatgagcttctccgaggctgctgcattccccatgaacttcgtcacagcctatgtgatgctgtttgaagttgccaacctccgggaagggatgtctgtgctcgtgcactcagctggtgggggcgtgggtcaagctgtggctcagctgtgttccactgtccccaacgtgactgtctttggaacagcctctactttcaagcatgaagcaatcaaagactctgtgacccacctctttgacagaaatgcagactacgtgcaagaagttaaaagaatctctgctgaaggtgtggacatcgttttggattgcctctgtggggacaacactggaaaaggtctcagtcttctcaaacccctgggaacctacattttatatggctcatccaacatggtaactggagagaccaagagcttcttcagctttgcaaaatcatggtggcaggtggagaaggtgaaccccatcaagctgtatgaggagaacaaagtcatcgcggggttttcccttttaaatctgctcttcaaacaaggccgggcgggcctcattcggggagtggtggaaaaactcatagggctctacaaccagaagaagatcaagcctgtggtggactccttgtgggctctggaggaggtgaaggaggccatgcagcggattcacgaccgagggaacattggcaagttaattctggatgtagaaaagaccccaactccactgatggccaatgacagcacagagaccagtgaagcaggggaagaggaggaggaccacgagggagacagcgagaacaaggagcggatgccctttatccagtaactgaggacccaggtgggagaatgtgaaggatggtttggaagatgaggacccggctgagaaaactcttctgtgccccagtgaacaaatgctgtagtccagtgcgtgtcgtgtttgtctgcagtcagctgagctaaaaagctgttgatcactgttgttttttgaagtgccaatcccatgccatgcagtattatgtccctctcctatctgtgtattacacattcccctctcccctgtatcaaaaccatccatctgtgggttcttcttgacagttctagaacagccttgcaaattaatacaagtcccaggcccaatgcctaagagaccagacgtgggcaaagacaagtttggatggaaaggtgttatcacagagccctgtccagctcctagaattcctcaggccagtgacacttttttgctgctggccacccatgcctctgatgagaacacttgccaatttggccagcagaaagagagtaggccggatgttttcatgagcccacaaatttagaaactctcctagtagtactttttctctctccatttaagagacaactacggtcaaaagtttgagccattctcttctaccccttcagtgtctgaccctttcactggctcttatctgtaaacacagggaggcaggtatggatttttcacagtagacaatgggtcaacagcatgagtttgaggacctgctgtgaagatttctcctccaaaatacatctcatgggcaggattcttcctgctccatatctgtttcaattttaagaaagcaccacatacaagacacattcagaagtcattcctgagcattgctggtgtttgcacacttgccacctgcattaccaattctgtaaatttcaattcctggtggaaagtgaccactttgaccatggatttcccaaagaagagttcctttgcagaccataggtggaaaagtcaatgagcatctccttccttgccaaagcatgtcccaacatgtaacaaactctagggatacaaaaggtttatattcagcatctgatgtcagatgtacagttcctcccctcccatatataaaccccggtgtagaatctgcagcgccctgctcttcggaaaccaaggaacaagccacctgctcacacaccttgttcaacttttcagctcctaaggaaccccacccccatgcaatttgactgtgcttgagaggtgaatacagttaccttcgagaaacagagggagctcctcaccccgtccttccagtccttttggctaaaatgcttaactatcactcacaaacaaatgtggagataccaggagctcatttgattcataccccaactttgtgttctgaaaaacatcagagggattttacattgcccagtttctccaccaacaagccttagggtggacccaaccctttccgcaagtggtaggaacgaatgcatcttagcaattacctgatttccaaagtccttttgtagcaaatgtcacctcattcgtggtctttttacctatcctaagcttatgatgatgagttatgtatgccaaatacttatctgaagagtttctcctcattgtgaatgtgtatgtaaaatatgaagacaagaaagggtgctttcatctgaggaaccaaggggtgagagtatcccaaaggaggacaccagcatcatcttttcttcgtactccaggacccaccaatattccagttctgggtcatttagagagataatggggcgtttattcccctattacctttgctaagtgctatattattggctgtttctcccgtaaccatgctgaaaagggggtcttagggagaactgtcatccaagtggcattcctagtaagttgggtagaaatgacattttccagagctgaaggagtgaagagcccttggccatactagggctctccttcccccggggagtgggaactcagccacattcagaattcacatcgcctttgttatgtccagaggagaggcataaaaaggcactctcccccaccacccctaccaaatctgggtttggtttggttttatttaactagcaaagttaatccagtaatcgcaaattactccagatggttaaagaaaaccctttcagaatacagaacgagaaaactagagtttgaccaataagaccaatttctgccatgaagaaccgggggacgcaagttaattgtttaacgtactctcattttaagcaccttctttcctgtctcttgattgttttttctgaaggaagtgtaaagaatgtctcagtctgccttaaaggaactgtgaaggcttctctgtaatttaagcttgatagaagtgaactgaaacattgtctaatgtctttgtggctttagagcttttgttatattgtgcctataaagcaaattatgtttacataaaaatataaataaagtattcagcatagcaaaacctc

SEQ ID NO: 8429 - DNA, 1874 bp, Homo sapiens
cacctcagcgggaagcggagacgcaagcagctggatctccggtaactgagacatagggtataactgttgtcgcggcggaggaagtgaggacggcgccaagggccttccgggccagtgttggatccctgtagtttgtgaagatggtgttgctaacaatgatcgcccgagtggcggacgggctcccgctggccgcctcgatgcaggaggacgaacagtctggccgggaccttcaacaatatcagagtcaggctaagcaactctttcgaaagttgaatgaacagtcccctaccagatgtaccttggaagcaggagccatgacttttcactacattattgagcagggggtgtgttatttggttttatgtgaagctgccttccctaagaagttggcttttgcctacctagaagatttgcactcagaatttgatgaacagcatggaaagaaggtgcccactgtgtcccgaccctattcctttattgaatttgatactttcattcagaaaaccaagaagctctacattgacagtcgtgctcgaagaaatctaggctccatcaacactgaattgcaagatgtgcagaggatcatggtggccaatattgaagaagtgttacaacgaggagaagcactctcagcattggattcaaaggctaacaatttgtccagtctgtccaagaaataccgccaggatgcgaagtacttgaacatgcgttccacttatgccaaacttgcagcagtagctgtatttttcatcatgttaatagtgtatgtccgattctggtggctgtgaaataatgaatacagtcactggtaagggagaacctagaacccagtaggtgtatattttcaggaaactgagctcacagagatgtgtattagaatccaagtggaacttctgcctctaaagaccttgcaagaaaagagatgccctgaaaatgaaaggttgcacctcatttaatgaagcttaaccctatgtagaaagtctctttcgggggcagaggctttctctgggtgccaagccatatatattagggaatagtagattgttaatttcgttttttccctcccagtgcattttaaaaacagcactggctggggcattctcattctctgatggagccatcaatgagatttaacttagtcaacctgtgctagcaacattctgaaattccttcaaagaaggcagtcctttgggaaggtgtttttttttttttttttttttttgactctaatcaacattccttttgttggtgacatttgtgattttcagtaatctgagtttttgatggccttttaaacaagactccagtatgtgaaggttaattgctgtgctccacagatcttgtctattggcccctgtagaaagttaacctttgttgttttccttttataatttgcttattgcacaattgctttagggtaagtgaattatattaagatgccttgaaattatagcactccttgattaagaagctaaaatgtttctctcatttactccttaaacaaaagacttaaattagtttgggtcattattacttttattttgcagcatttggtttgttattagcgtaagagcaagtataggatatggagaggcccctggcttcatgagaacaaaggcaggcccaggttataattacagctttctcctgccccttctttactttctctaccacagttttctccactgtttgttttcctcttgccacaatttgctaacatttaaaaaattttcctgcacccagtagtttcatatcctgtagacatcctcttaggacattctcaaatttcaaaataaaaaatattcatctatgtagttaattaaagttaaagtttttgcagatcaactactcaaactactaaatacatttacctg

SEQ ID NO: 8430 - DNA, 3725 bp, Homo sapiens
acatttcagagcagtccgggttgtggacgccaggagtttgccaaacacagcaaacactggtgtgtgagcggctgaaggggactctttccactccgatctccctccctcccagcctgttttgatttactaggacttcctcctccgggcgaggcgggggaaggacgccgccgagcgcctggagttgtgcgcgtgtgcgtgtgcgcgtgtgcgagtgtgaagtgcagcgctggagtgcaacatgctgtaatgggaggaaacccagcggcgtcggagcgcccgggaccgccgcggccgttctgagcgcagtggcgccgagcagcccctcccgcagccggtgtgacctgtcccttcaggctccaaccaggaatggagacgccattggatgttttgtccagggcagcatctctggtgcatgctgatgacgaaaaacgcgaagctgctctcaggggagaacccagaatacagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagctaccggaggccaccgagcgctgccaccacctgtgaccccgtggtggaggagcatttccgcaggagcctgggcaagaattacaaggagcccgagccggcacccaactccgtgtccatcacgggctccgtggacgaccactttgccaaagctctgggtgacacgtggctccagatcaaagcggccaaggacggagcatccagcagccctgagtccgcctctcgcaggggccagcccgccagcccctctgcccacatggtcagccacagtcactccccctctgtggtctcctgaagggagcgcctcctccaacaacacgtggatctgcatggtttgcctgagctttgaacagtcagtacttaaaaaaaaaaaaatcatgggggtggggtggggggaagggaagggatggtttatttgcaaaaaccatgttgttgggatttgtgttctgtttttgtacttgcttggtatccgtacaagggggccctcaaacatgatagcaggaactacgcgtggaacatctgtctaatgtagcatccttacttcctgcctcagttaccaaagaaacctctgatgcaggtctgctgccccgacggggccaggactccacagcgctttctcagtcacaagccatgatgaattggtgactcagacgctttgtgctttttcctttgcttcttgagaccggggtgtgtgtggctcagcttccacggcgtgtttggttcggtccatgtgtgtgcgtgtgtatacttgaagagaactgtcgtgtctgatttgcactattggaggaggactaaagttgcctgacaactttatgtgttatgccagaactctgagggcaaactgctgaaaaacaaagggtttaaggatgacatttctgaccatttgtgtgtttgttgttgttactgtttttgttttttttaatgtagacaatacagctttggaaggggaagtctcatacaggttataggtctttctctctctagatttcaggtgcttgcaactggactgcagactctaccaatcacgggcattttatcttctctgaacactgcagtttgttagactagagctgaggttggaggattccatagtgctttaaacgtgatgcatgttttaatggagaaaaaatagctggtttctattaattatatagacagtaaacaaaaaccttaatacttactatcttcttttcagaattagtttatttttgtcagttacagtcctagatatacttactgctggtacagttgtactctaagattggtatttgatattcactttactcacaagtagtgcgggaggccagctcctggcaggccctcgcgatgagcagtgggtcagctgcggtgtgggatgctggagtttggctgcaggctgacatcatttatttttgcatccctgtctgctttgttacaagctcccaggggaggtggggtttgtgtcttccaacttccctacatgcagaaactgctccctttgaactctcttggctgaacagcagattactgacagacaatctgtgatatggtgttttatacgcttcctcgtacgctggggccaaggcagtatacattcctctgactttatactgttattactgcatttattatttgctatattaatagctactaactagaaattagatgaagcaagcatgacagacacagctgtggaggtcacagctgctcctttttggtcaatgagcgtttctatcccctccccctggggtgtgctgtgtcccacctggcccaccagaggctcacgacgatggcacctgaccaggtgacgtgggcgtggtcacctcacctgcaaggctttgtggactctgcacaccgtatgacccccggttttacagtttttagctgttgaattttggaaattggcactgggtgaaaaggtcggaggactggctcttgtagtcacagagtggctgcaggcctttgaaaagtggaggaaagaaaagcccttctccttgccccgcacacatttcactcccactgtactgggcttccaagctttggcattcaggcccctatattttctgtaggaaaaatcgttgagaacacttttctatatgggtgattttgagaccatcgttacgctgtgcgtaaagaatgtacagagaaatttgtaggtattttttgaagaacattaatttgttaatgatatgtagctatttaatttttccctttcctattgtaatcattcattttttttgttgttcggaaaaaaaaagttgatctttttttttgtcgtagatttgtctgtaaaagtgcaggaacagttattctatgagaacactgcatctgcattcatagccacgagtttgttattgctacaggctactgagcgtcgtaacaggaaaaccacccacagctgaccggctcggtggaggacactcctgggacaggtctctttgtcagtgaacaagggcgtcactctgggaggggtcggcggtgctggcggccgggtccctggtgcactgacctatctgggataggcagtaccctggaggggggcctggggcagaggaggcagcagaaaaccaaacatttcactgagaaagccccctccctgctctaagaaggggctccgtgaagttcttcccagagccgcgctgcctgcagtgcgctctgaccttctcttcatgtgtgtaaatctgtaatataccattctctgtggcctgtttttcctggaagaagaaaaaaaaaggtttggcaggccatctttttttgtacttaaaagtagccttaagaacaataataaagtgctcttaaacc

SEQ ID NO: 8431 - DNA, 1424 bp, Homo sapiens
ccgggttgtggacgccaggagtttgccaaacacagcaaacactggtgtgtgagcggctgaaggggactctttccactccgatctccctccctcccagcctgttttgatttactaggacttcctcctccgggcgaggcgggggaaggacgccgccgagcgcctggagttgtgcgcgtgtgcgtgtgcgcgtgtgcgagtgtgaagtgcagcgctggagtgcaacatgctgtaatgggaggaaacccagcggcgtcggagcgcccgggaccgccgcggccgttctgagcgcagtggcgccgagcagcccctcccgcagccggtgtgacctgtcccttcaggctccaaccaggaatggagacgccattggatgttttgtccagggcagcatctctggtgcatgctgatgacgaaaaaccgtcacctgggaacttgttagaaatgcagaatcgtagtcctcgctgcggaactgatgactgagaatacgcattttgacaaaatccctgagtcctgtgcactcaaaagttggagacatccaggtctgcaccatggcgaagctgctctcaggggagaacccagaatacagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagctaccggaggccaccgagcgctgccaccacctgtgaccccgtggtggaggagcatttccgcaggagcctgggcaagaattacaaggagcccgagccggcacccaactccgtgtccatcacgggctccgtggacgaccactttgccaaagctctgggtgacacgtggctccagatcaaagcggccaaggacggagcatccagcagccctgagtccgcctctcgcaggggccagcccgccagcccctctgcccacatggtcagccacagtcactccccctctgtggtctcctgaagggagcgcctcctccaacaacacgtggatctgcatggtttgcctgagctttgaacagtcagtactt

SEQ ID NO: 8432 - DNA, 581 bp, Homo sapiens
agggattcctcgcgctcccgcgctcccgtccgccggcccggtccgcgcgtgcgtgtgcgtgctccaaccaggaatggagacgccattggatgttttgtccagggcagcatctctggtgcatgctgatgacgaaaaacgcgaagctgctctcaggggagaacccagaatacagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcaggtgggcctctgtctgggagggtggcgtgggg

SEQ ID NO: 8433 - DNA, 792 bp, Homo sapiens
gcgcgtgcgtgtgcgtgtgcgtgtttggcgggggcccgtgcgggggctcgggcgcgagcccgcctgtgcgtctgcgcgccctcggggtgcgccccgcgtgcccaggtcccgtccccgcccctgggtcccccgcagggccaggccggccccaggcgggcgcgcccagagccgccgggcggctccaaccaggaatggagacgccattggatgttttgtccagggcagcatctctggtgcatgctgatgacgaaaaacgcgaagctgctctcaggggagaacccagaatacagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagctaccggaggccaccgagcg

SEQ ID NO: 8434 - DNA, 466 bp, Homo sapiens
ggcaggaacacctggcagtttgaatgtgattcctccgatgctcacccccctggcctccacatctagacaaggctccaaccaggaatggagacgccattggatgttttgtccagggcagcatctctggtgcatgctgatgacgaaaaacgcgaagctgctctcaggggagaacccagaatacagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttg

SEQ ID NO: 8435 - DNA, 1377 bp, Homo sapiens
atgccaagcatagccctcatgtcagcgctgccggcttgcagcgggctgtgagaggggccggcgccgctttgtcctaggaaacgggctgcgcgtttctctttttcactcttttccatttccaggaaggacttgtaaggacttctgaaacgctgttttcatactcgatcggggatacagtacatacaccgtctaccagtaagcccttgaagggtttcgtgtgagctcgatttttttgtgcctgatttttttttttttaacttttgcatactttgttttgatagtctgaggctgggcctctgcctttgtgaagttgaagagccaggagctactcagcaacaattgatttttgaaacttaactcttttggggcaaaagcaaagagctggttttctttgctagcccaataaatgctatttatgaagatggacctgttgaactatcagtacttggacaagatgaacaacaatatcggcattctgtgctacgaaggcgaagctgctctcaggggagaacccagaatacagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagctaccggaggccaccgagcgctgccaccacctgtgaccccgtggtggaggagcatttccgcaggagcctgggcaagaattacaaggagcccgagccggcacccaactccgtgtccatcacgggctccgtggacgaccactttgccaaagctctgggtgacacgtggctccagatcaaagcggccaaggacggagcatccagcagccctgagtccgcctctcgcaggggccagcccgccagcccctctgcccacatggtcagccacagtcactccccctctgtggtctcctgaagggagcgcctcctccaacaacacgtggatctgcatggtttgcctgagctttgaacagtcagtacttaaaaaaaaaaaaa

SEQ ID NO: 8436 - DNA, 726 bp, Homo sapiens
gggttgtggacgccaggagtttgccaaacacagcaaacactggctccaaccaggaatggagacgccattggatgttttgtccagggcagcatctctggtgcatgctgatgacgaaaaacgcgaagctgctctcaggggagaacccagaatacagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagctaccggaggccaccgagcgctgccaccacctgtgaccccgtggtggaggagcatttccgcaggagcctgggcaagaattacaaggagcc

SEQ ID NO: 8437 - DNA, 1025 bp, Homo sapiens
agtgcccgcctaggatggggatgaggcccggggcggggccgggtgccgtgcagcctcagcggctctgataggcctggcacggagccactcagagtcctttgggtgttcgcggggatgccgtgggctctctcgggcacagtcctgaccaggagcggaggcgacttccatctcccgggcaggatgcgtgcggttttctgccgtccccgggagcacatgacgcctgggaagcagtggccgggaggtgattcatccgggcgagcggggcctggaaaacaatgtctgtcttgaagctccgggaaccaggaaaatgagctggaaatgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagctaccggaggccaccgagcgctgccaccacctgtgaccccgtggtggaggagcatttccgcaggagcctgggcaagaattacaaggagcccgagccggcacccaactccgtgtccatcacgggctccgtggacgaccactttgccaaagctctgggtgacacgtggctccagatcaaagcggccaaggacggagcatccagcagccctgagtccgcctctcgcaggggccagcccgccagcccctctgcccacatggtcagccacagtcactccccctctgtggtctcctgaagggagcgcctcctccaacaacacgtggatctgcatggtttgcctgagctttgaacagtcagtacttaaaaaaaaaaaaatcatgg

SEQ ID NO: 8438 - DNA, 938 bp, Homo sapiens
atccagttttgtgcctgagactgcttgccaagtttgtgaggcccaaggctttcttgtgggaggacgctgggctgtcttcatgctctttggcaatgattaaagtgaggaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagctaccggaggccaccgagcgctgccaccacctgtgaccccgtggtggaggagcatttccgcaggagcctgggcaagaattacaaggagcccgagccggcacccaactccgtgtccatcacgggctccgtggacgaccactttgccaaagctctgggtgacacgtggctccagatcaaagcggccaaggacggagcatccagcagccctgagtccgcctctcgcaggggccagcccgccagcccctctgcccacatggtcagccacagtcactccccctctgtggtctcctgaagggagcgcctcctccaacaacacgtggatctgcatggtttgcctgagctttgaacagtcagtacttaaaaaaaaaaaaatcatgggggtggggtggggggaagggaagggatggtttatttgcaaaaaccatgttgttgggatttgtgttctgtttttgtacttgcttggtatccgtacaagggggccctcaaacatgatagcaggaactac

SEQ ID NO: 8439 - DNA, 1044 bp, Homo sapiens
tgcaggacctcccagccctgaagacaaacatcagtgacagacatcagtggcagaatggcctcccggtatgtggcagtgggaatgatcttatcacagaccgtggtgggagtcctggggagcttctctgttcttctccattatctctccttttactgcactgggtgcaggttaaggtccacagatttgattgttaagcacctgattgtagccaacttcttagctctccgctgtaaaggagtcccccagacaatggcagcttttggggttagatattttctcaatgctcttgggtgcaaacttgttttctatctccatagagtgggcaggggagtgtccattggcaccacctgcctcttgagtgtcttccaggtgatcacggtcagctccaggaaatccaggtgggcaaaacttaaagagaaagcccccaagcatgttggcttttctgttctcctgtgctggatcgtgtgcatgttggtaaacatcatctttcccatgtatgtgactggcaaatggaactacacaaacatcacagtgaacgaggatttgggatactgttctgggggaggcaacaacaaaatcgcacagacactgcgtgcaatgttgttatcattccctgatgtgttgtgtctggggctcatgctctgggtcagcagctccatggtttgcatactgcacaggcacaagcagcgggtccagcacattgataggagcaatctctcccccagagcctccccagagaacagagctacgcagagcatcctcatcctggtgagcacctttgtgtcttcttacactctctcctgccttttccaagtttgtatggctcttttggataatcccaatagtttactggtgaacacttcagccttaatgagtgtatgtttcccaactctcagcccctttgttctcatgagctgtgaccccagtgtatacaggttttgttttgcctggaaaagatgacaagatctcctaacctcatcataaacatgtacattgtatatatttgctcatggttcaattgatgacttactcttctgtgccgca

SEQ ID NO: 8440 - DNA, 2875 bp, Homo sapiens
ggccgatgccgctttaaaaaacgcgaggggctctatgcacctccctggcggtagttcctccgacctcagccgggtcgggtcgtgccgccctctcccaggagagacaaacaggtgtcccacgtggcagccgcgccccgggcgcccctcctgtgatcccgtagcgccccctggcccgagccgcgcccgggtctgtgagtagagccgcccgggcaccgagcgctggtcgccgctctccttccgttatatcaacatgccccctttcctgttgctggaagccgtctgtgttttcctgttttccagagtgcccccatctctccctctccaggaagtccatgtaagcaaagaaaccatcgggaagatttcagctgccagcaaaatgatgtggtgctcggctgcagtggacatcatgtttctgttagatgggtctaacagcgtcgggaaagggagctttgaaaggtccaagcactttgccatcacagtctgtgacggtctggacatcagccccgagagggtcagagtgggagcattccagttcagttccactcctcatctggaattccccttggattcattttcaacccaacaggaagtgaaggcaagaatcaagaggatggttttcaaaggagggcgcacggagacggaacttgctctgaaataccttctgcacagagggttgcctggaggcagaaatgcttctgtgccccagatcctcatcatcgtcactgatgggaagtcccagggggatgtggcactgccatccaagcagctgaaggaaaggggtgtcactgtgtttgctgtgggggtcaggtttcccaggtgggaggagctgcatgcactggccagcgagcctagagggcagcacgtgctgttggctgagcaggtggaggatgccaccaacggcctcttcagcaccctcagcagctcggccatctgctccagcgccacgccagactgcagggtcgaggctcacccctgtgagcacaggacgctggagatggtccgggagttcgctggcaatgccccatgctggagaggatcgcggcggacccttgcggtgctggctgcacactgtcccttctacagctggaagagagtgttcctaacccaccctgccacctgctacaggaccacctgcccaggcccctgtgactcgcagccctgccagaatggaggcacatgtgttccagaaggactggacggctaccagtgcctctgcccgctggcctttggaggggaggctaactgtgccctgaagctgagcctggaatgcagggtcgacctcctcttcctgctggacagctctgcgggcaccactctggacggcttcctgcgggccaaagtcttcgtgaagcggtttgtgcgggccgtgctgagcgaggactctcgggcccgagtgggtgtggccacatacagcagggagctgctggtggcggtgcctgtgggggagtaccaggatgtgcctgacctggtctggagcctcgatggcattcccttccgtggtggccccaccctgacgggcagtgccttgcggcaggcggcagagcgtggcttcgggagcgccaccaggacaggccaggaccggccacgtagagtggtggttttgctcactgagtcacactccgaggatgaggttgcgggcccagcgcgtcacgcaagggcgcgagagctgctcctgctgggtgtaggcagtgaggccgtgcgggcagagctggaggagatcacaggcagcccaaagcatgtgatggtctactcggatcctcaggatctgttcaaccaaatccctgagctgcaggggaagctgtgcagccggcagcggccagggtgccggacacaagccctggacctcgtcttcatgttggacacctctgcctcagtagggcccgagaattttgctcagatgcagagctttgtgagaagctgtgccctccagtttgaggtgaaccctgacgtgacacaggtcggcctggtggtgtatggcagccaggtgcagactgccttcgggctggacaccaaacccacccgggctgcgatgctgcgggccattagccaggccccctacctaggtggggtgggctcagccggcaccgccctgctgcacatctatgacaaagtgatgaccgtccagaggggtgcccggcctggtgtccccaaagctgtggtggtgctcacaggcgggagaggcgcagaggatgcagccgttcctgcccagaagctgaggaacaatggcatctctgtcttggtcgtgggcgtggggcctgtcctaagtgagggtctgcggaggcttgcaggtccccgggattccctgatccacgtggcagcttacgccgacctgcggtaccaccaggacgtgctcattgagtggctgtgtggaggtgagtgggggaatccacaccctcagggctgcccccatggcaggccctcagcctgagccttcacatacatcatgacgaggatggcagctcttcccagctactgagcacttgcttcccaagtgccaggttctgtgctaaaccccatgctcacataaaatcctacagtaggcataaccatcctatttgacatttaaggtacagaaagtttaactaacatagataactccccccaaacttgagaatttatgcattccctttaaacagaacacacttttagaatatccacaagcttcctaagggtctaaagatcccacattcacactgacttgggcagtgacagagcccagagcaaacagggccaggccagcccaaatccagtgacctcctcttcaccttcttaaaagagacaggagaatcacttgaacccgggaggtggaggttgtggtgagccaagatcgcgccattgtactccagcctgggcaacaagagcaagattctgcctc

SEQ ID NO: 8441 - DNA, 1848 bp, Homo sapiens
atggccacgaaaggcatgaggttgaaatccacaaaagaggtgttccctctggcacatgtgtgcaacgacacaaataagatgacattaattaacccccaaggagccaaactcaatatctacaagcgaaaagtggaacaggcaattcaatcctatgaaaagcgcttgaataaaattgtttggcgagcattatctcaagaggaaaaagaaaagttagatgcaaacaaaccaatacagtacttggaaaacaaaacagttttaaaccaggctttagaacggttgaattggcccatttcactgaaagagctgtcgatgctggaaagtgaaatcctagctgggaaaatgtacatccagcaggccatggaactccaggaggctgccaagaagaattatgcaaacaaggccccgggagagcaacagaaattgcaaggaaatccaacaaagaaaaccaaatcaaaaagaccagatcccctcaaaggacagaaggttattgcaagatgtgatgaaaatggcttttattttccaggggttgtgaagaagtgtgtgagccgcacccaagcactggtgggcttcagttacggagacaccaaggtcgtgtccacctccttcatcacgcctgtggggggcgccatgccctgcccgctgctccaggttggagattatgtgtttgccaaaattgtgatacccaaaggatttgacttctatgtccctgccattgtcatagcacttcccaataagcatgtggccacagaaaaattctacacagttttgaagtgtaacaaccggagagaattttgccctcggagtgcacttattaagatcagccaaaacaagtatgcgctctcttgctctcatataaagtcacccccaattcctgaggatccagaagtagaggatgtggaggcgaggaactctgctttcctcttctggccactgaaagaagcggacacgcaggattccagagagccaagacgagagaagcccaggaggaaaaagaggcccgccaagcagccactccagcaggcggcgccctcggactcggacggctcctcccacggcatcagctcccatgggtcctgccaggggacacaccccgagcccaggacagcccacctccacttccccgcggccgggcgtctaggactcagcagccacgccatcattgccacacctccacctcgagcagccctgccctgtactctccaagccacccacagcagcaaagggctgaggagcgtccctgagacactttaaggccgtctggtggcagctatgtttaagagaccagcgtccttccaggctgttcagacctcagcgttgacactgaaactggcccctccgcggaggtaaggccgccctccgcgccgcctatgcctgccctgtctgtagcaaagactcctctcccctccatccctgctgcctcccctacccgtttgacgacttggttctggctttttctgactgttctttatcctgttttccccctgcactcacaaaattgtattccatcttctggtagacgccccacccccagaagttttaacctgaaggatgactgtcacaggactttcaaattgtttagcagtcagcatagtcaggatccaagcccgcaatcttgttttaaattaattatcacatctaaattagagaatttgtcacccaatattaggactgaaattcagactcggtaacttgtctgagatctgcaagactgaacatcccctactgtatagtttcctgacattttcatttagcctttcctaattatttttgtctatagtctgttgtaggtaactctaattgagcccgaaaccagaataaaaactcttacattggaaacatttcaaaacc

SEQ ID NO: 8442 - DNA, 2139 bp, Homo sapiens
ggagacgccgtcgtcaacagaccgcgctcggaaccagaggcgcgggtcacagagacctagaacagctggaatccttcgcccccggcgcgcagccttcgcccgccggaatcgctgccttatccaccagcgggatgcttacctcgcccgccctctcgggtcaggcgggcccgggaggatgggagggtggctgctgagcgggagccgccacgtcttccacccgacatattgcctagagtttgctgtgacttagatcttgattcagagatggagaaatcaggcccatcttctaccatctctgagcagcagctgcagaggcaagagggatggattaacaccaaaacagacttggctgagcagagtctcatttcatctgagaaatggcttcaactgcatgggcttaagagcaacaaattgaccttgaaacagattttgtcacagatcggattcccacattgtgaagattatgtggcgtctctggggagacctgtggcttctcggtatgctgatggtctgtttccacagctctacagagcagaagatggcagagtatacaatctgacagctaaatcagaactgatttatcagtttgtggaacatttaacacaagctgtggagagctacaagcagcgaatggactggctcaccagcaagagccggcagatttttggtgtcatcttggaacagtgcgtcaccatagtgctggattttggcggcattctggagggggagcttgatctgtgccgagaggctctaacaatggttctccaggagcaggtggctcacataaccgagttcaatatcatacgggtttctcaagagcctgtgaagtggcaggaaaatgctactcctgtgaccgaacagtccatagctactgccatcagttgggttgagaaactgacggttgagctgactgtgagcgaggctggccgcctggatgctctgctggaagccgggagagacaagactattgaatccatttactactttgtggtgggggatgttcctgaagaatccaaggagcttctcctccagagggccttggagatcccgtgtccagtctacacagtgtccttcaacgccagaggagaaggcactatagcttttctaaaggatctgagtgccaagacccacagcagattccacgcatttgccgagagaacagagtgtgtagaatttcctgcattctccacaaaggatggtgacaatgtgatgacttggaattcaaggaaactgaaaggaaaactccctccaggagctggagtcagagaggacgtgtttctcgtttggcaagagatggaggaagcctgcagcacgctggcccagatccagaggctggtggccgagcctcccaagcccgacgtggccactgtggactgcgagtcagaaacaacctctgttgagattgcatcgaatccagaagacacctgggactctaagacatggctgcagaaatatggcttgaaggcccagaagctatccttgtatgatgtgcttgccgactgctctttccgccacgctgatggggttgtggatataaaagccaaaccggagaatgagtccgtgcagaccagtgcggagacgaacaagaagacagtccatgcaaaatattgcagcaggtttgtccatgctccctggaaggatgggagcttggtccacgtcaacattaccaaagagaagtgcaagtggtacagtgagagaatccacacagccctggcccggatccgaaggaggattaaatggctacaggatgggagtcaaagcctctttggaagattgcataatgattgcatctacattctcattgacacgtctcactcaatgaagagcaaactggacttggtgaaggacaagatcattcagttcatacaggaacagctgaaatataaaagtaagtttaactttgtgaagtttgatggtcaagcagttgcttggcgggaacaacttgctgaagtcaatgaagataatttggaacaggctcagtcctggattagagacataaagattggaagctccacaaacaccctgagtgccctgaaaactgcttttgctgataaagaaacacaggcaatctaccttctgaccgatgggagacctgatcagggaacatcatctcatttactcctcacagcagccgtttaa

SEQ ID NO: 8443 - DNA, 1927 bp, Homo sapiens
ggaatcgctgccttatccaccagcgggatgcttacctcgcccgccctctcgggtcaggcgggcccgggaggatgggagggtggctgctgagcgggagccgccacgtcttccacccgacatattgcctagagtttgctgtgacttagatcttgattcagagatggagaaatcaggcccatcttctaccatctctgagcagcagctgcagaggcaagagggatggattaacaccaaaacagacttggctgagcagagtctcatttcatctgagaaatggcttcaactgcatgggcttaagagcaacaaattgaccttgaaacagattttgtcacagatcggattcccacattgtgaagattatgtggcgtctctggggagacctgtggcttctcggtatgctgatggtctgtttccacagctctacagagcagaagatggcagagtatacaatggtttctcaagagcctgtgaagtggcaggaaaatgctactcctgtgaccgaacagtccatagctactgccatcagttgggttgagaaactgacggttgagctgactgtgagcgaggctggccgcctggatgctctgctggaagccgggagagacaagactattgaatccatttactactttgtggtgggggatgttcctgaagaatccaaggagcttctcctccagagggccttggagatcccgtgtccagtctacacagtgtccttcaacgccagaggagaaggcactatagcttttctaaaggatctgagtgccaagacccacagcagattccacgcatttgccgagagaacagagtgtgtagaatttcctgcattctccacaaaggatggtgacaatgtgatgacttggaattcaaggaaactgaaaggaaaactccctccaggagctggagtcagagaggacgtgtttctcgtttggcaagagatggaggaagcctgcagcacgctggcccagatccagaggctggtggccgagcctcccaagcccgacgtggccactgtggactgcgagtcagaaacaacctctgttgagattgcatcgaatccagaagacacctgggactctaagacatggctgcagaaatatggcttgaaggcccagaagctatccttgtatgatgtgcttgccgactgctctttccgccacgctgatggggttgtggatataaaagccaaaccggagaatgagtccgtgcagaccagtgcggagacgaacaagaagacagtccatgcaaaatattgcagcaggtttgtccatgctccctggaaggatgggagcttggtccacgtcaacattaccaaagagaagtgcaagtggtacagtgagagaatccacacagccctggcccggatccgaaggaggattaaatggctacaggatgggagtcaaagcctctttggaagattgcataatgattgcatctacattctcattgacacgtctcactcaatgaagagcaaactggacttggtgaaggacaagatcattcagttcatacaggaacagctgaaatataaaagtaagtttaactttgtgaagtttgatggtcaagcagttgcttggcgggaacaacttgctgaagtcaatgaagataatttggaacaggctcagtcctggattagagacataaagattggaagctccacaaacaccctgagtgccctgaaaactgcttttgctgataaagaaacacaggcaatctaccttctgaccgatgggagacctgatcagcagccgtttaaggagggagtatcagttctgagccacagatgaggaaactcacattagacaggacatgccctaggccattcagatgggcagtgctggatgagcttcaagcccaagtctctcgctctggagctgtttccttcattccatacagctgaagacagcatgagtgggagagactgtca

SEQ ID NO: 8444 - DNA, 4454 bp, Homo sapiens
aacagctggaatccttcgcccccggcgcgcagccttcgcccgccggaatcgctgccttatccaccagcgggatgcttacctcgcccgccctctcgggtcaggcgggcccgggaggatgggagggtggctgctgagcgggagccgccacgtcttccacccgacatattgcctagagtttgctgtgacttagatcttgattcagagatggagaaatcaggcccatcttctaccatctctgagcagcagctgcagaggcaagagggatggattaacaccaaaacagacttggctgagcagagtctcatttcatctgagaaatggcttcaactgcatgggcttaagagcaacaaattgaccttgaaacagattttgtcacagatcggattcccacattgtgaagattatgtggcgtctctggggagacctgtggcttctcggtatgctgatggtctgtttccacagctctacagagcagaagatggcagagtatacaatctgacagctaaatcagaactgatttatcagtttgtggaacatttaacacaagctgtggagagctacaagcagcgaatggactggctcaccagcaagagccggcagatttttggtgtcatcttggaacagtgcgtcaccatagtgctggattttggcggcattctggagggggagcttgatctgtgccgagaggctctaacaatggttctccaggagcaggtggctcacataaccgagttcaatatcatacgggtttctcaagagcctgtgaagtggcaggaaaatgctactcctgtgaccgaacagtccatagctactgccatcagttgggttgagaaactgacggttgagctgactgtgagcgaggctggccgcctggatgctctgctggaagccgggagagacaagactattgaatccatttactactttgtggtgggggatgttcctgaagaatccaaggagcttctcctccagagggccttggagatcccgtgtccagtctacacagtgtccttcaacgccagaggagaaggcactatagcttttctaaaggatctgagtgccaagacccacagcagattccacgcatttgccgagagaacagagtgtgtagaatttcctgcattctccacaaaggatggtgacaatgtgatgacttggaattcaaggaaactgaaaggaaaactccctccaggagctggagtcagagaggacgtgtttctcgtttggcaagagatggaggaagcctgcagcacgctggcccagatccagaggctggtggccgagcctcccaagcccgacgtggccactgtggactgcgagtcagaaacaacctctgttgagattgcatcgaatccagaagacacctgggactctaagacatggctgcagaaatatggcttgaaggcccagaagctatccttgtatgatgtgcttgccgactgctctttccgccacgctgatggggttgtggatataaaagccaaaccggagaatgagtccgtgcagaccagtgcggagacgaacaagaagacagtccatgcaaaatattgcagcaggtttgtccatgctccctggaaggatgggagcttggtccacgtcaacattaccaaagagaagtgcaagtggtacagtgagagaatccacacagccctggcccggatccgaaggaggattaaatggctacaggatgggagtcaaagcctctttggaagattgcataatgattgcatctacattctcattgacacgtctcactcaatgaagagcaaactggacttggtgaaggacaagatcattcagttcatacaggaacagctgaaatataaaagtaagtttaactttgtgaagtttgatggtcaagcagttgcttggcgggaacaacttgctgaagtcaatgaagataatttggaacaggctcagtcctggattagagacataaagattggaagctccacaaacaccctgagtgccctgaaaactgcttttgctgataaagaaacacaggcaatctaccttctgaccgatgggagacctgatcagccacctgaaacagttatagaccaggtcaaacgttttcaggaaattcctatttataccatctccttcaattacaatgatgagattgcaaacaggtttttgaaagaggttgctgctttgactggaggagagttccatttttataattttggttgcaaggatcccactcccccagaggctgttcagaatgaagatctgactcttttagttaaggaaatggaacagggtcacagtgatctggagaagatgcaagacctttattctgagtccttgatcatggactggtggtacaatgcagaaaaggatggagacagcaagcatcaaaaggaaatctgttctatgatttcaaccccagaaaagtgtgcaaagcctcaatctgatgtcgattcaacacaaacttcatctctgaatatgttgaagggaccatggggcctttcagatcaaaaggttcagaaaaagaaagtccttcacgcagaatcaaccaaaaccagcctgctcagaagccagatgtcctccctcaggagctcagcttgcagtgaaaggaaggatggcctctccaatgccagcagccggaggactgctctaagtgacaaagaaatgagcatcttgctggctgaggagtggctggatgacaaatcgtcagaaaaggtgacgcgagaaggaagccaggtttatgaccacgattcttcagatgtgtcttcagaaaactggctgaagacctatggcttggtcgccaagaaactcaccctcatggatgccttgtcagtggcagcagtcccgcacagctccacctatgttcccgtcctggacaagcatgtcgtgtctaaggtctttgatgaggtgttccctctggcacatgtgtgcaacgacacaaataagatgacattaattaacccccaaggagccaaactcaatatctacaagcgaaaagtggaacaggcaattcaatcctatgaaaagcgcttgaataaaattgtttggcgagcattatctcaagaggaaaaagaaaagttagatgcaaacaaaccaatacagtacttggaaaacaaaacagttttaaaccaggctttagaacggttgaattggcccatttcactgaaagagctgtcgatgctggaaagtgaaatcctagctgggaaaatgtacatccagcaggccatggaactccaggaggctgccaagaagaattatgcaaacaaggccccgggagagcaacagaaattgcaaggaaatccaacaaagaaaaccaaatcaaaaagaccagatcccctcaaaggacagaaggttattgcaagatgtgatgaaaatggcttttattttccaggggttgtgaagaagtgtgtgagccgcacccaagcactggtgggcttcagttacggagacaccaaggtcgtgtccacctccttcatcacgcctgtggggggcgccatgccctgcccgctgctccaggttggagattatgtgtttgccaaaattgtgatacccaaaggatttgacttctatgtccctgccattgtcatagcacttcccaataagcatgtggccacagaaaaattctacacagttttgaagtgtaacaaccggagagaattttgccctcggagtgcacttattaagatcagccaaaacaagtatgcgctctcttgctctcatataaagtcacccccaattcctgaggatccagaagtagaggatgtggaggcgaggaactctgctttcctcttctggccactgaaagaagcggacacgcaggattccagagagccaagacgagagaagcccaggaggaaaaagaggcccgccaagcagccactccagcaggcggcgccctcggactcggacggctcctcccacggcatcagctcccatgggtcctgccaggggacacaccccgagcccaggacagcccacctccacttccccgcggccgggcgtctaggactcagcagccacgccatcattgccacacctccacctcgagcagccctgccctgtactctccaagccacccacagcagcaaagggctgaggagcgtccctgagacactttaaggccgtctggtggcagctatgtttaagagaccagcgtccttccaggctgttcagacctcagcgttgacactgaaactggcccctccgcggaggtaaggccgccctccgcgccgcctatgcctgccctgtctgtagcaaagactcctctcccctccatccctgctgcctcccctacccgtttgacgacttggttctggctttttctgactgttctttatcctgttttccccctgcactcacaaaattgtattccatcttctggtagacgccccacccccagaagttttaacctgaaggatgactgtcacaggactttcaaattgtttagcagtcagcatagtcaggatccaagcccgcaatcttgt

SEQ ID NO: 8445 - DNA, 4120 bp, Homo sapiens
gtgagactctcgcgctggcctctggagcgcggggtgggcgtcccgtcaccctgcgcccagcttccccggcccgttcccgcagggccggcctcccggcgccatgcccggcctgtactgcccctccagctggacgccgctgccgctcacggactcctgggtccgggcctgcgccaacggcccctgcctcagcgtgcgggcccggctcacctaccgcaacccgcagccgcagccggtggacggcgtgttcgtgtacccgctggccgaggccgaggtggtgtccggcttcgaggccgaggccgccggacggcgcgtctccttccagctgcagagccggcgccgctcgcaggccgcctgctgccgcgctctgggcccggggctggggaccccgacgccccgccgctgcgcgcagggtcatcttgtcttggatctggcccaggcccggtccacgttggtgctgcccacaggcattatcgccgcggctggcaccatgacggtgaccctgcacagcagccgggagctgccctcaaggcctgacggggtgctgcatgtggccctgcccactgtgctcaccccgctggccccgccaggcccgccggggccccccaggcctccggggctctgtgacgacagccccaccagctgcttcggggtgggcagccttcaggaggaagggctggcctgggaggagctggctgcccctcgggacgtgttctcaggccctgcccgctgccctgccccatataccttctccttcgagatgctggtgactgggccatgcctgcttgcaggcctggagagcccctctcatgctctgcgggcagatgccccccctcatgccagctctgcagccaccatctgtgtcacactggcagagggccaccactgtgaccgggccttggagatcctgctgcaccccagtgagccccatcagccacacctgatgctggagggcggcagcctgagctcagcagaatatgaggcccgggtgagggcccgccgagattttcagaggctacagcgaagggacagtgatggggaccggcaggtgtggttcctgcagcgacgcttccacaaggacatcctgctgaaccccgtgctggcgctgagcttctgcccagacctgagctccaagcccggacacctggggacagctactcgggagctactcttccttttggatagcagcagcgtggcacacaaggatgccattgttttggctgtgaagtccctcccgccccagacgcttatcaacctggccgtgtttgggacgttggtgcagccactcttcccagagagccggccttgcagtgatgatgctgtgcagctgatctgcgagagcattgagaccctgcaggttccgagtgggcccccagacgtgctggctgctctggactgggccgtggggcagccccagcacagggcctaccctcggcagctgttcctgctcactgctgcctcacccatggccgccactacccaccgaaccctggagctcatgaggtggcacagggggacagccagatgcttctcctttgggctggggcccacctgccaccagctgctccagggtttatctgccctcagcagaggccaggcctacttcctgaggcctgggcagaggctgcagcccatgctggtacaggctctgcggaaggcactggagcctgctttgagtgacatctctgtggactggtttgtgcccgacactgtggaggcactgctgaccccccgggagatcccagcactctaccctggggaccagctgctcggttactgctcactcttcagggtggatggcttccggtcccgcccaccagggggccaagagcctggctggcagagctcgggtgggtccgtgtttccatccccagaagaggccccgtctgctgccagccctggcactgagcccactggcacctcagagccactgggaacaggcactgtctcagcagaactgtccagcccatgggctgccagggactcggagcagagtactgatgctctgacagacccagtcacggatcctggacccaacccctctgacacagccatatggcgccgcatctttcagtcctcgtacattcgggagcagtatgtgctcacccactgctctgccagccccgagccaggcccaggctccacaggcagcagtgagtccccaggctcacagggccctggctcccccgaaggtagtgctcccttggagcccccttctcagcagggctgccgcagtctggcctggggagaacctgcaggctcccgctcctgtcccctgcctgcacccacaccagctccattcaaggtgggggccttgagtactgaggtgctgggccgtcagcacagagcggctctggctggccgaagcctctcatcccctccaggccgggcaaaccaagtccccggccgaccccggaaaccctctttgggtgcaatactagatggcccaagtcctgagccaggccaacagttgggacaaggcctggatgactcaggaaacctgctctccccagcccctatggactgggacatgctgatggaaccacccttcttattcacggctgtgcctcctagtggggagttggcccctccagcagtgcctccccaggctccacgctgccatgtggtgatccggggcctgtgtggggagcagcccatgtgctgggaggtgggtgttgggctggagacactgtggggacctggagatggctcacagcctccctcacctcctgtaagagaagctgcttgggaccaagcactccatcggctgacagcagcctctgtggtccgggacaatgagcagctggccctccgaggaggggcagagaccacagctgaccggggccatgcccggaggtgctggcttcgagcccttcagacaagtaaggtcagctctgccccctcctgcttcacttgccctgtagctgtggatgctactactagggaggtcctgcctggggccctgcaggtgtgcagctcagagcccgctgagcccccaggaacccctcctgcctctcacagccatctagatgcagctcctctgcccactgttgtctactctaaaggacttcagagaggctctccagcaggcgcctgggactcggaccaaaatggcaactccaagcgtgctttgggggaccctgccactcccacggaaggtcctcgccgcccacctccccgtcctccctgtcggctcagcatgggccgccgtcacaaactctgtagccctgacccgggccaggccaacaacagtgaaggcagcgaccatgactacctgcccttggtgcggctgcaggaggcaccaggctccttccgcctggacgcgcccttctgcgccgctgtgcgcatctcgcaggagcgcctctgccgtgcctcgccctttgccgtgcaccgcgccagcctcagccccacctcggcctcattgccctgggcacttctgggccctggtgttggccagggtgacagtgccacggcctcctgcagcccgtcccccagctcgggctctgaggggccaggccaggtggacagtgggcggggctcagacaccgaggcctccgagggggcggaagggctgggcggcaccgacctgcggggccggacctgggccactgccgtagcactcgcctggctggagcaccgatgcgccgctgccttcgacgagtgggaactgacagcggccaaggctgattgctggctgcgggcccagcacttgcctgacggccttgacctggccgccctcaaggccgcagcccgagggctcttcctgctactgcgccactgggaccaaaacctgcagctacacctgctgtgctacagcccagcgaacgtgtgaaggctgccccctgctgcttgggctggcgccccacccaacacactcaagtcactgccgcccagggctggcctcttggtgctgggaaagtgtaggctggtgccagcctgtcccccactgcttcttactccctccctagagccctcttgcccccacaaaaagtgcctgcctgtgctctctccctctcctcccaccccactcacactcccctccatcctctgagctccctgcaacacagtggaagggtagagagccacagtccccaaatcctatgcaataaagtgcctcttagga

SEQ ID NO: 8446 - DNA, 2881 bp, Homo sapiens
cctggcgtgggctgctgcctgtggctttgggcaggcaggagcgaaagggccaggggttgcctgtcctcccccaccctgttgaggccttcctccccctctgctgagcctcggttaattataactctgacctaagtgccctgtgacgtcaagcccgggccagccctgcccaggagacccagcaaccaggtccatgtctcagccatgctccccacggaggtcccccaatcccacccgggcccctcagcgttgcttctgctgcagctgttgctgccccccacatctgccttcttccccaacatctggagcctgctggctgcccctggctccatcacccaccaagacctaactgaggaggcagcgctcaacgtcaccctgcagctcttcctggagcagccacccccaggccgcccccctcttcgtcttgaggacttcctgggtcgaacactccttgctgatgacctctttgccgcctactttggacctggttcttctcggcggttccgagcagccttaggtgaggtgtctcgtgccaatgcagcccaggacttcctgccaacttccaggaatgaccccgacctgcactttgatgctgagcgactgggtcagggacgcgcgcgcctggtaggggctctgcgggagaccgtggtggcagccagggcccttgaccacaccctggctcgccagcgcctcggggctgcacttcatgccctgcaggatttctacagtcatagcaactgggtggagctgggcgagcagcagccacaccctcacctcctctggccaaggcaggagctccagaacctggcacaagtggccgatcctacctgctccgattgcgaggagttgagctgccccaggaattggctgggcttcacactcctcacctctggctactttggaactcatcccccgaaacctccagggaaatgtagccacgggggccattttgaccggagcagctcccagccaccgaggggaggcatcaacaaggacagcacatccccaggcttctcccctcaccacatgctgcacctccaggctgcaaaactggcccttctagcctccatccaggccttcagccttctgcgaagccgcctgggagacagggatttctccaggctgctggacatcaccccagcctccagcctgagctttgtcctggacaccacgggcagcatgggtgaggagatcaacgctgccaaaatccaggctcgccaccttgtggagcagcggagaggcagccccatggagcctgtccactatgtcctggtgccttttcatgacccagggttcggccctgtctttacaaccagtgaccctgacagcttctggcaacagcttaatgagatccatgccttggggggtggagacgagcctgagatgtgcctgtcagccctgcagctggccctgctgcacacacctccactctcagatatctttgtcttcacggatgcctcccccaaggatgcctttctcaccaaccaggtggaatccctgactcaggagcggcgctgccgggtaacattcctggtgactgaagatacatcaagggttcagggtcgagctcggcgtgagatcttgtcccctctgcgttttgagccatacaaagcagtggccctggcctcaggaggagaggtgatcttcaccaaagaccagcacattcgagacgtggcagccattgttggggagagcatggctgccctggtgactcttcccctggaccctcctgttgtggtgcctgggcagccacttgtgttcagcgtggatgggctgctccagaagatcacagtccggatccacggagacatcagcagcttctggatcaagaaccctgcaggggtctcccagggccaggaggaaggcgggggtcctctaggtcacactcgccgctttgggcagttctggatggtgaccatggatgaccctccacagacaggaacctgggagatccaggtcacagctgaggacacccctggggtgagagtgcaagcccagacctccctggacttcctcttccactttgggatccccatggaggatggaccccaccctggcctctaccccctgactcagccagttgcaggtcttcagacccagctgctggtagaagtgacagggttgggttccagagccaatcctggggatcctcagccgcatttctcccacgtcatccttcgaggggtcccagagggtgccgaactaggccaggtgcccttggagcccgtgggacctccggagcgaggtctcctcgcagcctcgctgtcgcccacgctgctgtcaacccctagacccttctccctggagctgattggccaggacgcagcggggcggcgcctgcacagggctgcccctcagcctagcactgtagtccctgtccttctggagcttagtggcccctcgggtttcttggccccgggcagcaaagtcccgctcagtctccgcatcgccagcttctcgggccctcaggatcttgaccttaggactttcgtcaaccccagcttctccctcacctccaacctctccagggctcacctggaactgaatgagtcggcctggggccgcctgtggctggaggtcccagattcagcggccccggattccgtggtgatggtgactgtgactgcagggggacgagaagccaacccagtacccccgactcatgctttcctccggctcctggtatcggccccagccccgcaggaccggcacaccacccctaccggctcatctgacccgatcctcaccacggccacccctgccttttcccccttcacattggtggctcaaggcagggctggggcagggctggctgcgggcagcccctggtggggcacagttggaggggtgctgcttctgctaggcctggcctcctggtgacaca

SEQ ID NO: 8447 - DNA, 2305 bp, Homo sapiens
ctcactcacctccgcactgcagccaagggaggcccgccctggcgtgggctgctgcctgtggctttgggcaggcaggagcgaaagggccaggggttgcctgtcctcccccaccctgttgaggccttcctccccctctgctgagcctcggttaattataactctgacctaagtgccctgtgacgtcaagcccgggccagccctgcccaggagacccagcaaccaggtccatgtctcagccatgctccccacggaggtcccccaatcccacccgggcccctcagcgttgcttctgctgcagctgttgctgccccccacatctgccttcttccccaacatctggagcctgctggctgcccctggctccatcacccaccaagacctaactgaggaggcagcgctcaacgtcaccctgcagctcttcctggagcagccacccccaggccgcccccctcttcgtcttgaggacttcctgggtcgaacactccttgctgatgacctctttgccgcctactttggacctggttcttctcggcggttccgagcagccttaggtgaggtgtctcgtgccaatgcagcccaggacttcctgccaacttccaggaatgaccccgacctgcactttgatgctgagcgactgggtcagggacgcgcgcgcctggtaggggctctgcgggagaccgtggtggcagccagggcccttgaccacaccctggctcgccagcgcctcggggctgcacttcatgccctgcaggatttctacagtcatagcaactgggtggagctgggcgagcagcagccacaccctcacctcctctggccaaggcaggagctccagaacctggcacaagtggccgatcctacctgctccgattgcgaggagttgagctgccccaggaattggctgggcttcacactcctcacctctggctactttggaactcatcccccgaaacctccagggaaatgtagccacgggggccattttgaccggagcagctcccagccaccgaggggaggcatcaacaaggacagcacatccccaggcttctcccctcaccacatgctgcacctccaggctgcaaaactggcccttctagcctccatccaggccttcagccttctgcgaagccgcctgggagacagggatttctccaggctgctggacatcaccccagcctccagcctgagctttgtcctggacaccacgggcagcatgggtgaggagatcaacgctgccaaaatccaggctcgccaccttgtggagcagcggagaggcagccccatggagcctgtccactatgtcctggtgccttttcatgacccagggttcggccctgtctttacaaccagtgaccctgacagcttctggcaacagcttaatgagatccatgccttggggggtggagacgagcctgagatgtgcctgtcagccctgcagctggccctgctgcacacacctccactctcagatatctttgtcttcacggatgcctcccccaaggatgcctttctcaccaaccaggtggaatccctgactcaggagcggcgctgccgggtaacattcctggtgactgaagatacatcaagggttcagggtcgagctcggcgtgagatcttgtcccctctgcgttttgagccatacaaagcagtggccctggcctcaggaggagaggtgatcttcaccaaagaccagcacattcgagacgtggcagccattgttggggagagcatggctgccctggtgactcttcccctggaccctcctgttgtggtgcctgggcagccacttgtgttcagcgtggatgggctgctccagaagatcacagtccggatccacggagacatcagcagcttctggatcaagaaccctgcaggggtctcccagggccaggaggaaggcgggggtcctctaggtcacactcgccgctttgggcagttctggatggtgaccatggatgaccctccacagacaggaacctgggagatccaggtcacagctgaggacacccctggggtgagagtgcaagcccagacctccctggacttcctcttccactttgggatccccatggaggatggaccccaccctggcctctaccccctgactcagccagttgcaggtcttcagacccagctgctggtagaaagccaatcctggggatcctcagccgcatttctcccacgtcatccttcgaggggtcccagagggtgccgaactaggccaggtgcccttggagcccgtgggacctccggagcgaggtctcctcgcagcctcgctgtcgcccacgctgctgtcaacccctag

SEQ ID NO: 8448 - DNA, 2942 bp, Homo sapiens
ctcactcacctccgcactgcagccaagggaggcccgccctggcgtgggctgctgcctgtggctttgggcaggcaggagcgaaagggccaggggttgcctgtcctcccccaccctgttgaggccttcctccccctctgctgagcctcggttaattataactctgacctaagtgccctgtgacgtcaagcccgggccagccctgcccaggagacccagcaaccaggtccatgtctcagccatgctccccacggaggtcccccaatcccacccgggcccctcagcgttgcttctgctgcagctgttgctgccccccacatctgccttcttccccaacatctggagcctgctggctgcccctggctccatcacccaccaagacctaactgaggaggcagcgctcaacgtcaccctgcagctcttcctggagcagccacccccaggccgcccccctcttcgtcttgaggacttcctgggtcgaacactccttgctgatgacctctttgccgcctactttggacctggttcttctcggcggttccgagcagccttaggtgaggtgtctcgtgccaatgcagcccaggacttcctgccaacttccaggaatgaccccgacctgcactttgatgctgagcgactgggtcagggacgcgcgcgcctggtaggggctctgcgggagaccgtggtggcagccagggcccttgaccacaccctggctcgccagcgcctcggggctgcacttcatgccctgcaggatttctacagtcatagcaactgggtggagctgggcgagcagcagccacaccctcacctcctctggccaaggcaggagctccagaacctggcacaagtggccgatcctacctgctccgattgcgaggagttgagctgccccaggaattggctgggcttcacactcctcacctctggctactttggaactcatcccccgaaacctccagggaaatgtagccacgggggccattttgaccggagcagctcccagccaccgaggggaggcatcaacaaggacagcacatccccaggcttctcccctcaccacatgctgcacctccaggctgcaaaactggcccttctagcctccatccaggccttcagccttctgcgaagccgcctgggagacagggatttctccaggctgctggacatcaccccagcctccagcctgagctttgtcctggacaccacgggcagcatgggtgaggagatcaacgctgccaaaatccaggctcgccaccttgtggagcagcggagaggcagccccatggagcctgtccactatgtcctggtgccttttcatgacccagggttcggccctgtctttacaaccagtgaccctgacagcttctggcaacagcttaatgagatccatgccttggggggtggagacgagcctgagatgtgcctgtcagccctgcagctggccctgctgcacacacctccactctcagatatctttgtcttcacggatgcctcccccaaggatgcctttctcaccaaccaggtggaatccctgactcaggagcggcgctgccgggtaacattcctggtgactgaagatacatcaagggttcagggtcgagctcggcgtgagatcttgtcccctctgcgttttgagccatacaaagcagtggccctggcctcaggaggagaggtgatcttcaccaaagaccagcacattcgagacgtggcagccattgttggggagagcatggctgccctggtgactcttcccctggaccctcctgttgtggtgcctgggcagccacttgtgttcagcgtggatgggctgctccagaagatcacagtccggatccacggagacatcagcagcttctggatcaagaaccctgcaggggtctcccagggccaggaggaaggcgggggtcctctaggtcacactcgccgctttgggcagttctggatggtgaccatggatgaccctccacagacaggaacctgggagatccaggtcacagctgaggacacccctggggtgagagtgcaagcccagacctccctggacttcctcttccactttgggatccccatggaggatggaccccaccctggcctctaccccctgactcagccagttgcaggtcttcagacccagctgctggtagaagtgacagggttgggttccagagccaatcctggggatcctcagccgcatttctcccacgtcatccttcgaggggtcccagagggtgccgaactaggccaggtgcccttggagcccgtgggacctccggagcgaggtctcctcgcagcctcgctgtcgcccacgctgctgtcaacccctagacccttctccctggagctgattggccaggacgcagcggggcggcgcctgcacagggctgcccctcagcctagcactgtagtccctgtccttctggagcttagtggcccctcgggtttcttggccccgggcagcaaagtcccgctcagtctccgcatcgccagcttctcgggccctcaggatcttgaccttaggactttcgtcaaccccagcttctccctcacctccaacctctccagggctcacctggaactgaatgagtcggcctggggccgcctgtggctggaggtcccagattcagcggccccggattccgtggtgatggtgactgtgactgcagggggacgagaagccaacccagtacccccgactcatgctttcctccggctcctggtatcggccccagccccgcaggtgaggaaccactactttccatcacagggaccggcacaccacccctaccggctcatctgacccgatcctcaccacggccacccctgccttttcccccttcacattggtggctcaaggcagggctggggcagggctggctgcgggcagcccctggtggggcacagttggaggggtgctgcttctgctaggcctggcctcctggtga

SEQ ID NO: 8449 - DNA, 4701 bp, Homo sapiens
cagccaaaatgggaagggaggagtcgcagacggattacgcgaaggctctatcccacgaaaggactgggtgcaccccagaacgaggacgcggagcttccctgttccaagcagcaacagactgagaaaatccaagaaaggaggcccgaggggctgctgtggccccatcctcctggcacccgcggcccgggctctgcgacgcctttcgccccacctgcggaagcagcgatgcctggcggagcctgcgtgctggtgatcgcgctgatgttcctggcctggggggaagctcaggagtgctctcctgggggacaccagtttcttcggagtccttatagaagtgtccgttttgactcatggcacctccagcagtcagctgttcaagacctaatatgtgaccattccctctcccctggatggtatagatttctcatccttgacagacctgccgagatgccaaccaaatgtgttgagatgaaccattgtggaactcaggcccccatctggctgtctctgagagattcagaaacactgccatctcctggggagatcaagcaattgacagcttgtgcaacatggcagtttttgttcagcactacaaaagactgctgtctctttcaaatcccagtgtctgtaagaaactgtgggaacttttctgtatacttactacaaccaactcagggatgtatgggctactgtgcggaagctatttctgatgcacgattacacccatgtggttctgatgaaactgaaacaggaggtgattgtgttcgtcagctggctgcctcattgccacctccacctgcaggaaggccagaggttctggtggagttgattgagtccaggcttttctgtaggtgttcttttgatgttcccgctacaaaaaactcagtgggatttcacatagcttggtctaggctttcttctcaagaagtcaaagaggagctgacacaagagaccacagttcaggcattctctcttttagaacttgatggcataaatctcagacttggagacaggatattctgcagcgcttctgtctttttcttggagaatcctcatgtacaaagtgtagccatcgaaagccaagaattttttgcaggctttaagctacagcctgaattgagcactatatcagaggatgggaaagaatactacctgaggatagaaagcacagttcctattatttgttctgaatttagtgagcttgatcaagaatgcaaaatctcattaaaactgaaaactattggtcaagatctggttttcttctggggcatttatccgtgctgatcttggtgaatggggcatgagtctaacgatcagagcccctagtgtagattacagaaacactctgggactttgtggaacctttgatgaaaatccggaaaatgatttccatgacaaaaatgggatgcaaattgatcaaaattttaacaattatgttgcttttattaatgaatggaggattttaccaggaaaaagcatgtctgacacactgccagtttctatgacatcacctggaaagccatcctattgtagctgttcattggacactgcagcgtatccgtcttccgaagatctggacagtgtttctcgatcagaaattgccttgggttgcaaagacctcaatcatgtcagcttatcttctttgataccagaactagatgtcacctccgaatatattaattcagacactcttgtcagagagataaacaagcatacatctccagaagaatataatctaaatttatttctgcaagaaaaaaaacacataaacctgactaaactcggcttaaatgtacaaaaacatcctggaaatgagaaagaagattcactacaatatttggccaataagaaatatacacaaggccggggaagccacagccaagaaatgaggtacaatcgacaaaacagatggaaacggcagaactttcatgagtttcctcctttgtttgctttcccgagtctcagccaaacggatctggaagaacttacttattttttcccagaggaccatgctgaggatgtacagcaagagtttttcccctcttggcccactccctctggcctcaccgagtatagcaccttgaccctctgtcaggagactctagccaactccagcataggaaggctgtgtcttgcttttcttggcaagagattagacagtgttatagagatgtgtgtgaaggatgttctgttaaaagatgatcttagttgggcagaagcaggtgtggcccttttagaaaatgaatgtgaaaagaggattgtggaggaggggaaatataacacagaagagtatggcacatcaattgaagacattctctcagtattaaaatgccccaatttatgcagcggcaatgggcagtgcatggaatgggggtgtgcgtgttccccaagctttagttcctatgactgcagtgattcctatgacaaagctcctgaaattacagagcttgggaatgctggattctgtgatgttcaaaaatataattgtatgatggtgagagtttttggcaaaggcttcaaagaattaccttcaattaaatgtgaagttactaagctacagtataatagcagtgaatggatgcctggagaacccatctatacacagactgttttccacaatagcagagctgttgattgtcagctgcccactgatgttcagcagtttgataccatggatctggtgggtgggaaaccaactgggaagtggcagttgaaggtatctaatgatggttataaattcagtaatcccaaaataacggtcatatatgatggtgcttgccaagtttgtggtctctataaaaatgactcatgtactataaaggaaaatgtttgcattattgatggactctgctatgttgaaggagacaaaaatccaaccagcccttgtttgatttgtagacccaaaatttcaagatttacttggtcatttttagaaaacaaccagcccccagtgattcaagcattgcaagacaaattacagacattttatggtgaaaactttgagtatcagttcgtggccttcgatccagaaggttctgacatccattttacgttggactctggtcctgaaggggcaagtgtttcctctgcagggctttttatgtggaaaacagatttactaactacccaacaaattactgtacgccttaatgatgactgcgatgctgaaactagagtcacgattgaggtgactgtgaagtcttgtgattgcttgaatggtggatcatgtgtatctgataggaacttttctccagggagtggagtgtacctgtgtgtctgcttgcctggcttccatggcagcctttgtgaagtggacattagtgggtgccaatccaacccttgtggtcttggcagctatattagtggttttcacagttattcctgtgattgtccacctgagctcaaagttgaaacacagtttgtaaatcaatttactacacaaactgtggttctcacaagatctgataaaagtgtaaataaagaagaggatgataaaaatgcccaagggagaaagaggcatgttaagccaacaagtggaaatgccttcaccatttgtaaatatccatgtggaaaaagtagggagtgtgttgccccaaacatctgcaaatgtaaacctggttacattggttctaactgccaaactgctctttgtgaccctgattgcaaaaaccatggaaaatgtattaagcctaacatttgtcagtgtcttccaggacatggtggagcaacctgtgatgaagaacattgtaacccaccttgtcaacatggtggcacatgcttggctgggaatctctgcacttgtccttatggttttgtaggaccaaggtgtgaaacaatggtttgtaacaggcactgtgaaaatggaggccagtgtcttacaccagatatttgccagtgcaaacctggctggtatggacccacctgtagtacagctttgtgcgaccctgtctgcctcaatggtggttcgtgtaataagccaaatacttgcctctgtccaaatggattctttggggaacactgtcagaatgctttctgtcaccctccctgtaagaatggtggccactgcatgagaaataatgtgtgcgtctgtcgtgaaggatacactggtaggagattccaaaaaaggcatctgtgatcctacgtgcatgaatggaggaaaatgtgtgggaccaagcacttgctcttgtccttctggttggagtgggaaacgatgcaacacacctatctgcttgcagaaatgtaaaaacggtggtgaatgcattgcgcccagcatatgccattgtccttcctcctgggaaggagtgcggtgtcaaataccaatttgcaacccaaaatgtctttatggaggcagatgcatatttcccaatgtgtgttcctgccgcactgaatactctggagtcaaatgtgagaagaaaatacagataagacgccattgagtagcatcaagtatatgaattacaagcctgtatcttaagaatggaaatattttgttcagaaaaagttggagataacttggagtttatttgaacatcattcaaaaaatatcttaaagactgaagaaactaataaaatacataatgatctctgttgtaatcatagagaaaagcaaagaagaaatccaggtaatctaaatttgatgttgagatgggataggatatttacatattgagatgatgtatctgatattccacccattcacaa

SEQ ID NO: 8450 - DNA, 1463 bp, Homo sapiens
acgcgaaggctctatcccacgaaaggactgggtgcaccccagaacgaggacgcggagcttccctgttccaagcagcgatgcctggcggagcctgcgtgctggtgatcgcgctgatgttcctggcctggggggaagctcaggagtgctctcctgggggacaccagtttcttcggagtccttatagaagtgtccgttttgactcatggcacctccagcagtcagctgttcaagacctaatatgtgaccattccctctcccctggatggtatagatttctcatccttgacagacctgccgagatgccaaccaaatgtgttgagatgaaccattgtggaactcaggcccccatctggctgtctctgagagattcagaaacactgccatctcctggggagatcaagcaattgacagcttgtgcaacatggcagtttttgttcagcactacaaaagactgctgtctctttcaaatcccagtgtctgtaagaaactgtgggaacttttctgtatacttactacaaccaactcagggatgtatgggctactgtgcggaagggttctttgccaagattgtaaagtccccccacacgtgaaagcatcaaaacagacatctcacatttttccactggacataatgattgagtgtgttaaaaattctttggtttcctcaagtccattcctgttttaattaaaggatgaagaaggctatttctgatgcacgattacacccatgtggttctgatgaaactgaaacaggaggtgattgtgttcgtcagctggctgcctcattgccacctccacctgcaggaaggccagaggttctggtggagttgattgagtccaggcttttctgtaggtgttcttttgatgttcccgctacaaaaaactcagtgggatttcacatagcttggtctaggctttcttctcaagaagtcaaagaggagctgacacaagagaccacagttcaggcattctctcttttagaacttgatggcataaatctcagacttggagacaggatattctgcagcgcttctgtctttttcttggagaatcctcatgtacaaagtgtagccatcgaaagccaagaattttttgcaggctttaagctacagcctgaattgagcactatatcagaggatgggaaagaatactacctgaggatagaaagcacagttcctattatttgttctgaatttagtgagcttgatcaagaatgcaaaatctcattaaaactgaaaactattggtcaaggtaatatactaactttattttatcttattattagattgcaaacaataatgcttttttttcctgtaggaaaagtcactggagtgtactcatataataaatcatgttgcatgttgacatcaaattttagcccaatcatattactaatactcggccaaactgacgattgccaaagcaattcacatttcttcttcttggctgaaagcatacatttt

SEQ ID NO: 8451 - DNA, 5946 bp, Homo sapiens
agccgtggtcgcgctgtgtgtgtgtgtgagtggagagtgagtgcgggacctgaggctgtgtgtgtgtgaactgtggccactggcggggtcgggggggggcagcggcggagccgcctcggacggcaaagccatgactacagtagtggtacatgtggactccaaagctgagctcactaccctgctggagcagtgggaaaaggaacatggcagtgggcaggacatggtacctatccttaccaggatgtctcaattgattgaaaaagaaactgaagagtatcgtaaaggggatccagacccatttgatgatcgacatcctggtcgagctgatccagagtgtatgctgggccacttgctgagaatactcttcaagaatgatgatttcatgaatgcactggtgaatgcatatgtgatgacaagccgagagccccctttaaacactgcagcttgcagactcctattagacatcatgccagggctggaaactgctgtcgtctttcaagaaaaggagggaattgtcgagaatcttttcaaatgggcccgagaggccgatcaaccattgaggacatattctactggactgttaggaggtgctatggaaaatcaagacattgctgccaactatagagatgaaaattcacagctggtggcaatagtgcttcgaagactgagggagctacagctacaggaagtggctttgcggcaggaaaacaagcgtcccagtccacggaagctctcttctgaaccccttttgcctctggatgaggaggctgtggatatggactatggtgacatggctgtagatgtagtggatggagaccaagaggaagcttctggagacatggagatctcctttcatcttgattcaggccacaagactagtagcagagtgaactcaacaaccaaacctgaggatggaggattaaagaaaaacaagtcagcaaaacagggtgacagagagaactttaggaaagccaagcaaaagttgggtttctcatcttctgatccagatcgcatgtttgttgagctgtctaatagcagttggtcagaaatgtctccctgggtgattggcaccaattataccctttatcctatgactcctgctatcgagcagcgactcattctccaatatttgacccctctaggagaatatcaggagctacttcccatattcatgcaacttggatcacgggagctgatgatgttctatattgacctgaagcaaactaatgatgtcctgcttacatttgaggcactaaagcacctagcatctctcctgctccataacaaatttgccacagaatttgttgcgcatggtggagtacagaaattactggaaatacctcgtccttctatggctgcaaccggtgtgtctatgtgtttgtattacctatcctacaatcaggatgccatggaaagagtttgcatgcatccccacaatgttctgtctgatgtggtgaactataccctgtggttaatggagtgttctcatgcttcaggatgctgccatgctaccatgtttttttcaatttgcttctcatttcgggccgtcttggagctctttgaccgctatgatggtcttcgtcgtctggtgaacttgatcagtactttggagattctaaatttggaagatcagggtgcacttctgagtgatgatgaaatatttgctagccgccaaactgggaaacatacctgcatggccttgcgcaaatactttgaggctcacctggccattaaattggaacaagtgaagcagtcacttcagaggactgagggtggcattcttgtccacccacaacccccgtacaaggcatgctcatatactcatgaacagattgtggaaatgatggaatttttgatagaatatggcccagcgcagctatattgggaaccagctgaagttttcctcaaactttcttgtgtgcaactcttgttgcagcttatttctattgcctgcaattggaagacctattatgcaaggaatgacactgtgcgctttgctttggatgtcctggctattcttactgtggtgccaaaaatccagctccagttggcagaatcagtggacgtgttggatgaggctggatctacagtctctactgtaggtatcagcattattttgggagtggctgagggtgagttcttcatccatgatgctgaaattcagaagtcagcacttcagattatcatcaattgtgtgtgtggcccagataaccgaatatccagtattggtaaatttatctctggtactcctcggagaaagctgcctcagaaccctaaaagcagtgagcacaccctggccaagatgtggaatgtggttcagtccaacaacggcatcaaggtgctcctgtccttactgtccattaagatgcccatcacagatgcagaccaaatccgggccctggcctgcaaagccctagtgggcctgtctcgcagtagcactgtccggcagatcatcagtaaactgccccttttcagcagctgccagatccagcagctgatgaaggagcctgtgctgcaggacaagcgcagtgaccatgtcaagttctgcaagtatgctgctgaactcattgaacgggtgtcaggaaaaccacttctcattggcactgatgtttccctagcacgactgcagaaagcagatgttgttgcccagtcaaggatctccttccctgagaaagagctgcttttgttgatacgaaaccatcttatttctaaagggcttggagaaacagcaaccgtgctgacaaaagaggctgacctgcccatgactgctgcctcccattcttctgcctttaccccagtcactgctgctgcttctcctgtctctctaccccgaacccctcgtatcgctaatggcattgcaactcgtctgggcagccatgctgctgtgggtgcctctgcgccttctgcccctactgctcatcctcagccacggcccccccagggtccgctagctctgcccggcccatcttatgcaggcaactcccctttgattggtagaatcagttttatcagagagaggccatcaccctgcaatggcaggaaaatcagagtgttgcggcagaagtcggaccatggtgcctacagccaaagcccagccataaaaaaacagctggacagacatcttccttccccacctacgctggacagtataatcacagagtatcttagagaacaacatgctcgctgcaagaatccagttgccacctgcccacctttctccctctttactcctcaccaatgtcctgagccaaaacagaggcggcaagcgccaataaactttacgtcaaggctaaaccgcagggcatcatttccaaagtatggaggggtggatggcggatgctttgataggcaccttatctttagcagattccgtcctatttcagtgttccgggaagccaatgaagatgagagtggcttcacctgctgtgcattctcagcacgggagcggttcctgatgcttggcacctgcacagggcagctgaagctctataatgtgtttagtggacaggaggaggccagctataactgtcacaactcagccatcacacatcttgaaccttccagggatgggtccttgctgctgacatctgctacttggagccagcctttgtctgcactttggggaatgaagtcagtatttgatatgaagcattccttcacagaagatcactatgttgagttcagtaagcactcccaggatcgggtcatcggcacaaaaggagacattgcccacatttatgatattcagactggcaacaagctgttgactctgtttaacccagatcttgccaacaactacaagaggaactgtgccacctttaatcctacagatgatcttgtcttaaatgatggcgtcctctgggatgtccgctctgcacaggccatccacaagtttgacaagttcaatatgaacatcagtggtgttttccatccaaatggactggaggtgatcattaatactgagatttgggaccttcgaacttttcatcttttgcatactgttcccgctctggatcagtgtcgcgtggtgttcaatcacacgggaacagtgatgtatggagctatgttgcaggcagatgatgaagatgacttaatggaagagaggatgaaaagcccctttgggtcatccttccgaacatttaatgcaactgactacaaacctatagcaaccattgatgtgaaacggaacatctttgacctgtgtacagacaccaaagactgctatcttgctgtcattgagaatcaaggcagcatggatgccctgaacatggacacagtatgcaggctgtatgaagtgggcaggcagcgtctggcagaggatgaggatgaagaggaggaccaggaagaggaagaacaggaggaagaagatgatgatgaagatgatgatgacaccgatgatttagatgagcttgacactgaccagttgctggaggcggagttggaggaggacgacaataatgagaacgcaggggaagatggggacaatgacttctctccctctgatgaggagctagcaaaccttctagaggagggagaggacggggaggatgaagactctgatgcagatgaggaggtggaactgatcctgggggacactgacagctctgacaactctgatttggaagatgacatcatcttatctctgaatgagtgaggagccatcactgcttggaagagattcttggcagagagaagaggggacaaatttggttgtgaagtaaacaagaaacacaagacggctaaaactctccaggggcaggtaaagccctgctgggctcagaagcactatagaatttgctgtacacactgaagtgggtctgtgtcacacaggtatttcttggtcctctggagagcagaggactcactcagctctttgcttcatgcctcgctttaatggtagtaaacacttaaccagtggaatagtctgactgctggtactgatggcatcagaagaaaacaggttaacaatcaagtagtgaaagcactatattctagtcattaactcaacggagccagtctcaactctgctgggagcacccacaggtctctgtgggggagacagggactataacagggaggcagaattcaggttggcttgacaacacaccttaggaacatgtgctaaggggctaaggaggcatcagctgtcttccttattctaccagggctgaaaatcggagtcacttaggaggcagcatgagaacagtggcacaccaccagtgaggcacatgttgcctttttgtctttaagcaacaccttagacagggcctgaaccctgggtgggggcactggatgcctgaagtaagtaagttttctcagtggggcagtctcataaaatcaccaggacattgaccacctgacctcccctaactagtgctggccaaggcctgagagttcacagaacctgctaggtcttaagagccaaaggaaggaagtggttgagggccaggaaagagaaggaatgtcatgccagggtgttactcctcaccaaaacttggcagttctttttggggccatgggacacctttctctgaagaggggttggataaggcaaaggttgaagtgtcttctctaggcacgttttctagcatgtttccttttacttggttctgtctcacaaagctgggaggtagatgattcttccgggtcctgagcacctgcttcatgaaggaagataggtagcccagagaagaagttttggacttaacaacataccaaggcagctctggcctgtgactcaggcgtttgttggagagctgcaggaaaaccactgcagtgtgcctgcaacaggacaagacccactcctgtttctggcggtaccagctaccctggaatggtggcgtgtcctgctgtacccaactgacttgcttaggtacctggcagctgtgaccacagctcaagtaaaaaaacaaaaacaggcaaataaataaacatgcttaacatgtc

SEQ ID NO: 8452 - DNA, 5984 bp, Homo sapiens
cgcgctgtgtgtgtgtgtgagtggagagtgagtgcgggacctgaggctgtgtgtgtgtgaactgtggccactggcggggtcgggggggggcagcggcggagccgcctcggacgataaggaaattgagatttggagaagttaaataaccaagacttcacaggcaaagccatgactacagtagtggtacatgtggactccaaagctgagctcactaccctgctggagcagtgggaaaaggaacatggcagtgggcaggacatggtacctatccttaccaggatgtctcaattgattgaaaaagaaactgaagagtatcgtaaaggggatccagacccatttgatgatcgacatcctggtcgagctgatccagagtgtatgctgggccacttgctgagaatactcttcaagaatgatgatttcatgaatgcactggtgaatgcatatgtgatgacaagccgagagccccctttaaacactgcagcttgcagactcctattagacatcatgccagggctggaaactgctgtcgtctttcaagaaaaggagggaattgtcgagaatcttttcaaatgggcccgagaggccgatcaaccattgaggacatattctactggactgttaggaggtgctatggaaaatcaagacattgctgccaactatagagatgaaaattcacagctggtggcaatagtgcttcgaagactgagggagctacagctacaggaagtggctttgcggcaggaaaacaagcgtcccagtccacggaagctctcttctgaaccccttttgcctctggatgaggaggctgtggatatggactatggtgacatggctgtagatgtagtggatggagaccaagaggaagcttctggagacatggagatctcctttcatcttgattcaggccacaagactagtagcagagtgaactcaacaaccaaacctgaggatggaggattaaagaaaaacaagtcagcaaaacagggtgacagagagaactttaggaaagccaagcaaaagttgggtttctcatcttctgatccagatcgcatgtttgttgagctgtctaatagcagttggtcagaaatgtctccctgggtgattggcaccaattataccctttatcctatgactcctgctatcgagcagcgactcattctccaatatttgacccctctaggagaatatcaggagctacttcccatattcatgcaacttggatcacgggagctgatgatgttctatattgacctgaagcaaactaatgatgtcctgcttacatttgaggcactaaagcacctagcatctctcctgctccataacaaatttgccacagaatttgttgcgcatggtggagtacagaaattactggaaatacctcgtccttctatggctgcaaccggtgtgtctatgtgtttgtattacctatcctacaatcaggatgccatggaaagagtttgcatgcatccccacaatgttctgtctgatgtggtgaactataccctgtggttaatggagtgttctcatgcttcaggatgctgccatgctaccatgtttttttcaatttgcttctcatttcgggccgtcttggagctctttgaccgctatgatggtcttcgtcgtctggtgaacttgatcagtactttggagattctaaatttggaagatcagggtgcacttctgagtgatgatgaaatatttgctagccgccaaactgggaaacatacctgcatggccttgcgcaaatactttgaggctcacctggccattaaattggaacaagtgaagcagtcacttcagaggactgagggtggcattcttgtccacccacaacccccgtacaaggcatgctcatatactcatgaacagattgtggaaatgatggaatttttgatagaatatggcccagcgcagctatattgggaaccagctgaagttttcctcaaactttcttgtgtgcaactcttgttgcagcttatttctattgcctgcaattggaagacctattatgcaaggaatgacactgtgcgctttgctttggatgtcctggctattcttactgtggtgccaaaaatccagctccagttggcagaatcagtggacgtgttggatgaggctggatctacagtctctactgtaggtatcagcattattttgggagtggctgagggtgagttcttcatccatgatgctgaaattcagaagtcagcacttcagattatcatcaattgtgtgtgtggcccagataaccgaatatccagtattggtaaatttatctctggtactcctcggagaaagctgcctcagaaccctaaaagcagtgagcacaccctggccaagatgtggaatgtggttcagtccaacaacggcatcaaggtgctcctgtccttactgtccattaagatgcccatcacagatgcagaccaaatccgggccctggcctgcaaagccctagtgggcctgtctcgcagtagcactgtccggcagatcatcagtaaactgccccttttcagcagctgccagatccagcagctgatgaaggagcctgtgctgcaggacaagcgcagtgaccatgtcaagttctgcaagtatgctgctgaactcattgaacgggtgtcaggaaaaccacttctcattggcactgatgtttccctagcacgactgcagaaagcagatgttgttgcccagtcaaggatctccttccctgagaaagagctgcttttgttgatacgaaaccatcttatttctaaagggcttggagaaacagcaaccgtgctgacaaaagaggctgacctgcccatgactgctgcctcccattcttctgcctttaccccagtcactgctgctgcttctcctgtctctctaccccgaacccctcgtatcgctaatggcattgcaactcgtctgggcagccatgctgctgtgggtgcctctgcgccttctgcccctactgctcatcctcagccacggcccccccagggtccgctagctctgcccggcccatcttatgcaggcaactcccctttgattggtagaatcagttttatcagagagaggccatcaccctgcaatggcaggaaaatcagagtgttgcggcagaagtcggaccatggtgcctacagccaaagcccagccataaaaaaacagctggacagacatcttccttccccacctacgctggacagtataatcacagagtatcttagagaacaacatgctcgctgcaagaatccagttgccacctgcccacctttctccctctttactcctcaccaatgtcctgagccaaaacagaggcggcaagcgccaataaactttacgtcaaggctaaaccgcagggcatcatttccaaagtatggaggggtggatggcggatgctttgataggcaccttatctttagcagattccgtcctatttcagtgttccgggaagccaatgaagatgagagtggcttcacctgctgtgcattctcagcacgggagcggttcctgatgcttggcacctgcacagggcagctgaagctctataatgtgtttagtggacaggaggaggccagctataactgtcacaactcagccatcacacatcttgaaccttccagggatgggtccttgctgctgacatctgctacttggagccagcctttgtctgcactttggggaatgaagtcagtatttgatatgaagcattccttcacagaagatcactatgttgagttcagtaagcactcccaggatcgggtcatcggcacaaaaggagacattgcccacatttatgatattcagactggcaacaagctgttgactctgtttaacccagatcttgccaacaactacaagaggaactgtgccacctttaatcctacagatgatcttgtcttaaatgatggcgtcctctgggatgtccgctctgcacaggccatccacaagtttgacaagttcaatatgaacatcagtggtgttttccatccaaatggactggaggtgatcattaatactgagatttgggaccttcgaacttttcatcttttgcatactgttcccgctctggatcagtgtcgcgtggtgttcaatcacacgggaacagtgatgtatggagctatgttgcaggcagatgatgaagatgacttaatggaagagaggatgaaaagcccctttgggtcatccttccgaacatttaatgcaactgactacaaacctatagcaaccattgatgtgaaacggaacatctttgacctgtgtacagacaccaaagactgctatcttgctgtcattgagaatcaaggcagcatggatgccctgaacatggacacagtatgcaggctgtatgaagtgggcaggcagcgtctggcagaggatgaggatgaagaggaggaccaggaagaggaagaacaggaggaagaagatgatgatgaagatgatgatgacaccgatgatttagatgagcttgacactgaccagttgctggaggcggagttggaggaggacgacaataatgagaacgcaggggaagatggggacaatgacttctctccctctgatgaggagctagcaaaccttctagaggagggagaggacggggaggatgaagactctgatgcagatgaggaggtggaactgatcctgggggacactgacagctctgacaactctgatttggaagatgacatcatcttatctctgaatgagtgaggagccatcactgcttggaagagattcttggcagagagaagaggggacaaatttggttgtgaagtaaacaagaaacacaagacggctaaaactctccaggggcaggtaaagccctgctgggctcagaagcactatagaatttgctgtacacactgaagtgggtctgtgtcacacaggtatttcttggtcctctggagagcagaggactcactcagctctttgcttcatgcctcgctttaatggtagtaaacacttaaccagtggaatagtctgactgctggtactgatggcatcagaagaaaacaggttaacaatcaagtagtgaaagcactatattctagtcattaactcaacggagccagtctcaactctgctgggagcacccacaggtctctgtgggggagacagggactataacagggaggcagaattcaggttggcttgacaacacaccttaggaacatgtgctaaggggctaaggaggcatcagctgtcttccttattctaccagggctgaaaatcggagtcacttaggaggcagcatgagaacagtggcacaccaccagtgaggcacatgttgcctttttgtctttaagcaacaccttagacagggcctgaaccctgggtgggggcactggatgcctgaagtaagtaagttttctcagtggggcagtctcataaaatcaccaggacattgaccacctgacctcccctaactagtgctggccaaggcctgagagttcacagaacctgctaggtcttaagagccaaaggaaggaagtggttgagggccaggaaagagaaggaatgtcatgccagggtgttactcctcaccaaaacttggcagttctttttggggccatgggacacctttctctgaagaggggttggataaggcaaaggttgaagtgtcttctctaggcacgttttctagcatgtttccttttacttggttctgtctcacaaagctgggaggtagatgattcttccgggtcctgagcacctgcttcatgaaggaagataggtagcccagagaagaagttttggacttaacaacataccaaggcagctctggcctgtgactcaggcgtttgttggagagctgcaggaaaaccactgcagtgtgcctgcaacaggacaagacccactcctgtttctggcggtaccagctaccctggaatggtggcgtgtcctgctgtacccaactgacttgcttaggtacctggcagctgtgaccacagctcaagtaaaaaaacaaaaacaggcaaataaataaacatgcttaacatgtc

SEQ ID NO: 8453 - DNA, 1148 bp, Homo sapiens
gcccgggcggctgcccttgggtgctcccttccctgcccgacacccagaccgaccttgaccgcccacctggcaggagcaggacaggacggccggacgcggccatggccgagctcccggggccctttctctgcggggccctgctaggcttcctgtgcctgagtgggctggccgtggaggtgaaggtacccacagagccgctgagcacgcccctggggaagacagccgagctgacctgcacctacagcacgtcggtgggagacagcttcgccctggagtggagctttgtgcagcctgggaaacccatctctgagtcccatccaatcctgtacttcaccaatggccatctgtatccaactggttctaagtcaaagcgggtcagcctgcttcagaacccccccacagtgggggtggccacactgaaactgactgacgtccacccctcagatactggaacctacctctgccaagtcaacaacccaccagatttctacaccaatgggttggggctaatcaaccttactgtgctggttccccccagtaatcccttatgcagtcagagtggacaaacctctgtgggaggctctactgcactgagatgcagctcttccgagggggctcctaagccagtgtacaactgggtgcgtcttggaacttttcctacaccttctcctggcagcatggttcaagatgaggtgtctggccagctcattctcaccaacctctccctgacctcctcgggcacctaccgctgtgtggccaccaaccagatgggcagtgcatcctgtgagctgaccctctctgtgaccgaaccctcccaaggccgagtggccggagctctgattggggtgctcctgggcgtgctgttgctgtcagttgctgcgttctgcctggtcaggttccagaaagagagggggaagaagcccaaggagacatatgggggtagtgaccttcgggaggatgccatcgctcctgggatctctgagcacacttgtatgagggctgattctagcaaggggttcctggaaagaccctcgtctgccagcaccgtgacgaccaccaagtccaagctccctatggtcgtgtgacttctcccgatccctgagggcggtgagggggaatatcaataattaaagtctgtgggtaccata

SEQ ID NO: 8454 - DNA, 1191 bp, Homo sapiens
agaccgaccttgaccgcccacctggcaggagcaggacaggacggccggacgcggccatggccgagctcccggggccctttctctgcggggccctgctaggcttcctgtgcctgagtgggctggccgtggaggtgaaggtacccacagagccgctgagcacgcccctggggaagacagccgagctgacctgcacctacagcacgtcggtgggagacagcttcgccctggagtggagctttgtgcagcctgggaaacccatctctgagtcccatccaatcctgtacttcaccaatggccatctgtatccaactggttctaagtcaaagcgggtcagcctgcttcagaacccccccacagtgggggtggccacactgaaactgactgacgtccacccctcagatactggaacctacctctgccaagtcaacaacccaccagatttctacaccaatgggttggggctaatcaaccttactgtgctggttccccccagtaatcccttatgcagtcagagtggacaaacctctgtgggaggctctactgcactgagatgcagctcttccgagggggctcctaagccagtgtacaactgggtgcgtcttggaacttttcctacaccttctcctggcagcatggttcaagatgaggtgtctggccagctcattctcaccaacctctccctgacctcctcgggcacctaccgctgtgtggccaccaaccagatgggcagtgcatcctgtgagctgaccctctctgtgaccgaaccctcccaaggccgagtggccggagctctgattggggtgctcctgggcgtgctgttgctgtcagttgctgcgttctgcctggtcaggttccagaaagagagggggaagaagcccaaggagacatatgggggtagtgaccttcggtgagcaggagggctggggggtggcgcaaggagggaggaaagggcttgagttaaaagcgggtgcctgcaaccctcaaactccgacatcattcagtgtgtttaggggcaggaggtgttgttcagccgtggaatttgctggtggcagcagtgtaacctgtgtatttgagggtacaggcaagcggtacagggtggagtggctggtccacaagctgtggcagggaagctgtttgcaggactgccctgcccctcctcatatttaataaagtttacttttctgttccgaa

SEQ ID NO: 8455 - DNA, 363 bp, Homo sapiens
atggactggaattggaggatcctgtttttggtggtcatagctgcgggtgcccagtcccaggtacagctggtgcagtctggggctgaggtgaagaagcctggggcctcagtgaaggtctcctgcaaggcttctggatacaccatcaccagctactgtatgcactgggtgcaccaggtccatgcacaagggcttgagtggatgggattggtgtgccctagtgatggcagcacaagctatgcacagaagttccaggccagagtcaccataaccagggacacatccatgagcacagcctacatggagctaagcagtctgagatctgaggacacggccatgtattactgtgtgagagacacaatgtga

SEQ ID NO: 8456 - DNA, 1908 bp, Homo sapiens
gcgtggccttccgcggaagggaagagtcccgcagtcggaggcggccggctgggcgtgcgctcgctccccgaagccggggctgggccggagccgggcgagggctgggagctgggccgggtccggggacagcgggcgaggggcagctgccggagccgggcagccaggccgctcagggcaggggacagctggcgccggttctgcggtctccggggcccagatgtgaggcggcggcgcccccggcccgagagcgcacgatgggggccccgctcgccgtagcgctgggcgccctccactacctggcacttttcctgcaactcggcggcgccacgcggcccgccggccacgcgccctgggacaaccacgtctccggccacgccctgttcacagagacaccccatgacatgacagcacggacgggcgaggacgtggagatggcctgctccttccgcggcagcggctccccctcctactcgctggagatccagtggtggtatgtacggagccaccgggactggaccgacaagcaggcgtgggcctcgaaccaggtggtcaaggtggtgggcagcaacatctcccacaagctgcgcctgtcccgggtgaagcccacggacgaaggcacctacgagtgccgcgtcatcgacttcagcgacggcaaggcccggcaccacaaggtcaaggcctacctgcgggtgcagccaggggagaactccgtcctgcatctgcccgaagcccctcccgccgcgcccgccccgccgccccccaagccaggcaaggagctgaggaagcgctcggtggaccaggaggcctgcagcctctagactgatgcccctgcccccgcccatccgcccccacgctgtacagagtgcatgaggagccgccggaccaccggggaccgactgcctgcgtccagccgcgccccatccccgaggccgcctgtggccaccatgtcggccctctttccaccaccccttgctcagcatgtaagccccacccacccctgccctttcagacccctgcggtgacctggctcggagaaggtggccctgggcaccaaggggccaaccgccctgaacactggggcagggaccatgctggggcccggggccacccccttcctgtcaccagcttctgtggagtccagtgttttgctttgcttgcttgtcccccatcctgtcctgagccggggccccccagcctcgcctccctcctcctaccatccctcacttggacctgggggtgtggacagtgacccctccctgaatatggacttgaatcttctgagcagaactagggcctctcccctggtgaagacccagggaacccaggagggcccttctggggcagtggctctgcagggtcactcatggaggcctaggggaacagcgagatgccccaccacctcctggcgagtccttcctgttcagctccctgtgcgaccctccagggatgcaggggatccaggattctctgccctgtcacacggcgagtcagaagggaggggcctttccctcggacccatggccccaggcagagttttgcaccagcaggacccctttgagggccttcaaggctctcccaggagtccccctctgccggccccccaatgccccagctccctcttgggtcctgtgccaagtccgccccagggcctggggctgttgggagccaagggccccctggtactcagttccctcacgattcccgatcacgggcacacctgccccctggttatttgtaaatatttctattggacccaattctcctcggaattggctggcacctctggctgccgcagctcagtgatgacgtgggggaggtgggagaggccgagggctttgcctaggggtgggttgccctgtatacatgatccagtctgtgactaccagccaacctgaataaagcggtttt

SEQ ID NO: 8457 - DNA, 1959 bp, Homo sapiens
cttccgcggaagggaagagtcccgcagtcggaggcggccggctgggcgtgcgctcgctccccgaagccggggctgggccggagccgggcgagggctgggagctgggccgggtccggggacagcgggcgaggggcagctgccggagccgggcagccaggccgctcagggcaggggacagctggcgccggttctgcggtctccggggcccagatgtgaggcggcggcgcccccggcccgagagcgcacgatgggggccccgctcgccgtagcgctgggcgccctccactacctggcacttttcctgcaactcggcggcgccacgcggcccgccggccacgcgccctgggacaaccacgtctccggccacgccctgttcacagagacaccccatgacatgacagcacggacgggcgaggacgtggagatggcctgctccttccgcggcagcggctccccctcctactcgctggagatccagtggtggtatgtacggagccaccgggactggaccgacaagcaggcgtgggcctcgaaccagctaaaagcatctcagcaggaagacgcagggaaggaggcaaccaaaataagtgtggtcaaggtggtgggcagcaacatctcccacaagctgcgcctgtcccgggtgaagcccacggacgaaggcacctacgagtgccgcgtcatcgacttcagcgacggcaaggcccggcaccacaaggtcaaggcctacctgcgggtgcagccaggggagaactccgtcctgcatctgcccgaagcccctcccgccgcgcccgccccgccgccccccaagccaggcaaggagctgaggaagcgctcggtggaccaggaggcctgcagcctctagactgatgcccctgcccccgcccatccgcccccacgctgtacagagtgcatgaggagccgccggaccaccggggaccgactgcctgcgtccagccgcgccccatccccgaggccgcctgtggccaccatgtcggccctctttccaccaccccttgctcagcatgtaagccccacccacccctgccctttcagacccctgcggtgacctggctcggagaaggtggccctgggcaccaaggggccaaccgccctgaacactggggcagggaccatgctggggcccggggccacccccttcctgtcaccagcttctgtggagtccagtgttttgctttgcttgcttgtcccccatcctgtcctgagccggggccccccagcctcgcctccctcctcctaccatccctcacttggacctgggggtgtggacagtgacccctccctgaatatggacttgaatcttctgagcagaactagggcctctcccctggtgaagacccagggaacccaggagggcccttctggggcagtggctctgcagggtcactcatggaggcctaggggaacagcgagatgccccaccacctcctggcgagtccttcctgttcagctccctgtgcgaccctccagggatgcaggggatccaggattctctgccctgtcacacggcgagtcagaagggaggggcctttccctcggacccatggccccaggcagagttttgcaccagcaggacccctttgagggccttcaaggctctcccaggagtccccctctgccggccccccaatgccccagctccctcttgggtcctgtgccaagtccgccccagggcctggggctgttgggagccaagggccccctggtactcagttccctcacgattcccgatcacgggcacacctgccccctggttatttgtaaatatttctattggacccaattctcctcggaattggctggcacctctggctgccgcagctcagtgatgacgtgggggaggtgggagaggccgagggctttgcctaggggtgggttgccctgtatacatgatccagtctgtgactaccagccaacctgaataaagcggttttaaaaaaa

SEQ ID NO: 8458 - DNA, 656 bp, Homo sapiens
cggctgggcgtgcgctcgctccccgaagccggggctgggccggagccgggcgagggctgggagctgggccgggtccggggacagcgggcgaggggcagctgccggagccgggcagccaggccgctcagggcaggggacagctggcgccggttctgcggtctccggggcccagatgtgaggcggcggcgcccccggcccgagagcgcacgatgggggccccgctcgccgtagcgctgggcgccctccactacctggcacttttcctgcaactcggcggcgccacgcggcccgccggccacgcgccctgggacaaccacgtctccggccacgccctgttcacagagacaccccatgacatgacagcacggacgggcgaggacgtggagatggcctgctccttccgcggcagcggctccccctcctactcgctggagatccagtggtggtatgtacggagccaccgggactggaccgacaagcaggcgtgggcctcgaaccaggtggtcaaggtggtgggcagcaacatctcccacaagctgcgcctgtcccgggtgaagcccacggacgaaggcacctacgagtgccgcgtcatcgacttcagcgacggcaaggcccggcaccacaaggtcaaggcctacctgcgggtgcagccaggg

SEQ ID NO: 8459 - DNA, 1243 bp, Homo sapiens
atggaacagcggaaccggctcggtgccctcggatacctgccgcctctgctgctgcatgccctgctgctcttcgtggccgacgctgcattcacagaagtccccaaagatgtgacagtacgggagggagacgacatcgaaatgccctgcgcgttccgggccagcggagccacctcgtattcgctggagattcagtggtggtacctcaaggagccaccccgggagctgctgcacgagctggcgctcagcgtgccgggcgcccggagcaaggtaacaaataaggatgcaactaaaatcagcaccgtacgcgtccagggcaatgacatctcacaccggcttcggctgtctgccgtgcggctgcaggacgagggcgtgtacgagtgccgcgtgtcggactacagcgacgacgacacgcaggagcacaaggcccaggcgatgctgcgcgtgctctcgcgcttcgcgccgcccaacatgcaggccgccgaggccgtgtcccacatccagagcagcggcccgcgtcgccacggcccagccagcgccgccaacgccaacaacgcgggcgccgcgagccgtaccacctccgagcccggccgcggcgacaagagcccgccgcccgggagccctcccgccgccatcgatcccgcagtccccgaggccgcggcagcctcggcggcccacacgcccaccaccacagtcgcggcagctgctgctgcctcgtcagcgtcgccgccatcgggacaggcggtcctgctgcgccagaggcacggctcgggcaccggccgtagctacaccacagacccactcttgtccctgctcctgttagctctgcataagttcctgcgcctgctcttgggacattgacagacaagaccaacccgagcatctcagaggccgcacatgacctgcccggggccctcggtgaggaccatgtcgctggatggacacagagagactgagagacgcatgaaaaagtccacatggaaaataaataaatcatatttttgggaaagttacacaaatgtagaacacctaaaataatgcatctagtttccaaataatttggagtttggcccatgcagtctgcatgggaatcaatgatttctctacttcaatgtagttttcttttctacactttccctccaagtcttcattttgcacgaactgttgagcagttatctttaggataatatgtacaaatgttggggtcaaagccttttgacaaagcaaaatatttttagtagattat

SEQ ID NO: 8460 - DNA, 4805 bp, Homo sapiens
aagtgggggggcccggctagccattctggaagcggccgggcgcagtcttcgtagcgtacccgccggctgcgaggcgcagggcggaggcggagactgcgtggcgcaggcgcgttgctgggcttctcctgggtccccagacagctggaggagataaacagaggaggaggagggaggggagtgcgtgtgtgagagcgcgcgagggagtgtgagtgtgtgtgagcgcgggtgtgaggcggtgcgcaggggcgggcggaggcgctgtccggccccggccaggcgccgggcggggagcatgggaaggggctagaactgctcgagccccccagccccctccccgggatccgcgccccccttcccgggagaggggccgccccccccggacggacatgggctcctgaagttgcgccgctgccggtcgggggaagagacctgacaggtaattaaatgtgtattttgtggacctgggcttggctggaatgctcaggggtcctgaagatcctattatagcttccttctgttgaaccattaagaaaagatggcgaaagtcaacataactagagacctcatccgtaggcagatcaaggagcggggtgccctgagctttgagcggcgctaccatgtcactgacccctttatccggcggctgggcctggaagcagagctgcagggtcactcaggatgtgtcaactgtctggagtggaatgagaaaggagacttgctggcctctggttccgatgaccagcacacgattgtgtgggacccgctgcaccacaagaagctgctctccatgcacacgggacacaccgcaaatatcttctctgtcaagttcctgcctcacgctggggaccgcatcttgatcacgggggcagccgactctaaggtgcatgtgcacgacctgacagtaaaggagaccatccacatgtttggagaccacacaaaccgggtgaagcgcatcgccacagcgcccatgtggcccaacacattctggagtgctgctgaggatgggcttatccgccagtatgaccttcgagagaacagcaaacactcggaggtgctgattgacctgacagagtactgtggccagctggtggaggccaagtgcctcactgtcaacccccaggacaacaactgcctggcagttggggccagcgggcccttcgtgaggctctatgacatccgcatgatccataaccacagaaagagcatgaagcagagcccttcagcgggtgtgcacaccttctgtgaccggcagaaaccccttccggacggtgcagcccagtattacgtagcaggtcacctgccagtgaagcttcctgactacaacaaccgtttgagagtgctggttgccacctatgtgaccttcagccccaatggcacagagctactagtcaacatggggggggaacaggtctatttgtttgacttgacttacaagcagcggccgtacaccttcctcttgcctagaaaatgccactcctcgggggaagtccagaatggcaagatgtccaccaacggtgtgtccaacggtgtgtccaatggcctgcaccttcatagcaatggcttccggctgccggagagtaggggacatgtcagcccccaagtagagctaccaccatacctggagcgtgtgaaacagcaagccaatgaggcttttgcctgccagcagtggacccaagccattcagctttacagcaaggctgtgcagagggcccctcacaatgccatgctttatggaaaccgagcagcagcctacatgaagcgcaagtgggatggtgaccactatgatgccctgagggactgcctcaaggccatctccctaaacccatgccacctgaaggcacactttcgcctggcccgctgcctctttgagctcaagtatgtggctgaagccctggagtgcctggacgacttcaaagggaaatttccggagcaggcccacagcagcgcttgtgatgcattgggccgcgacatcacagctgccctcttctctaaaaatgatggtgaggagaagaagggacctggtggcggcgccccagtccgcctccgcagcacgagccgcaaggactccatctcagaggatgaaatggtgctgcgggagcgaagctacgactatcagttccgctactgcggccactgcaacaccaccacggatatcaaagaggccaatttctttggcagcaacgctcagtatatcgtcagtggctctgacgatggctccttcttcatctgggaaaaggagaccaccaacctggtccgtgtgctccaaggggatgagtccattgtcaactgcctgcagccacaccccagctactgcttcctggccaccagtggcatcgatcctgttgtgcggctctggaacccccgaccagagagtgaagacctcacaggccgagtcgtggaagatatggagggtgcttcacaggccaaccagcggcgcatgaatgcagacccgttggaggtgatgctgctcaacatgggctaccggatcacgggcctgagcagtgggggtgccggggcctctgatgatgaggacagctctgagggccaggtgcagtgccggcccagctagaccctccagccctggtccccagcccctgctactggctggaccctctgccctgggcaggaggtcaggggattctgttttggtttgtcttccccaccacccttttttttcatttcccctgttttgtttgttagtttggcgttaggggtggaggttgctacaacttgctggctttcggactctgggctgattgtcccctgactatccccagccctgaaaaaaagagcaggaggggacacccctccatatgcccccccccatctcctgctttcatgtccctggagggctctggcctgcctcaaaaccccttctgcctcaggtggggaggaacaagctgaactgtcttcagggactgtcctgccctttagctggcagcagcaggaggagtgggattcccaattggtaagggctcgccttggcctgttgccactcttgctccctagcctgcaaggctagctcccctgtggtcttcaggaaaggttttgaaaaaggatgggtcccaccctccctccagagccaccagtgttagagcggagcccaaaggaaggatgggagccctggagtgggcaagaccaggccacctgctgaggtcgctgtggagcaccctcgctcctctcctggctactagctctggccctgcacctactctcactggccacctctggaggctctgcctttcccaagggccctggcagagggtggggcactgcaccttaccccacccatccatgccagcacttctgcactacggccattctcctcttgggcgctcctcagcctcactgtgacctttctgccagagctcccagccaggcctactctgctgaggtggcgcttcctgctaagggcccttctctgccctttctgccctccttcccatcccacatgctgagccgccacaaagaccaaagaagtgatggcttttctctgtcccctgctgctctgaggggagaggggtgggtctcctgagccactcagatgggaaagtcccttactcggcccctccctccccagcagccccaagctttacactggatgcagcgatcaacccaccactcaccaggcctctcctcccctctgcccccggctcttagctccagctgctccaggtagttggttcatccttccccctctctccctccctgcttccccttcagtgcttacttggctccagccctccagctgcagcccctggggaaaagcagcctcccttctcctctccctccactccctcgctccctccctcagcccctgtctctgccaggtgcctcctctcagtcaggcttcagagcagccctggagacaggagggccatgttaaaagctttttcacagttttaagaagacaagtggagggtgaggatagtggtggggggtctggcaccatctcattgctttaatcccagcaacacaggtggcagcttctcccccttccttcccaccccagtccctcttcccacccctctcttctagcttggtaatgaagtatatttattggtgaaggaaacagctgctgctgcttctcctgctgctgggacctgctcccctgtctcttctccgtgacctttctctagccagggagaagggagagcaggagtattggggctgggccctggggcccaaggaccagctgggtcccctttgctttcttgtgttccagccacctgccatttcctccctgcctcccaccctccctccctgccccctgtcctgcttcccaccccctgcctgcccagcctgggccctgcagtgtggagagacacataagccttactgtcctctgggggcaggagccgagcctttttgttgctccgctcccaggagagtgagggtgacgcaattgattaaaaccattttgttctaggtgtggctggtggcatttgtggggtgcagatgggtcttggaaccaaagtgagggcacctggtccctcacctctgtagctctatgacttagtaaccacacctctactggacagaatgaggcctgccttgaagggtcaccgtgagcagcggccacccagcccagcagggctgagtgcagagcccagctctcatggctgtgatttgtaatcatcagctttcactctctggctgttttctcatcagtaaaataagggacttggaatcttagtggtttttcaaaccattttacattgtgacccaatatacacatgattacttgtagatatgtgtgtgtgtatatatatataaaaaaaatgaacaaaagttttacacaataa

SEQ ID NO: 8461 - DNA, 4275 bp, Homo sapiens
aaacagaggaggaggagggaggggagtgcgtgtgtgagagcgcgcgagggagtgtgagtgtgtgtgagcgcgggtgtgaggcggtgcgcaggggcgggcggaggcgctgtccggccccggccaggcgccgggcggggagcatgggaaggggctagaactgctcgagccccccagccccctccccgggatccgcgccccccttcccgggagaggggccgccccccccggacggacatgggctcctgaagttgcgccgctgccggtcgggggaagagacctgacaggtaattaaatgtgtattttgtggacctgggcttggctggaatgctcaggggtcctgaagatcctattatagcttccttctgttgaaccattaagaaaagatggcgaaagtcaacataactagagacctcatccgtaggcagatcaaggagcggggtgccctgagctttgagcggcgctaccatgtcactgacccctttatccggcggctgggcctggaagcagagctgcagggtcactcaggatgtgtcaactgtctggagtggaatgagaaaggagacttgctggcctctggttccgatgaccagcacacgattgtgtgggacccgctgcaccacaagaagctgctctccatgcacacgggacacaccgcaaatatcttctctgtcaagttcctgcctcacgctggggaccgcatcttgatcacgggggcagccgactctaaggtgcatgtgcacgacctgacagtaaaggagaccatccacatgtttggagaccacacaaaccgggtgaagcgcatcgccacagcgcccatgtggcccaacacattctggagtgctgctgaggatgggcttatccgccagtatgaccttcgagagaacagcaaacactcggaggtgctgattgacctgacagagtactgtggccagctggtggaggccaagtgcctcactgtcaacccccaggacaacaactgcctggcagttggggccagcgggcccttcgtgaggctctatgacatccgcatgatccataaccacagaaagagcatgaagcagagcccttcagcgggtgtgcacaccttctgtgaccggcagaaaccccttccggacggtgcagcccagtattacgtagcaggtcacctgccagtgaagcttcctgactacaacaaccgtttgagagtgctggttgccacctatgtgaccttcagccccaatggcacagagctactagtcaacatggggggggaacaggtctatttgtttgacttgacttacaagcagcggccgtacaccttcctcttgcctagaaaatgccactcctcgggggtccagaatggcaagatgtccaccaacggtgtgtccaacggtgtgtccaatggcctgcaccttcatagcaatggcttccggctgccggagagtaggggacatgtcagcccccaagtagagctaccaccatacctggagcgtgtgaaacagcaagccaatgaggcttttgcctgccagcagtggacccaagccattcagctttacagcaaggctgtgcagagggcccctcacaatgccatgctttatggaaaccgagcagcagcctacatgaagcgcaagtgggatggtgaccactatgatgccctgagggactgcctcaaggccatctccctaaacccatgccacctgaaggcacactttcgcctggcccgctgcctctttgagctcaagtatgtggctgaagccctggagtgcctggacgacttcaaagggaaatttccggagcaggcccacagcagcgcttgtgatgcattgggccgcgacatcacagctgccctcttctctaaaaatgatggtgaggagaagaagggacctggtggcggcgccccagtccgcctccgcagcacgagccgcaaggactccatctcagaggatgaaatggtgctgcgggagcgaagctacgactatcagttccgctactgcggccactgcaacaccaccacggatatcaaagaggccaatttctttggcagcaacgctcagtatatcgtcagtggctctgacgatggctccttcttcatctgggaaaaggagaccaccaacctggtccgtgtgctccaaggggatgagtccattgtcaactgcctgcagccacaccccagctactgcttcctggccaccagtggcatcgatcctgttgtgcggctctggaacccccgaccagagagtgaagacctcacaggccgagtcgtggaagatatggagggtgcttcacaggccaaccagcggcgcatgaatgcagacccgttggaggtgatgctgctcaacatgggctaccggatcacgggcctgagcagtgggggtgccggggcctctgatgatgaggacagctctgagggccaggtgcagtgccggcccagctagaccctccagccctggtccccagcccctgctactggctggaccctctgccctgggcaggaggtcaggggattctgttttggtttgtcttccccaccacccttttttttcatttcccctgttttgtttgttagtttggcgttaggggtggaggttgctacaacttgctggctttcggactctgggctgattgtcccctgactatccccagccctgaaaaaaagagcaggaggggacacccctccatatgcccccccccatctcctgctttcatgtccctggagggctctggcctgcctcaaaaccccttctgcctcaggtggggaggaacaagctgaactgtcttcagggactgtcctgccctttagctggcagcagcaggaggagtgggattcccaattggtaagggctcgccttggcctgttgccactcttgctccctagcctgcaaggctagctcccctgtggtcttcaggaaaggttttgaaaaaggatgggtcccaccctccctccagagccaccagtgttagagcggagcccaaaggaaggatgggagccctggagtgggcaagaccaggccacctgctgaggtcgctgtggagcaccctcgctcctctcctggctactagctctggccctgcacctactctcactggccacctctggaggctctgcctttcccaagggccctggcagagggtggggcactgcaccttaccccacccatccatgccagcacttctgcactacggccattctcctcttgggcgctcctcagcctcactgtgacctttctgccagagctcccagccaggcctactctgctgaggtggcgcttcctgctaagggcccttctctgccctttctgccctccttcccatcccacatgctgagccgccacaaagaccaaagaagtgatggcttttctctgtcccctgctgctctgaggggagaggggtgggtctcctgagccactcagatgggaaagtcccttactcggcccctccctccccagcagccccaagctttacactggatgcagcgatcaacccaccactcaccaggcctctcctcccctctgcccccggctcttagctccagctgctccaggtagttggttcatccttccccctctctccctccctgcttccccttcagtgcttacttggctccagccctccagctgcagcccctggggaaaagcagcctcccttctcctctccctccactccctcgctccctccctcagcccctgtctctgccaggtgcctcctctcagtcaggcttcagagcagccctggagacaggagggccatgttaaaagctttttcacagttttaagaagacaagtggagggtgaggatagtggtggggggtctggcaccatctcattgctttaatcccagcaacacaggtggcagcttctcccccttccttcccaccccagtccctcttcccacccctctcttctagcttggtaatgaagtatatttattggtgaaggaaacagctgctgctgcttctcctgctgctgggacctgctcccctgtctcttctccgtgacctttctctagccagggagaagggagagcaggagtattggggctgggccctggggcccaaggaccagctgggtcccctttgctttcttgtgttccagccacctgccatttcctccctgcctcccaccctccctccctgccccctgtcctgcttcccaccccctgcctgcccagcctgggccctgcagtgtggagagacacataagccttactgtcctctgggggcaggagccgagcctttttgttgctccgctcccaggagagtgagggtgacgcaattgattaaaaccattttgttctagg

SEQ ID NO: 8462 - DNA, 1613 bp, Homo sapiens
gaagcagggagcgcggagtcgttcccgagagaggcggccaggctatgctcgccggtttccggcgttccgctccggccagccagagtctctgtctcaacctgtgtccgtgctccagcagtctcctcagcccggccccgcggcgcggttggcggcggcgccccaggcgcgccccctcctccgatggcggcggagatccagcccaagcctctgacccgcaagccgatcctgctgcagcggatggaggggtcccaggaggtggtgaatatggccgtgatcgtgcccaaagaggagggcgtcatcagcgtctccgaggacaggacagttcgtgtttggttaaagagagacagtggacagtattggccaagcgtataccatgcaatgccttctccatgttcatgcatgtcttttaacccggaaacaagaagactgtccataggtctagacaatggtacaatctcagagtttatattgtcagaagattataacaagatgactcctgtgaaaaactatcaagcgcatcagagcagagtgacgatgatcctgtttgtcctggagctggagtgggtgctgagcacaggacaggacaagcaatttgcctggcactgctctgagagtgggcagcgcctgggaggttatcggaccagtgctgtggcctcaggcctgcaatttgatgttgaaacccggcatgtgtttatcggtgaccactcaggccaagtaacaatcctcaaactggagcaagaaaactgcaccctggtcacaacattcagaggacacacaggtggggtgaccgctctctgttgggacccagtccagcgggtgttgttctcaggcagttcagatcactctgtcatcatgtgggacatcggtgggagaaaaggaacagccatcgagctccaaggacacaacgacagagtccaggccctctcctatgcacagcacacgcgacaattgatctcctgtggcggtgatggtgggattgtcgtctggaacatggacgtggagaggcaggagacccctgaatggttggacagtgattcctgccaaaagtgtgatcagcctttcttctggaacttcaagcaaatgtgggacagtaagaaaattggtctaagacagcaccactgccgcaagtgtgggaaggccgtctgtggcaagtgcagctccaagcgctcctccatccccctgatgggcttcgagtttgaagtgagggtctgtgacagctgccacgaggccatcacagatgaagaacgtgcacccacagccaccttccatgacagtaaacataacattgtgcatgtgcatttcgatgcaaccagaggatggttactgacttctggaactgacaaggttattaagttgtgggatatgaccccagtcgtgtcttgatgactctcccaggaatcagaaagatagtatttactaaagaaacggttgttttaacccaaatcattaccagagtggtaaagcagacatgtgagaagtaagaaagaaactaaagaccctgaatgaatttgcagattacccatgtgcacagtggggacctggccagtgagcactcgcaaggggactcttccaacttgttcatacaatataaaagaagctatttttttaacaaa

SEQ ID NO: 8463 - DNA, 2844 bp, Homo sapiens
agatatctccggcgccgcccgccattttgactccagtgtctcgtttgcagtcggcgctttaggggaactgtcttcctccgcaggcgcgaggctgggtacagggtctattgtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcgtgagattacgtactataggtgaacttttagctcctgcagctccttttgacaagaaatgtggtcgtgaaaattggactgttgcttttgctccagatggttcatactttgcttggtcacaaggacatcgcacagtaaagcttgttccgtggtcccagtgccttcagaactttctcttgcatggcaccaagaatgttaccaattcaagcagtttaagattgccaagacaaaatagtgatggtggtcagaaaaataagcctcgtgaacatattatagactgtggagatatagtctggagtcttgcttttgggtcatcagttccagaaaaacagagtcgctgtgtaaatatagaatggcatcgcttcagatttggacaagatcagctacttcttgctacagggttgaacaatgggcgtatcaaaatatgggatgtatatacaggaaaactcctccttaacttggtagatcatactgaagtggtcagagatttaacttttgctccagatggaagcttgatcctggtgtcagcttcaagagacaaaactctcagagtatgggacctgaaagatgatggaaacatgatgaaagtattgagggggcatcagaattgggtgtacagctgtgcattctctcctgactcttctatgctgtgttcagtcggagccagtaaagcagttttcctttggaatatggataaatacaccatgatacggaaactagaaggacatcaccatgatgtggtagcttgtgacttttctcctgatggagcattactggctactgcatcttatgatactcgagtatatatctgggatccacataatggagacattctgatggaatttgggcacctgtttcccccacctactccaatatttgctggaggagcaaatgaccggtgggtacgatctgtatcttttagccatgatggactgcatgttgcaagccttgctgatgataaaatggtgaggttctggagaattgatgaggattatccagtgcaagttgcacctttgagcaatggtctttgctgtgccttctctactgatggcagtgttttagctgctgggacacatgacggaagtgtgtatttttgggccactccacggcaggtccctagcctgcaacatttatgtcgcatgtcaatccgaagagtgatgcccacccaagaagttcaggagctgccgattccttccaagcttttggagtttctctcgtatcgtatttagaagattctgccttccctagtagtagggactgacagaatacacttaacacaaacctcaagctttactgacttcaattatctgtttttaaagacgtagaagatttatttaatttgatatgttcttgtactgcattttgatcagttgagcttttaaaatattatttatagacaatagaagtatttctgaacatatcaaatataaatttttttaaagatctaactgtgaaaacatacatacctgtacatatttagatataagctgctatatgttgaatggacccttttgcttttctgatttttagttctgacatgtatatattgcttcagtagagccacaatatgtatctttgctgtaaagtgcaaggaaattttaaattctgggacactgagttagatggtaaatactgacttacgaaagttgaattgggtgaggcgggcaaatcacctgaggtcagcagtttgagactagcctggcaaacatgatgaaaccctgtctctactaaaaatacaaaaaaaaaaaaaattagccaggcgtggtggtgcacacctgtagtcctagctacttgggaggctgaggcaggagaattgcttgaacccaggaggtggaggttgcagtaagccaagatcacaccactgcactccaacctggacaacagagcgagactccatctcaaaaaaaaaaaaaaattgtgttgcctcatacgaaatgtatttggttttgttggagagtgtcagactgatctggaagtgaaacacagtttatgtacagggaaaaggattttattatccttaggaatgtcatccaagacgtagagcttgaatgtgacgttatttaaaaacaacaacaaagaaggcagagccaggatataactagaaaaaggatgtctttttttttttttttactccccctctaaacactgctgctgccttaattttagaaagcagcttactagtttacccttgtggtataaagtattataaattgttgtgaatttgaagaatccgtctactgtattattgctaaatattttgtttatactaagggacaattattttaagaccatggatttaaaaaaaaaaaaaaaaactctgtttctgcaggggatgatattggtgagttgccaaagaagcaatacagcatatctgcttttgccttctgttgtttatcttacctgcagatattaagaatgtatgcattatgtaaaatgctcaattatatatttttgttgagttttttaattaaagacttgtaaaaaaaaaaaa

SEQ ID NO: 8464 - DNA, 1611 bp, Homo sapiens
cggcgctttaggggaactgtcttcctccgcaggcgcgaggctgggtacagggtctattgtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcggaaaactcctccttaacttggtagatcatactgaagtggtcagagatttaacttttgctccagatggaagcttgatcctggtgtcagcttcaagagacaaaactctcagagtatgggacctgaaagatgatggaaacatgatgaaagtattgagggggcatcagaattgggtgtacagctgtgcattctctcctgactcttctatgctgtgttcagtcggagccagtaaagcagttttcctttggaatatggataaatacaccatgatacggaaactagaaggacatcaccatgatgtggtagcttgtgacttttctcctgatggagcattactggctactgcatcttatgatactcgagtatatatctgggatccacataatggagacattctgatggaatttgggcacctgtttcccccacctactccaatatttgctggaggagcaaatgaccggtgggtacgatctgtatcttttagccatgatggactgcatgttgcaagccttgctgatgataaaatggtgaggttctggagaattgatgaggattatccagtgcaagttgcacctttgagcaatggtctttgctgtgccttctctactgatggcagtgttttagctgctgggacacatgacggaagtgtgtatttttgggccactccacggcaggtccctagcctgcaacatttatgtcgcatgtcaatccgaagagtgatgcccacccaagaagttcaggagctgccgattccttccaagcttttggagtttctctcgtatcgtatttagaagattctgccttccctagtagtagggactgacagaatacacttaacacaaacctcaagctttactgacttcaattatctgtttttaaagacgtagaagatttatttaatttgatatgttcttgtactgcattttgatcagttgagcttttaaaatattatttatagacaatagaagtatttctgaacatatcaaatataaatttttttaaagatctaactgtgaaaacatacatacctgtacatatttagatataagctgctatatgttgaatggacccttttgcttttctgatttttagttctgacatgtatatattgcttcagtagagccacaatatgtatctttgctgtaaagtgcaaggaaattttaaattctgggacactgagttagatggtaaatactgacttacgaaagttgaattgggtgaggcgggcaaatcacctgaggtcagcagtttgagactagcctggcaaacatgatgaaaccctgtctctactaaaaatacaaaaaaaaaa

SEQ ID NO: 8465 - DNA, 1149 bp, Homo sapiens
agtgtctcgtttgcagtcggcgctttaggggaactgtcttcctccgcaggcgcgaggctgggtacagggtctattgtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcgatggttcatactttgcttggtcacaaggacatcgcacagtaaagcttgttccgtggtcccagtgccttcagaactttctcttgcatggcaccaagaatgttaccaattcaagcagtttaagattgccaagacaaaatagtgatggtggtcagaaaaataagcctcgtgaacatattatagactgtggagatatagtctggagtcttgcttttgggtcatcagttccagaaaaacagagtcgctgtgtaaatatagaatggcatcgcttcagatttggacaagatcagctacttcttgctacagggttgaacaatgggcgtatcaaaatatgggatgtatatacaggaaaactcctccttaacttggtagatcatactgaagtggtcagagatttaacttttgctccagatggaagcttgatcctggtgtcagcttcaagagacaaaactctcagagtatgggacctgaaagatgatggaaacatgatgaaagtattgagggggcatcagaattgggtgtacagctgtgcattctctcctgactcttctatgctgtgttcagtcggagccagtaaagcagtggtggcagcaatattggtgtgattgaggttatgctggcaccactcgcacacaggcgcacaatggtgttagctgggcagaaagagtggcatctctggctaccgggctgggggcgacctttaccataggatgaagtaaccttgcattcggctgcaaggtgtactgtacgtacacaggtgctggtcgatgtccactttctgcttttctttctttctttttttcttttttaaagtaatttcccccacagta

SEQ ID NO: 8466 - DNA, 2646 bp, Homo sapiens
catgtgacgggaagcagctgatggcctctccgggcggcggcggcggcctggccggggcgggcggcgcgggggcggcatgagggcccgcggcccggggggctgaggcgcccgccgcctgccgcgggggccgctcgcgtcctccatggaggccggagaggaaccgctgctgctggccgaactcaagcccgggcgcccccaccagtttgattggaagtccagctgtgaaacctggagcgtcgccttctccccagatggctcctggtttgcttggtctcaaggacactgcatcgtcaaactgatcccctggccgttggaggagcagttcatccctaaagggtttgaagccaaaagccgaagtagcaaaaatgagacgaaagggcggggcagcccaaaagagaagacgctggactgtggtcagattgtctgggggctggccttcagcccgtggccttccccacccagcaggaagctctgggcacgccaccacccccaagtgcccgatgtctcttgcctggttcttgctacgggactcaacgatgggcagatcaagatctgggaggtgcagacagggctcctgcttttgaatctttccggccaccaagatgtcgtgagagatctgagcttcacacccagtggcagtttgattttggtctccgcgtcacgggataagactcttcgcatctgggacctgaataaacacggtaaacagattcaagtgttatcgggccacctgcagtgggtttactgctgttccatctccccagactgcagcatgctgtgctctgcagctggagagaagtcggtctttctatggagcatgaggtcctacacgttaattcggaagctagagggccatcaaagcagtgttgtctcttgtgacttctcccccgactctgccctgcttgtcacggcttcttacgataccaatgtgattatgtgggacccctacaccggcgaaaggctgaggtcactccaccacacccaggttgaccccgccatggatgacagtgacgtccacattagctcactgagatctgtgtgcttctctccagaaggcttgtaccttgccacggtggcagatgacagactcctcaggatctgggccctggaactgaaaactcccattgcatttgctcctatgaccaatgggctttgctgcacattttttccacatggtggagtcattgccacagggacaagagatggccacgtccagttctggacagctcctagggtcctgtcctcactgaagcacttatgccggaaagcccttcgaagtttcctaacaacttaccaagtcctagcactgccaatccccaagaaaatgaaagagttcctcacatacaggactttttaagcaacaccacatcttgtgcttctttgtagcagggtaaatcgtcctgtcaaagggagttgctggaataatgggccaaacatctggtcttgcattgaaatagcatttctttgggattgtgaatagaatgtagcaaaaccagattccagtgtactagtcatggatctttctctccctggcatgtgaaagtcagtcttagaggaagagattccacttgcacggcaacagagccttacgttaaattttcagtccagttatgaacagcaagtgttgaactctttctgcttgttttgattcaaagtgcagttactgatgttgttttgattatgcaactaagtaggcctccagagcctctctagtggcagagcagctcacactccctccgctgggaacgatggcttctgcctagtacctatccttgtgtttctgatgcagtggtagcattggttcaagttctctcctgctgtggtcagagttgcttcgatgttggccaagtgcttttcttcttgggctcccttctgacctgcaggacagttttcctggagccatttggtatgaggtattaatttagcttaactaaattacaggggactcagaggccgtgctcctgaccgatccagacactattactggctttttttttttttttttaacaatggtgtgcatgtgcaggaaatgacaaatttgtatgtcagattatacaaggatgtattcttaaaccgcatgactattcagatggctactgagttatcagtggccatttattagcatcatatttatttgtattttctcaacagatgttaaggtacaactgtgtttttctcgattatctaaaaaccatagtacttaaattgaacagttgcaaagatgtcttaattgtgtaaagaattggtgtagtcatgactttagctgatactcttatgtacgagatctgtctctgctgtttaacttcattggattaatcagctggtttcaactctactgcgaaacaaaaatagctccttaaaagtactgttctccttcagtggcatgtagttatctaatcaagacacctcattcaaacaaaacctgccttaggaaaatttaatatattttaaattattttaaaagaaatacaacatcttattctttagctttcttaatcggtgctttatggaggccagtgtaacgttacatgactcgttgagaaagttgaggaatttcctctaccacctttgttgcttgaagaaaaacatgtcttttcaaaatgagaggctttcattgaagaaaagaaaaaaacaacagttaaaagc

SEQ ID NO: 8467 - DNA, 1419 bp, Homo sapiens
gtgaaacctggagcgtcgccttctccccagatggctcctggtttgcttggtctcaaggacactgcatcgtcaaactgatcccctggccgttggaggagcagttcatccctaaagggtttgaagccaaaagccgaagtagcaaaaatgagacgaaagggcggggcagcccaaaagagaagacgctggactgtggtcagattgtctgggggctggccttcagcccgtggccttccccacccagcaggaagctctgggcacgccaccacccccaagtgcccgatgtctcttgcctggttcttgctacgggactcaacgatgggcagatcaagatctgggaggtgcagacagggctcctgcttttgaatctttccggccaccaagatgtcgtgagagatctgagcttcacacccagtggcagtttgattttggtctccgcgtcacgggataagactcttcgcatctgggacctgaataaacacggtctttctatggagcatgaggtcctacacgttaattcggaagctagagggccatcaaagcagtgttgtctcttgtgacttctcccccgactctgccctgcttgtcacggcttcttacgataccaatgtgattatgtgggacccctacaccggcgaaaggctgaggtcactccaccacacccaggttgaccccgccatggatgacagtgacgtccacattagctcactgagatctgtgtgcttctctccagaaggcttgtaccttgccacggtggcagatgacagactcctcaggatctgggccctggaactgaaaactcccattgcatttgctcctatgaccaatgggctttgctgcacattttttccacatggtggagtcattgccacagggacaagagatggccacgtccagttctggacagctcctagggtcctgtcctcactgaagcacttatgccggaaagcccttcgaagtttcctaacaacttaccaagtcctagcactgccaatccccaagaaaatgaaagagttcctcacatacaggactttttaagcaacaccacatcttgtgcttctttgtagcagggtaaatcgtcctgtcaaagggagttgctggaataatgggccaaacatctggtcttgcattgaaatagcatttctttgggattgtgaatagaatgtagcaaaaccagattccagtgtactagtcatggatctttctctccctggcatgtgaaagtcagtcttagaggaagagattccacttgcacggcaacagagccttacgttaaattttcagtccagttatgaacagcaagtgttgaactctttctgcttgttttgattcaaagtgcagttactgatgttgttttgattatgcaactaagtaggcctccagagcctctctagtggcagagcagctcacactccctccgct

SEQ ID NO: 8468 - DNA, 935 bp, Homo sapiens
atgagggcccgcggcccggggggctgaggcgcccgccgcctgccgcgggggccgctcgcgtcctccatggaggccggagaggaaccgctgctgctggccgaactcaagcccgggcgcccccaccagtttgattggaagtccagctgtgaaacctggagcgtcgccttctccccagatggctcctggtttgcttggtctcaaggacactgcatcgtcaaactgatcccctggccgttggaggagcagttgtaaacagattcaagtgttatcgggccacctgcagtgggtttactgctgttccatctccccagactgcagcatgctgtgctctgcagctggagagaagtcggtctttctatggagcatgaggtcctacacgttaattcggaagctagagggccatcaaagcagtgttgtctcttgtgacttctcccccgactctgccctgcttgtcacggcttcttacgataccaatgtgattatgtgggacccctacaccggcgaaaggctgaggtcactccaccacacccaggttgaccccgccatggatgacagtgacgtccacattagctcactgagatctgtgtgcttctctccagaaggcttgtaccttgccacggtggcagatgacagactcctcaggatctgggccctggaactgaaaactcccattgcatttgctcctatgaccaatgggctttgctgcacattttttccacatggtggagtcattgccacagggacaagagatggccacgtccagttctggacagctcctagggtcctgtcctcactgaagcacttatgccggaaagcccttcgaagtttcctaacaacttaccaagtcctagcactgccaatccccaagaaaatgaaagagttcctcacatacaggactttttaagcaacaccacatcttgtgcttctttgtagca

SEQ ID NO: 8469 - DNA, 2124 bp, Homo sapiens
ctttctgatagcaggcagccatcttgcctggagcctgagaaagggaggagagacagaaggaaccggcgacagtggtctcagggccgctccggggggcctcaagaaccggaggcagccccggaggtggtccccgatcccgggctatgctcttggatctgagaagggaaggcggagggcggcggggacaagatgggtggagaatgtcaagcaaggaatgctaggcgggggaggggcgttgctatggcgactggggaggggcggtgtctgttctgaatcgctgtgtgtcacccgggcgctgcccaggaagggcagggctggggtgatgaccatggtaacacccgggggggagttcgtgacatctccggcgcggagggactcgatgtctatggcaatggtcgcctggtggaagggacggaactagatcccttcgctcgggacgctcacattccaggcccttgtcctgcaggctgccgcgggcggacacgccagaggaggaggccggggaatggccgcggtgtggcagcaagtcttagcagtggacgcgaggtacaacgcgtaccgcacaccaacgtttccacagtttcggacgcagtatatccgccggcgcagccagctgctgcgggagaatgccaaggctgggcaccccccagcgctgcgtcggcagtacctgaggcttcgggggcagctgctgggccagcgctacgggcccctctccgagccaggcagtgctcgtgcctatagcaacagcatcgtccgcagtagccgcactactcttgaccgcatggaggactttgaggatgatcctcgggccctgggggcccgtgggcaccgtcgttctgtcagcagaggctcctaccagctgcaggcgcagatgaaccgtgccgtctatgaggacaggccccctggcagcgtggtgcccacgtcagcagcagaggcaagtcgggccatggccggggacacgtcactgagcgagaactatgcctttgcgggcatgtatcatgtttttgaccagcacgtggatgaggcagtcccaagggtgcgcttcgccaatgatgaccgacaccgcctggcctgctgctcactcgacggcagcatctccctgtgccagctggtgcctgccccacccacagtgcttcgcgtgctacggggccacacccgtggtgtctccgacttcgcctggtccctctccaatgacatcctcgtgtccacctcactggatgccaccatgcgcatctgggcctctgaggatggtcgctgcatccgagagatccctgaccccgatagcgctgaactgctctgctgcaccttccagcctgtcaacaacaacctcactgtggtggggaacgccaagcacaacgtgcatgtcatgaacatctccacaggcaagaaagtgaaggggggctccagcaagctgacaggccgtgtccttgctctgtcctttgatgcccctggccggctgctctgggcgggtgatgaccatggcagtgtcttctctttcctctttgatatggccacagggaagctgaccaaagccaagcgtttggtggtgcatgaggggagccctgtgaccagcatctcagcccggtcctgggtcagccgcgaggcccgggatccctcactgctcatcaatgcttgcctcaacaagttgctgctctacagggtggtagacaacgaggggaccctgcagctgaagagaagcttccccatcgagcagagctcacatcctgtgcgcagcatcttctgtcccctcatgtccttccgccagggggcctgcgtggtgacgggcagtgaggacatgtgcgtgcacttctttgatgtggagcgggcggccaaggctgctgtcaacaagctgcagggccacagtgcacctgtgcttgatgtcagcttcaactgcgacgagagcctactggcctccagtgacgccagcggcatggtcatcgtctggaggcgggagcagaagtagggtcctgtcggccctgctgctgtcctccatcccacccctcttactccagcctcgtgttgtaaataaagtttcggtggtcatgctgagggccggctcccagctctgccggggacggacagggcagagggcagcgggcagctccaggaacacggtggaacggg

SEQ ID NO: 8470 - DNA, 1551 bp, Homo sapiens
acgtccggggcggtggggaaggcaagatggcggcgcccatggaggtggccgtgtgtacggactcggcggccccgatgtggagctgcatcgtgtgggaacttcactcgggcgccaacctgctcacctaccgcggcggccaggcgggaccccgcggcctggcgctgctcaatggcgagtatctgctggcggcgcagctgggcaagaattacatcagcgcctgggagctccagcggaaggaccagctccagcagaagatcatgtgccccgggcctgtcacctgtctgactgcatcacccaatggtctctacgtcctggcaggagttgcagaaagcatccacctgtgggaggtctccaccgggaaccttctggtcatcctgagtcgacactaccaggacgtctcctgccttcagttcacaggggacagcagccacttcatctcagggggcaaggactgcctggtgctggtttggagcctctgcagcgtgctgcaggccgacccctccaggattccggcgcccaggcacgtctggtctcaccacgcgctccccatcacggacctgcactgcggctttgggggccccctggcccgggtggccacctcctcactggaccagacggtgaagctatgggaggtctcctcgggggagctgctgctctccgtcctctttgacgtgtccatcatggcagtgaccatggacctggctgagcaccatatgttctgcgggggcagtgagggctccatcttccaggtcgacctcttcacctggcccggacagagggagaggagcttccacccagagcaggacgccgggaaggtcttcaaagggcacaggaaccaggtgacttgcctgtcagtgtccactgacggcagcgtgctgctctcaggctcccacgacgagaccgtgcgcctctgggacgtgcagagcaagcagtgcatccggacggtggccctcaaaggcccagtcaccaatgccgccatcctgctggcgcccgtcagcatgctgagctcagacttcaggcccagcctgccgctgccccacttcaacaagcacctgctgggcgccgagcacggggacgagccgcgccacgggggcctcactctgcgcctgggcctccaccagcagggctcggagcccagctacctggaccgcacggagcagctgcaggccgtcctgtgcagcaccatggagaagagcgtgctcggcggccaggaccagctgcgcgtccgtgtgacggagctggaggacgaggtgcgcaacctgcgcaagatcaatcgggacctgttcgacttctccacgcgcttcatcacgcggccggccaagtgaggcccggagaccccggcccgaggcgcccaggcctgagccccatgcctcccagcaaccagggcccgcgggtgtggcccccaccagcccaggcctggactctcctcagttctgtgtcgtgttcgggtttttcctctgtgactgggccgtcttggtgtctcgtggcacgcgtcacagtggtgctagtctgtttttaacaaaagaggatgaaaagcccctcctctccggc

SEQ ID NO: 8471 - DNA, 2616 bp, Homo sapiens
gaagagggagcaccaggaacagcgcctgcgcggtgggcgtgatccgggcacttagggcaggatgaacgctgctttccaagatggcgacggagggaggagggaaggagatgaacgagattaagacccaattcaccacccgggaaggtctgtacaagctgctgccgcactcggagtacagccggcccaaccgggtgcccttcaactcgcagggatccaaccctgtccgcgtctccttcgtaaacctcaacgaccagtctggcaacggcgaccgcctctgcttcaatgtgggccgggagctgtacttctatatctacaagggggtccgcaaggctgctgacttgagtaaaccaatagataaaaggatatacaaaggaacacagcctacttgtcatgacttcaaccacctaacagccacagcagaaagtgtctctctcctagtgggcttttccgcaggccaagtccagcttatagacccaatcaaaaaagaaactagcaaactttttaatgaggaaagactaatagacaagtcacgagttacctgtgtcaaatgggttcccggttcggaaagccttttcctagtagcccactcgagtgggaacatgtacttatataatgtggagcacacttgtggcaccacagccccccactaccagcttctgaagcagggagagagctttgccgtgcacacttgcaagagcaaatccacgaggaaccctctccttaagtggacggtgggcgagggggccctcaacgagtttgctttctccccagatggcaagttcttagcgtgcgtgagccaggacgggtttctgcgggtgttcaactttgactcagtggagctgcacggtacgatgaaaagctactttgggggcttgctgtgtgtgtgctggagcccggatggcaagtacatcgtgacaggtggggaggacgacttggtgacagtctggtcctttgtagactgccgagtaatagccagaggccacgggcacaagtcctgggtcagtgttgtagcgtttgacccttataccactagtgtagaagaaggtgaccctatggagtttagtggcagcgatgaggacttccaagaccttcttcattttggcagagatcgagcaaatagtacacagtccaggctctccaaacggaactctacagacagccgccccgtaagtgtcacgtatcggtttggttccgtgggccaggacacacagctctgtttatgggaccttacagaagatatccttttccctcaccaacccctctcaagagcaaggacacacacaaatgtcatgaatgccacgagtcctcctgctggaagcaatgggaacagtgttacaacacccgggaactctgtgccgcctcctctgccacggtccaacagccttccacattcagcagtctcaaatgctggcagcaaaagcagtgtcatggacggggccattgcttctggggtcagcaaatttgcaacactttcactacatgaccggaaggagaggcaccacgagaaagatcacaagcgaaatcatagcatgggacacatttctagcaagagcagtgacaaactgaatctagttaccaaaaccaaaacggaccctgctaaaactctgggaacgcccctgtgtcctcgaatggaagatgttcccttgttagagccgctgatatgtaaaaagatagcacatgagagactgactgtactaatatttcttgaagactgtatagtcactgcttgtcaggagggatttatttgcacatggggaaggcctggtaaagtgggctcattgtcatccccaagccaggccagttctccaggtggaactgtagtgtagcgacctcactgctgcgcgcacagtctcccgggacttggactcgagggagtgacgaggaggagctccgagctgcgcctgagccgtgccagccggcggacctcaggcggtggacgtcggcgatagccgtgtggacggtgaccggctcactctgcggcgccgtgctcccgctgctcacccaaagaagttgtttccattttaaaccggtcttttggggctgcagtaaaaaataagaaatggagttttcttgctttttactctaaaattcaatgtaattaaatttcatatatatataatatatacatatatacatagtgtaaaataaaatgtttcttggacaagaaatcccctgaaattcagctgttatagtgcttcactgtttttgcactgatttttctataccttaggtggtcagaagacaaccttgaatgcactcatagagaaaactgttactttctgacgtaatgtaattcaggaagacagacgctgcaatcacagattttaaaaaattgtttgcacttaaaaatagttgaatgctggtggaaagttactttgcagatgggtgtaaggactcatggccctctgaggtgcggcgtgaagatgccctttttacccgttgacgtttattttacgtaaaataaactgttgtttccaatgcaatcaactctgtattatatgtataaatattgtaattctgcaattggggaaaatagttacttcactagtaattttcatcatttaagagtgatatttctaattcacaaaagttaatattaaaactatcttgaatata

SEQ ID NO: 8472 - DNA, 2391 bp, Homo sapiens
acttagggcaggatgaacgctgctttccaagatggcgacggagggaggagggaaggagatgaacgagattaagacccaattcaccacccgggaaggtctgtacaagctgctgccgcactcggagtacagccggcccaaccgggtgcccttcaactcgcagggatccaaccctgtccgcgtctccttcgtaaacctcaacgaccagtctggcaacggcgaccgcctctgcttcaatgtgggccgggagctgtacttctatatctacaagggggtccgcaaggctgctgacttgagtaaaccaatagataaaaggatatacaaaggaacacagcctacttgtcatgacttcaaccacctaacagccacagcagaaagtgtctctctcctagtgggcttttccgcaggccaagtccagcttatagacccaatcaaaaaagaaactagcaaactttttaatgaggaaagactaatagacaagtcacgagttacctgtgtcaaatgggttcccggttcggaaagccttttcctagtagcccactcgagtgggaacatgtacttatataatgtggagcacacttgtggcaccacagccccccactaccagcttctgaagcagggagagagctttgccgtgcacacttgcaagagcaaatccacgaggaaccctctccttaagtggacggtgggcgagggggccctcaacgagtttgctttctccccagatggcaagttcttagcgtgcgtgagccaggacgggtttctgcgggtgttcaactttgactcagtggagctgcacggtacgatgaaaagctactttgggggcttgctgtgtgtgtgctggagcccggatggcaagtacatcgtgacaggtggggaggacgacttggtgacagtctggtcctttgtagactgccgagtaatagccagaggccacgggcacaagtcctgggtcagtgttgtagcgtttgacccttataccactagtgtagaagaaggtgaccctatggagtttagtggcagcgatgaggacttccaagaccttcttcattttggcagagatcgagcaaatagtacacagtccaggctctccaaacggaactctacagacagccgccccgtaagtgtcacgtatcggtttggttccgtgggccaggacacacagctctgtttatgggaccttacagaagatatccttttccctcaccaacccctctcaagagcaaggacacacacaaatgtcatgaatgccacgagtcctcctgctggaagcaatgggaacagtgttacaacacccgggaactctgtgccgcctcctctgccacggtccaacagccttccacattcagcagtctcaaatgctggcagcaaaagcagtgtcatggacggggccattgcttctggggtcagcaaatttgcaacactttcactacatgaccggaaggagaggcaccacgagaaagatcacaagcgaaatcatagcatgggacacatttctagcaagagcagtgacaaactgaatctagttaccaaaaccaaaacggaccctgctaaaactctgggaacgcccctgtgtcctcgaatggaagatgttcccttgttagagccgctgatatgtaaaaagatagcacatgagagactgactgtactaatatttcttgaagactgtatagtcactgcttgtcaggagggatttatttgcacatggggaaggcctggtaaagtggtaagttttaatccttaatgctgcaccagatctagaacttgaataggtagtgacttttttctttttcgtgggaggggtggggtgtacaatgaatgtgaatgacacttcttattcttaatgtaaatctcaatgcatcagagccataattttggatactgcatgccatgtaattctgaatcatttgataatttaccttagagcatttaaaaaaatataatcaaactaattgccagccaagtcagtcatcctcctgggagtatatagagtcccaaggttagcgctcctgtattagactatttcaattttaggaaaatcatgaccatgtggggaaacaatgactttaaaatgctgaaattaaaatttatgctttaactggaatattttttgcttaactactcaattagaatattgtacacctgatcaatgtgtgttcagcacagatggccatgaattgtcatttatagtccaattttttatcttaatcataaaatgtttaggaatctatgaaatttaactttaggaacaaaacgtttagcagggttgattgatattatttttacattgttctggcaatccacagaaagagaagagccttaatttttaaaacccattttagtcattttatgacaattaaagttgtttaataaacatcttttttcaaagaagca

SEQ ID NO: 8473 - DNA, 2347 bp, Homo sapiens
gcgacggagggaggagggaaggagatgaacgagattaagacccaattcaccacccgggaaggtctgtacaagctgctgccgcactcggagtacagccggcccaaccgggtgcccttcaactcgcagggatccaaccctgtccgcgtctccttcgtaaacctcaacgaccagtctggcaacggcgaccgcctctgcttcaatgtgggccgggagctgtacttctatatctacaagggggtccgcaagagactaatagacaagtcacgagttacctgtgtcaaatgggttcccggttcggaaagccttttcctagtagcccactcgagtgggaacatgtacttatataatgtggagcacacttgtggcaccacagccccccactaccagcttctgaagcagggagagagctttgccgtgcacacttgcaagagcaaatccacgaggaaccctctccttaagtggacggtgggcgagggggccctcaacgagtttgctttctccccagatggcaagttcttagcgtgcgtgagccaggacgggtttctgcgggtgttcaactttgactcagtggagctgcacggtacgatgaaaagctactttgggggcttgctgtgtgtgtgctggagcccggatggcaagtacatcgtgacaggtggggaggacgacttggtgacagtctggtcctttgtagactgccgagtaatagccagaggccacgggcacaagtcctgggtcagtgttgtagcgtttgacccttataccactagtgtagaagaaggtgaccctatggagtttagtggcagcgatgaggacttccaagaccttcttcattttggcagagatcgagcaaatagtacacagtccaggctctccaaacggaactctacagacagccgccccgtaagtgtcacgtatcggtttggttccgtgggccaggacacacagctctgtttatgggaccttacagaagatatccttttccctcaccaacccctctcaagagcaaggacacacacaaatgtcatgaatgccacgagtcctcctgctggaagcaatgggaacagtgttacaacacccgggaactctgtgccgcctcctctgccacggtccaacagccttccacattcagcagtctcaaatgctggcagcaaaagcagtgtcatggacggggccattgcttctggggtcagcaaatttgcaacactttcactacatgaccggaaggagaggcaccacgagaaagatcacaagcgaaatcatagcatgggacacatttctagcaagagcagtgacaaactgaatctagttaccaaaaccaaaacggaccctgctaaaactctgggaacgcccctgtgtcctcgaatggaagatgttcccttgttagagccgctgatatgtaaaaagatagcacatgagagactgactgtactaatatttcttgaagactgtatagtcactgcttgtcaggagggatttatttgcacatggggaaggcctggtaaagtgggctcattgtcatccccaagccaggccagttctccaggtggaactgtagtgtagcgacctcactgctgcgcgcacagtctcccgggacttggactcgagggagtgacgaggaggagctccgagctgcgcctgagccgtgccagccggcggacctcaggcggtggacgtcggcgatagccgtgtggacggtgaccggctcactctgcggcgccgtgctcccgctgctcacccaaagaagttgtttccattttaaaccggtcttttggggctgcagtaaaaaataagaaatggagttttcttgctttttactctaaaattcaatgtaattaaatttcatatatatataatatatacatatatacatagtgtaaaataaaatgtttcttggacaagaaatcccctgaaattcagctgttatagtgcttcactgtttttgcactgatttttctataccttaggtggtcagaagacaaccttgaatgcactcatagagaaaactgttactttctgacgtaatgtaattcaggaagacagacgctgcaatcacagattttaaaaaattgtttgcacttaaaaatagttgaatgctggtggaaagttactttgcagatgggtgtaaggactcatggccctctgaggtgcggcgtgaagatgccctttttacccgttgacgtttattttacgtaaaataaactgttgtttccaatgcaatcaactctgtattatatgtataaatattgtaattctgcaattggggaaaatagttacttcactagtaattttcatcatttaagagtgatatttctaattcacaaaagttaatattaaaactatcttgaat

SEQ ID NO: 8474 - DNA, 2235 bp, Homo sapiens
ggtgggcgtgatccgggcacttagggcaggatgaacgctgctttccaagatggcgacggagggaggagggaaggagatgaacgagattaagacccaattcaccacccgggaaggtctgtacaagctgctgccgcactcggagtacagccggcccaaccgggtgcccttcaactcgcagggatccaaccctgtccgcgtctccttcgtaaacctcaacgaccagtctggcaacggcgaccgcctctgcttcaatgtgggccgggagctgtacttctatatctacaagggggtccgcaagacaatcccatgagagactaatagacaagtcacgagttacctgtgtcaaatgggttcccggttcggaaagccttttcctagtagcccactcgagtgggaacatgtacttatataatgtggagcacacttgtggcaccacagccccccactaccagcttctgaagcagggagagagctttgccgtgcacacttgcaagagcaaatccacgaggaaccctctccttaagtggacggtgggcgagggggccctcaacgagtttgctttctccccagatggcaagttcttagcgtgcgtgagccaggacgggtttctgcgggtgttcaactttgactcagtggagctgcacggtacgatgaaaagctactttgggggcttgctgtgtgtgtgctggagcccggatggcaagtacatcgtgacaggtggggaggacgacttggtgacagtctggtcctttgtagactgccgagtaatagccagaggccacgggcacaagtcctgggtcagtgttgtagcgtttgacccttataccactagtgtagaagaaggtgaccctatggagtttagtggcagcgatgaggacttccaagaccttcttcattttggcagagatcgagcaaatagtacacagtccaggctctccaaacggaactctacagacagccgccccgtaagtgtcacgtatcggtttggttccgtgggccaggacacacagctctgtttatgggaccttacagaagatatccttttccctcaccaacccctctcaagagcaaggacacacacaaatgtcatgaatgccacgagtcctcctgctggaagcaatgggaacagtgttacaacacccgggaactctgtgccgcctcctctgccacggtccaacagccttccacattcagcagtctcaaatgctggcagcaaaagcagtgtcatggacggggccattgcttctggggtcagcaaatttgcaacactttcactacatgaccggaaggagaggcaccacgagaaagatcacaagcgaaatcatagcatgggacacatttctagcaagagcagtgacaaactgaatctagttaccaaaaccaaaacggaccctgctaaaactctgggaacgcccctgtgtcctcgaatggaagatgttcccttgttagagccgctgatatgtaaaaagatagcacatgagagactgactgtactaatatttcttgaagactgtatagtcactgcttgtcaggagggatttatttgcacatggggaaggcctggtaaagtggtaagttttaatccttaatgctgcaccagatctagaacttgaataggtagtgacttttttctttttcgtgggaggggtggggtgtacaatgaatgtgaatgacacttcttattcttaatgtaaatctcaatgcatcagagccataattttggatactgcatgccatgtaattctgaatcatttgataatttaccttagagcatttaaaaaaatataatcaaactaattgccagccaagtcagtcatcctcctgggagtatatagagtcccaaggttagcgctcctgtattagactatttcaattttaggaaaatcatgaccatgtggggaaacaatgactttaaaatgctgaaattaaaatttatgctttaactggaatattttttgcttaactactcaattagaatattgtacacctgatcaatgtgtgttcagcacagatggccatgaattgtcatttatagtccaattttttatcttaatcataaaatgtttaggaatctatgaaatttaactttaggaacaaaacgtttagcagggttgattgatattatttttacattgttctggcaatccacagaaagagaagagccttaatttttaaaacccattttagtcattttatgacaattaaagttgtttaataaacatcttttttcaaaga

SEQ ID NO: 8475 - DNA, 2067 bp, Homo sapiens
gctttccaagatggcgacggagggaggagggaaggagatgaacgagattaagacccaattcaccacccgggaaggtctgtacaagctgctgccgcactcggagtacagccggcccaaccgggtgcccttcaactcgcagggatccaaccctgtccgcgtctccttcgtaaacctcaacgaccagtctggcaacggcgaccgcctctgcttcaatgtgggccgggagctgtacttctatatctacaagggggtccgcaaggctgctgacttgagtaaaccaatagataaaaggatatacaaaggaacacagcctacttgtcatgacttcaaccacctaacagccacagcagaaagtgtctctctcctagtgggcttttccgcaggccaagtccagcttatagacccaatcaaaaaagaaactagcaaactttttaatgaggaaaactcttgtcagcacttgtggaaggtggattggaatgaagaaagacagaatgaaggtagcaagaccagtgaggaggctctagtaactgtccagagactaatagacaagtcacgagttacctgtgtcaaatgggttcccggttcggaaagccttttcctagtagcccactcgagtgggaacatgtacttatataatgtggagcacacttgtggcaccacagccccccactaccagcttctgaagcagggagagagctttgccgtgcacacttgcaagagcaaatccacgaggaaccctctccttaagtggacggtgggcgagggggccctcaacgagtttgctttctccccagatggcaagttcttagcgtgcgtgagccaggacgggtttctgcgggtgttcaactttgactcagtggagctgcacggtacgatgaaaagctactttgggggcttgctgtgtgtgtgctggagcccggatggcaagtacatcgtgacaggtggggaggacgacttggtgacagtctggtcctttgtagactgccgagtaatagccagaggccacgggcacaagtcctgggtcagtgttgtagcgtttgacccttataccactagtgtagaagaaggtgaccctatggagtttagtggcagcgatgaggacttccaagaccttcttcattttggcagagatcgagcaaatagtacacagtccaggctctccaaacggaactctacagacagccgccccgtaagtgtcacgtatcggtttggttccgtgggccaggacacacagctctgtttatgggaccttacagaagatatccttttccctcaccaacccctctcaagagcaaggacacacacaaatgtcatgaatgccacgagtcctcctgctggaagcaatgggaacagtgttacaacacccgggaactctgtgccgcctcctctgccacggtccaacagccttccacattcagcagtctcaaatgctggcagcaaaagcagtgtcatggacggggccattgcttctggggtcagcaaatttgcaacactttcactacatgaccggaaggagaggcaccacgagaaagatcacaagcgaaatcatagcatgggacacatttctagcaagagcagtgacaaactgaatctagttaccaaaaccaaaacggaccctgctaaaactctgggaacgcccctgtgtcctcgaatggaagatgttcccttgttagagccgctgatatgtaaaaagatagcacatgagagactgactgtactaatatttcttgaagactgtatagtcactgcttgtcaggagggatttatttgcacatggggaaggcctggtaaagtggtaagttttaatccttaatgctgcaccagatctagaacttgaataggtagtgacttttttctttttcgtgggaggggtggggtgtacaatgaatgtgaatgacacttcttattcttaatgtaaatctcaatgcatcagagccataattttggatactgcatgccatgtaattctgaatcatttgataatttaccttagagcatttaaaaaaatataatcaaactaattgccagccaagtcagtcatcctcctgggagtatatagagtcccaa

SEQ ID NO: 8476 - DNA, 2175 bp, Homo sapiens
acttagggcaggatgaacgctgctttccaagatggcgacggagggaggagggaaggagatgaacgagattaagacccaattcaccacccgggaaggtctgtacaagctgctgccgcactcggagtacagccggcccaaccgggtgcccttcaactcgcagggatccaaccctgtccgcgtctccttcgtaaacctcaacgaccagtctggcaacggcgaccgcctctgcttcaatgtgggccgggagctgtacttctatatctacaagggggtccgcaagacaatcccatgaggttggtagaacagagattctcatctccgttttaactgaggctgctgacttgagtaaaccaatagataaaaggatatacaaaggaacacagcctacttgtcatgacttcaaccacctaacagccacagcagaaagtgtctctctcctagtgggcttttccgcaggccaagtccagcttatagacccaatcaaaaaagaaactagcaaactttttaatgaggaaatggcaagttcttagcgtgcgtgagccaggacgggtttctgcgggtgttcaactttgactcagtggagctgcacggtacgatgaaaagctactttgggggcttgctgtgtgtgtgctggagcccggatggcaagtacatcgtgacaggtggggaggacgacttggtgacagtctggtcctttgtagactgccgagtaatagccagaggccacgggcacaagtcctgggtcagtgttgtagcgtttgacccttataccactagtgtagaagaaggtgaccctatggagtttagtggcagcgatgaggacttccaagaccttcttcattttggcagagatcgagcaaatagtacacagtccaggctctccaaacggaactctacagacagccgccccgtaagtgtcacgtatcggtttggttccgtgggccaggacacacagctctgtttatgggaccttacagaagatatccttttccctcaccaacccctctcaagagcaaggacacacacaaatgtcatgaatgccacgagtcctcctgctggaagcaatgggaacagtgttacaacacccgggaactctgtgccgcctcctctgccacggtccaacagccttccacattcagcagtctcaaatgctggcagcaaaagcagtgtcatggacggggccattgcttctggggtcagcaaatttgcaacactttcactacatgaccggaaggagaggcaccacgagaaagatcacaagcgaaatcatagcatgggacacatttctagcaagagcagtgacaaactgaatctagttaccaaaaccaaaacggaccctgctaaaactctgggaacgcccctgtgtcctcgaatggaagatgttcccttgttagagccgctgatatgtaaaaagatagcacatgagagactgactgtactaatatttcttgaagactgtatagtcactgcttgtcaggagggatttatttgcacatggggaaggcctggtaaagtggtaagttttaatccttaatgctgcaccagatctagaacttgaataggtagtgacttttttctttttcgtgggaggggtggggtgtacaatgaatgtgaatgacacttcttattcttaatgtaaatctcaatgcatcagagccataattttggatactgcatgccatgtaattctgaatcatttgataatttaccttagagcatttaaaaaaatataatcaaactaattgccagccaagtcagtcatcctcctgggagtatatagagtcccaaggttagcgctcctgtattagactatttcaattttaggaaaatcatgaccatgtggggaaacaatgactttaaaatgctgaaattaaaatttatgctttaactggaatattttttgcttaactactcaattagaatattgtacacctgatcaatgtgtgttcagcacagatggccatgaattgtcatttatagtccaattttttatcttaatcataaaatgtttaggaatctatgaaatttaactttaggaacaaaacgtttagcagggttgattgatattatttttacattgttctggcaatccacagaaagagaagagccttaatttttaaaacccattttagtcattttatgacaattaaagttgtttaataaacatcttttttc

SEQ ID NO: 8477 - DNA, 2164 bp, Homo sapiens
aaaacaacaaaaaacagttgtaaggagtccatggcacagaaagtttaagcaccctgatttaggctgctgacttgagtaaaccaatagataaaaggatatacaaaggaacacagcctacttgtcatgacttcaaccacctaacagccacagcagaaagtgtctctctcctagtgggcttttccgcaggccaagtccagcttatagacccaatcaaaaaagaaactagcaaactttttaatgaggaaagactaatagacaagtcacgagttacctgtgtcaaatgggttcccggttcggaaagccttttcctagtagcccactcgagtgggaacatgtacttatataatgtggagcacacttgtggcaccacagccccccactaccagcttctgaagcagggagagagctttgccgtgcacacttgcaagagcaaatccacgaggaaccctctccttaagtggacggtgggcgagggggccctcaacgagtttgctttctccccagatggcaagttcttagcgtgcgtgagccaggacgggtttctgcgggtgttcaactttgactcagtggagctgcacggtacgatgaaaagctactttgggggcttgctgtgtgtgtgctggagcccggatggcaagtacatcgtgacaggtggggaggacgacttggtgacagtctggtcctttgtagactgccgagtaatagccagaggccacgggcacaagtcctgggtcagtgttgtagcgtttgacccttataccactagtgtagaagaaggtgaccctatggagtttagtggcagcgatgaggacttccaagaccttcttcattttggcagagatcgagcaaatagtacacagtccaggctctccaaacggaactctacagacagccgccccgtaagtgtcacgtatcggtttggttccgtgggccaggacacacagctctgtttatgggaccttacagaagatatccttttccctcaccaacccctctcaagagcaaggacacacacaaatgtcatgaatgccacgagtcctcctgctggaagcaatgggaacagtgttacaacacccgggaactctgtgccgcctcctctgccacggtccaacagccttccacattcagcagtctcaaatgctggcagcaaaagcagtgtcatggacggggccattgcttctggggtcagcaaatttgcaacactttcactacatgaccggaaggagaggcaccacgagaaagatcacaagcgaaatcatagcatgggacacatttctagcaagagcagtgacaaactgaatctagttaccaaaaccaaaacggaccctgctaaaactctgggaacgcccctgtgtcctcgaatggaagatgttcccttgttagagccgctgatatgtaaaaagatagcacatgagagactgactgtactaatatttcttgaagactgtatagtcactgcttgtcaggagggatttatttgcacatggggaaggcctggtaaagtggtaagttttaatccttaatgctgcaccagatctagaacttgaataggtagtgacttttttctttttcgtgggaggggtggggtgtacaatgaatgtgaatgacacttcttattcttaatgtaaatctcaatgcatcagagccataattttggatactgcatgccatgtaattctgaatcatttgataatttaccttagagcatttaaaaaaatataatcaaactaattgccagccaagtcagtcatcctcctgggagtatatagagtcccaaggttagcgctcctgtattagactatttcaattttaggaaaatcatgaccatgtggggaaacaatgactttaaaatgctgaaattaaaatttatgctttaactggaatattttttgcttaactactcaattagaatattgtacacctgatcaatgtgtgttcagcacagatggccatgaattgtcatttatagtccaattttttatcttaatcataaaatgtttaggaatctatgaaatttaactttaggaacaaaacgtttagcagggttgattgatattatttttacattgttctggcaatccacagaaagagaagagccttaatttttaaaacccattttagtcattttatgacaattaaagttgtttaataaacatcttttttc

SEQ ID NO: 8478 - DNA, 2117 bp, Homo sapiens
atggcgacggagggaggagggaaggagatgaacgagattaagacccaattcaccacccgggaaggtctgtacaagctgctgccgcactcggagtacagccggcccaaccgggtgcccttcaactcgcagggatccaaccctgtccgcgtctccttcgtaaacctcaacgaccagtctggcaacggcgaccgcctctgcttcaatgtgggccgggagctgtacttctatatctacaagggggtccgcaagagactaatagacaagtcacgagttacctgtgtcaaatgggttcccggttcggaaagccttttcctagtagcccactcgagtgggaacatgtacttatataatgtggagcacacttgtggcaccacagccccccactaccagcttctgaagcagggagagagctttgccgtgcacacttgcaagagcaaatccacgaggaaccctctccttaagtggacggtgggcgagggggccctcaacgagtttgctttctccccagatggcaagttcttagcgtgcgtgagccaggacgggtttctgcgggtgttcaactttgactcagtggagctgcacggtacgatgaaaagctactttgggggcttgctgtgtgtgtgctggagcccggatggcaagtacatcgtgacaggtggggaggacgacttggtgacagtctggtcctttgtagactgccgagtaatagccagaggccacgggcacaagtcctgggtcagtgttgtagcgtttgacccttataccactagtgtagaagaaggtgaccctatggagtttagtggcagcgatgaggacttccaagaccttcttcattttggcagagatcgagcaaatagtacacagtccaggctctccaaacggaactctacagacagccgccccgtaagtgtcacgtatcggtttggttccgtgggccaggacacacagctctgtttatgggaccttacagaagatatccttttccctcaccaacccctctcaagagcaaggacacacacaaatgtcatgaatgccacgagtcctcctgctggaagcaatgggaacagtgttacaacacccgggaactctgtgccgcctcctctgccacggtccaacagccttccacattcagcagtctcaaatgctggcagcaaaagcagtgtcatggacggggccattgcttctggggtcagcaaatttgcaacactttcactacatgaccggaaggagaggcaccacgagaaagatcacaagcgaaatcatagcatgggacacatttctagcaagagcagtgacaaactgaatctagttaccaaaaccaaaacggaccctgctaaaactctgggaacgcccctgtgtcctcgaatggaagatgttcccttgttagagccgctgatatgtaaaaagatagcacatgagagactgactgtactaatatttcttgaagactgtatagtcactgcttgtcaggagggatttatttgcacatggggaaggcctggtaaagtggtaagttttaatccttaatgctgcaccagatctagaacttgaataggtagtgacttttttctttttcgtgggaggggtggggtgtacaatgaatgtgaatgacacttcttattcttaatgtaaatctcaatgcatcagagccataattttggatactgcatgccatgtaattctgaatcatttgataatttaccttagagcatttaaaaaaatataatcaaactaattgccagccaagtcagtcatcctcctgggagtatatagagtcccaaggttagcgctcctgtattagactatttcaattttaggaaaatcatgaccatgtggggaaacaatgactttaaaatgctgaaattaaaatttatgctttaactggaatattttttgcttaactactcaattagaatattgtacacctgatcaatgtgtgttcagcacagatggccatgaattgtcatttatagtccaattttttatcttaatcataaaatgtttaggaatctatgaaatttaactttaggaacaaaacgtttagcagggttgattgatattatttttacattgttctggcaatccacagaaagagaagagccttaatttttaaaacc

SEQ ID NO: 8479 - DNA, 3060 bp, Homo sapiens
ggtgggcgtgatccgggcacttagggcaggatgaacgctgctttccaagatggcgacggagggaggagggaaggagatgaacgagattaagacccaattcaccacccgggaaggtctgtacaagctgctgccgcactcggagtacagccggcccaaccgggtgcccttcaactcgcagggatccaaccctgtccgcgtctccttcgtaaacctcaacgaccagtctggcaacggcgaccgcctctgcttcaatgtgggccgggagctgtacttctatatctacaagggggtccgcaaggctgctgacttgagtaaaccaatagataaaaggatatacaaaggaacacagcctacttgtcatgacttcaaccacctaacagccacagcagaaagtgtctctctcctagtgggcttttccgcaggccaagtccagcttatagacccaatcaaaaaagaaactagcaaactttttaatgaggaaaactcttgtcagcacttgtggaaggtggattggaatgaagaaagacagaatgaaggtagcaagaccagtgaggaggctctagtaactgtccagccggcagagcacttctgcaggcaggaggacaggatgcaaggtgttctccaagaccagaactaaaagtgcccaacagcttgagaagagggcactggagagaggggcagggaagcgcccttctcctcggctgtgcttctgagtaatggctcccgcagacctggggagggcctggggaggggtggccgcggtggttcctgatatcaggtgtgtaaggtgcaatgcgtgctgctaaccctaggagaaatttggggaaaatatttgtagttttctcgccaaactttgagcttcctcattgaaatttttcagtctttcagcctaaacgttattatgagcaagaatatcttttctaacctaatctgtggaataaaacacagcatttggcaagaagaggctgttaaatactcagtcagcatcactgttccagcgtgtaccaaaccacagagatgaaaggctcagacgaaagtcaggtgcacgctgcgtggctggagaatcccgctcccacccggcaagggggcgagctggtccctgggcggtgtcagacaccttctgaaggtgccaggccagggccaggggagcttcaactcgccctccttgggttggcctttttcaccagaattcaagaagccagatttgtgctgtgactgcgatggggcaggcttctaaacactactggtggccctggagcctttctctgaggcttttttcttattcagaaggagaattaaaaattcccccagcggcctggagaagggaacctttggaaaagcttgccttcttttaaaagcaaatgcatgtgcaggagtagacactttacaaataaccagtagccttggggtcgaaatttgcttaaatcatggtaaaggatctcatttctcttttgtgctgattgaaccttctagcagtttggaagtgttttcctgtgaacccttagctggggactgagggtaaatgccttaaaaatggaggcatggaaaatcagaaaggagctatcacaatcattcttttctcaaaggcgttcaggaattctgaggaagaaatgcagtgacaggatgggattttaggggcaaggacaccgtccgggcggggcccagggctctccactggctgacttcacccccagggcccagctggcacgtggccaggcagccatttctccccagttcctccacttcctggggttcattttaaataataaattgtaaagtatgaaatgagtgctgaagttgcctgcatacaaggtcctcatcacctctcgcctgggagggagacgttttctttctttgttgagcgagctcaaagtgtgaggcggagaaaacctaggggttgggggcggctggagaagggatccacggaaacccaagcgccacatcatgcgtgtctgactgcccacggaagaactagaagcagttcaccagtggattttctggggaacgattcatggaacacagcgtctggcgtccagctttgtgggtgagggcatggcgggggatccggtggccctgccctgcctccggtgccggtggatgggggagggactggcctctgactgcggggttgcaccatggcggcggtcggtgtgcccttggctgaggtttcgttccttagcagtgagaacctccacatgcgtgggtaggggtcgggtgacctggagacgcctcctccggtctggtctgggtgacaaaggtgaaggtttatagtctaccaccctggcagcagcctgcagggcccccccttgtctggagcacacccttcgccacgggctgattgggactgtcgggtgttgctttaagttaacaaggtgcacatcacagcgaccccaagtgatgtcccaaagggaggagacattagtctggccgaagtgaagtctgtggctttatatgtaaaagcactcgtatgcaactgttacctttgaaactcagatcctagttacgaactataagaacgtgcccctccagtagagggagactgtctcactgatgttgatttctttattcatttccgcatctgttacacgaacttcgtgtcataaattgctatcctttcatttgaaagtgtaaaaaatttcctgcatttttatcatttctgtatacttgagtttattagagattgttatgttaggcgacactgtataaaattgtatggatattttgagtgaaaatcaaaagtaaaattcacatgtatttccttttttatattttcatccaatttcttgacaacttgaataaatttcataaagagccttcctaacatgaaatattggtaaattaaattctttactgttgcaataattaatgaaactttagtatcagtattgttttataattttaaggaaatcatgtttgtttcactgctttgtttttttttttagctgttgccttgtcactgtcacagctaacaagacttactacatacttgatattctgaagtactgtggggctgtcctctgtatactgacattaaataaacgtgtgtgagtgaactgtaaa

SEQ ID NO: 8480 - DNA, 2382 bp, Homo sapiens
acttagggcaggatgaacgctgctttccaagatggcgacggagggaggagggaaggagatgaacgagattaagacccaattcaccacccgggaaggtctgtacaagctgctgccgcactcggagtacagccggcccaaccgggtgcccttcaactcgcagggatccaaccctgtccgcgtctccttcgtaaacctcaacgaccagtctggcaacggcgaccgcctctgcttcaatgtgggccgggagctgtacttctatatctacaagggggtccgcaagagactaatagacaagtcacgagttacctgtgtcaaatgggttcccggttcggaaagccttttcctagtagcccactcgagtgggaacatgtacttatataatgtggagcacacttgtggcaccacagccccccactaccagcttctgaagcagggagagagctttgccgtgcacacttgcaagagcaaatccacgaggaaccctctccttaagtggacggtgggcgagggggccctcaacgagtttgctttctccccagatggcaagttcttagcgtgcgtgagccaggacgggtttctgcgggtgttcaactttgactcagtggagctgcacggtacgatgaaaagctactttgggggcttgctgtgtgtgtgctggagcccggatggcaagtacatcgtgacaggtggggaggacgacttggtgacagtctggtcctttgtagactgccgagtaatagccagaggccacgggcacaagtcctgggtcagtgttgtagcgtttgacccttataccactagtgtagaagaaggtgaccctatggagtttagtggcagcgatgaggacttccaagaccttcttcattttggcagagatcgagcaaatagtacacagtccaggctctccaaacggaactctacagacagccgccccgtaagtgtcacgtatcggtttggttccgtgggccaggacacacagctctgtttatgggaccttacagaagatatccttttccctcaccaacccctctcaagagcaaggacacacacaaatgtcatgaatgccacgagtcctcctgctggaagcaatgggaacagtgttacaacacccgggaactctgtgccgcctcctctgccacggtccaacagccttccacattcagcagtctcaaatgctggcagcaaaagcagtgtcatggacggggccattgcttctggggtcagcaaatttgcaacactttcactacatgaccggaaggagaggcaccacgagaaagatcacaagcgaaatcatagcatgggacacatttctagcaagagcagtgacaaactgaatctagttaccaaaaccaaaacggaccctgctaaaactctgggaacgcccctgtgtcctcgaatggaagatgttcccttgttagagccgctgatatgtaaaaagatagcacatgagagactgactgtactaatatttcttgaagactgtatagtcactgcttgtcaggagggatttatttgcacatggggaaggcctggtaaagtgggctcattgtcatccccaagccaggccagttctccaggtggaactgtagtgtagcgacctcactgctgcgcgcacagtctcccgggacttggactcgagggagtgacgaggaggagctccgagctgcgcctgagccgtgccagccggcggacctcaggcggtggacgtcggcgatagccgtgtggacggtgaccggctcactctgcggcgccgtgctcccgctgctcacccaaagaagttgtttccattttaaaccggtcttttggggctgcagtaaaaaataagaaatggagttttcttgctttttactctaaaattcaatgtaattaaatttcatatatatataatatatacatatatacatagtgtaaaataaaatgtttcttggacaagaaatcccctgaaattcagctgttatagtgcttcactgtttttgcactgatttttctataccttaggtggtcagaagacaaccttgaatgcactcatagagaaaactgttactttctgacgtaatgtaattcaggaagacagacgctgcaatcacagattttaaaaaattgtttgcacttaaaaatagttgaatgctggtggaaagttactttgcagatgggtgtaaggactcatggccctctgaggtgcggcgtgaagatgccctttttacccgttgacgtttattttacgtaaaataaactgttgtttccaatgcaatcaactctgtattatatgtataaatattgtaattctgcaattggggaaaatagttacttcactagtaattttcatcatttaagagtgatatttctaattcacaaaagttaatattaaaactatcttgaata

SEQ ID NO: 8481 - DNA, 2875 bp, Homo sapiens
atgggtaagaagaggaccacttccggcgagggacgggaaagacagcggcttccggcgcggcggttccggacaaccagccccgccgccctcagggctgacagtgtggacggcgggagtctcctcgctcccctgctgggattgactgaccgagcgtttagtgactgcccagatctggctgatggggccatggagaagatgtcccgtgtgaccacagccctgggtggcagcgtgctgacaggccgcaccatgcactgccacctggatgctcccgccaatgccatcagtgtgtgccgcgacgcagcccaggtggtcgtggcaggccgtagcatcttcaagatctatgccatcgaggaggaacagttcgtggaaaagctgaacctgcgtgtggggcgcaagccttcgcttaacctgagctgtgctgacgtggtctggcaccagatggatgagaacctgctggccacagcagccaccaatggcgtggtggtcacgtggaacctgggccggccatcccgcaacaagcaggaccagctgttcacagaacacaagcgcacggtaaacaaagtctgcttccaccccaccgaagcccacgtgctgctcagtggctcccaggatggcttcatgaagtgctttgacctccgcagaaaggactctgtcagcaccttctcgggtgaggccacagaggcagggccacgggagtgggcgatggctgggtgcgttcctattctcccagtgctcagctgccgcatcctgaggctgcaccacagctttgctcatggaccgatgcaggatgcagaatctacggcaaatgacgcccgggaatcttggggatgtccactctaccctctgggcctctgttctgggccacaggcaggccagtcggagagcgtgcgggacgtgcagttcagtatccgggactacttcaccttcgcctccacctttgagaacggcaatgtgcagctctgggacatccggcgtcccgaccggtgcgagaggatgttcacagcccacaacggacccgtcttctgctgcgactggcaccccgaggacaggggctggttggccactggagggcgcgacaagatggtgaaggtctgggacatgaccacgcaccgtgccaaggagatgcactgtgtgcagaccatcgcctcggtggcccgtgtgaagtggcggccagagtgccgccaccacctggccacgtgctccatgatggtggaccacaacatctatgtttgggacgtgcgccggcccttcgtgccagctgccatgtttgaggaacaccgagacgtcaccacgggaattgcctggcgccacccccacgacccctccttcctgctgtctggctccaaggacagctcgctgtgccagcacctgttccgcgacgccagccagcccgtcgagcgcgccaaccctgagggcctctgctacggcctcttcggggacctggccttcgccgccaaggagagcctcgtggctgccgagtcggggcgcaagccctacactggcgaccggcgccaccccatcttctttaagcgcaagctggaccctgccgagcccttcgcaggcctcgcctccagtgccctcagtgtctttgagacggagccaggtggcggcggcatgcgctggtttgtggacacagctgagcgttatgcgctggctggccggccactggccgagctctgtgaccacaacgcaaaggtggctcgagagcttggccgcaaccaggtggcgcaaacgtggaccatgctgcggatcatctactgcagccctggcctagtgcccactgcaaacctcaaccacagtgtgggcaagggtggctcctgtggcctcccgctcatgaacagtttcaacctgaaggatatggccccagggttgggcagtgagacgcggctggaccgcagcaaaggagatgcacggagcgacacagttctgctcgactcctcggccacactcatcaccaatgaggataacgaggaaaccgagggcagcgacgtacctgccgactacctgctgggtgacgtggaaggtgaggaggacgagctgtacctgctggatccggaacacgcgcaccccgaggaccctgagtgcgtgctgccgcaggaggcctttccgctgcgccacgagatcgtggacacgcctcccgggcccgagcacctgcaggacaaggccgactccccgcacgtgagcggcagcgaggcggatgtggcctccctggcccccgtggactcctccttctcgctcctgtctgtctcacacgcgctctacgacagccgcctgccgcccgacttcttcggcgtgctggtgcgcgacatgctgcacttctacgctgagcagggcgacgtgcagatggctgtgtctgtgctcatcgtcctgggtgaacgggtgcgcaaggacatcgacgagcagacccaggagcactggtacacttcctacatcgacctgctgcagcgcttccgcctctggaacgtgtccaacgaggtggtcaagctgagcaccagccgcgccgtcagctgcctcaaccaggcctccaccaccctgcacgtcaactgcagccactgcaagcggcccatgagcagccggggctgggtctgcgacaggtgccaccgctgcgccagcatgtgtgccgtctgccaccacgtagtcaagggtctcttcgtgtggtgccagggctgcagccacggcggccacctgcagcacatcatgaagtggctggaaggcagctcccactgtcccgcaggctgcggccacctctgcgagtactcctgacggggcatctgctgggcttgcccgggcggccgcgtgcagaaccccgcctggtcttgtgcccgagacgggcggaggctggaacttgagacctcaataaaggaagtagagccgc

SEQ ID NO: 8482 - DNA, 3245 bp, Homo sapiens
gcggcttccggcgcggcggttccggacaaccgtgcgcttttagtaaaagattggggttcgcgcgggggagaagggctgccccgggccctctggttctcgtcccgcagcgtccgctcccccgcgccactgcgccgctcccaggaaccctgtactccggggtcgccggcttctctcctgcctccggtcccgccagacacctcgagctccttaagtagctcggtccttgacgtccctctgggcccttcccgcgtctatcgcctgagtccccgggcccctctagccctctgttccctcccctcttttgttcctccctagagccccgccgccctcagggctgacagtgtggacggcgggagtctcctcgctcccctgctgggattgactgaccgagcgtttagtgactgcccagatctggctgatgggggtaccgagaggtggcctgggccgggaatgtccagctagagtcttccgtggaagtcagacatgaaactgacaggcctaagggaagctaggaagtcccctcaccgctcagccagggtgatgggctggactgacagactccagtgaatttgagcttgcctgtcaggctgattggctgatagacagccctggattggctcactaagactgaccagcccgggaccaagcagttctggggtcccaacctgggtggaaggtctgaactgatgacccacccaggctgaccaggccagcccacctcactgacctcctgacccctgacctcatcacctgtgcagccatggagaagatgtcccgtgtgaccacagccctgggtggcagcgtgctgacaggccgcaccatgcactgccacctggatgctcccgccaatgccatcagtgtgtgccgcgacgcagcccaggtggtcgtggcaggccgtagcatcttcaagatctatgccatcgaggaggaacagttcgtggaaaagctgaacctgcgtgtggggcgcaagccttcgcttaacctgagctgtgctgacgtggtctggcaccagatggatgagaacctgctggccacagcagccaccaatggcgtggtggtcacgtggaacctgggccggccatcccgcaacaagcaggaccagctgttcacagaacacaagcgcacggtaaacaaagtctgcttccaccccaccgaagcccacgtgctgctcagtggctcccaggatggcttcatgaagtgctttgacctccgcagaaaggactctgtcagcaccttctcgggccagtcggagagcgtgcgggacgtgcagttcagtatccgggactacttcaccttcgcctccacctttgagaacggcaatgtgcagctctgggacatccggcgtcccgaccggtgcgagaggatgttcacagcccacaacggacccgtcttctgctgcgactggcaccccgaggacaggggctggttggccactggagggcgcgacaagatggtgaaggtctgggacatgaccacgcaccgtgccaaggagatgcactgtgtgcagaccatcgcctcggtggcccgtgtgaagtggcggccagagtgccgccaccacctggccacgtgctccatgatggtggaccacaacatctatgtttgggacgtgcgccggcccttcgtgccagctgccatgtttgaggaacaccgagacgtcaccacgggaattgcctggcgccacccccacgacccctccttcctgctgtctggctccaaggacagctcgctgtgccagcacctgttccgcgacgccagccagcccgtcgagcgcgccaaccctgagggcctctgctacggcctcttcggggacctggccttcgccgccaaggagagcctcgtggctgccgagtcggggcgcaagccctacactggcgaccggcgccaccccatcttctttaagcgcaagctggaccctgccgagcccttcgcaggcctcgcctccagtgccctcagtgtctttgagacggagccaggtggcggcggcatgcgctggtttgtggacacagctgagcgttatgcgctggctggccggccactggccgagctctgtgaccacaacgcaaaggtggctcgagagcttggccgcaaccaggtggcgcaaacgtggaccatgctgcggatcatctactgcagccctggcctagtgcccactgcaaacctcaaccacagtgtgggcaagggtggctcctgtggcctcccgctcatgaacagtttcaacctgaaggatatggccccagggttgggcagtgagacgcggctggaccgcagcaaaggagatgcacggagcgacacagttctgctcgactcctcggccacactcatcaccaatgaggataacgaggaaaccgagggcagcgacgtacctgccgactacctgctgggtgacgtggaaggtgaggaggacgagctgtacctgctggatccggaacacgcgcaccccgaggaccctgagtgcgtgctgccgcaggaggcctttccgctgcgccacgagatcgtggacacgcctcccgggcccgagcacctgcaggacaaggccgactccccgcacgtgagcggcagcgaggcggatgtggcctccctggcccccgtggactcctccttctcgctcctgtctgtctcacacgcgctctacgacagccgcctgccgcccgacttcttcggcgtgctggtgcgcgacatgctgcacttctacgctgagcagggcgacgtgcagatggctgtgtctgtgctcatcgtcctgggtgaacgggtgcgcaaggacatcgacgagcagacccaggagcactggtacacttcctacatcgacctgctgcagcgcttccgcctctggaacgtgtccaacgaggtggtcaagctgagcaccagccgcgccgtcagctgcctcaaccaggcctccaccaccctgcacgtcaactgcagccactgcaagcggcccatgagcagccggggctgggtctgcgacaggtgccaccgctgcgccagcatgtgtgccgtctgccaccacgtagtcaagggtctcttcgtgtggtgccagggctgcagccacggcggccacctgcagcacatcatgaagtggctggaaggcagctcccactgtcccgcaggctgcggccacctctgcgagtactcctgacggggcatctgctgggcttgcccgggcggccgcgtgcagaaccccgcctggtcttgtgcccgagacgggcggaggctggaacttgagacctcaataaaggaagtagagccgc

SEQ ID NO: 8483 - DNA, 2123 bp, Homo sapiens
cggtgcgtgtggtgagcggcgggccccgggctggaggggccgggactgggcagcgcctaaagcgccccgtgccgcttaacgcggtctctcatagccgctcgccttcctttcacttcctgttccttcagaaagcgctgtgccttggaccaaccttacttcttactattgacagctcagctaactcctattcatccttcaaaacccatctctggtggtttggctttgaatgacagcaagaactctgtctttaatggcttcattggtagcgtatgatgattcggactcggaggctgagacagagcatgcaggaagttttaatgctaccggccagcagaaagacacttctggtgtggccagaccacctgggcaggattttgcatctggtacactggatgtgcccaaagcaggggcacagcccacaaagcatggctcctgtgaagacccagggggctatcgccttccattggctcagcttgggagaagcgattggggatcttgccccagccagaggctacagtggcccgggaaggagcctcaagtcaccttccccatcaaagagccttcttgttcttctctgtggacgagccatgttccagccagccacatgcccctggcagctgcccgctttaagcaagtaaaactctccaggaactttcccaagtcatctttccatgctcaaagtgagtctgaaaccgtaggtaaaaatggcagctcttttcagaagaaaaaatgtgaggactgtgtggtaccctatactcccagaagactaagacagcggcaggcattaagcacggagacaggcaagggtaaagacgtggagccacaggggccccctgcagggcgtgccccagcccctctctacgtgggcccgggagtgtctgagtttattcagccatatttgaatagccattataaagaaaccacagttccccggaaagtgcttttccacctgagaggccacaggggccctgtcaacaccattcagtggtgtccagtcctttctaagagccacatgcttctctccacttctatggataaaactttcaaggtatggaacgccgtggactccgggcactgcctgcagacctactccctgcacacagaggcagtgcgggccgcccggtgggctccctgtggccggcgcatcctcagtggtggctttgacttcgcgctgcacctaacagaccttgaaacaggaacccagctatttagtggtcgaagtgactttagaatcactaccttgaaattccatccaaaagaccacaacatctttttatgtggaggcttcagctctgaaatgaaagcttgggatataaggactggcaaggtgatgagaagctacaaggcgaccatccagcagaccttggacatcctgttcctccgggaaggctccgagttcctgagcagcacagacgcttccacccgggactcagctgaccgcaccattattgcctgggatttccggacctctgccaaaatctccaaccagattttccacgagaggttcacctgccccagcctcgccttgcacccgagagagcccgtgttcctggcacagaccaatggcaactacctggcccttttctccactgtgtggccctaccggatgagcagacggcggcgctatgaagggcacaaggtggagggctactcagtgggctgcgagtgctccccaggcggtgacttgctggtgacgggcagcgccgatggccgggtcctgatgtacagcttccgcacagccagccgagcatgcacactgcaggggcacacacaggcctgtgtcggcaccacctatcaccccgtgctgccctccgtcctcgccacctgctcctggggaggggacatgaagatctggcactgagctttttgtcactgaaccttcccgatgccagctgggctcttggactcccctcttcctcaagggtagatgagaggaacgagcacagaggttggctgtgggtcctgggtaccaccttctgagcctcagtttcctcatctgtaaagtggggagaaaagtctgtttgcctcaggagtgtgaggactacactagtgaaagcgcctggcgggcagccggcgatgcccaataaatgtgtgttttgctgtttgttaagtgatttcagcaa

SEQ ID NO: 8484 - DNA, 1969 bp, Homo sapiens
cgtgactggatggtagtgtgctggccggtctgcctccgggagaaccgagcgcttccggtggtttggctttgaatgacagcaagaactctgtctttaatggcttcattggtagcgtatgatgattcggactcggaggctgagacagagcatgcaggaagttttaatgctaccggccagcagaaagacacttctggtgtggccagaccacctgggcaggattttgcatctggtacactggatgtgcccaaagcaggggcacagcccacaaagcatggctcctgtgaagacccagggggctatcgccttccattggctcagcttgggagaagcgattggggatcttgccccagccagaggctacagtggcccgggaaggagcctcaagtcaccttccccatcaaagagccttcttgttcttctctgtggacgagccatgttccagccagccacatgcccctggcagctgcccgctttaagcaagtaaaactctccaggaactttcccaagtcatctttccatgctcaaagtgagtctgaaaccgtaggtaaaaatggcagctcttttcagaagaaaaaatgtgaggactgtgtggtaccctatactcccagaagactaagacagcggcaggcattaagcacggagacaggcaagggtaaagacgtggagccacaggggccccctgcagggcgtgccccagcccctctctacgtgggcccgggagtgtctgagtttattcagccatatttgaatagccattataaagaaaccacagttccccggaaagtgcttttccacctgagaggccacaggggccctgtcaacaccattcagtggtgtccagtcctttctaagagccacatgcttctctccacttctatggataaaactttcaaggtatggaacgccgtggactccgggcactgcctgcagacctactccctgcacacagaggcagtgcgggccgcccggtgggctccctgtggccggcgcatcctcagtggtggctttgacttcgcgctgcacctaacagaccttgaaacaggaacccagctatttagtggtcgaagtgactttagaatcactaccttgaaattccatccaaaagaccacaacatctttttatgtggaggcttcagctctgaaatgaaagcttgggatataaggactggcaaggtgatgagaagctacaaggcgaccatccagcagaccttggacatcctgttcctccgggaaggctccgagttcctgagcagcacagacgcttccacccgggactcagctgaccgcaccattattgcctgggatttccggacctctgccaaaatctccaaccagattttccacgagaggttcacctgccccagcctcgccttgcacccgagagagcccgtgttcctggcacagaccaatggcaactacctggcccttttctccactgtgtggccctaccggatgagcagacggcggcgctatgaagggcacaaggtggagggctactcagtgggctgcgagtgctccccaggcggtgacttgctggtgacgggcagcgccgatggccgggtcctgatgtacagcttccgcacagccagccgagcatgcacactgcaggggcacacacaggcctgtgtcggcaccacctatcaccccgtgctgccctccgtcctcgccacctgctcctggggaggggacatgaagatctggcactgagctttttgtcactgaaccttcccgatgccagctgggctcttggactcccctcttcctcaagggtagatgagaggaacgagcacagaggttggctgtgggtcctgggtaccaccttctgagcctcagtttcctcatctgtaaagtggggagaaaagtctgtttgcctcaggagtgtgaggactacactagtgaaagcgcctggcgggcagccggcgatgcccaataaatgtgtgttttgctgtttgttaagtgatttcagcaa

SEQ ID NO: 8485 - DNA, 1214 bp, Homo sapiens
gagggaggaggtgagagtgattagtgggagaagaaaagcaggcccaggaccaagccctggggactggggacatcctcggtgaccctgtggagcattgagccatgccagctctgtgcctggtgctgtgctggtttcaagggctgttgggagaggtatggaacgccgtggactccgggcactgcctgcagacctactccctgcacacagaggcagtgcgggccgcccggtgggctccctgtggccggcgcatcctcagtggtggctttgacttcgcgctgcacctaacagaccttgaaacaggaacccagctatttagtggtcgaagtgactttagaatcactaccttgaaattccatccaaaagaccacaacatctttttatgtggaggcttcagctctgaaatgaaagcttgggatataaggactggcaaggtgatgagaagctacaaggcgaccatccagcagaccttggacatcctgttcctccgggaaggctccgagttcctgagcagcacagacgcttccacccgggactcagctgaccgcaccattattgcctgggatttccggacctctgccaaaatctccaaccagattttccacgagaggttcacctgccccagcctcgccttgcacccgagagagcccgtgttcctggcacagaccaatggcaactacctggcccttttctccactgtgtggccctaccggatgagcagacggcggcgctatgaagggcacaaggtggagggctactcagtgggctgcgagtgctccccaggcggtgacttgctggtgacgggcagcgccgatggccgggtcctgatgtacagcttccgcacagccagccgagcatgcacactgcaggggcacacacaggcctgtgtcggcaccacctatcaccccgtgctgccctccgtcctcgccacctgctcctggggaggggacatgaagatctggcactgagctttttgtcactgaaccttcccgatgccagctgggctcttggactcccctcttcctcaagggtagatgagaggaacgagcacagaggttggctgtgggtcctgggtaccaccttctgagcctcagtttcctcatctgtaaagtggggagaaaagtctgtttgcctcaggagtgtgaggactacactagtgaaagcgcctggcgggcagccggcgatgcccaataaatgtgtgttttgctgtttgttaa

SEQ ID NO: 8486 - DNA, 1952 bp, Homo sapiens
tcggaacgtgactggatggtagtgtgctggccggtctgcctccgggagaaccgagcgcttccggtgcgtgtggtggtttggctttgaatgacagcaagaactctgtctttaatggcttcattggtagcgtatgatgattcggactcggaggctgagacagagcatgcaggaagttttaatgctaccggccagcagaaagacacttctggtgtggccagaccacctgggcaggattttgcatctggtacactggatgtgcccaaagcaggggcacagcccacaaagcatggctcctgtgaagacccagggggctatcgccttccattggctcagcttgggagaagcgattggggatcttgccccagccagaggctacagtggcccgggaaggagcctcaagtcaccttccccatcaaagagccttcttgttcttctctgtggacgagccatgttccagccagccacatgcccctggcagctgcccgctttaagcaagtaaaactctccaggaactttcccaagtcatctttccatgctcaaagtgagtctgaaaccgtaggtaaaaatggcagctcttttcagaagaaaaaatgtgaggactgtgtggtaccctatactcccagaagactaagacagcggcaggcattaagcacggagacaggcaagggtaaagacgtggagccacaggggccccctgcagggcgtgccccagcccctctctacgtgggcccgggagtgtctgagtttattcagccatatttgaatagccattataaagaaaccacagttccccggaaagtgcttttccacctgagaggccacaggggccctgtcaacaccattcagtggtgtccagtcctttctaagagccacatgcttctctccacttctatggataaaactttcaaggtatggaacgccgtggactccgggcactgcctgcagacctactccctgcacacagaggcagtgcgggccgcccggtgggctccctgtggccggcgcatcctcagtggtggctttgacttcgcgctgcacctaacagaccttgaaacaggaacccagctatttagtggtcgaagtgactttagaatcactaccttgaaattccatccaaaagaccacaacatctttttatgtggaggcttcagctctgaaatgaaagcttgggatataaggactggcaaggtgatgagaagctacaaggcgaccatccagcagaccttggacatcctgttcctccgggaaggctccgagttcctgagcagcacagacgcttccacccgggactcagctgaccgcaccattattgcctgggatttccggacctctgccaaaatctccaaccagattttccacgagaggttcacctgccccagcctcgccttgcacccgagagagcccgtgttcctggcacagaccaatggcaactacctggcccttttctccactgtgtggccctaccggatgagcagacggcggcgctatgaagggcacaaggtggagggctactcagtgggctgcgagtgctccccaggcggtgacttgctggtgacgggcagcgccgatggccgggtcctgatgtacagcttccgcacagccagccgagcatgcacactgcaggggcacacacaggcctgtgtcggcaccacctatcaccccgtgctgccctccgtcctcgccacctgctcctggggaggggacatgaagatctggcactgagctttttgtcactgaaccttcccgatgccagctgggctcttggactcccctcttcctcaagggtagatgagaggaacgagcacagaggttggctgtgggtcctgggtaccaccttctgagcctcagtttcctcatctgtaaagtggggagaaaagtctgtttgcctcaggagtgtgaggactacactagtgaaagcgcctggcgggcagccggcgatgcccaataaatgt

SEQ ID NO: 8487 - DNA, 3466 bp, Homo sapiens
aaaggggcgtgggcgcgaggggcggcgggctagtaaccatagcggctcgcgtgggtcggctggcaagtaaccatagcggcgagcgtggggcggagtgtggctcggtagtcctctgcgtgccctcctgggagctgggtgctgtgagtcctcccctagcgggctggtctcggcgcggagtcggcgccgaacccgagctgctgctctggggcgtgtgcctagggcgcagggctggagcgcgggggctgcgcggttgctcgcggctccgctgaggtctctaggaaagggggcgatttgagggttccgccgtgaccgcttccaacggcggacacgcgcgctctggaccagagccgttgcccgctgtctcgtcacccgaagcctcctcctgacgccgtgctagtgcgagggtctccaggggaattcggggcacaagtcgggccggagcatccgggcggccgcttgagatcggcgctttgagaactgagcgcatgtggagttcggaggaaaagggctcagattgaagatggaaaatccccaagacattttctcaagtaatggtggctgtctaagtgatatagttatagaaaaatacctggttgaatccaaggagtctgtgtctcatgttcagcttgcttgcagcatgcaggactgtgctttccctttggatggaactgaactttgtatatggaacactaaggatccttctcatcagcttctaatcctacgaggacaccatcagccaattactgctatggcttttggaaataaagtgaacccacttctaatctgctcagcatcactggattatgttataatgtggaacctggatgaatgtagagagaaagtacttcaagggctggtccctcgagggactgtcatgggctcgcttttgggaaaggtgctgtgtttacagttgagcctggatgatcatgttgttgccgtgtgtgctggaaacaaaatattcatgctggatattgagcagcgattttctgtgacatacatagaacgtcctgatgttaataaccgccacaaagtcccaccaccgaccttcctgcacacattctctcagactcaggctgttcgggccgagctgcagggccacctgggcccggtgactgcggtggagttctgtccctggcgagcaggcaccctcatctcggcgtctgaggacagaggctttaaggtctgggaccattgtacaggatcattaatatacagttcatctgtgttatcagcatatcctcttctcagtttattcattgatgcagaaagcaggcagctggtcaccgggtgtgctgacggccagctttggatcttcagtttgatggatggacaccattatcgtcgtgtggcacgggttgacctaaggaagaagacagagactttctccacaagaagggttaagtctgggctgtgcagccagccagaagaaagccagcttccctctacaagtgctctgggaaaaggagagcaggttgaagtaacatttcctgtactgagacttgcaccctgtgatctctcactcatcccaaattctgcatgtggatgtctttcttctgagaacacccgatgtgtgtggatcggaagctcagtgggcttattcgtatttaacctggcaaacctggaagtggaagctgctttgtattacaaggatttccagagcctcagcatcctgctggccggatcgtgtgccctgaggaaccgcactgcggatcaaaaggtgctgtgcttgctggcctccctctttggcgggaagattgccgtgttggagatcaacccggccgcgctagtcagggctcagcagtgccccagcatggggcagagcctctcggtgccagccagctcctgtgtcctaccgacctctccactgtatctgggaattgccaaggagaagagtaccaaggctgctagtgaacagcgacgtgctgcacggaacgtcatgaaggaccaacgcctggttttccatagtaaagttaggtcatctggttatgcgtcagcaccacatgtaactatgttttcaccaaagaccaacatcaagagtgaggggaaaggatcttcaaggagcaggagcagctgcgcacgggaggcataccccgtggagtgcgctgtgcccaccaagcccggcccccaggtcgctgccgcccccacctgcacacgtgtatgctgcatccagtactcaggagatgggcagtggctggcctgtgggttggccaaccatctgttactcgtttttgatgccagcctgactgggacacctgctgtgttttcaggtcacgacggggcagtgaatgccgtgtgctggagccaggaccggaggtggctgctctctgcggcccgggacgggaccctgcgaatgtggtcggctcgtggggcagagctcgcactgcttctgggcaaagacatgttttctaaacctatacagtctgcacagttctattatatagatgcctttatattgttatcttctggccctgaatttcagctactgaggtatcacattgacacttgcaaagatgagattaagagatataaacagaagagcaagtccaagctgatttgcaggctctccacgacgggtgcagtagacatgaccagtttatcggcagtcaacgacttttattcccacatcgtactcgcagctggccggaacaggaccgtggaagtgtttgacctcaacgccggctgcagtgcagcggtgatagcggaagcccactcacggcctgtccatcaaatctgccaaaataaaggttcatcatttacaacccaacagcctcaggcttataaccttttcctgaccacggccattggcgatgggatgagactgtgggacctgagaaccctgaggtgtgagcgccactttgaagggcatccaacccgcggctatccatgtggaatcgctttcagtccttgtggacgattcgcggcttgtggggccgaggacagacacgcttacgtgtatgaaatgggctcaagcacgttttctcaccggctggctgggcacacagacactgtcactggagtggccttcaacccatcagcgccccagcttgccacagctaccttggatggtaaactccagctctttctagctgagtaaccactgacctgtgagctgggtccaggaatgctgtgaggaacaacttaaaagtaagaagtagtggttcatccatcagggggccagaagcagcaactgtttttcatattttgagacttgcctcagatttcccccgtttgcaagctcctcccctctgtgtgtgccatgtcagagttttatgtctttctgctcctcaaaagggatccccttcattgggaaaatggaaatggcgtccagtacttctgcacagaatttggtaaagttaaaacaaaatatctttcaataaaacataatatagtatttgtttgataattagagttggaagaaaaaagagagaatttcttttgggcagtgaaaataaagcagttaacagtc

SEQ ID NO: 8488 - DNA, 1403 bp, Homo sapiens
aaccatagcggctcgcgtgggtcggctggcaagtaaccatagcggcgagcgtggggcggagtgtggctcggtagtcctctgcgtgccctcctgggagctgggtgctgtgagtcctcccctagcgggctggtctcggcgcggagtcggcgccgaacccgagctgctgctctggggcgtgtgcctagggcgcagggctggagcgcgggggctgcgcggttgctcgcggctccgctgaggtctctaggaaagggggcgatttgagggttccgccgtgaccgcttccaacggcggacacgcgcgctctggaccagagccgttgcccgctgtctcgtcacccgaagcctcctcctgacgccgtgctagtgcgagggtctccaggggaattcggggcacaagtcgggccggagcatccgggcggccgcttgagatcggcgctttgagaactgagcgcatgtggagttcggaggaaaagggctcagattgaagatggaaaatccccaagacattttctcaagtaatggtggctgtctaagtgatatagttatagaaaaatacctggttgaatccaaggagtctgtgtctcatgttcagcttgcttgcagcatgcaggactgtgctttccctttggatggaactgaactttgtatatggaacactaaggatccttctcatcagcttctaatcctacgaggacaccatcagccaattactgctatggcttttggaaataaagtgaacccacttctaatctgctcagcatcactggattatgttataatgtggaacctggatgaatgtagagagaaagtacttcaagggctggtccctcgagggactgtcatgggctcgcttttgggaaaggtgctgtgtttacagttgagcctggatgatcatgttgttgccgtgtgtgctggaaacaaaatattcatgctggatattgagcatatcctcttctcagtttattcattgatgcagaaagcaggcagctggtcaccgggtgtgctgacggccagctttggatcttcagtttgatggatggacaccattatcgtcgtgtggcacgggttgacctaaggaagaagacagagactttctccacaagaagggttaagtctgggctgtgcagccagccagatgccacatgcacccacccagcaaccttgtcctcacctggtctctggctgtccagagttgcttcctgttgacgacagctctcctcagaagaaagccagcttccctctacaagtgctctgggaaaaggagagcaggttgaagtaacatttcctgtactgagacttgcaccctgtgatctctcactcatcccaaattctgcatgtggatgtctttcttctgagaacacccgatgtgtgtggatcggaagctcagtgggcttattcgtattt

SEQ ID NO: 8489 - DNA, 3085 bp, Homo sapiens
aaaggggcgtgggcgcgaggggcggcgggctagtaaccatagcggctcgcgtgggtcggctggcaagtaaccatagcggcgagcgtggggcggagtgtggctcggtagtcctctgcgtgccctcctgggagctgggtgctgtgagtcctcccctagcgggctggtctcggcgcggagtcggcgccgaacccgagctgctgctctggggcgtgtgcctagggcgcagggctggagcgcgggggctgcgcggttgctcgcggctccgctgaggtctctaggaaagggggcgatttgagggttccgccgtgaccgcttccaacggcggacacgcgcgctctggaccagagccgttgcccgctgtctcgtcacccgaagcctcctcctgacgccgtgctagtgcgagggtctccaggggaattcggggcacaagtcgggccggagcatccgggcggccgcttgagatcggcgctttgagaactgagcgcatgtggagttcggaggaaaagggctcagattgaagatggaaaatccccaagacattttctcaagtaatggtggctgtctaagtgatatagttatagaaaaatacctggttgaatccaaggagtctgtgtctcatgttcagcttgcttgcagcatgcaggactgtgctttccctttggatggaactgaactttgtatatggaacactaaggatccttctcatcagcttctaatcctacgaggacaccatcagccaattactgctatggcttttggaaataaagtgaacccacttctaatctgctcagcatcactggattatgttataatgtggaacctggatgaatgtagagagaaagtacttcaagcatatcctcttctcagtttattcattgatgcagaaagcaggcagctggtcaccgggtgtgctgacggccagctttggatcttcagtttgatggatggacaccattatcgtcgtgtggcacgggttgacctaaggaagaagacagagactttctccacaagaagggttaagtctgggctgtgcagccagccagaagaaagccagcttccctctacaagtgctctgggaaaaggagagcaggttgaagtaacatttcctgtactgagacttgcaccctgtgatctctcactcatcccaaattctgcatgtggatgtctttcttctgagaacacccgatgtgtgtggatcggaagctcagtgggcttattcgtatttaacctggcaaacctggaagtggaagctgctttgtattacaaggatttccagagcctcagcatcctgctggccggatcgtgtgccctgaggaaccgcactgcggatcaaaaggtgctgtgcttgctggcctccctctttggcgggaagattgccgtgttggagatcaacccggccgcgctagtcagggctcagcagtgccccagcatggggcagagcctctcggtgccagccagctcctgtgtcctaccgacctctccactgtatctgggaattgccaaggagaagagtaccaaggctgctagtgaacagcgacgtgctgcacggaacgtcatgaaggaccaacgcctggttttccatagtaaagttaggtcatctggttatgcgtcagcaccacatgtaactatgttttcaccaaagaccaacatcaagagtgaggggaaaggatcttcaaggagcaggagcagctgcgcacgggaggcataccccgtggagtgcgctgtgcccaccaagcccggcccccaggtcgctgccgcccccacctgcacacgtgtatgctgcatccagtactcaggagatgggcagtggctggcctgtgggttggccaaccatctgttactcgtttttgatgccagcctgactgggacacctgctgtgttttcaggtcacgacggggcagtgaatgccgtgtgctggagccaggaccggaggtggctgctctctgcggcccgggacgggaccctgcgaatgtggtcggctcgtggggcagagctcgcactgcttctgggcaaagacatgttttctaaacctatacagtctgcacagttctattatatagatgcctttatattgttatcttctggccctgaatttcagctactgaggtatcacattgacacttgcaaagatgagattaagagatataaacagaagagcaagtccaagctgatttgcaggctctccacgacgggtgcagtagacatgaccagtttatcggcagtcaacgacttttattcccacatcgtactcgcagctggccggaacaggaccgtggaagtgtttgacctcaacgccggctgcagtgcagcggtgatagcggaagcccactcacggcctgtccatcaaatctgccaaaataaaggttcatcatttacaacccaacagcctcaggcttataaccttttcctgaccacggccattggcgatgggatgagactgtgggacctgagaaccctgaggtgtgagcgccactttgaagggcatccaacccgcggctatccatgtggaatcgctttcagtccttgtggacgattcgcggcttgtggggccgaggacagacacgcttacgtgtatgaaatgggctcaagcacgttttctcaccggctggctgggcacacagacactgtcactggagtggccttcaacccatcagcgccccagcttgccacagctaccttggatggtaaactccagctctttctagctgagtaaccactgacctgtgagctgggtccaggaatgctgtgaggaacaacttaaaagtaagaagtagtggttcatccatcagggggccagaagcagcaactgtttttcatattttgagacttgcctcagatttcccccgtttgcaagctcctcccctctgtgtgtgccatgtcagagttttatgtctttctgctcctcaaaagggatccccttcattgggaaaatggaaatggcgtccagtacttctgcacagaatttggtaaagttaaaacaaaatatctttcaataaaacataatatagtatttgtttgataattagagttggaagaaaaaagagagaatttcttttgggcagtgaaaataaagcagttaacagtc

SEQ ID NO: 8490 - DNA, 3178 bp, Homo sapiens
aggggaattcggggcacaagtcgggccggagcatccgggcggccgcttgagatcggcgctttgagaactgagcgcatgtggagttcggaggaaaagggctcagattgaagatggaaaatccccaagacattttctcaagtaatggtggctgtctaagtgatatagttatagaaaaatacctggttgaatccaaggagtctgtgtctcatgttcagcttgcttgcagcatgcaggactgtgctttccctttggatggaactgaactttgtatatggaacactaaggatccttctcatcagcttctaatcctacgaggacaccatcagccaattactgctatggcttttggaaataaagtgaacccacttctaatctgctcagcatcactggattatgttataatgtggaacctggatgaatgtagagagaaagtacttcaagggctggtccctcgagggactgtcatgggctcgcttttgggaaaggtgctgtgtttacagttgagcctggatgatcatgttgttgccgtgtgtgctggaaacaaaatattcatgctggatattgagcagcgattttctgtgacatacatagaacgtcctgatgttaataaccgccacaaagtcccaccaccgaccttcctgcacacattctctcagactcaggctgttcgggccgagctgcagggccacctgggcccggtgactgcggtggagttctgtccctggcgagcaggcaccctcatctcggcgtctgaggacagaggctttaaggtctgggaccattgtacaggatcattaatatacagttcatctgtgttatcagcatatcctcttctcagtttattcattgatgcagaaagcaggcagctggtcaccgggtgtgctgacggccagctttggatcttcagtttgatggatggacaccattatcgtcgtgtggcacgggttgacctaaggaagaagacagagactttctccacaagaagggttaagtctgggctgtgcagccagccagaagaaagccagcttccctctacaagtgctctgggaaaaggagagcaggttgaagtaacatttcctgtactgagacttgcaccctgtgatctctcactcatcccaaattctgcatgtggatgtctttcttctgagaacacccgatgtgtgtggatcggaagctcagtgggcttattcgtatttaacctggcaaacctggaagtggaagctgctttgtattacaaggatttccagagcctcagcatcctgctggccggatcgtgtgccctgaggaaccgcactgcggatcaaaaggtgctgtgcttgctggcctccctctttggcgggaagattgccgtgttggagatcaacccggccgcgctagtcagggctcagcagtgccccagcatggggcagagcctctcggtgccagccagctcctgtgtcctaccgacctctccactgtatctgggaattgccaaggagaagagtaccaaggctgctagtgaacagcgacgtgctgcacggaacgtcatgaaggaccaacgcctggttttccatagtaaagttaggtcatctggttatgcgtcagcaccacatgtaactatgttttcaccaaagaccaacatcaagagtgaggggaaaggatcttcaaggagcaggagcagctgcgcacgggaggcataccccgtggagtgcgctgtgcccaccaagcccggcccccaggtcgctgccgcccccacctgcacacgtgtatgctgcatccagtactcaggagatgggcagtggctggcctgtgggttggccaaccatctgttactcgtttttgatgccagcctgactgggacacctgctgtgttttcaggtcacgacggggcagtgaatgccgtgtgctggagccaggaccggaggtggctgctctctgcggcccgggacgggaccctgcgaatgtggtcggctcgtggggcagagctcgcactgcttctgggcaaagacatgttttctaaacctatacagtctgcacagttctattatatagatgcctttatattgttatcttctggccctgaatttcagctactgaggtatcacattgacacttgcaaagatgagattaagagatataaacagaagagcaagtccaagctgatttgcaggctctccacgacgggtgcagtagacatgaccagtttatcggcagtcaacgacttttattcccacatcgtactcgcagctggccggaacaggaccgtggaagtgtttgacctcaacgccggctgcagtgcagcggtgatagcggaagcccactcacggcctgtccatcaaatctgccaaaataaaggttcatcatttacaacccaacagcctcaggcttataaccttttcctgaccacggccattggcgatgggatgagactgtgggacctgagaaccctgaggtgtgagcgccactttgaagggcatccaacccgcggctatccatgtggaatcgctttcagtccttgtggacgattcgcggcttgtggggccgaggacagacacgcttacgtgtatgaaatgggctcaagcacgttttctcaccggctggctgggcacacagacactgtcactggagtggccttcaacccatcagcgccccagatggagtctcgctctgtcgcccacgctggagtgcagtggcacgatctcggttcactgcaacctccgccttccaggttcaagcaattcttctgcctcagcctcccgagtagctgggattacagcttgccacagctaccttggatggtaaactccagctctttctagctgagtaaccactgacctgtgagctgggtccaggaatgctgtgaggaacaacttaaaagtaagaagtagtggttcatccatcagggggccagaagcagcaactgtttttcatattttgagacttgcctcagatttcccccgtttgcaagctcctcccctctgtgtgtgccatgtcagagttttatgtctttctgctcctcaaaagggatccccttcattgggaaaatggaaatggcgtccagtacttctgcacagaatttggtaaagttaaaacaaaatatctttcaataaaacataatatagtatttgtttgataattagagttggaagaaaaaagagagaatttcttttgggcagtgaaaataaagcagttaacagtc

SEQ ID NO: 8491 - DNA, 951 bp, Homo sapiens
cgaggggcggcgggctagtaaccatagcggctcgcgtgggtcggctggcaagtaaccatagcggcgagcgtggggcggagtgtggctcggtagtcctctgcgtgccctcctgggagctgggtgctgtgagtcctcccctagcgggctggtctcggcgcggagtcggcgccgaacccgagctgctgctctggggcgtgtgcctagggcgcagggctggagcgcgggggctgcgcggttgctcgcggctccgctgaggtctctaggaaagggggcgatttgagggttccgccgtgaccgcttccaacggcggacacgcgcgctctggaccagagccgttgcccgctgtctcgtcacccgaagcctcctcctgacgccgtgctagtgcgagggtctccaggggaattcggggcacaagtcgggccggagcatccgggcggccgcttgagatcggcgctttgagaactgagcgcatgtggagttcggaggaaaagggctcagttgtggaagctgatcgaggaagcctaagcaggctctgtgaagtgggaatagtggtatttgagtcaaggtttgcttaactggaaagcccgtgagaagaatggagcagttgagaatgtggaagctccagagttttcggcaatttctcttcttttttcttgggatgaggagaggtgaataaatagattgaagatggaaaatccccaagacattttctcaagtaatggtggctgtctaagtgatatagttatagaaaaatacctggttgaatccaaggagtctgtgtctcatgttcagcttgcttgcagcatgcaggactgtgctttccctttggatggaactgaactttgtatatggaacactaaggatccttctcatcagcttctaatcctacgaggacaccatcagccaattactgctatggcttttggaaataaagtgaacccacttctaatc

SEQ ID NO: 8492 - DNA, 2192 bp, Homo sapiens
acccccaggctccgcgttcccgccggccccagctccagccccgcagcccaccgtgcaaacatgcttagacagagaagagattaacttcagtggcttcccactaattacagagattaagaagtggctgcctgaactattttccaaaggatacacattacaaattattgaatagggcagctaaccaagaagatcctattggtttggggggaacacaacttccagcagccacaagggatgctgctactcaggtgccaactgaaacaagctcctccacagaaggtttcgtttaggttttgtgtcgtgatggggaaacagcaaagcaaactcaaacacagcacttataaatacgggcctgatgaaattatagaagagagaattcaaactaaagcttttcaagagtatagcccagctcacatggataccgtctctgtcgtggctgctttgaactcagacctttgtgtctctggagggaaagataagacagttgtggcctataattggaaaactggaaatgtggtgaaaaggttcaaaggacatgaacatgagatcaccaaggtagcctgtattcccaaatccagccagttcttcagtgcctctcgtgacaggatggtcatgatgtgggacttgcacggttcctcacaaccaaggcagcaattgtgtggccatgccatggtggtcaccggattggctgtgagtccagactcatcacagctgtgcactggctctcgggacaacaccctgcttctgtgggatgtggtgacaggacagagtgtggaaagagcatctgtctccaggaacgtggtcactcacctgtgctgggtccccagagaaccatacatactacagacctctgaagataaaaccctcagattatgggacagtcgggggctgcaggtagctcatatgtttcctgcaaagcagcacattcagacctactgtgaagtcagtgtggatggacacaagtgtatctcctgcagcaatggctttggaggagaaggctgtgaagccacgttgtgggacctaagacagactcgaaacagaatatgtgagtataaggggcatttccagactgtcgcatcctgcgtctttctaccaagagcattggccttgatgcctttaattgctacctcatcacatgattgcaaggtgaagatttggaaccaagatactggagcctgccttttcaccttgtctctggatggatcaggacccttgacttctctggctgttggtgacgccatctccttattgtgtgcaagttttaacagaggaattcacttactcagaatggaccacagccaagggctggaactgcaggaagtggcagcattctgaggccaagagacactcactggacaatatcaaaccatggctcctcctcagcatggctttgtgtctttcccagttatcttgaggggagtgggatgtagggctggtattctttgcttaggttcatttacaagatgtatcagtgttgtaagtccaataatttaagtccagtgattcaaaatcaggtatagagtccagaaacatggactacacataaggttctctatttaagttaaatacaaatgcaactttttagtgagcttttaggactactcttcaaaaaaagtgtattgctcagaatgatgacctgtaaatgtaagagtggcaggcctctgtctgtgaaagtcagaacacagggctcgagcctctggaactgaccctttgcaagtctttacaaaagaaaaaaggcagtggggagagagagtgttttggttacatcagaaataattgagatgggaaagaatagtgcagctccatagaggagacggactgtagacaatgagattaagcttcaatcactgctcctcagcaatgtgaagaatcaaagtcagggcaagaaagcgaaagcttggacttctattcaaagtggcagcagagtgggagggcggtacccttctagcccagtgctgctgagcttgtgtgaaaatcagacctgagatggcttgaagcagccaagaaccacatgggcattgcccagaattacaggagttagcacaccagctctacagataagaaaacattgaaattcaaagattaaggccaaaaatatctcacttgcaattttaatattttcatttggatttatataaatgaaacatatatatgttttggaatggccagagtgaggcaaaggggatccctga

SEQ ID NO: 8493 - DNA, 2429 bp, Homo sapiens
ggaggctgttcccacccccaggctccgcgttcccgccggccccagctccagccccgcagcccaccgtgcaaacatgcttagacagagaagagattaacttcagtggcttcccactaattacagagattaagaagtggctgcctgaactattttccaaaggatacacattacaaattattgaatagggcagctaaccaagaagatcctattggtttggggggaacacaacttccagcagccacaagggatgctgctactcaggtgccaactgaaacaagctcctccacagaaggtttcgtttaggttttgtgtcgtgatggggaaacagcaaagcaaactcaaacacagcacttataaatacggcaggcctgatgaaattatagaagagagaattcaaactaaagcttttcaagagtatagcccagctcacatggataccgtctctgtcgtggctgctttgaactcagacctttgtgtctctggagggaaagataagacagttgtggcctataattggaaaactggaaatgtggtgaaaaggttcaaaggacatgaacatgagatcaccaaggtagcctgtattcccaaatccagccagttcttcagtgcctctcgtgacaggatggtcatgatgtgggacttgcacggttcctcacaaccaaggcagcaattgtgtggccatgccatggtggtcaccggattggctgtgagtccagactcatcacagctgtgcactggctctcgggacaacaccctgcttctgtgggatgtggtgacaggacagagtgtggaaagagcatctgtctccaggaacgtggtcactcacctgtgctgggtccccagagaaccatacatactacagacctctgaagataaaaccctcagattatgggacagtcgggggctgcaggtagctcatatgtttcctgcaaagcagcacattcagacctactgtgaagtcagtgtggatggacacaagtgtatctcctgcagcaatggctttggaggagaaggctgtgaagccacgttgtgggacctaagacagactcgaaacagaatatgtgagtataaggggcatttccagactgtcgcatcctgcgtctttctaccaagagcattggccttgatgcctttaattgctacctcatcacatgattgcaaggtgaagatttggaaccaagatactggagcctgccttttcaccttgtctctggatggatcaggacccttgacttctctggctgttggtgacgccatctccttattgtgtgcaagttttaacagaggaattcacttactcagaatggaccacagccaagggctggaactgcaggaagtggcagcattctgaggccaagagacactcactggacaatatcaaaccatggctcctcctcagcatggctttgtgtctttcccagttatcttgaggggagtgggatgtagggctggtattctttgcttaggttcatttacaagatgtatcagtgttgtaagtccaataatttaagtccagtgattcaaaatcaggtatagagtccagaaacatggactacacataaggttctctatttaagttaaatacaaatgcaactttttagtgagcttttaggactactcttcaaaaaaagtgtattgctcagaatgatgacctgtaaatgtaagagtggcaggcctctgtctgtgaaagtcagaacacagggctcgagcctctggaactgaccctttgcaagtctttacaaaagaaaaaaggcagtggggagagagagtgttttggttacatcagaaataattgagatgggaaagaatagtgcagctccatagaggagacggactgtagacaatgagattaagcttcaatcactgctcctcagcaatgtgaagaatcaaagtcagggcaagaaagcgaaagcttggacttctattcaaagtggcagcagagtgggagggcggtacccttctagcccagtgctgctgagcttgtgtgaaaatcagacctgagatggcttgaagcagccaagaaccacatgggcattgcccagaattacaggagttagcacaccagctctacagataagaaaacattgaaattcaaagattaaggccaaaaatatctcacttgcaattttaatattttcatttggatttatataaatgaaacatatatatgttttggaatggccagagtgaggcaaaggggatccctgaaataacattagaacatacaggaaaaacgaggcaggcagatcactttaggtcaggagttcaagaccagcctgtacgtgcgtgcctgtagtcccagctactcgggaggctgagatgggagaatcacttgaacctgggaggcagagtttgcagtgagctgagattgtgccactgcactccagtctgtgtgacagaatgagaccttgtcttgaaaaaaaaaaaaa

SEQ ID NO: 8494 - DNA, 2255 bp, Homo sapiens
gttcccgccggccccagctccagccccgcagcccaccgtgcaaacatgcttagacagagaagagattaacttcagtggcttcccactaattacagagattaagaagtggctgcctgaactattttccaaaggatacacattacaaattattgaatagggcagctaaccaagaagatcctattggtttggggggaacacaacttccagcagccacaagggatgctgctactcaggtgccaactgaaacaagctcctccacagaaggtttcgtttaggttttgtgtcgtgatggggaaacagcaaagcaaactcaaacacagcacttataaatacggacagttgtggcctataattggaaaactggaaatgtggtgaaaaggttcaaaggacatgaacatgagatcaccaaggtagcctgtattcccaaatccagccagttcttcagtgcctctcgtgacaggatggtcatgatgtgggacttgcacggttcctcacaaccaaggcagcaattgtgtggccatgccatggtggtcaccggattggctgtgagtccagactcatcacagctgtgcactggctctcgggacaacaccctgcttctgtgggatgtggtgacaggacagagtgtggaaagagcatctgtctccaggaacgtggtcactcacctgtgctgggtccccagagaaccatacatactacagacctctgaagataaaaccctcagattatgggacagtcgggggctgcaggtagctcatatgtttcctgcaaagcagcacattcagacctactgtgaagtcagtgtggatggacacaagtgtatctcctgcagcaatggctttggaggagaaggctgtgaagccacgttgtgggacctaagacagactcgaaacagaatatgtgagtataaggggcatttccagactgtcgcatcctgcgtctttctaccaagagcattggccttgatgcctttaattgctacctcatcacatgattgcaaggtgaagatttggaaccaagatactggagcctgccttttcaccttgtctctggatggatcaggacccttgacttctctggctgttggtgacgccatctccttattgtgtgcaagttttaacagaggaattcacttactcagaatggaccacagccaagggctggaactgcaggaagtggcagcattctgaggccaagagacactcactggacaatatcaaaccatggctcctcctcagcatggctttgtgtctttcccagttatcttgaggggagtgggatgtagggctggtattctttgcttaggttcatttacaagatgtatcagtgttgtaagtccaataatttaagtccagtgattcaaaatcaggtatagagtccagaaacatggactacacataaggttctctatttaagttaaatacaaatgcaactttttagtgagcttttaggactactcttcaaaaaaagtgtattgctcagaatgatgacctgtaaatgtaagagtggcaggcctctgtctgtgaaagtcagaacacagggctcgagcctctggaactgaccctttgcaagtctttacaaaagaaaaaaggcagtggggagagagagtgttttggttacatcagaaataattgagatgggaaagaatagtgcagctccatagaggagacggactgtagacaatgagattaagcttcaatcactgctcctcagcaatgtgaagaatcaaagtcagggcaagaaagcgaaagcttggacttctattcaaagtggcagcagagtgggagggcggtacccttctagcccagtgctgctgagcttgtgtgaaaatcagacctgagatggcttgaagcagccaagaaccacatgggcattgcccagaattacaggagttagcacaccagctctacagataagaaaacattgaaattcaaagattaaggccaaaaatatctcacttgcaattttaatattttcatttggatttatataaatgaaacatatatatgttttggaatggccagagtgaggcaaaggggatccctgaaataacattagaacatacaggaaaaacgaggcaggcagatcactttaggtcaggagttcaagaccagcctgtacgtgcgtgcctgtagtcccagctactcgggaggctgagatgggagaatcacttgaacctgggaggcagagtttgcagtgagctgagattgtgccactgcactccagtctgtgtgacagaatgagaccttgtcttg

SEQ ID NO: 8495 - DNA, 9471 bp, Homo sapiens
ggggaagatggcggctgctcctttggaggagcgggattgagaggatcggggtggggagaccaaacaagagagacatttctggctctgaaggcgaacgcttcgctggccatttaggagctctgctcaaagccagacgtatcctagaaggaaaacatcaccatggctacagaaattggttctcctcctcgttttttccatatgccaaggttccagcaccaggcacctcgacagctgttttataagcgacctgattttgcacaacagcaagcaatgcaacagcttacttttgatggaaaacgaatgagaaaagctgtgaaccgaaaaaccatagactacaatccatctgtaattaagtatttggagaacagaatatggcaaagagaccagagagatatgcgggcaattcagcctgatgcaggttattacaatgatctggtcccacctataggaatgttgaataatcctatgaatgcagtaacaacaaaatttgttcggacatcaacaaataaagtaaagtgtcctgtatttgttgttaggtggactccagaaggaagacgcttggtcactggagcttctagtggggagtttaccctgtggaatggactcactttcaattttgaaacaatattacaggctcacgacagcccagtgagggccatgacgtggtcacataatgacatgtggatgttgacagcagaccacggaggatatgtgaaatattggcagtcgaacatgaacaacgtcaagatgttccaggcacataaggaggcgattagagaggccagtttctcacccacggataataaatttgctacatgctctgatgacggcactgttagaatctgggactttcttcgttgccatgaggaaagaattctccgagggcatggtgctgatgtgaaatgtgtagactggcatccaaccaaagggttagttgtttcaggaagtaaagatagtcaacagccaatcaagttctgggatcccaagactgggcagagtcttgcaacacttcatgcccataaaaacacagtaatggaagtgaaattaaacctcaatggcaattggctactcacagcatcacgtgatcatctctgtaaactttttgatatcagaaacctaaaagaagagcttcaagtcttccgaggtcataagaaagaagccacagctgtggcctggcatcctgttcatgaaggactttttgccagtggagggtctgatggttctttgttattctggcatgttggggtagagaaggaagtgggtgggatggagatggctcacgaagggatgatctggagtctggcttggcatcctcttgggcatattctctgctcaggctcaaatgaccatactagcaaattctggactcgaaaccgaccaggtgataaaatgcgagatcgatataatctaaaccttttacctggaatgtctgaagatggagtagaatatgatgacctcgaacctaatagcctggcagtaattccaggaatgggaataccagaacaactaaaattagctatggaacaagaacagatggggaaagatgaatcaaatgaaattgaaatgacaattccaggtttagattggggaatggaggaagtgatgcaaaaggatcagaaaaaagtacctcagaagaaagttccttatgcaaaacccattcctgctcagttccagcaggcttggatgcaaaataaagttccaattcctgctccaaatgaggtgctgaatgacagaaaagaagacattaaattggaagagaagaaaaaaacacaagcagaaattgagcaagaaatggctacattacaatatactaacccacaacttctggagcaacttaaaattgaaagacttgcacagaaacaagttgagcaaattcagcctcctccctcatctggcacccctctcctcggaccccagccttttccaggacaaggtccaatgtctcagattcctcaaggttttcaacagccccatccatctcagcagatgccaatgaacatggctcaaatggggcctccaggtccacagggacagtttaggcctcctggaccccagggacaaatgggaccacaaggtcctccactgcatcagggaggtggggggccacaaggattcatgggaccacaggggccccagggcccgccccaggggttgccacggcctcaggacatgcatgggccccaaggaatgcagaggcatcctggacctcatggccctttgggacctcaagggccacctggaccacaaggtagttctggtcctcaaggtcatatgggtcctcagggtccacctggcccacagggtcacataggcccccaaggcccgcctggccctcagggtcacttgggcccacaggggcctccgggtactcaaggtatgcagggaccacctggtcccagaggaatgcaagggcctcctcatcctcatgggatccaaggcggaccagggtctcaagggatccaaggtcctgtgtctcagggacctctgatgggattgaatccaagaggaatgcaggggcctccaggcccccgggagaaccagggtcctgctccccaagggatgattatgggccacccgcctcaagagatgagaggacctcaccctccaggtggactactgggacacggccctcaggaaatgagaggtcctcaggagatccgaggcatgcaggggcctccaccccaaggatcaatgctgggacctccccaggaattgcgagggcctccaggctcacaaagtcagcaggggccgccccagggctctttaggacctccaccccagggtggcatgcaaggaccccccggacctcagggacagcagaacccagcaagagggccacatccatctcaagggccaataccattccagcaacagaaaacgcctctgctaggtgatgggccccgggcccccttcaaccaggaaggacagagcacaggccccccacccctgataccaggcctagggcagcagggagcacaaggtcgcattccccctctgaaccccggacaaggacctggccccaacaaaggtgactcccgcggccctccaaaccatcacatgggcccgatgtcagagaggcggcatgagcagagcggcgggcctgagcatgggcccgagagggggcctttccggggtggccaggactgcaggggtccccctgataggcgtggccctcacccagacttccccgatgacttcagcagaccagatgacttccaccctgacaagcgctttggccaccggttacgtgaatttgaggggcgaggaggacctttaccgcaagaagagaagtggaggcgagggggccctgggcctccgtttccccctgatcacagggaattcagcgagggggatggccggggtgcagcccgaggccctccgggggcatgggaaggccgcaggcccggagatgaacgtttcccccgggatcccgaggacccacgttttcgagggcgcagagaagaaagtttcagaagaggagccccgccgaggcatgagggccgtgctccccccagaggaagggatggttttcctggtcctgaagactttggtccagaggagaattttgatgcttctgaggaagcggcccgaggacgagatctcagaggtcgaggtcggggtaccccacgaggaggaaggaagggtttacttcccactcctgacgagttccctcgctttgaaggagggcggaagccagattcctgggatggaaacagagagcctgggccaggtcatgaacattttcgtgatactccccgccctgatcatccccctcacgacggtcattccccagccagcagagaacgctcctcttctctccaaggcatggacatggcatccctacctccccgaaagcgcccctggcatgatggcccaggcacttctgagcacagagagatggaggccccaggaggcccttctgaagaccgaggaggcaaaggccgagggggcccaggacctgctcagagagtgcccaaatctgggcgttccagctccttagacggagagcaccacgatggataccacagagatgaaccttttgggggccctccaggcagtggcaccccttctcgagggggccggagtggcagtaactggggtagagggagtaacatgaactctggcccgccgaggcgaggagcttcacggggtggtggaaggggtcggtagaagctggaactgagtaccctgaggcctctctggacagtatgtaagaacttcttgtggactcaccaagagaaacaaaaggaagcctgcaccattgtagccctgaactcttttctgggcacctgaatcccaggaaccctcaatgaggtcttcaagatgaagagactgctgccagctaccagcctggctggccctgtcctgtccaccctcattgccccaactcccatgttgttttgtgaagataaaagctgggatctttttcttttttttaagtctcacaagacatggggcatctccacaaatttaagttcctgtccatttggaaatttgtttctatgtgtacagtttgtcagagaaaaacaaagtttttgtatgaatacagaatgtgatttacgcaagaattgacagaaaactagttgtgaagtgcttgccttaaggaaacctttggtttccatcgcatcccatctgccaaggaatgcacggttgttgctgatgttcatgagcatattaaccactaggttatctaaattaatctcagctgtgaactttgtgtttttcaacacattctgtcacaccatttttgtgacagaaaaatacttgaaaattattctaatgtagtttgtagtaggttcaaatttttattcagacatgctctgacagatggaaaattgtactctgaagagaaaatgcaatcttctggatgtccaacgagggagcttccccttggaagcatctcctaagaatcacagtttaggtttgaatcgccttgttatgatgaggagaggaacttgatgttagtcagaaataaagtcacatgccctttagataacttgaaatcacacatggagttgataaggaatggaccaaaataggtcctcaaacaattttgcaacacttaattaagttttcctctcttcctcttccatactatgtggaaataccagtgttacggcagggcgtacttctaactcacagtaagccagatagatcttgtccatggcaaattccttgtttaaaataaacataccatttagcccagtttggattggaagccaaaaattcagtttgttatataccccatgatactttctatactgacctttattttggttttacatggaagcttttattaaaaggactgtcctatggccaccttaacatttcattacattggcagcttcagttttggcatcagtcaaatttatttggcaaatttagtggtgctggaagtttctttttttcttttccttttttgacagagtcttgctctgtcacccagccaggagtgcagtggtgcaatcacggctcacttcagctttgaccctgcctcagcctccctagtagctaggactacaggcatatgccaccatgcccagctaattttttgtgtgtgtgttttttgtagagatggagtttcaccactttgtctatgctggtttcaaactcctgggctcaagcggtccacctgctgtggcctcccaaagtgctgggattgcagatctgagccacagtacctggccgctggtgctggaagtttcaatggttgcttagaaaaggcatactgatatagtttaacaggatatgaaaatttaactggttctctatgaatgtaaaaaacagcaaaagctaattgatttctgtggagtgagaaaatgtcagccatatacactgcttttcagtgttagaatctagagactattttttttttaactttgaaattacagcttatttaatcagcgctccaccataaacatgctattaggaggctcaagattgctttaggttatgggtatttcttcactcacccccaactggtatagcttaaagagagagaaactgtaatcaaatttcatgaagctaaaaccggatccagagaccaaacccatatcaagattagactttttttccctgagattctagtggaaaaattttcattattttgggctttaactttagaaacatagtatctcagtaagcagataaccagatcacatttaaaaattttcattttaccttgaagctctactggacttgacagatcacattttgagagtgaattcatttaaacaataaacctctacattatacttattaaatatatatggcatttaaaaacatcactgtcagcatacatactagatgttgtgatttgaagcttataaaaagtagattttcaatgatgtttgatttgagaaaaaatttttgagacaaggtctcgctgttgcctaggctgtggtgcagtggtgtgatcacagttcactgcagcctcaacctcctgggctcaagtgatcttcccacctcagccccaccccaagtagctgggatcacagttgtgtgccaccatatctggcaaattttttgaagattttctgtggcgatggggtttaactgtgttgcccaggctggtcttgaactcctggcctcaagtgatcctcccgccttggcctcccaaaatgctgggattacaggtgtgagccaccagctgagaaatgttgaatttttaagtttttatttaagaaataaacattgtaaaacatcattataaaacccccaactattgcaagttctagagaaatttaaaactagaacagaaatttaggggactagaaagagcagccaatggcacaagtctttacaattaattaaaaaaataaatcattctgaagatactgcatttgctctctcacaagcagcctcctgaggtaggtaaccttgtttactgatggggaacaaggcagtgttctttaccaaatctcagggcgggtagcctgcaagcctacagtgtggatgttggccacttgtgtcacttcttgggacggggcttagggacctgacttacttaggaacataaattttggggttggaggaagcagcagtgctctactgcggcacgacagacaccctgttaaggcaacactgggatccagctcaggaaaagcattactttcaaattgtgcaagccaatgcacagaaaagtggtcctcaaacttggggaacgtagaatcacttggggagctttaaaaaggtcctgatgtctgggacctacttcccaggttctgactgcattgatctgaggtgtggctcttcaagtaactgatgtgcagtcaagcgcgaggaccactggcacacaatgtttaaattctaaatatattttacttcctagtgtattgctactgacaaaacgtagttttctggactcatcagaatgttaggctcataccttctggcaataaattaaggtagttaaaagtaactgctgaacctaaaatgaaggcagcagcaattagatataaaaaaatcttaagatcagcctgcaaattgtaaactagtttacaaagcaggctatacaatgaggaataattcgagcttgtagaaatccatggtttccaccagatacaggtattccggatctagaattatctttctatttgcaggatttccgaagagaccgttaagcatctacgcgccccttcctggatcccatgcttcttggggcaggaaatttcttttggtccgtcgctttcgtcgtgaaatacacaactaattttcctttcatgttataaggcaccatatttatgattttgttaactgaagaaaaaacccgagataaaccatcttaagtacttttaaaagtccagtggctgaattcggtgtttaatctgatacccttctggattcgctgacactggagagaataatttccaagtcttagtatagccaaaacaaaaaactaccgtcgctaagctacatctaccactggattttaaaatgacaaaacagcctgagaaaaatcacaagagcagctaactcgaagaaaaatcctttttctttactcagccgaacctaagaccacagttacttcgaaagcaacttctaataaccgtctcacatcctgtcaccagttcaatgacaaaatctcagttttcagagcgtgtgccaagtccagcacaaaaagctgacatcgaggagctcccaacgctgctgtcgcctccgctggcagcagccgctcccggattagactcgcaggctgttagggcagggccttcgccacgggcttccgcacagcggcgtgcagtcctcagctcggccggcgcggtctccgacggcgctggctccgcgtacttccccagcggcgagggcgcgaggtcctcacacgggcagcaccttggcgaggccggcgccgcggcccaggcgacccagtgcgaggcgcagcgcggtgccgccgccccagggcagcagcccaaccagcgcggccagcagcgcggccacctgcgcgcccgcgcccagcaccgtgagcagcgtgctgcgaaggcccagcgcggcgaacagcgtggcgcccagcgctgccatgtagagcagcgcgggccgggacggcgcttcttcgcagcgcagcaggcgtccgcacgccgcgccgccccgcagcagcgcgcttcccgccaacgccagcgccgagcccagtgaccagagcagcgcgaacttgcgcgcgcgcagcagcaacaccggtgcgtagagcgcggctaggccgaaacacagtgcagccagcagcaggcacccgccgcccgccgccagccgctgcccgcgcgtcacgctcgggaggcacgtcaggccggccgctgccgactccgcagggctccgcgcccacgtccagcgcaagcccgcgcggcccagccactcctccgccggccggtccccgggctcctccgccttctccgcggcgagcagcggctccgcggccgccgggccgccagctttcccctgcgccaggtactcctgcagctggcggtggaggtccgccatcttggacaaggcggtggcagaaaggaaaagctgcggctcacttccggccctccgctgaagcggttcggtcttcgggcggcaattggtcggcgacggcgaaaggggcagggcctgcggcgctcgcggaagtgccgcggtgcctgctctgcggacttttgtggtgtccccaagtaccgtggtcgcaggtgctgcctgtccgcttgcagtcgccctcccagcgcctgaccctcttccttgttcggagtaggcgcccttgcggtctggctaagtcctgccagcattaatagttggaaggcaggggtgggtgtggttctaaaggggcacaagaagtgacccttttgctgacggaaatgtcttatggcctcactgcgtctaccgtggcggtgatattgtgctagttttgcaacatggaggaatgggtaaagggtacacagaatctctcttgtttcttacaactgaacacaaacagtgatctcaaaataaaaatttaatttttaaaaaagttca

SEQ ID NO: 8496 - DNA, 3574 bp, Homo sapiens
agagcgtgcgttcggtggcccataggggaagatggcggctgctcctttggaggagcgggattgagaggatcggggtggggagaccaaacaagagagacatttctggctctgaaggcgaacgcttcgctggccatttaggagctctgctcaaagccagacgtatcctagaaggaaaacatcaccatggctacagaaattggttctcctcctcgttttttccatatgccaaggttccagcaccaggcacctcgacagctgttttataagcgacctgattttgcacaacagcaagcaatgcaacagcttacttttgatggaaaacgaatgagaaaagctgtgaaccgaaaaaccatagactacaatccatctgtaattaagtatttggagaacagaatatggcaaagagaccagagagatatgcgggcaattcagcctgatgcaggttattacaatgatctggtcccacctataggaatgttgaataatcctatgaatgcagtaacaacaaaatttgttcggacatcaacaaataaagtaaagtgtcctgtatttgttgttaggtggactccagaaggaagacgcttggtcactggagcttctagtggggagtttaccctgtggaatggactcactttcaattttgaaacaatattacaggctcacgacagcccagtgagggccatgacgtggtcacataatgacatgtggatgttgacagcagaccacggaggatatgtgaaatattggcagtcgaacatgaacaacgtcaagatgttccaggcacataaggaggcgattagagaggccagtttctcacccacggataataaatttgctacatgctctgatgacggcactgttagaatctgggactttcttcgttgccatgaggaaagaattctccgagatacatgttttcatcactgccgttgttacttcctttctgtcaagaggtgaataacagtaggtggacaaagtttagggagccacatttaccaacttctgtgaatatacccaagaagattctggcaaaacatagattcaaattacagttgatgctgtggatggctatgggttaactactcttctactttgacacggattatttgttgcttttatgtttctaaattctcaattaaaaagaagtgtatccttaatctggccaactgaaagtgaacttgttcattcacctctaccttgctttcaaaaggactgcttaccatggaagtgctccagaagaatcatttgaaacatcttttgttttccttcttggttctgcgttttcttccttaccaggggcttcagtcatggcttctctttattcttggcctgggttgtctgctggcactaatacatctattattaacgtagtgtaggtactggcctttctaatagtcttggtatttagtgccagactcccatcaatcttttgaatgtcttttctttttctttttgcacttttctagcttttcaagtgatgactatatactgcttttcttgactgtatatattgttactgaattgtgaatatctgcagaaatgtttactagagaacctgtgactgttgaataacatgtgcccgaacatacacacacacatatgtacacacacacctcagagtactctttcttacagcggactttgctgctgctttctgcatgtgtgggacactggtatctcccgtctcagacaaatggctgatgttctctatgatattggtgttaatatcaaagaattgaatgaatacaacagaattgaggttgaaaaatatttgattgccacattcctttaagcatctttgatgaatactctgcaaagtagcctttaaaaaaatgtaaattttttaaaaagtccacagaggagaatttgctggttagcacaaaacatactgcaaaattgcttctttctggttattataactgaagaatatagaagattgacacacattttatacaccctcaggcagtgttttggaataatattgtaccttttcaaattgttatcaattaactgtttttctccatttcataattctcaagatttttctaaatacagcctttaaatttgactcaaatggaaattgtgcactttcctgtttatacccttccccacgttattgtaaaagagtttaacagcagcctgatatgtaagtttcagcaaaacttatacctgtatatgtttttatttgactcaaaaattagatattttaccatatagtcataagaatttgctcactttgatgccagaagtacttaagaagttacacggcactaattttatgagttgtatgcctaatttcaatttctaacctatttgacagtttcttttaggtcagcctttgttggtcttccatgtaaatacaagttggtacaaatcaatagaaaccattttacctacataggcaaagtaaatgtgtgacttagagactgccagatttatggtgcatctacctttttatccatttgagcttgcttttttatgtttgtgtattggttgctcctgacactatacatttcaaaattttttataacttgaaaaacacttctgtgctaccactcagttctgatcaaatccttacattttgcaacactcatttctgaattttcagtaaagaaatacacattacaaattaaaggttaaaggcccctttacatgcccttccccagtctcctcttcctcccccggaagtgtccattctgctgaattcaggttcatcattgccagacaaatgtagtaagctagtgtttcacatttccaaaatcagccttctggcagacttggaagtactcttgagaaaagaagactcgtgaccaaattctcccacagatttgtaataatgtacatattgaaaggactgaaggctctcagactgggaaagaaacttacccattttaaaattcagcattgctcaacttacctgactgccggaccccttcacccatgattctatgcactgtattgttggaacatacattgtgaaaacactgccctgcctaggcataccccctttccagaattaactttccatttaattctatagtttttcactgatgtaactttctagactggacaacaaagatgactaatagtaatcactccaagttgatgttgactgttgggttgtggtgaaatcattttgcattaaaggaaggtaaaatactaataaattgcatattccttgaccagagcacagattacttatgcttcttaattttttaaaatcttaaatcctctgtccaactggagtatctggctatgggccatgggtactcatataccctttgtcttaaactgatctgttacattttatgttcttgtggctagaagtagcctgagtttgctgttaatgtttaacacattttcttgagtaacagttctgttaatattgtacaagatggtacttgaattctttgtttgccttttttcttcctgtattagaaaatcttggtgctttttataagttttgtataaaagaattttttttaagatttgttcataaaatggtctgatccaggaaaaataaaatgggaacatggacaccatttctgaccttcaaataaaacttattatgtat

SEQ ID NO: 8497 - DNA, 583 bp, Homo sapiens
attttcgggctcggccgttgcgtgctttgggggcctggacgggcgcctgggcacaggttggaggaactgggagaatcgacctcggggcggctgttcgaggcaggttcgagacttatgggagggggctggaggctggaggccaaccgggaaaagcggccatggttagaactaaggccctgactgggagcggtggcgacgagaagactatcctagaaggaaaacatcaccatggctacagaaattggttctcctcctcgttttttccatatgccaaggttccagcaccaggcacctcgacagctgttttataagcgacctgattttgcacaacagcaagcaatgcaacagcttacttttgatggaaaacgaatgagaaaagctgtgaaccgaaaaaccatagactacaatccatctgtaattaagtatttggagaacagaatatggcaaagagaccagagagatatgcgggcaattcagcctgatgcaggttattacaatgatctggtcccacctataggaatgttgaataatcctatgaatgcagtaacaacaaaatttgttcggacatcaacaaataaagtaa

SEQ ID NO: 8498 - DNA, 3104 bp, Homo sapiens
agagcgtgcgttcggtggcccataggggaagatggcggctgctcctttggaggagcgggattgagaggatcggggtggggagaccaaacaagagagacatttctggctctgaaggcgaacgcttcgctggccatttaggagctctgctcaaagccagacgtatcctagaaggaaaacatcaccatggctacagaaattggttctcctcctcgttttttccatatgccaaggttccagcaccaggcacctcgacagctgttttataagcgacctgattttgcacaacagcaagcaatgcaacagcttacttttgatggaaaacgaatgagaaaagctgtgaaccgaaaaaccatagactacaatccatctgtaattaagtatttggagaacagaatatggcaaagagaccagagagatatgcgggcaattcagcctgatgcaggttattacaatgatctggtcccacctataggaatgttgaataatcctatgaatgcagtaacaacaaaatttgttcggacatcaacaaataaagtaaagtgtcctgtatttgttgttaggtggactccagaaggaagacgcttggtcactggagcttctagtggggagtttaccctgtggaatggactcactttcaattttgaaacaatattacaggctcacgacagcccagtgagggccatgacgtggtcacataatgacatgtggatgttgacagcagaccacggaggatatgtgaaatattggcagtcgaacatgaacaacgtcaagatgttccaggcacataaggaggcgattagagaggccaggtttatacacaatataccattttctgtagtccctattgtcatggttaaattattctctaagtgtattctgggtgcagagatgcatgggctctgtcagtttctgggaaactttctgcaccctataaacacaatatttttctttgttttcacacattcaccattttgctggcacctttctgaagtagtgttgtcccggtatcagcctttgcaatatgttagagatgtactgtctgccgcattttgcactggttttctcttttcatttatgattaataatgtgtatacgttattcctttttattatctactgtgtaagacaagaatatttcattccaaataaagaattcagtctttaattatgcaactgaataaaatctaaagcctacagaaaacaacttcagaattcacacaaagtggaaaaaggcttaagtgaagacctggttggcttggttatgccacgacttccaaaggaaagtataggactaaaaccctcacagataactggatgtggcaaacattaacggagtaatgaatgggttcttcaagctttgcagctgtaagcagatcattgtcaagaagactctaggacttttcttctgattcactgttgataacatcacttatgcaaatgtatacaataagtggagtttaaaatattttcagtgagttgtatatttttacacatcagtgaggtatgtatagtaaaactgggggaaaaagttccaaatacaagcctgaagaattgctgcagcctcagaataaagctaagcagcattctttaaggttgtgccacccatgtgtgggaggaggttgacatctttatggaaacatcatccactgtagtcatttgttcatactttcagaatcttaacagaaattgttggatgaacatgcttctgctttgtagattttgccttagtgtcatgcccatacattgagtttacacagctggtccttcataggattccaaagttcaagggagtttttagagttagttgagaaacttgatgatctttcactgctgggaaaaactgactccttcttgcagcagattctttggctttacacacaagtctgaatgtccttattttaaagttttcctcaaaggtgcaacattcatggaatagcttgccaggaagatgtgaaacttttctacagacctttgaaatggatgagaaacattgtatgtagggatgtttagcaatcagtcttttaatagacagcccacattgtttcagcttatttcatgaagtgtctgaggcagaagctgatgataattttgggagcagtattcgtgtgtgatttaaaagactgcaggaatactgcaaaaatagaatccatttattttcaccacttaaggcagcttcatgtgatttcctcgtatcatagaaaatagagaaggaacatggatagcattagcactaataatacacacttgaagttctcagaatactgatgattgaaaactcaaacaactgctctgttgaagtcttcttttgatgagatgcctatgttagctgacgacattcactttaagggcttcttcactggattcttccctctcctgtttataatgcagcacagtgtttttatttttccctgtctgagaagcacagattatctgttaaatgctgacttctttcccctgctgtgtgtcttcatgtaacagtttctcacccacggataataaatttgctacatgctctgatgacggcactgttagaatctgggactttcttcgttgccatgaggaaagaattctccgaggtacgtgtactaacagtactgattggaatatttaaatagggaagacatttgtggttaaatcatcacaaaaccacaatactggcttacacctccattcaattttttttacatatacacaccgtctcaggctcttcaaaaaaacccagcactttctctgactcacagtcattttgtaggtttttactaccagtgttatctttgaatttttcagctgtaaattaaatacaagagtgcctcccccttacttgcttatctgtatgcatcttttagggctgtattccttttccttccttgtagccagggtacttgttcccaacatattgacactgtggtttgatttagatagccgtcattctcctggcagtccttttacaatatgaattaaccgacaagatagaggtatcaaagctacacttcttagtgttactatttttgaaagcagttggtttttcagtacaccacatttgtactacatggccggcttgttactaagttcgggtggcattgctgcttgtttacttttgttgat

SEQ ID NO: 8499 - DNA, 4462 bp, Homo sapiens
gcggtgtcctgcgcgtcttcgggtcagtacggggggccgcgtcgtagggactcactggcggtgcgcgacctgggctggctccgggggtggcgggcgcagctgctgtgacagcttattgcaggagtgaccaggacactacctcctagaagtaatgcccacagaaagcgcaagttgttcgactgctcgccaaacaaaacagaagcgcaaatcccatagcctttctatacgaagaactaacagctcggagcaggagaggacgggactgccaagagacatgttagaaggacaagattctaaactgccttcctcggttcgcagtacacttctggaactgtttggtcaaatagaaagagaatttgaaaacctttatatcgaaaacttagaattacgtagagaaatcgacactcttaatgaacgtttagctgctgaaggacaagcgattgatggagcagagctgagtaagggccaactcaaaacaaaagccagtcacagcaccagccagctctcccagaaactgaagaccacttacaaggcttccaccagcaagattgtctccagctttaagaccacgacatcgagagctgcctgccagctcgtgaaggagtacatcggccaccgggacggcatctgggatgtcagcgtggccaagacacagccagtggtgctcgggactgcatcagccgatcacacggctttgctgtggagcatagagacagggaagtgcctagtcaagtacgcaggccacgtgggctcagtaaattctatcaaatttcatccctcagagcagttggctctcactgcttctggagatcagactgctcatatctggagatacgcggtgcagctgccgacaccccagcctgttgctgacactagtatatctggggaagatgaagtagagtgctctgacaaggacgagcccgacctcgatggggatgtgtccagcgactgccccaccatccgcgtcccactgacatccctcaagagccaccagggcgtggtcatcgcctccgactggctggttggggggaagcaggctgtgactgcctcctgggaccggacggcaaacctgtacgacgtggagacgtccgagctcgttcactctctgacagggcacgaccaggagttgacgcactgctgcacacaccccacccagcggctcgtggtgacctcctcccgtgacacgactttccgcctctgggatttcagggacccctccatccactcggtgaatgttttccagggacacacggacactgtgacttctgccgtgttcaccgtgggagacaacgtggtttcaggcagcgatgaccgcacggtgaaagtctgggacttgaaaaatatgagatcccccattgcaactattcgcacggactctgccattaacaggatcaatgtatgtgtcggccaaaaaatcatagccctcccccatgacaaccgacaagtgagactgtttgatatgtcaggagtgcgcctggcgcggcttccccggagcagccgacagggccacaggagaatggtatgctgctcggcatggagtgaagaccaccccgtgtgcaatctgttcacctgtgggtttgaccggcaagccattggttggaacatcaacatccctgcattgctacaagaaaaataaggacaccggcagcccttagtttcactgtttgccagcacagacctttgatgggtgcaggcttttctgcgtattaatcagccatttttgtgagagtttgaccctggaaagggtgctttgtatatgttcttttcacatagtgcccagcttgcatgaaatgtacagagaaatgtgtggtcgtattttttacttttgtcttgtatatgtatgtatattgggtcctctgggcagtagaggcaaagctcacctcccatgtagcacatgaaatgcttgtgagttgttgacattggacaggtgaacagtagggcattacatttgtgtgaattaaatgtgaacttctgtattacgttgcggcgtcggcagtcctgcgttccctggagtaactgtacgtatctgcctttgctgggaagactgtggggctgcctgtgttggctggcgaccagcaggattgctccaggattttgtgtttacctcgcgtgaagttcagcacgtgctgtcgtgtagtcagcttctactctaatttctgttacagttctgcaaaggtaacctggagtttagaagttaaaaaaaagcatgggatgttggatttgcaccatttggagtttctttaggaaagaaaagttttctgcttttttatagaaaatcatttcagtctcccgaggtctcatgctagcaaattttgaaataggattctaatcactgatttcaaatattaagcaaaatgtaaagcactttaatttatagctatggttataaacaggttttagatgtttcaaatgacttgtccactgaatgtcacttgaccttgataagaggccgcctgcacacagagcccagttaattctccgcacctcggttgtgtgcttccgaatgggctcactcccgtggtggtgtttgagagccaacaacactacctcagagacgggtctttgggaaactttgggtctcactgttgcctggctggagcactttggtttatagctggaatactgagttcagttcagaaggcaggaaagacagtcacaccgacgtgtcctgaaggtgtaggctctccacttaggcgcacaagctgacggctgcagccagcaggccccggtgacgagacacttccaggtcttgtggtggggacgcctctcagtgccagtcccgccactgctgagtgagcctggtgttcttgccttcttggaaattactgctcacctggtatctgtacgttaatgtttcttgctgagttacagttttgataaagaggctctcatttcctgtgtcttgtatattcagtcctttcaatacgtccacctggaggctcaccacttggagagacacaggaaggtaatatttacagctgtcatgtgacatccccaggtctttgtgttttgccctgttttacggtgaggtaggagggaacccatctggggaccggtaggtgcaggtgcagtaggacgtgggacttttggacccgtcctttggtgcagctcgccagggatgagaggcacctccctacttgggtcttcaggagctggtccaaggagcttcgaatctaagtcatctagaatgaccctgaaatgactgacagccccgggcccaagaaaaacccataaccacctcagatggatctgacgtggctaagggacaaacagcaaatatttcagtcattttgattttacaaataaaaaatgtgttgtgtttttgtccgacattatttcctgactgcactgttctgagaatggagtccacctggtccctctggttgattagaatctcaggtttcagctcctgctgtcctgagcgaacttgcctgatgcagggctgtgctgtgtccagatgttgctggggcctcactttttctcttggctggaggtccaattgccagagcctcccacactgcacatacaaaggtctgagcccagggcagcttctggggccactgcacaggccacctgcttgggttcctcggagtttaatttgaaagtctgggtgtcttaggatgatggttaggaacattgaaaaatggctgcaaatagccaaatcaaacttaagaaccagatctctgccagattaaacatttttgaagcttttaaaagtcaatattcctagtggccactgagttccaggcacactggtgccctttactgccacagctgctcaccttgtctggcaaactggagggacctcagaaactggactcctgcatgtccttgggggcgcagccctgtggtgctcaggcagagctctcaggagccggggcaccttgctgttcgctgctgtgtcgtcttctaatgtgagctcatccactgctgctgcagcgtggtgatcaggagtcacagacaagatcggggatggtgtgtgtgtgtgtgtgtgtgtgtgtgtgcacgtgtgtgtggctaaattaagtcatactgtcaaccacacgtgatctcgtctgaaacagtgtttggaagtgggaacagttttgtcctgtatgctgatgtgtccagaatttcatttaatgatagacggaaaatgtgtggttactgaaaactgtatatgatacagaatttcataagagccatgctgttgggcaaagcaactctttttcaaccactgctcatcagtttctgtagagacaaaaactctgtacatattttggaatctgaagaatcctatgtaaatcatttgttacttaagtctgtgaaaaacatatttctttggaggaaaatgtatgcatttataagtgttccatggaatcagtttttattgtatcgatataattgtctctaagtgttgactgtcttcattgcaatatgaaattcattaaaatgtccatgttccataattactattataaaa

SEQ ID NO: 8500 - DNA, 4582 bp, Homo sapiens
agaacgatggcctttctgcggtgtctgcgaccgggaccaaggcggagcaaagtcgccgggggtgtggggtgttccacgctatgttgggagtgttcgctttcgagcttattgcaggagtgaccaggacactacctcctagaagtaatgcccacagaaagcgcaagttgttcgactgctcgccaaacaaaacagaagcgcaaatcccatagcctttctatacgaagaactaacagctcggagcaggagaggacgggactgccaagagacatgttagaaggacaagattctaaactgccttcctcggttcgcagtacacttctggaactgtttggtcaaatagaaagagaatttgaaaacctttatatcgaaaacttagaattacgtagagaaatcgacactcttaatgaacgtttagctgctgaaggacaagcgattgatggagcagagctgagtaagggccaactcaaaacaaaagccagtcacagcaccagccagctctcccagaaactgaagaccacttacaaggcttccaccagcaagattgtctccagctttaagaccacgacatcgagagctgcctgccagctcgtgaaggagtacatcggccaccgggacggcatctgggatgtcagcgtggccaagacacagccagtggtgctcgggactgcatcagccgatcacacggctttgctgtggagcatagagacagggaagtgcctagtcaagtacgcaggccacgtgggctcagtaaattctatcaaatttcatccctcagagcagttggctctcactgcttctggagatcagactgctcatatctggagatacgcggtgcagctgccgacaccccagcctgttgctgacactagtatatctggggaagatgaagtagagtgctctgacaaggacgagcccgacctcgatggggatgtgtccagcgactgccccaccatccgcgtcccactgacatccctcaagagccaccagggcgtggtcatcgcctccgactggctggttggggggaagcaggctgtgactgcctcctgggaccggacggcaaacctgtacgacgtggagacgtccgagctcgttcactctctgacagggcacgaccaggagttgacgcactgctgcacacaccccacccagcggctcgtggtgacctcctcccgtgacacgactttccgcctctgggatttcagggacccctccatccactcggtgaatgttttccagggacacacggacactgtgacttctgccgtgttcaccgtgggagacaacgtggtttcaggcagcgatgaccgcacggtgaaagtctgggacttgaaaaatatgagatcccccattgcaactattcgcacggactctgccattaacaggatcaatgtatgtgtcggccaaaaaatcatagccctcccccatgacaaccgacaagtgagactgtttgatatgtcaggagtgcgcctggcgcggcttccccggagcagccgacagggccacaggagaatggtatgctgctcggcatggagtgaagaccaccccgtgtgcaatctgttcacctgtgggtttgaccggcaagccattggttggaacatcaacatccctgcattgctacaagaaaaataaggacaccggcagcccttagtttcactgtttgccagcacagacctttgatgggtgcaggcttttctgcgtattaatcagccatttttgtgagagtttgaccctggaaagggtgctttgtatatgttcttttcacatagtgcccagcttgcatgaaatgtacagagaaatgtgtggtcgtattttttacttttgtcttgtatatgtatgtatattgggtcctctgggcagtagaggcaaagctcacctcccatgtagcacatgaaatgcttgtgagttgttgacattggacaggtgaacagtagggcattacatttgtgtgaattaaatgtgaacttctgtattacgttgcggcgtcggcagtcctgcgttccctggagtaactgtacgtatctgcctttgctgggaagactgtggggctgcctgtgttggctggcgaccagcaggattgctccaggattttgtgtttacctcgcgtgaagttcagcacgtgctgtcgtgtagtcagcttctactctaatttctgttacagttctgcaaaggtaacctggagtttagaagttaaaaaaaagcatgggatgttggatttgcaccatttggagtttctttaggaaagaaaagttttctgcttttttatagaaaatcatttcagtctcccgaggtctcatgctagcaaattttgaaataggattctaatcactgatttcaaatattaagcaaaatgtaaagcactttaatttatagctatggttataaacaggttttagatgtttcaaatgacttgtccactgaatgtcacttgaccttgataagaggccgcctgcacacagagcccagttaattctccgcacctcggttgtgtgcttccgaatgggctcactcccgtggtggtgtttgagagccaacaacactacctcagagacgggtctttgggaaactttgggtctcactgttgcctggctggagcactttggtttatagctggaatactgagttcagttcagaaggcaggaaagacagtcacaccgacgtgtcctgaaggtgtaggctctccacttaggcgcacaagctgacggctgcagccagcaggccccggtgacgagacacttccaggtcttgtggtggggacgcctctcagtgccagtcccgccactgctgagtgagcctggtgttcttgccttcttggaaattactgctcacctggtatctgtacgttaatgtttcttgctgagttacagttttgataaagaggctctcatttcctgtgtcttgtatattcagtcctttcaatacgtccacctggaggctcaccacttggagagacacaggaaggtaatatttacagctgtcatgtgacatccccaggtctttgtgttttgccctgttttacggtgaggtaggagggaacccatctggggaccggtaggtgcaggtgcagtaggacgtgggacttttggacccgtcctttggtgcagctcgccagggatgagaggcacctccctacttgggtcttcaggagctggtccaaggagcttcgaatctaagtcatctagaatgaccctgaaatgactgacagccccgggcccaagaaaaacccataaccacctcagatggatctgacgtggctaagggacaaacagcaaatatttcagtcattttgattttacaaataaaaaatgtgttgtgtttttgtccgacattatttcctgactgcactgttctgagaatggagtccacctggtccctctggttgattagaatctcaggtttcagctcctgctgtcctgagcgaacttgcctgatgcagggctgtgctgtgtccagatgttgctggggcctcactttttctcttggctggaggtccaattgccagagcctcccacactgcacatacaaaggtctgagcccagggcagcttctggggccactgcacaggccacctgcttgggttcctcggagtttaatttgaaagtctgggtgtcttaggatgatggttaggaacattgaaaaatggctgcaaatagccaaatcaaacttaagaaccagatctctgccagattaaacatttttgaagcttttaaaagtcaatattcctagtggccactgagttccaggcacactggtgccctttactgccacagctgctcaccttgtctggcaaactggagggacctcagaaactggactcctgcatgtccttgggggcgcagccctgtggtgctcaggcagagctctcaggagccggggcaccttgctgttcgctgctgtgtcgtcttctaatgtgagctcatccactgctgctgcagcgtggtgatcaggagtcacagacaagatcggggatggtgtgtgtgtgtgtgtgtgtgtgtgtgtgcacgtgtgtgtggctaaattaagtcatactgtcaaccacacgtgatctcgtctgaaacagtgtttggaagtgggaacagttttgtcctgtatgctgatgtgtccagaatttcatttaatgatagacggaaaatgtgtggttactgaaaactgtatatgatacagaatttcataagagccatgctgttgggcaaagcaactctttttcaaccactgctcatcagtttctgtagagacaaaaactctgtacatattttggaatctgaagaatcctatgtaaatcatttgttacttaagtctgtgaaaaacatatttctttggaggaaaatgtatgcatttataagtgttccatggaatcagtttttattgtatcgatataattgtctctaagtgttgactgtcttcattgcaatatgaaattcattaaaatgtccatgttccataattactattataaaagctttgtgttattgggagtcttattatttttatagtttttcatgttttgctttggtgaaacattgtgaatgactatataaacatcacgatgagctagaaattgaacaaatataatactggtcactcg

SEQ ID NO: 8501 - DNA, 1307 bp, Homo sapiens
ctgaccgcgccgtccccgccaggctcccgcgcggccggcaccgcggccctgagcgcaggcggccccgggtctcaggcctcaggcggaccgcgccccgggctcgcagccctcccgccccggctgccgggctacggggcagatggactcggagcgccccgccgcttattgcaggagtgaccaggacactacctcctagaagtaatgcccacagaaagcgcaagttgttcgactgctcgccaaacaaaacagaagcgcaaatcccatagcctttctatacgaagaactaacagctcggagcaggagaggacgggactgccaagagacatgttagaaggacaagattctaaactgccttcctcggttcgcagtacacttctggaactgtttggtcaaatagaaagagaatttgaaaacctttatatcgaaaacttagaattacgtagagaaatcgacactcttaatgaacgtttagctgctgaaggacaagcgattgatggagcagagctgagtaagggccaactcaaaacaaaagccagtcacagcaccagccagctctcccagaaactgaagaccacttacaaggcttccaccagcaagattgtctccagctttaagaccacgacatcgagagctgcctgccagctcgtgaaggagtacatcggccaccgggacggcatctgggatgtcagcgtggccaagacacagccagtggtgctcgggactgcatcagccgatcacacggctttgctgtggagcatagagacagggaagtgcctagtcaagtacgcaggccacgtgggctcagtaaattctatcaaatttcatccctcagagcagttggctctcactgcttctggagatcagactgctcatatctggagatacgcggtgcagctgccgacaccccagcctgttgctgacactagtgtaagcacctttccttacctgtgaatgtgtaggatgctgatgtctgcgaatctgagaatccatttatgatatctgtcatggacggaatgtttgtgtccccccaagttcagtgttgaaggcctcacccccggtatggttgaatttggagattgggcctctaaggtagtagttaaggttcagtgaggttgcgtgaggtcctcataagaggagacagtggagagctcacctgtgttctcaatctctctgtcactctccgtgtcacgtaagagcagagccagagggcggccgtctttaaggatgagcccgcaccagaacctgaattggcttgatcttggacttccagcctccagcactgtgagaaaataaatgtctgtttttta

SEQ ID NO: 8502 - DNA, 714 bp, Homo sapiens
ggtctccaagccgcacggcctcgtcctctgctccacctttggcctgtgtctcccacgctcgctccctagacggagctcatttgttcaatgagcagtgattcggagtgggaccggtcagcatgttctgattctaaactgccttcctcggttcgcagtacacttctggaactgtttggtcaaatagaaagagaatttgaaaacctttatatcgaaaacttagaattacgtagagaaatcgacactcttaatgaacgtttagctgctgaaggacaagcgattgatggagcagagctgagtaagggccaactcaaaacaaaagccagtcacagcaccagccagctctcccagaaactgaagaccacttacaaggcttccaccagcaagattgtctccagctttaagaccacgacatcgagagctgcctgccagctcgtgaaggagtacatcggccaccgggacggcatctgggatgtcagcgtggccaagacacagccagtggtgctcgggactgcatcagccgatcacacggctttgctgtggagcatagagacagggaagtgcctagtcaagtacgcaggccacgtgggctcagtaaattctatcaaatttcatccctcagagcagttggctctcactgcttctggagatcagactgctcatatctggagatacgcggtgcagctgccgacaccccagcctgttgctgacactagt

SEQ ID NO: 8503 - DNA, 1252 bp, Homo sapiens
gggtcccgcggccgcctaggagggagcccgccggggcggggcggggccgggtgcccatgaacagcggggtcccggccacgctggccgtgcggagagtgaaattcttcggccagcacggcggggaggtcaactcttctgccttctcccctgatggccagatgctgctcacaggctcagaagatggctgcgtgtatggctgggagacccggagtgggcagctgctgtggaggctgggtggccacacaggccccgtgaagttctgccgcttctcccctgatggccacctcttcgccagcgcctcctgtgactgcactgtccgcctgtgggatgtggcaagagcgaagtgtctgcgggtcctgaagggtcaccaacggagtgtggagacggtcagcttcagccctgactcgagacagctggcatcaggtggctgggacaagcgggtgatgctctgggatgtgcagtccggccagatgctgcgcctcttagttgggcaccgtgactccatccagagcagcgacttctcacccacggtgaactgcctggccaccggctcctgggactccaccgtacacatctgggacctgcggatggtgaccccagcagtctcccaccaggcgctagagggacacagtgccaacatcagctgcctgtgctattcagcatccggcctcctggcatccggctcctgggacaagaccatccacatctggaagcccacaaccagcagcctgcttatccaactgaagggccatgtcacctgggtgaagagcatagccttctctcccgacgagctgtggctggccagcgccggctattcccgcatggtcaaagtctgggactgcaacacaggaaagtgccttgagaccctgaagggagtcctggatgtggcccacacctgtgccttcaccccagatgggaaaatcttagtgtctggagctgccgatcagactagacgtcaaatatcccgcacgtccaaatcacccagggaccctcaaacctaacaccaaccaccttagatggtgccgacctcacccgctcccctcagtggcgcacaggcatgccgcttctccccacagacgcaaagtgactgtgctggcatccagcagatccccatggccaggactctccaggccccaccagagcagacaactgtggtgggcaggacgcttgctggaacccatcagacacctggtccccaaaaccagacccacccacctccacccaatcagtggaagtgccaggaaacaaagca

SEQ ID NO: 8504 - DNA, 3958 bp, Homo sapiens
gtcgggttgctgctccgcgcgcgtccaccaggggccgctcgagctacctaagctccgtgcgctacccggcggcgctcccgcgcgtgctcactcggagcagcgcgcgccccgcaatcgccgcagccgcccccgccgtcggccgccgcaccccaagcgactgcccaaactaagcctccgtggctgggtacgggagcgctttggggacaaaaattctccctcaactgtggtctgcattccttcggcccgtgggctgatctggggcgggaagtattagcgtctcagttgcgctgcagccggggaggaaggaggaggccgagcctggggcggagtttgggctgactggggctggaccgggcaagacgccgccgctgcccggatgttgcgatggctgatcgggggaggccgagaaccgcagggactggccgagaaatctcctttacagacaataggtgaagaacaaacccagaatccctacactgaactgctagtactgaaggctcatcatgatattgtacgatttctggtacagttagatgactacagatttgcatctgctggtgatgatggaattgtagttgtgtggaatgcccagacaggggaaaaacttttagaactgaatggacacactcaaaagataacagctattattacatttccttccttggaatcttgtgaagagaaaaatcaactcatcttgacagcctctgctgatagaacagttattgtgtgggatggtgatactaccagacaagttcagagaatatcatgcttccagtctactgtaaagtgtttaactgttcttcagagactagatgtttggctttctggtgggaatgacctgtgtgtgtggaaccgaaaattagatctcctgtgtaagactagccacctttctgatacaggtattagtgctttggttgaaatacctaagaactgtgttgtggcagcagttggcaaagaactgataattttcaggttggtagcacccacagaaggatcactagaatgggatattcttgaagttaagcgcctccttgatcaccaggataatattctctcattgattaatgtcaatgatttgagttttgtcaccggctcccacgtcggagagctgatcatctgggatgccctggactggaccatgcaggcctatgaacgcaacttctgggacccatctccacaactggacacccaacaagaaataaaactctgtcaaaaatcaaatgacatttctattcatcatttcacatgtgatgaagagaatgtatttgctgcagttggaaggggtttatacgtgtatagccttcaaatgaagcgtgtgattgcctgccagaaaactgcacatgactccaatgtcctgcacgttgccagacttccaaacaggcagttaatctcatgctcagaagatggcagtgtacgcatttgggagttaagagaaaaacagcagcttgcagctgagcctgtaccaacaggtttttttaacatgtggggatttggaagagtcagcaaacaagccagccaacctgttaaaaagcagcaagaaaatgctacttcatgttcactggagcttattggagatttgattggacactcatcatctgtggagatgtttctatactttgaagatcatggactagtgacgtgctccgctgatcatctcattattttgtggaaaaatggagagcgagaatctggattgcgcagtttaagattatttcaaaaattagaggagaatggtgacttataccttgctgtctagtttaaggaattaaaaatacacatgcatgaaccttgaacatcaaatatcgggtactactctgaaaaccattaatatattgatcacttaaattggtaattttttttgtcagtccataaaattctacatgtttaaattttttgtggacctaccaaccaggaacatgttgcttctcaggtcctagtatatcctccaaagaatataccacaagtttttccatttgactttgagctgctgttgaagtggtgagtgctgtgttttgagcttattttgaacctagatccttgtgaaaggtacaaatagaggtaatagttaagttatggcatttattagaagttttattatttggcttcctttagaattattgtgaagtttaaaaatagcctttctcctgcaaattttcctagtctttagtaactgttagtgttctatatagcacaaacttgaatctctcagccaaaaaagggaacatatatactgtttaagtatggcaagttttctttggtaccaatttgtttagataattttaaaaatgttttttagttctagctactaaaacctgtatgaactcaaatggataggcatcttgtgagggtgtgtttttcccagtgtgaattggcttgaagagccatgggctaaatgggtactagaacaacaactgcccctcatgtacgccaaggatgagctctagatcatttgagaggcacagtgtttccggagtcagggactgcagctgagcgcaactgccccatctgaccactgactcaaatacgaactgcttgagacagacttcttttatgtagttctttgcagtgtccattgagacactataaccagccttgtaacaatatgttttctccttttggtgctaaaaaatgaaaatattagaaagtagtctacacattaaagattgaaattcttaaactactgatgaagaaagggcaacgtgacagatgttagcagactgacccttcttacagaaaacctacagatttatttgttcattatacaaatatactacaaatataccctaaagggaatctccataagttcttttactagttttagctttgacagttgcttccacaactacctacaaagactggaagagttaaggtcatctgagtagaccagtggcataatgttacaaatgaggaaactgaggcccagtgcagtaaggccttgcaattaaatctgtagtgcccagtatcaccaagcagctctaaaaacaggaactgaagactgaatgagaaaaggcttatatgactactttaaatccaaacaacattgagtcatgaaaagttctatggagaaatattaaaacttaagctacctcaattacagaagactttctcccattattcacgtgctttttcctttagaaattctgcattggcccatacatttgtaaagttgttttctgaagttgtatgacacaagggagccatagacttaactgttttacttcctagcctgttctaggctagtattttgtgatagtaatctattcaaatggagtggtagaaatcacatgaattttggaagcaaatggtaccgtaagtaccacagcaaattccttctggtcattatacaggcgtacctcagagatactacaggttaggtttcagaccacatcaaaaaagcaactattgcaaatagagtgagtcacatctagtttttggtttcccagtgcctataaaacttgtgtttatactacagtcttaaatttctaaaaaatgtacataccttaagaatactttattgctaaaaaatgctaacaatcatctgagccttcagcgagtcataatctttttgctggtggagggtcttgatactgctggctgttgactaaggtggttactgaaggttggggtggctgtggcagttccttaaaataagatagcgatgaagttttccaaatcaattgacttcctttcacaaatgagatctctgtaacatgtaatactatttaatagcattttacccacagtagaacttctttcaaaatttagagtctgtcatctcaaatcctgatgctcctttatgaactaagtttatagaatattctaaatcctttgttgtcatttcaactatgtttacagcatcttcactgtggaaatgactgtctccagaaaccactttctatacacattcttaagcaacttctcatctattaaagtttgatcatgagattacagcaattca

SEQ ID NO: 8505 - DNA, 1507 bp, Homo sapiens
ggaggccgagaaccgcagggactggccgagaaatctcctttacagacaataggtgaagaacaaacccagaatccctacactgaactgctagtactgaaggctcatcatgatattgtacgatttctggtacagttagatgactacagatttgcatctgctggtgatgatggaattgtagttgtgtggaatgcccagacaggggaaaaacttttagaactgaatggacacactcaaaagataacagctattattacatttccttccttggaatcttgtgaagagaaaaatcaactcatcttgacagcctctgctgatagaacagttattgtgtgggatggtgatactaccagacaagttcagagaatatcatgcttccagtctactgtaaagtgtttaactgttcttcagagactagatgtttggctttctggtgggaatgacctgtgtgtgtggaaccgaaaattagatctcctgtgtaagactagccacctttctgatacagatttgagttttgtcaccggctcccacgtcggagagctgatcatctgggatgccctggactggaccatgcaggcctatgaacgcaacttctgggacccatctccacaactggacacccaacaagaaataaaactctgtcaaaaatcaaatgacatttctattcatcatttcacatgtgatgaagagaatgtatttgctgcagttggaaggggtttatacgtgtatagccttcaaatgaagcgtgtgattgcctgccagaaaactgcacatgactccaatgtcctgcacgttgccagacttccaaacaggcagttaatctcatgctcagaagatggcagtgtacgcatttgggagttaagagaaaaacagcagcttgcagctgagcctgtaccaacaggtttttttaacatgtggggatttggaagagtcagcaaacaagccagccaacctgttaaaaagcagcaagaaaatgctacttcatgttcactggagcttattggagatttgattggacactcatcatctgtggagatgtttctatactttgaagatcatggactagtgacgtgctccgctgatcatctcattattttgtggaaaaatggagagcgagaatctggattgcgcagtttaagattatttcaaaaattagaggagaatggtgacttataccttgctgtctagtttaaggaattaaaaatacacatgcatgaaccttgaacatcaaatatcgggtactactctgaaaaccattaatatattgatcacttaaattggtaattttttttgtcagtccataaaattctacatgtttaaattttttgtggacctaccaaccaggaacatgttgcttctcaggtcctagtatatcctccaaagaatataccacaagtttttccatttgactttgagctgctgttgaagtggtgagtgctgtgttttgagcttattttgaacctagatccttgtgaaaggtacaaatagaggtaatagttaagttatggca

SEQ ID NO: 8506 - DNA, 1688 bp, Homo sapiens
ggctcccacaccactgcctcgtgtggggttgttcgcccgtgaaggggcaggacagggtgcgcgctggtggaggttgaaattgttacattttggccgggcgcggtggctcacgcctgtaatcccagcactttgggaggccgaggcaggtggatcacgaggtcaggagatcgagaccatcctggctaacacagtgaaaccccgtctctactaaaaaaatacaaaaaatcagccgggcgtggtgacgggcgcctgtagtcccagctactcaggaggctgaggcaggaggatggcgtgaacccgggaggcggagcttgcagtgagccgagatcgcgccagtgcactccagcctgggcgacagagcgaaactacgtctcaaaaaaaaaaaaaaagaaagaaaagaaattgttacattttatatatataggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctggaccacgagcaggtgggcagcatgggcttggtggagatgctgcaccgctccaaccttctggccttggtgggcggtggtagtagtcccaagttctcagagatctcagcagtgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggggctctgtgacctctgccccagcctggagaagcaactgctagtgttcccgggacacaagtgtgggagtctgcaacttgtggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgcattaacttcagccacgactcctccttcctctgcgcttccagtgataagggtactgtccatatctttgctctcaaggatacccgcctcaaccgccgctccgcgctggctcgcgtgggcaaggtggggcctatgattgggcagtacgtggactctcagtggagcctggcgagcttcactgtgcctgctgagtcagcttgcatctgcgccttcggtcgcaatacttccaagaacgtcaactctgtcattgccatctgcgtagatgggaccttccacaaatatgtcttcactcctgatggaaactgcaacagagaggctttcgacgtgtaccttgacatctgtgatgatgatgacttttaaggaccctgggggctgtgctagggacctgcagtggcagaactgcagagctgagccttggcagtggggcgtgcttggaagccaccagccagcaagcattaatggggctggtgcccactttccactcagcagagctatgtctaaataaagagctcacttcccccca

SEQ ID NO: 8507 - DNA, 2358 bp, Homo sapiens
gtagttctgacatgtttagggagtggagttctgctaaaaagactagactaggacatttttaggcaagatggggaaactaatccagaaaaagaaaccgcaccgctacttagcccctggctccggacctgcctttcttttttaaatcactcttgcataagctgccgctcgcgataaggtgccaaaaactgttccgcccctctaaggagagcgtgccctcactcaagatggcacctagagagcttcatacctggtacgctgctgattggatgaaggacagagggcttccgggagttttcaagccgactgtgtggcagctgagaggagttttgcacgtggatcgccgttcgggtgggcgagatggagacagcccccaagccgggcaaggatgtcccgcccaagaaagacaaacttcagaccaagagaaagaaaccgcggcgatactgggaggaagagaccgttccgaccacagccggagcctctccagggcctcctcgtaacaagaagaatcgggagctccgtcctcagagaccaaaaaatgcttacatcttaaagaagtctcggatctctaagaagcctcaggtcccgaagaaaccccgagaatggaagaacccggagtcccagcgcggcttgtccgggacccaagatccattcccaggccccgcccccgtccctgtggaagtggtccagaagttctgtcgcattgacaaatcccgaaagctaccacattctaaagccaaaactcgaagccgacttgaggtggctgaagctgaggaagaggaaacaagtatcaaagctgctcgttctgagctgctgcttgctgaagaacctgggtttctggaaggggaggatggggaagacacagcaaagatatgccaggctgacattgtggaggctgtggacattgcaagtgcagccaagcactttgacttgaatctgcggcagtttggaccctacagactaaactactctcgaactggaagacacctggcttttggagggcgccgaggtcatgtggctgcccttgattgggtaacaaagaagcttatgtgcgagatcaacgtcatggaggcggtgcgggacatccggtttctccattctgaggcactgcttgctgttgctcagaaccgctggctccacatctatgacaatcagggcattgagctccactgtatccgccgctgtgaccgagtaacacggcttgagttcctgcccttccacttcctcctggctacagcttcagaaacagggtttctaacctacctggatgtgtcagtggggaagattgtggcagctctgaatgctcgagctgggcggctcgatgttatgagtcagaacccttacaatgccgtcatccatctcggacacagcaatggtactgtgtctttatggagtccagctatgaaggagccactggcaaagattctctgtcatcgtggtggggtccgggctgtggcagtagattctacaggcacgtacatggccacctctggcctagaccaccagctgaagatctttgacttgcgagggacgtaccagcctctgagcactcggaccctgccccatggagcagggcacctggccttctcccagaggggactgctggtggcgggaatgggtgacgttgtcaacatctgggcagggcagggcaaggccagcccaccctcccttgaacagccctacctcacccaccggctctcaggccctgtgcatggccttcagttctgcccctttgaagatgtgctgggggtggggcacactgggggcatcaccagcatgctggtccctggggccggtgagcccaacttcgatggcctggagagtaatccatacagaagccggaagcagcgccaggagtgggaggtgaaggccctgctagagaaggtacctgcagagcttatttgtctggacccacgagccctggccgaggtggatgtcatctccctggagcagggaaagaaggagcagatagagaggctgggctatgacccgcaggctaaggctcccttccagccaaagccaaagcagaagggccgcagctccacggcaagcctggtgaagaggaagaggaaggtcatggatgaggaacacagggacaaggtccggcagagccttcagcagcagcatcataaggaggcgaaggccaagcccacgggggcccggccatctgccctggacagatttgtgcgctgagccagactccagggttgcctgggaacagtctctccccaagatcacctgtagggaaatgagtgttccctggaacaaggaggtgggggcagtgtggccccttccccaactgggggtggacagctgtctcctggggtgggttggtattaaagaggaaagcgattttttgga

SEQ ID NO: 8508 - DNA, 2358 bp, Homo sapiens
gtagttctgacatgtttagggagtggagttctgctaaaaagactagactaggacatttttaggcaagatggggaaactaatccagaaaaagaaaccgcaccgctacttagcccctggccccggacctgcctttcttttttaagtcactcttgcataagctgccgctcgcgataaggtgccaaaaactgttccgcccctctaaggagagcgtgccctcactcaagatggcacctagagagcttcatacctggtacgctgctgattggatgaaggacagagggcttccgggagttttcaagccgactgtgtggcagctgagaagagttttgcacgtggatcgccgttcgggtgggcgagatggagacagcccccaagccgggcaaggatgtcccgcccaagaaagacaaacttcagaccaagagaaagaaaccgcggcgatactgggaggaagagaccgttccgaccacagccggagcctctccagggcctcctcgtaacaagaagaatcgggagctccgtcctcagagaccaaaaaatgcttacatcttaaagaagtctcggatctctaagaagcctcaggtcccgaagaaaccccgagaatggaagaacccggagtcccagcgcggcttgtccggggcccaagatccattcccaggccccgcccccgtccctgtggaagtggtccagaagttctgtcgcattgacaaatctcgaaagctaccacattctaaagccaaaactcgaagccgacttgaggtggctgaagctgaggaagaggaaacaagtatcaaagctgctcgttctgagctgctgcttgctgaagaacctgggtttctggaaggggaggatggggaagacacagcaaagatatgccaggctgacattgtggaggctgtggacattgcaagtgcagccaagcactttgacttgaatctgcggcagtttggaccctacagactaaactactctcgaactggaagacacctggcttttggagggcgccgaggtcatgtggctgcccttgattgggtaacaaagaagcttatgtgcgagatcaacgtcatggaggcggtgcgggacatccggtttctccattctgaggcactgcttgctgttgctcagaaccgctggctccacatctatgacaatcagggcattgagctccactgtatccgccgctgtgaccgagtaacacggcttgagttcctgcccttccacttcctcctggctacagcttcagaaacagggtttctaacctacctggatgtgtcagtggggaagattgtggcagctctgaatgctcgagctgggcggctcgatgttatgagtcagaacccttacaatgccgtcatccatctcggacacagcaatggtactgcgtctttatggagtccagctatgaaggagccactggcaaagattctctgtcatcgtggtggggtccgggctgtggcagtagattctacaggcacgtacatggccacctctggcctagaccaccagctgaagatctttgacttgcgagggacgtaccagcctctgagcactcggaccctgccccatggagcagggcacctggccttctcccagaggggactgctggtggcgggaatgggtgacgttgtcaacatctgggcagggcagggcaaggccagcccaccctcccttgaacagccctacctcacccaccggctctcaggccctgtgcatggccttcagttctgcccctttgaagatgtgctgggggtggggcacactgggggcatcaccagcatgctggtccctggggccggtgagcccaacttcgatggcctggagagtaatccatacagaagccggaagcagcgccaggagtgggaggtgaaggccctgctagagaaggtacctgcagagcttatttgtctggacccacgagccctggccgaggtggatgtcatctccctggagcagggaaagaaggagcagatagagaggctgggctatgacccgcaggctaaggctcccttccagccaaagccaaagcagaagggccgcagctccacggcaagcctggtgaagaggaagaggaaggtcatggatgaggaacacagggacaaggtccggcagagccttcagcagcagcatcataaggaggcgaaggccaagcccacgggggcccggccatctgccctggacagatttgtgcgctgagccagactccagggttgcctgggaacagtctctccccaagatcacctgtagggaaatgagtgttccctggaacaaggaggtgggggcagtgtggccccttccccaactgggggtggacagctgtctcctggggtgggttggtattaaagaggaaagcgattttttgga

SEQ ID NO: 8509 - DNA, 968 bp, Homo sapiens
aagtctcggatctctaagaagcctcaggtcccgaagaaaccccgagaatggaagaacccggagtcccagcgcggcttgtccggggcccaagatccattcccaggccccgcccccgtccctgtggaagtggtccagaagttctgtcgcattgacaaatctcgaaagctaccacattctaaagccaaaactcgaagccgacttgaggtggctgaagctgaggaagaggaaacaagtatcaaagctgctcgttctgagctgctgcttgctgaagaacctgggtttctggaaggggaggatggggaagacacagcaaagatatgccaggctgacattgtggaggctgtggacattgcaagtgcagccaagtttggaccctacagactaaactactctcgaactggaagacacctggcttttggagggcgccgaggtcatgtggctgcccttgattgggtaacaaagaagcttatgtgcgagatcaacgtcatggaggcggtgcgggacatccggtttctccattctgaggcactgcttgctgttgctcagaaccgctggctccacatctatgacaatcagggcattgagctccactgtatccgccgctgtgaccgagtaacacggcttgagttcctgcccttccacttcctcctggctacagcttcagaaacagggtttctaacctacctggatgtgtcagtggggaagattgtggcagctctgaatgctcgagctgggcggctcgatgttatgagtcagaacccttacaatgccgtcatccatctcggacacagcaatggtactgcgtctttatggagtccagctatgaaggagccactggcaaagattctctgtcatcgtggtggggtccgggctgtggcagtagattctacaggcacgtacatggccacctctggcctagaccaccagctgaagatctttgacttgcgagggacgtaccagcctctgag

SEQ ID NO: 8510 - DNA, 2358 bp, Homo sapiens
gtagttctgacatgtttagggagtggagttctgctaaaaagactagactaggacatttttaggcaagatggggaaactaatccagaaaaagaaaccgcaccgctacttagcccctggctccggacctgcctttcttttttaagtcactcttgcataagctgccgctcgcgataaggtgccaaaaactgttccgcccctctaaggagagcgtgccctcactcaagatggcacctagagagcttcatacctggtacgctgctgattggatgaaggacagagggcttccgggagttttcaagccgactgtgtggcagctgagaggagttttgcacgtggatcgccgttcgggtgggcgagatggagacagcccccaagccgggcaaggatgtcccgcccaagaaagacaaacttcagaccaagagaaagaaaccgcggcgatactgggaggaagagaccgttccgaccacagccggagcctctccagggcctcctcgtaacaagaagaatcgggagctccgtcctcagagaccaaaaaatgcttacatcttaaagaagtctcggatctctaagaagcctcaggtcccgaagaaaccccgagaatggaagaacccggagtcccagcgcggcttgtccggggcccaagatccattcccaggccccgcccccgtccctgtggaagtggtccagaagttctgtcgcattgacaaatcccgaaagctaccacattctaaagccaaaactcgaagccgacttgaggtggctgaagctgaggaagaggaaacaagtatcaaagctgctcgttctgagctgctgcttgctgaagaacctgggtttctggaaggggaggatggggaagacacagcaaagatatgccaggctgacattgtggaggctgtggacattgcaagtgcagccaagcactttgacttgaatctgcggcagtttggaccctacagactaaactactctcgaactggaagacacctggcttttggagggcgccgaggtcatgtggctgcccttgattgggtaacaaagaagcttatgtgcgagatcaacgtcatggaggcggtgcgggacatccggtttctccattctgaggcactgcttgctgttgctcagaaccgctggctccacatctatgacaatcagggcattgagctccactgtatccgccgctgtgaccgagtaacacggcttgagttcctgcccttccacttcctcctggctacagcttcagaaacagggtttctaacctacctggatgtgtcagtggggaagattgtggcagctctgaatgctcgagctgggcggctcgatgttatgagtcagaacccttacaatgccgtcatccatctcggacacagcaatggtactgtgtctttatggagtccagctatgaaggagccactggcaaagattctctgtcatcgtggtggggtccgggctgtggcagtagattctacaggcacgtacatggccacctctggcctagaccaccagctgaagatctttgacttgcgagggacgtaccagcctctgagcactcggaccctgccccatggagcagggcacctggccttctcccagaggggactgctggtggcgggaatgggtgacgttgtcaacatctgggcagggcagggcaaggccagcccaccctcccttgaacagccctacctcacccaccggctctcaggccctgtgcatggccttcagttctgcccctttgaagatgtgctgggggtggggcacactgggggcatcaccagcatgctggtccctggggccggtgagcccaacttcgatggcctggagagtaatccatacagaagccggaagcagcgccaggagtgggaggtgaaggccctgctagagaaggtacctgcagagcttatttgtctggacccacgagccctggccgaggtggatgtcatctccctggagcagggaaagaaggagcagatagagaggctgggctatgacccgcaggctaaggctcccttccagccaaagccaaagcagaagggccgcagctccacggcaagcctggtgaagaggaagaggaaggtcatggatgaggaacacagggacaaggtccggcagagccttcagcagcagcatcataaggaggcgaaggccaagcccacgggggcccggccatctgccctggacagatttgtgcgctgagccagactccagggttgcctgggaacagtctctccccaagatcacctgtagggaaatgagtgttccctggaacaaggaggtgggggcagtgtggccccttccccaactgggggtggacagctgtctcctggggtgggttggtattaaagaggaaagcgattttttgga

SEQ ID NO: 8511 - DNA, 2358 bp, Homo sapiens
gtagttctgacatgtttagggagtggagttctgctaaaaagactagactaggacatttttaggcaagatggggaaactaatccagaaaaagaaaccgcaccgctacttagcccctggccccggacctgcctttcttttttaagtcactcttgcataagctgccgctcgcgataaggtgccaaaaactgttccgcccctctaaggagagcgtgccctcactcaagatggcacctagagagcttcatacctggtacgctgctgattggatgaaggacagagggcttccgggagttttcaagccgactgtgtggcagctgagaagagttttgcacgtggatcgccgttcgggtgggcgagatggagacagcccccaagccgggcaaggatgtcccgcccaagaaagacaaacttcagaccaagagaaagaaaccgcggcgatactgggaggaagagaccgttccgaccacagccggagcctctccagggcctcctcgtaacaagaagaatcgggagctccgtcctcagagaccaaaaaatgcttacatcttaaagaagtctcggatctctaagaagcctcaggtcccgaagaaaccccgagaatggaagaacccggagtcccagcgcggcttgtccggggcccaagatccattcccaggccccgcccccgtccctgtggaagtggtccagaagttctgtcgcattgacaaatcccgaaagctaccacattctaaagccaaaactcgaagccgacttgaggtggctgaagctgaggaagaggaaacaagtatcaaagctgctcgttctgagctgctgcttgctgaagaacctgggtttctggaaggggaggatggggaagacacagcaaagatatgccaggctgacattgtggaggctgtggacattgcaagtgcagccaagcactttgacttgaatctgcggcagtttggaccctacagactaaactactctcgaactggaagacacctggcttttggagggcgccgaggtcatgtggctgcccttgattgggtaacaaagaagcttatgtgcgagatcaacgtcatggaggcggtgcgggacatccggtttctccattctgaggcactgcttgctgttgctcagaaccgctggctccacatctatgacaatcagggcattgagctccactgtatccgccgctgtgaccgagtaacacggcttgagttcctgcccttccacttcctcctggctacagcttcagaaacagggtttctaacctacctggatgtgtcagtggggaagattgtggcagctctgaatgctcgagctgggcggctcgatgttatgagtcagaacccttacaatgccgtcatccatctcggacacagcaatggtactgtgtctttatggagtccagctatgaaggagccactggcaaagattctctgtcatcgtggtggggtccgggctgtggcagtagattctacaggcacgtacatggccacctctggcctagaccaccagctgaagatctttgacttgcgagggacgtaccagcctctgagcactcggaccctgccccatggagcagggcacctggccttctcccagaggggactgctggtggcgggaatgggtgacgttgtcaacatctgggcagggcagggcaaggccagcccaccctcccttgaacagccctacctcacccaccggctctcaggccctgtgcatggccttcagttctgcccctttgaagatgtgctgggggtggggcacactgggggcatcaccagcatgctggtccctggggccggtgagcccaacttcgatggcctggagagtaatccatacagaagccggaagcagcgccaggagtgggaggtgaaggccctgctagagaaggtacctgcagagcttatttgtctggacccacgagccctggccgaggtggatgtcatctccctggagcagggaaagaaggagcagatagagaggctgggctatgacccgcaggctaaggctcccttccagccaaagccaaagcagaagggccgcagctccacggcaagcctggtgaagaggaagaggaaggtcatggatgaggaacacagggacaaggtccggcagagccttcagcagcagcatcataaggaggcgaaggccaagcccacgggggcccggccatctgccctggacagatttgtgcgctgagccagactccagggttgcctgggaacagtctctccccaagatcacctgtagggaaatgagtgttccctggaacaaggaggtgggggcagtgtggccccttccccaactgggggtggacagctgtctcctggggtgggttggtattaaagaggaaagcgattttttgga

SEQ ID NO: 8512 - DNA, 968 bp, Homo sapiens
aagtctcggatctctaagaagcctcaggtcccgaagaaaccccgagaatggaagaacccggagtcccagcgcggcttgtccggggcccaagatccattcccaggccccgcccccgtccctgtggaagtggtccagaagttctgtcgcattgacaaatcccgaaagctaccacattctaaagccaaaactcgaagccgacttgaggtggctgaagctgaggaagaggaaacaagtatcaaagctgctcgttctgagctgctgcttgctgaagaacctgggtttctggaaggggaggatggggaagacacagcaaagatatgccaggctgacattgtggaggctgtggacattgcaagtgcagccaagtttggaccctacagactaaactactctcgaactggaagacacctggcttttggagggcgccgaggtcatgtggctgcccttgattgggtaacaaagaagcttatgtgcgagatcaacgtcatggaggcggtgcgggacatccggtttctccattctgaggcactgcttgctgttgctcagaaccgctggctccacatctatgacaatcagggcattgagctccactgtatccgccgctgtgaccgagtaacacggcttgagttcctgcccttccacttcctcctggctacagcttcagaaacagggtttctaacctacctggatgtgtcagtggggaagattgtggcagctctgaatgctcgagctgggcggctcgatgttatgagtcagaacccttacaatgccgtcatccatctcggacacagcaatggtactgtgtctttatggagtccagctatgaaggagccactggcaaagattctctgtcatcgtggtggggtccgggctgtggcagtagattctacaggcacgtacatggccacctctggcctagaccaccagctgaagatctttgacttgcgagggacgtaccagcctctgag

SEQ ID NO: 8513 - DNA, 968 bp, Homo sapiens
aagtctcggatctctaagaagcctcaggtcccgaagaaaccccgagaatggaagaacccggagtcccagcgcggcttgtccgggacccaagatccattcccaggccccgcccccgtccctgtggaagtggtccagaagttctgtcgcattgacaaatcccgaaagctaccacattctaaagccaaaactcgaagccgacttgaggtggctgaagctgaggaagaggaaacaagtatcaaagctgctcgttctgagctgctgcttgctgaagaacctgggtttctggaaggggaggatggggaagacacagcaaagatatgccaggctgacattgtggaggctgtggacattgcaagtgcagccaagtttggaccctacagactaaactactctcgaactggaagacacctggcttttggagggcgccgaggtcatgtggctgcccttgattgggtaacaaagaagcttatgtgcgagatcaacgtcatggaggcggtgcgggacatccggtttctccattctgaggcactgcttgctgttgctcagaaccgctggctccacatctatgacaatcagggcattgagctccactgtatccgccgctgtgaccgagtaacacggcttgagttcctgcccttccacttcctcctggctacagcttcagaaacagggtttctaacctacctggatgtgtcagtggggaagattgtggcagctctgaatgctcgagctgggcggctcgatgttatgagtcagaacccttacaatgccgtcatccatctcggacacagcaatggtactgtgtctttatggagtccagctatgaaggagccactggcaaagattctctgtcatcgtggtggggtccgggctgtggcagtagattctacaggcacgtacatggccacctctggcctagaccaccagctgaagatctttgacttgcgagggacgtaccagcctctgag

SEQ ID NO: 8514 - DNA, 968 bp, Homo sapiens; identical to SEQ ID NO: 8512

SEQ ID NO: 8515 - DNA, 968 bp, Homo sapiens; identical to SEQ ID NO: 8512

SEQ ID NO: 8516 - DNA, 2358 bp, Homo sapiens; identical to SEQ ID NO: 8511

SEQ ID NO: 8517 - DNA, 4264 bp, Homo sapiens
gactcgcccttcggctcaggcacctgcctggccgccccgcgcggcggggtcctgaggcgcctcggggaagcgcggcgattggctgccgctcgcgggtagagctcggctccccggcacttgacaaccgcagtctgcaagaggctgagctgaggagtcgctgggccgggaggggcggacgtgagaaggacggattgacgaactgatggattgacgcgcgggcggtaggagggaggaccgacgccaaacccagaccgccgccgtcgtgctcctgccgcagcccggagccggccgcttcggggccctggccgccggcctcccagccgcgttctcctccgccgctcctccgggcttgccctggagccctcaggctatcaatatgacggctgaagaaacagtgaatgtaaaagaggttgaaatcattaagctaattttggacttcctgaattcaaagaagcttcacattagtatgctggccctggagaaggaaagtggagtcataaatggcctgttttcagatgatatgcttttcctgaggtttcgttatattatcctgaagcagaagtttttagaagctttatgtgttaacaacgcgatgtcagcagaagatgagccccagcatctggaatttaccatgcaagaagctgtgcaatgtttacatgctctagaagaatactgtccttctaaagatgactatagtaagctctgtttgcttttgactttgcctcgtctgaccaatcatgccgagtttaaggactggaatcccagcaccgcacgagttcactgttttgaagaggcttgtgtcatggttgcagaattcatccctgctgataggaagctaagtgaagctggttttaaggctagtaacaatcgtttatttcagcttgtaatgaaaggcctgctttatgaatgctgtgtagaattttgtcagagtaaagcaactggagaagaaattacagaaagcgaagtgcttcttggcatcgacctcttatgtggtaatggttgtgatgatttggatctgagtttactgtcatggcttcagaatcttccatcttctgtcttctcttgtgcttttgaacagaaaatgcttaatattcatgttgacaaacttctgaaacctacaaaagctgcatatgctgatcttttgactcctcttatcagcaaactctctccctatccatcatccccaatgagaagacctcaatcagctgatgcctatatgacccgctctctgaatcctgctttagatggcctcacctgtggactaaccagtcatgataagagaatttcagaccttggaaacaaaacttctccaatgtcacactcctttgctaacttccattatccaggggtacaaaacctcagtagaagtctcatgcttgagaatacagaatgtcacagtatttacgaagaatcccctgagcgtgatacacctgttgatgcacagaggcctatcggcagtgaaatcttgggccagagttcagtttcagaaaaagagcctgcaaatggagcacagaatccaggaccagctaaacaagaaaaaaatgagcttcgagattcaacagaacaatttcaagaatattataggcaaagattacgctatcaacagcatttagaacagaaggagcaacagcggcagatataccaacagatgttgcttgaaggaggcgtgaatcaggaggatggtcctgatcagcagcagaatcttactgaacagttccttaataggtccattcaaaagcttggtgaattaaatattggaatggatggccttggtaatgaggtatcagcactcaaccagcaatgtaatgggagcaaaggcaatggatctaatggttcttctgtgactagttttactacaccaccccaagactctagtcagagattaacacatgatgcttcaaatattcatacaagcactcctcgtaatcctggatcaacaaatcacataccttttctggaggaatcaccttgtggaagccaaatctcttcagaacattcggtcattaagccacctcttggagattctccagggagtctttcaaggtcgaaaggggaagaggatgacaaatcaaaaaagcagtttgtttgtattaatatcctagaagacacacaagctgttagagcagtggcttttcatccagctggaggtttatatgctgttggttcaaattcaaaaactctgagagtatgtgcctatccagatgtaattgatccaagtgcacatgagactcctaagcagccggtggtacgttttaaaaggaataaacatcataaaggatccatttactgtgtggcctggagtccttgtgggcagttattagcaacaggatcaaatgacaaatacgtcaaagtgctgcccttcaatgcagagacttgtaacgcaacaggaccagatctggaatttagtatgcatgatggaacaattagagacttggcatttatggaaggcccagaaagcggaggagctattttaataagtgctggagcaggggattgtaacatttatacaaccgattgtcaaagaggacagggcctccatgctttgagtggacatactgggcatattttagcactttatacctggagtggctggatgattgcatctggttcccaagataagactgttagattttgggatcttcgagtaccaagttgtgttcgtgttgttggcacaacatttcatggaactggtagtgcagtggcatctgtagctgtagatcccagtggtcgtctcttagccacaggtcaagaagattctagctgcatgttgtatgacataagaggaggaagaatggtacaaagttatcatcctcattccagtgatgttcgctctgttcgattctcccctggagctcactacttgctaacaggctcttatgatatgaaaataaaggtgacagacctacaaggggacctcaccaagcagcttcctatcatggtggtgggggagcacaaggacaaagtgattcagtgcagatggcacacccaggatctttccttcctgtcatcctctgcagatagaactgtcaccctctggacttacaatgggtagagcacaccgcatgtcagtctatgcagcaaaagcacagagacttaagactactgagttgtgaaaattacaaatctgaagaacatagtgtccaggaaagtggtttagcacgaagaggccccttattaccatgtatcccactgataggaggtgttgggtggtgttattccgcagtgctttcagtcttccatgtgagctcgtgctgctgtgacctgctatatgtagtctcgttgccaaagtctgcagaagagctcttcagttgttggtgtgcactccaagtcaggatggacaatgtgtttacggtttagtattcaatgcattccttggtctttgcctaaataacagttttatatgcacattgaaatggaattatacttcaactatattattaaatgtaatgcaaccaagttcctcccagattaaacttcccaggtgttcagaattacttttgctcttctcacgatcccatattgtattatcacttgtcttctagaggtcagaattccataatatatgtcactcaaaagttacatggttgctttcacttaaggatcattgtggagtttaaagatgaatgaaaaactgcttcttagtttactacatggtataggcccttttttcttaaacccagggatatgattattttgtcatataattttgtttcaggctaaaaggtaaatgtgtttgcttcagaaacttgttaacttcagttttttgaatgcaacaggatacctcccttccaaactgaactgtagaagcagagcagcagcagttatgtgatgcaacacttgatggtacagtaaatttactggcatttttctccttaaaaattaaaatccttgacatagaccatagcatggcttgaaatgctatgtctgcatgataatttaaaatggaagatttaaactttgcactccaaaagcttatttggatttttttcttgcactgttttgtgtaatgcagaataatgattttatttctacagctttgtagattctaacatttatgtatctttattttcatattgtacagtaattttactttaaattatttaaataggctattttatttatttcaaatgcagttgtattagttctcattattgaactgtctgtgcactgtatgtagcaagcatttttcatctgttgtatacaagtggaaagggtattagaagtgtaactgtgctattatttcaataaagacctcttgacattt

SEQ ID NO: 8518 - DNA, 4115 bp, Homo sapiens
gtcgctgggccgggaggggcggacgtgagaaggacggattgacgaactgatggattgacgcgcgggcggtaggagggaggaccgacgccaaacccagaccgccgccgtcgtgctcctgccgcagcccggagccggccgcttcggggccctggccgccggcctcccagccgcgttctcctccgccgctcctccgggcttgccctggagccctcaggctatcaatatgacggctgaagaaacagtgaatgtaaaagaggttgaaatcattaagctaattttggacttcctgaattcaaagaagcttcacattagtatgctggccctggagaaggaaagtggagtcataaatggcctgttttcagatgatatgcttttcctgaggtttcgttatattatcctgaagcagaagtttttagaagctttatgtgttaacaacgcgatgtcagcagaagatgagccccagcatctggaatttaccatgcaagaagctgtgcaatgtttacatgctctagaagaatactgtccttctaaagatgactatagtaagctctgtttgcttttgactttgcctcgtctgaccaatcatgccgagtttaaggactggaatcccagcaccgcacgagttcactgttttgaagaggcttgtgtcatggttgcagaattcatccctgctgataggaagctaagtgaagctggttttaaggctagtaacaatcgtttatttcagcttgtaatgaaaggcctgctttatgaatgctgtgtagaattttgtcagagtaaagcaactggagaagaaattacagaaagcgaagtgcttcttggcatcgacctcttatgtggtaatggttgtgatgatttggatctgagtttactgtcatggcttcagaatcttccatcttctgtcttctcttgtgcttttgaacagaaaatgcttaatattcatgttgacaaacttctgaaacctacaaaagctgcatatgctgatcttttgactcctcttatcagcaaactctctccctatccatcatccccaatgagaagacctcaatcagctgatgcctatatgacccgctctctgaatcctgctttagatggcctcacctgtggactaaccagtcatgataagagaatttcagaccttggaaacaaaacttctccaatgtcacactcctttgctaacttccattatccaggggtacaaaacctcagtagaagtctcatgcttgagaatacagaatgtcacagtatttacgaagaatcccctgagcgtgatacacctgttgatgcacagaggcctatcggcagtgaaatcttgggccagagttcagtttcagaaaaagagcctgcaaatggagcacagaatccaggaccagctaaacaagaaaaaaatgagcttcgagattcaacagaacaatttcaagaatattataggcaaagattacgctatcaacagcatttagaacagaaggagcaacagcggcagatataccaacagatgttgcttgaaggaggcgtgaatcaggaggatggtcctgatcagcagcagaatcttactgaacagttccttaataggtccattcaaaagcttggtgaattaaatattggaatggatggccttggtaatgaggtatcagcactcaaccagcaatgtaatgggagcaaaggcaatggatctaatggttcttctgtgactagttttactacaccaccccaagactctagtcagagattaacacatgatgcttcaaatattcatacaagcactcctcgtaatcctggatcaacaaatcacataccttttctggaggaatcaccttgtggaagccaaatctcttcagaacattcggtcattaagccacctcttggagattctccagggagtctttcaaggtcgaaaggggaagaggatgacaaatcaaaaaagcagtttgtttgtattaatatcctagaagacacacaagctgttagagcagtggcttttcatccagctggaggtttatatgctgttggttcaaattcaaaaactctgagagtatgtgcctatccagatgtaattgatccaagtgcacatgagactcctaagcagccggtggtacgttttaaaaggaataaacatcataaaggatccatttactgtgtggcctggagtccttgtgggcagttattagcaacaggatcaaatgacaaatacgtcaaagtgctgcccttcaatgcagagacttgtaacgcaacaggaccagatctggaatttagtatgcatgatggaacaattagagacttggcatttatggaaggcccagaaagcggaggagctattttaataagtgctggagcaggggattgtaacatttatacaaccgattgtcaaagaggacagggcctccatgctttgagtggacatactgggcatattttagcactttatacctggagtggctggatgattgcatctggttcccaagataagactgttagattttgggatcttcgagtaccaagttgtgttcgtgttgttggcacaacatttcatggaactggcagtgcagtggcatctgtagctgtagatcccagtggtcgtctcttagccacaggtcaagaagattctagctgcatgttgtatgacataagaggaggaagaatggtacaaagttatcatcctcattccagtgatgttcgctctgttcgattctcccctggagctcactacttgctaacaggctcttatgatatgaaaataaaggtgacagacctacaaggggacctcaccaagcagcttcctatcatggtggtgggggagcacaaggacaaagtgattcagtgcagatggcacacccaggatctttccttcctgtcatcctctgcagatagaactgtcaccctctggacttacaatgggtagagcacaccgcatgtcagtctatgcagcaaaagcacagagacttaagactactgagttgtgaaaattacaaatctgaagaacatagtgtccaggaaagtggtttagcacgaagaggccccttattaccatgtatcccactgataggaggtgttgggtggtgttattccgcagtgctttcagtcttccatgtgagctcgtgctgctgtgacctgctatatgtagtctcgttgccaaagtctgcagaagagctcttcagttgttggtgtgcactccaagtcaggatggacaatgtgtttacggtttagtattcaatgcattccttggtctttgcctaaataacagttttatatgcacattgaaatggaattatacttcaactatattattaaatgtaatgcaaccaagttcctcccagattaaacttcccaggtgttcagaattacttttgctcttctcacgatcccatattgtattatcacttgtcttctagaggtcagaattccataatatatgtcactcaaaagttacatggttgctttcacttaaggatcattgtggagtttaaagatgaatgaaaaactgcttcttagtttactacatggtataggcccttttttcttaaacccagggatatgattattttgtcatataattttgtttcaggctaaaaggtaaatgtgtttgcttcagaaacttgttaacttcagttttttgaatgcaacaggatacctcccttccaaactgaactgtagaagcagagcagcagcagttatgtgatgcaacacttgatggtacagtaaatttactggcatttttctccttaaaaattaaaatccttgacatagaccatagcatggcttgaaatgctatgtctgcatgataatttaaaatggaagatttaaactttgcactccaaaagcttatttggatttttttcttgcactgttttgtgtaatgcagaataatgattttatttctacagctttgtagattctaacatttatgtatctttattttcatattgtacagtaattttactttaaattatttaaataggctattttatttatttcaaatgcagttgtattagttctcattattgaactgtctgtgcactgtatgtagcaagcatttttcatctgttgtatacaagtggaaagggtattagaagtgtaactgtgctattatttcaataaagacctcttgacatttaaaa

SEQ ID NO: 8519 - DNA, 4199 bp, Homo sapiens
gtcgctgggccgggaggggcggacgtgagaaggacggattgacgaactgatggattgacgcgcgggcggtaggagggaggaccgacgccaaacccagaccgccgccgtcgtgctcctgccgcagcccggagccggccgcttcggggccctggccgccggcctcccagccgcgttctcctccgccgctcctccgggcttgccctggagccctcaggctatcaatatgacggctgaagaaacagtgaatgtaaaagaggttgaaatcattaagctaattttggacttcctgaattcaaagaagcttcacattagtatgctggccctggagaaggaaagtggagtcataaatggcctgttttcagatgatatgcttttcctgaggcagctaatacttgatggtcaatgggatgaagttcttcagttcattcagcctctagaatgtatggaaaaatttgacaaaaaaaggtttcgttatattatcctgaagcagaagtttttagaagctttatgtgttaacaacgcgatgtcagcagaagatgagccccagcatctggaatttaccatgcaagaagctgtgcaatgtttacatgctctagaagaatactgtccttctaaagatgactatagtaagctctgtttgcttttgactttgcctcgtctgaccaatcatgccgagtttaaggactggaatcccagcaccgcacgagttcactgttttgaagaggcttgtgtcatggttgcagaattcatccctgctgataggaagctaagtgaagctggttttaaggctagtaacaatcgtttatttcagcttgtaatgaaaggcctgctttatgaatgctgtgtagaattttgtcagagtaaagcaactggagaagaaattacagaaagcgaagtgcttcttggcatcgacctcttatgtggtaatggttgtgatgatttggatctgagtttactgtcatggcttcagaatcttccatcttctgtcttctcttgtgcttttgaacagaaaatgcttaatattcatgttgacaaacttctgaaacctacaaaagctgcatatgctgatcttttgactcctcttatcagcaaactctctccctatccatcatccccaatgagaagacctcaatcagctgatgcctatatgacccgctctctgaatcctgctttagatggcctcacctgtggactaaccagtcatgataagagaatttcagaccttggaaacaaaacttctccaatgtcacactcctttgctaacttccattatccaggggtacaaaacctcagtagaagtctcatgcttgagaatacagaatgtcacagtatttacgaagaatcccctgagcgtgatacacctgttgatgcacagaggcctatcggcagtgaaatcttgggccagagttcagtttcagaaaaagagcctgcaaatggagcacagaatccaggaccagctaaacaagaaaaaaatgagcttcgagattcaacagaacaatttcaagaatattataggcaaagattacgctatcaacagcatttagaacagaaggagcaacagcggcagatataccaacagatgttgcttgaaggaggcgtgaatcaggaggatggtcctgatcagcagcagaatcttactgaacagttccttaataggtccattcaaaagcttggtgaattaaatattggaatggatggccttggtaatgaggtatcagcactcaaccagcaatgtaatgggagcaaaggcaatggatctaatggttcttctgtgactagttttactacaccaccccaagactctagtcagagattaacacatgatgcttcaaatattcatacaagcactcctcgtaatcctggatcaacaaatcacataccttttctggaggaatcaccttgtggaagccaaatctcttcagaacattcggtcattaagccacctcttggagattctccagggagtctttcaaggtcgaaaggggaagaggatgacaaatcaaaaaagcagtttgtttgtattaatatcctagaagacacacaagctgttagagcagtggcttttcatccagctggaggtttatatgctgttggttcaaattcaaaaactctgagagtatgtgcctatccagatgtaattgatccaagtgcacatgagactcctaagcagccggtggtacgttttaaaaggaataaacatcataaaggatccatttactgtgtggcctggagtccttgtgggcagttattagcaacaggatcaaatgacaaatacgtcaaagtgctgcccttcaatgcagagacttgtaacgcaacaggaccagatctggaatttagtatgcatgatggaacaattagagacttggcatttatggaaggcccagaaagcggaggagctattttaataagtgctggagcaggggattgtaacatttatacaaccgattgtcaaagaggacagggcctccatgctttgagtggacatactgggcatattttagcactttatacctggagtggctggatgattgcatctggttcccaagataagactgttagattttgggatcttcgagtaccaagttgtgttcgtgttgttggcacaacatttcatggaactggcagtgcagtggcatctgtagctgtagatcccagtggtcgtctcttagccacaggtcaagaagattctagctgcatgttgtatgacataagaggaggaagaatggtacaaagttatcatcctcattccagtgatgttcgctctgttcgattctcccctggagctcactacttgctaacaggctcttatgatatgaaaataaaggtgacagacctacaaggggacctcaccaagcagcttcctatcatggtggtgggggagcacaaggacaaagtgattcagtgcagatggcacacccaggatctttccttcctgtcatcctctgcagatagaactgtcaccctctggacttacaatgggtagagcacaccgcatgtcagtctatgcagcaaaagcacagagacttaagactactgagttgtgaaaattacaaatctgaagaacatagtgtccaggaaagtggtttagcacgaagaggccccttattaccatgtatcccactgataggaggtgttgggtggtgttattccgcagtgctttcagtcttccatgtgagctcgtgctgctgtgacctgctatatgtagtctcgttgccaaagtctgcagaagagctcttcagttgttggtgtgcactccaagtcaggatggacaatgtgtttacggtttagtattcaatgcattccttggtctttgcctaaataacagttttatatgcacattgaaatggaattatacttcaactatattattaaatgtaatgcaaccaagttcctcccagattaaacttcccaggtgttcagaattacttttgctcttctcacgatcccatattgtattatcacttgtcttctagaggtcagaattccataatatatgtcactcaaaagttacatggttgctttcacttaaggatcattgtggagtttaaagatgaatgaaaaactgcttcttagtttactacatggtataggcccttttttcttaaacccagggatatgattattttgtcatataattttgtttcaggctaaaaggtaaatgtgtttgcttcagaaacttgttaacttcagttttttgaatgcaacaggatacctcccttccaaactgaactgtagaagcagagcagcagcagttatgtgatgcaacacttgatggtacagtaaatttactggcatttttctccttaaaaattaaaatccttgacatagaccatagcatggcttgaaatgctatgtctgcatgataatttaaaatggaagatttaaactttgcactccaaaagcttatttggatttttttcttgcactgttttgtgtaatgcagaataatgattttatttctacagctttgtagattctaacatttatgtatctttattttcatattgtacagtaattttactttaaattatttaaataggctattttatttatttcaaatgcagttgtattagttctcattattgaactgtctgtgcactgtatgtagcaagcatttttcatctgttgtatacaagtggaaagggtattagaagtgtaactgtgctattatttcaataaagacctcttgacatttaaaa

SEQ ID NO: 8520 - DNA, 4240 bp, Homo sapiens
acttgacaaccgcagtctgcaagaggctgagctgaggagtcgctgggccgggaggggcggacgtgagaaggacggattgacgaactgatggattgacgcgcgggcggtaggagggaggaccgacgccaaacccagaccgccgccgtcgtgctcctgccgcagcccggagccggccgcttcggggccctggccgccggcctcccagccgcgttctcctccgccgctcctccgggcttgccctggagccctcaggctatcaatatgacggctgaagaaacagtgaatgtaaaagaggttgaaatcattaagctaattttggacttcctgaattcaaagaagcttcacattagtatgctggccctggagaaggaaagtggagtcataaatggcctgttttcagatgatatgcttttcctgaggcagctaatacttgatggtcaatgggatgaagttcttcagttcattcagcctctagaatgtatggaaaaatttgacaaaaaaaggtttcgttatattatcctgaagcagaagtttttagaagctttatgtgttaacaacgcgatgtcagcagaagatgagccccagcatctggaatttaccatgcaagaagctgtgcaatgtttacatgctctagaagaatactgtccttctaaagatgactatagtaagctctgtttgcttttgactttgcctcgtctgaccaatcatgccgagtttaaggactggaatcccagcaccgcacgagttcactgttttgaagaggcttgtgtcatggttgcagaattcatccctgctgataggaagctaagtgaagctggttttaaggctagtaacaatcgtttatttcagcttgtaatgaaaggcctgctttatgaatgctgtgtagaattttgtcagagtaaagcaactggagaagaaattacagaaagcgaagtgcttcttggcatcgacctcttatgtggtaatggttgtgatgatttggatctgagtttactgtcatggcttcagaatcttccatcttctgtcttctcttgtgcttttgaacagaaaatgcttaatattcatgttgacaaacttctgaaacctacaaaagctgcatatgctgatcttttgactcctcttatcagcaaactctctccctatccatcatccccaatgagaagacctcaatcagctgatgcctatatgacccgctctctgaatcctgctttagatggcctcacctgtggactaaccagtcatgataagagaatttcagaccttggaaacaaaacttctccaatgtcacactcctttgctaacttccattatccaggggtacaaaacctcagtagaagtctcatgcttgagaatacagaatgtcacagtatttacgaagaatcccctgagcgaagtgatacacctgttgatgcacagaggcctatcggcagtgaaatcttgggccagagttcagtttcagaaaaagagcctgcaaatggagcacagaatccaggaccagctaaacaagaaaaaaatgagcttcgagattcaacagaacaatttcaagaatattataggcaaagattacgctatcaacagcatttagaacagaaggagcaacagcggcagatataccaacagatgttgcttgaaggaggcgtgaatcaggaggatggtcctgatcagcagcagaatcttactgaacagttccttaataggtccattcaaaagcttggtgaattaaatattggaatggatggccttggtaatgaggtatcagcactcaaccagcaatgtaatgggagcaaaggcaatggatctaatggttcttctgtgactagttttactacaccaccccaagactctagtcagagattaacacatgatgcttcaaatattcatacaagcactcctcgtaatcctggatcaacaaatcacataccttttctggaggaatcaccttgtggaagccaaatctcttcagaacattcggtcattaagccacctcttggagattctccagggagtctttcaaggtcgaaaggggaagaggatgacaaatcaaaaaagcagtttgtttgtattaatatcctagaagacacacaagctgttagagcagtggcttttcatccagctggaggtttatatgctgttggttcaaattcaaaaactctgagagtatgtgcctatccagatgtaattgatccaagtgcacatgagactcctaagcagccggtggtacgttttaaaaggaataaacatcataaaggatccatttactgtgtggcctggagtccttgtgggcagttattagcaacaggatcaaatgacaaatacgtcaaagtgctgcccttcaatgcagagacttgtaacgcaacaggaccagatctggaatttagtatgcatgatggaacaattagagacttggcatttatggaaggcccagaaagcggaggagctattttaataagtgctggagcaggggattgtaacatttatacaaccgattgtcaaagaggacagggcctccatgctttgagtggacatactgggcatattttagcactttatacctggagtggctggatgattgcatctggttcccaagataagactgttagattttgggatcttcgagtaccaagttgtgttcgtgttgttggcacaacatttcatggaactggcagtgcagtggcatctgtagctgtagatcccagtggtcgtctcttagccacaggtcaagaagattctagctgcatgttgtatgacataagaggaggaagaatggtacaaagttatcatcctcattccagtgatgttcgctctgttcgattctcccctggagctcactacttgctaacaggctcttatgatatgaaaataaaggtgacagacctacaaggggacctcaccaagcagcttcctatcatggtggtgggggagcacaaggacaaagtgattcagtgcagatggcacacccaggatctttccttcctgtcatcctctgcagatagaactgtcaccctctggacttacaatgggtagagcacaccgcatgtcagtctatgcagcaaaagcacagagacttaagactactgagttgtgaaaattacaaatctgaagaacatagtgtccaggaaagtggtttagcacgaagaggccccttattaccatgtatcccactgataggaggtgttgggtggtgttattccgcagtgctttcagtcttccatgtgagctcgtgctgctgtgacctgctatatgtagtctcgttgccaaagtctgcagaagagctcttcagttgttggtgtgcactccaagtcaggatggacaatgtgtttacggtttagtattcaatgcattccttggtctttgcctaaataacagttttatatgcacattgaaatggaattatacttcaactatattattaaatgtaatgcaaccaagttcctcccagattaaacttcccaggtgttcagaattacttttgctcttctcacgatcccatattgtattatcacttgtcttctagaggtcagaattccataatatatgtcactcaaaagttacatggttgctttcacttaaggatcattgtggagtttaaagatgaatgaaaaactgcttcttagtttactacatggtataggcccttttttcttaaacccagggatatgattattttgtcatataattttgtttcaggctaaaaggtaaatgtgtttgcttcagaaacttgttaacttcagttttttgaatgcaacaggatacctcccttccaaactgaactgtagaagcagagcagcagcagttatgtgatgcaacacttgatggtacagtaaatttactggcatttttctccttaaaaattaaaatccttgacatagaccatagcatggcttgaaatgctatgtctgcatgataatttaaaatggaagatttaaactttgcactccaaaagcttatttggatttttttcttgcactgttttgtgtaatgcagaataatgattttatttctacagctttgtagattctaacatttatgtatctttattttcatattgtacagtaattttactttaaattatttaaataggctattttatttatttcaaatgcagttgtattagttctcattattgaactgtctgtgcactgtatgtagcaagcatttttcatctgttgtatacaagtggaaagggtattagaagtgtaactgtgctattatttcaataaagacctcttgacatttaaaa

SEQ ID NO: 8521 - DNA, 4134 bp, Homo sapiens
aaacccagaccgccgccgtcgtgctcctgccgcagcccggagccggccgcttcggggccctggccgccggcctcccagccgcgttctcctccgccgctcctccgggcttgccctggagccctcaggctatcaatatgacggctgaagaaacagtgaatgtaaaagaggttgaaatcattaagctaattttggacttcctgaattcaaagaagcttcacattagtatgctggccctggagaaggaaagtggagtcataaatggcctgttttcagatgatatgcttttcctgaggcagctaatacttgatggtcaatgggatgaagttcttcagttcattcagcctctagaatgtatggaaaaatttgacaaaaaaaggtttcgttatattatcctgaagcagaagtttttagaagctttatgtgttaacaacgcgatgtcagcagaagatgagccccagcatgtaagatttttattcctgaagctggaatttaccatgcaagaagctgtgcaatgtttacatgctctagaagaatactgtccttctaaagatgactatagtaagctctgtttgcttttgactttgcctcgtctgaccaatcatgccgagtttaaggactggaatcccagcaccgcacgagttcactgttttgaagaggcttgtgtcatggttgcagaattcatccctgctgataggaagctaagtgaagctggttttaaggctagtaacaatcgtttatttcagcttgtaatgaaaggcctgctttatgaatgctgtgtagaattttgtcagagtaaagcaactggagaagaaattacagaaagcgaagtgcttcttggcatcgacctcttatgtggtaatggttgtgatgatttggatctgagtttactgtcatggcttcagaatcttccatcttctgtcttctcttgtgcttttgaacagaaaatgcttaatattcatgttgacaaacttctgaaacctacaaaagctgcatatgctgatcttttgactcctcttatcagcaaactctctccctatccatcatccccaatgagaagacctcaatcagctgatgcctatatgacccgctctctgaatcctgctttagatggcctcacctgtggactaaccagtcatgataagagaatttcagaccttggaaacaaaacttctccaatgtcacactcctttgctaacttccattatccaggggtacaaaacctcagtagaagtctcatgcttgagaatacagaatgtcacagtatttacgaagaatcccctgagcgaagtgatacacctgttgatgcacagaggcctatcggcagtgaaatcttgggccagagttcagtttcagaaaaagagcctgcaaatggagcacagaatccaggaccagctaaacaagaaaaaaatgagcttcgagattcaacagaacaatttcaagaatattataggcaaagattacgctatcaacagcatttagaacagaaggagcaacagcggcagatataccaacagatgttgcttgaaggaggcgtgaatcaggaggatggtcctgatcagcagcagaatcttactgaacagttccttaataggtccattcaaaagcttggtgaattaaatattggaatggatggccttggtaatgaggtatcagcactcaaccagcaatgtaatgggagcaaaggcaatggatctaatggttcttctgtgactagttttactacaccaccccaagactctagtcagagattaacacatgatgcttcaaatattcatacaagcactcctcgtaatcctggatcaacaaatcacataccttttctggaggaatcaccttgtggaagccaaatctcttcagaacattcggtcattaagccacctcttggagattctccagggagtctttcaaggtcgaaaggggaagaggatgacaaatcaaaaaagcagtttgtttgtattaatatcctagaagacacacaagctgttagagcagtggcttttcatccagctggaggtttatatgctgttggttcaaattcaaaaactctgagagtatgtgcctatccagatgtaattgatccaagtgcacatgagactcctaagcagccggtggtacgttttaaaaggaataaacatcataaaggatccatttactgtgtggcctggagtccttgtgggcagttattagcaacaggatcaaatgacaaatacgtcaaagtgctgcccttcaatgcagagacttgtaacgcaacaggaccagatctggaatttagtatgcatgatggaacaattagagacttggcatttatggaaggcccagaaagcggaggagctattttaataagtgctggagcaggggattgtaacatttatacaaccgattgtcaaagaggacagggcctccatgctttgagtggacatactgggcatattttagcactttatacctggagtggctggatgattgcatctggttcccaagataagactgttagattttgggatcttcgagtaccaagttgtgttcgtgttgttggcacaacatttcatggaactggcagtgcagtggcatctgtagctgtagatcccagtggtcgtctcttagccacaggtcaagaagattctagctgcatgttgtatgacataagaggaggaagaatggtacaaagttatcatcctcattccagtgatgttcgctctgttcgattctcccctggagctcactacttgctaacaggctcttatgatatgaaaataaaggtgacagacctacaaggggacctcaccaagcagcttcctatcatggtggtgggggagcacaaggacaaagtgattcagtgcagatggcacacccaggatctttccttcctgtcatcctctgcagatagaactgtcaccctctggacttacaatgggtagagcacaccgcatgtcagtctatgcagcaaaagcacagagacttaagactactgagttgtgaaaattacaaatctgaagaacatagtgtccaggaaagtggtttagcacgaagaggccccttattaccatgtatcccactgataggaggtgttgggtggtgttattccgcagtgctttcagtcttccatgtgagctcgtgctgctgtgacctgctatatgtagtctcgttgccaaagtctgcagaagagctcttcagttgttggtgtgcactccaagtcaggatggacaatgtgtttacggtttagtattcaatgcattccttggtctttgcctaaataacagttttatatgcacattgaaatggaattatacttcaactatattattaaatgtaatgcaaccaagttcctcccagattaaacttcccaggtgttcagaattacttttgctcttctcacgatcccatattgtattatcacttgtcttctagaggtcagaattccataatatatgtcactcaaaagttacatggttgctttcacttaaggatcattgtggagtttaaagatgaatgaaaaactgcttcttagtttactacatggtataggcccttttttcttaaacccagggatatgattattttgtcatataattttgtttcaggctaaaaggtaaatgtgtttgcttcagaaacttgttaacttcagttttttgaatgcaacaggatacctcccttccaaactgaactgtagaagcagagcagcagcagttatgtgatgcaacacttgatggtacagtaaatttactggcatttttctccttaaaaattaaaatccttgacatagaccatagcatggcttgaaatgctatgtctgcatgataatttaaaatggaagatttaaactttgcactccaaaagcttatttggatttttttcttgcactgttttgtgtaatgcagaataatgattttatttctacagctttgtagattctaacatttatgtatctttattttcatattgtacagtaattttactttaaattatttaaataggctattttatttatttcaaatgcagttgtattagttctcattattgaactgtctgtgcactgtatgtagcaagcatttttcatctgttgtatacaagtggaaagggtattagaagtgtaactgtgctattatttcaataaagacctcttgacatttaaaa

SEQ ID NO: 8522 - DNA, 580 bp, Homo sapiens
aaacccagaccgccgccgtcgtgctcctgccgcagcccggagccggccgcttcggggccctggccgccggcctcccagccgcgttctcctccgccgctcctccgggcttgccctggagccctcagagacatggtcttcctctgttgttcagaggtgtgcagtggtgtgatcatagctcactgtatgtaacttctaacttctgggctcaagcgatcctcctgcttcagcctcccaaagtgctgggactacaggcgctatcaatatgacggctgaagaaacagtgaatgtaaaagaggttgaaatcattaagctaattttggacttcctgaattcaaagaagcttcacattagtatgctggccctggagaaggaaagtggagtcataaatggcctgttttcagatgatatgcttttcctgaggcagctaatacttgatggtcaatgggatgaagttcttcagttcattcagcctctagaatgtatggaaaaatttgacaaaaaaaggtttcgttatattatcctgaagcagaagtttttagaagctttatgtgttaacaacgcgatgtcagcagaagatgag

SEQ ID NO: 8523 - DNA, 556 bp, Homo sapiens
ctggcactgagcagcaagtgagcgcgaggctatcaatatgacggctgaagaaacagtgaatgtaaaagaggttgaaatcattaagctaattttggacttcctgaattcaaagaagcttcacattagtatgctggccctggagaaggaaagtggagtcataaatggcctgttttcagatgatatgcttttcctgaggcagctaatacttgatggtcaatgggatgaagttcttcagttcattcagcctctagaatgtatggaaaaatttgacaaaaaaaggtttcgttatattatcctgaagcagaagtttttagaagctttatgtgttaacaacgcgatgtcagcagaagatgagccccagcatctggaatttaccatgcaagaagctgtgcaatgtttacatgctctagaagaatactgtccttctaaagatgactatagtaagctctgtttgcttttgactttgcctcgtctgaccaatcatgccgagtttaaggactggaatcccagcaccgcacgagttcactgttttgaagaggcttgtgtcatggttgca

SEQ ID NO: 8524 - DNA, 2594 bp, Homo sapiens
aggcacctgttgaaggaaaaagaagatccatccttatagaaatagttgaaggcaactgagaaaaggtgaagccattatgagttgccagaaagctgtacttgagttaaacatagggtcacagcttgggccaaagagtcctgagagaacagaaggtgtaactgcatttgaagactatggcacaggcctgcttgaaaaccaactcagcgtgggtgactttgtaaaaatacagaaggcctttgagttacttacaatgcatctttagacgctatcatttccagtacaaccagcaatacaaatagtgtggtgatggcttggagagagaaatcaaaaaagcgtcttaatatgacatccttcaacattgcccagggcattcatgcttttgattatcactctcggctcaatttaattgcaactgctggcattaacaataaagtttgcctttggaatccctatgttgtctctaaaccagtgggtgtcctttggggccactcagccagtgtaatagccgtccaattctttgtggaaagaaaacaacttttcagcttctccaaggataaagttttgagactctgggatattcaacaccagctgtccatccagaggatagcttgttctttccccaaaagtcaggacttcagatgtctcttccactttgatgaagcccatggacgacttttcatctcgtttaataaccagctagcattgttggcaatgaaaagtgaagccagcaagagggtgaaaagccatgagaaagcagtcacttgtgttctttacaattctatcttgaagcaggtaatcagctctgatacagggtctactgtttccttctggatgatagacactgggcagaaaatcaaacagtttactggttgccacggcaacgcagaaatcagcactatggcccttgatgcaaatgagactcggcttttgactggcagcacagatgggactgtaaagatatgggacttcaatggatattgtcaccatacactaaatgttgggcaagatggagctgtggatatttcacaaatcctcattcttaagaagaaaatactggttacaggctgggagagggctattactgtgtttcgaccccaaaacttcaatcaatttttcatccagcctgaagaatggaaaggaggtatacagcaccatgatgacatcttgtgtgctgcgtttttacctccacaaactcttgttacggggagttatgatggagaaattgttctatggaacaatagcacagagaatgctcaccatgttcttcaccctgattaccagaggttgctaaagtcaaaattagatacaaaacctcaaaaacttctcagtgctgggagaagccaaccctcccaccccatggcagaccattctaccacgggagtccgcaactttgagattgacactgagggcaaaaatgctgttatgagactttgctttcttaaagcaagaaaaaacactgcagtgacaggaggagctaacctggtatcatgtggaggatctggttatgtcagattttgggatatatataagaagcaacttctggctgaatttttggctcatagtggagttggatcgattattatgtctactgataagatgaatcgataccttaccacaggagatcttgatggatggttgaaaatctggaatatagaggagtactgtcttaactccagtaagaacaaaatcaccaaggccccaactctgataagatcattccaacctcatgaggaccgaataagttccttagagatgtgtgagccaggtggtcagttactgattatctcctcctctgcagactgcagtatttgtgtgactggtgtctgcaatgctcctgtttggatctttggtcaggcaaagcactggcatattgaaaactgccttttccttcctaaaagagatactaatttagtggaaagtgagattcaaaaggaaatttctttattttctaaggaggaatcttgtttagacccaacagaacattctctacttaataagaaaaacaaagatgactcaacatacaatgtcagaccatcagaagatataaatttagatataaaatataaggaaagaagtacctgcatgaaagaaacacaaaaaccttattatggtgaagttataaaaaaatcattcagtacatttaggtcattaaacattggagccctggaagagctgcctgaagtgaataaacctgctttccttctagaccctgagaaatactttaggaaagaaccagaggaagagcgtccccaaattctggaggccccgtcactttttaaaactttgaaagctgtatttgatgagaaaaacctgtttcccaaggaaattctgcatcatgaacgaaaagccaagcaattatgccaagaaaaaagttgtgaagtgaagaaaaataagaagtaattacaacagaaaaaccttcactgttacataaggtacagatataaaatgcagaaaaagcatcaagaattctgccttttattttattttatatttaaacttcaggaagttttctcttcatgggataatttagtactgcttttatctatcatctgtcaatttctctgtattcttaataaaataaatattgaactaaa

SEQ ID NO: 8525 - DNA, 2215 bp, Homo sapiens
ggcctgctagtgcatgtgaagatggagaagccactatgaccattaactgggcagagctgctctctggatgtcacaaatgttgccatatattagagcataaacttcatcaaggagattgggtcaggcaagttacttacaatgcatctttagacgctatcatttccagtacaaccagcaatacaaatagtgtggtgatggcttggagagagaaatcaaaaaagcgtcttaatatgacatccttcaacattgcccagggcattcatgcttttgattatcactctcggctcaatttaattgcaactgctggcattaacaataaagtttgcctttggaatccctatgttgtctctaaaccagtgggtgtcctttggggccactcagccagtgtaatagccgtccaattctttgtggaaagaaaacaacttttcagcttctccaaggataaagttttgagactctgggatattcaacaccagctgtccatccagaggatagcttgttctttccccaaaagtcaggacttcagatgtctcttccactttgatgaagcccatggacgacttttcatctcgtttaataaccagctagcattgttggcaatgaaaagtgaagccagcaagagggtgaaaagccatgagaaagcagtcacttgtgttctttacaattctatcttgaagcaggtaatcagctctgatacagggtctactgtttccttctggatgatagacactgggcagaaaatcaaacagtttactggttgccacggcaacgcagaaatcagcactatggcccttgatgcaaatgagactcggcttttgactggcagcacagatgggactgtaaagatatgggacttcaatggatattgtcaccatacactaaatgttgggcaagatggagctgtggatatttcacaaatcctcattcttaagaagaaaatactggttacaggctgggagaggtatgattatgcctcatggaaaactataggaagggctattactgtgtttcgaccccaaaacttcaatcaatttttcatccagcctgaagaatggaaaggaggtatacagcaccatgatgacatcttgtgtgctgcgtttttacctccacaaactcttgttacggggagttatgatggagaaattgttctatggaacaatagcacagagaatgctcaccatgttcttcaccctgattaccagaggttgctaaagtcaaaattagatacaaaacctcaaaaacttctcagtgctgggagaagccaaccctcccaccccatggcagaccattctaccacgggagtccgcaactttgagattgacactgagggcaaaaatgctgttatgagactttgctttcttaaagcaagaaaaaacactgcagtgacaggaggagctaacctggtatcatgtggaggatctggttatgtcagattttgggatatatataagaagcaacttctggctgaatttttggctcatagtggagttggatcgattattatgtctactgataagatgaatcgataccttaccacaggagatcttgatggatggttgaaaatctggaatatagaggaggaatcttgtttagacccaacagaacattctctacttaataagaaaaacaaagatgactcaacatacaatgtcagaccatcagaagatataaatttagatataaaatataaggaaagaagtacctgcatgaaagaaacacaaaaaccttattatggtgaagttataaaaaaatcattcagtacatttaggtcattaaacattggagccctggaagagctgcctgaagtgaataaacctgctttccttctagaccctgagaaatactttaggaaagaaccagaggaagagcgtccccaaattctggaggccccgtcactttttaaaactttgaaagctgtatttgatgagaaaaacctgtttcccaaggaaattctgcatcatgaacgaaaagccaagcaattatgccaagaaaaaagttgtgaagtgaagaaaaataagaagtaattacaacagaaaaaccttcactgttacataaggtacagatataaaatgcagaaaaagcatcaagaattctgccttttattttattttatatttaaacttcaggaagttttctcttcatgggataatttagtactgcttttatctatcatctgtcaatttctctgtattcttaataaaataaatattgaact

SEQ ID NO: 8526 - DNA, 3377 bp, Homo sapiens
gggttcccggagagctggacgccggccgcgcatgcgccccacggcccgccctggttccgcctccctggaagaggggtggcgttgtctcggtaaccggagtaaacggaggcctccggcagacgctgtgaagagaggagccgcggcggtcagtaccttcgaggaaatgaaggaaccagatgatcaggatactgatggggagaaatcagttacatcaaagagtgatgggaagaagtctctgaggtcttctaaatcagaatcaagatctcctgttcaagaagataacacatttttagaagatgacacagatgaaacatttaccaaaggggaaggatcatatttagaagaagactcagatgaggaacgtttggaaggaagtttgagttcatttcagtatggtgatttgcaaagcactacagtacctcagcaaacccctgctccagctgtggaagaagcagaggaggaagttaagaagaaaatatcagagagcttcttctatgattatatggagcttgcttcgatgccttttgtgactctggattcaaacataccactggatcttctcacacttgtacattcttttggttatgactgtagaaagcgagccaacctacaacttctggacgacagtatcgccatatacatagctgggaaccaactgatctttctgaatttgaaaaccaaggaacagatctacctgcgaagtagcagtggtgaaggaattggcgtcattggggttcatccacataaaacttatttcacagtagctgaaaaagggagttttccagatattatcatctatgaatatccttctctgagaccatacagagtccttcgagatgggactgagaagggatatgcttatgtggactttaactacagcggtaacttgctggcctctgttggtagtaaccctgactacacactgactatctggaactggaaagaagaacaacccatactaaggacaaaagctttttctcaggaagtttttaaggttactttcaatcctgataaggaagagcagcttactacatcgggatcaggccacatcaagttctgggaaatggcttttacgttcaccggtctcaagctgcagggatcactaggtcgatttggcaaaacaatcactactgatatagaaggctacatggagctcccagatgggaaggtgctctcagggtcagaatggggcaacatgctgctttgggaaggtggtctgatcaaagtggagctctgtcgagggacaagcaagtcatgtcacaatggtcccattaaccagataatgctgtatgagggtgaagttatcactgttgggtcagatggatatgttaggatatgggattttgagacaatagacactgctgatgtaatagatgagactggattgttggagattgagcctattaatgaacttcaagtagacaagaatgtgaatctcttctctatgataaaaatgaatgaaactggaaataacttttggttggctcaggatgccaatggagccatatggaagcttgaccttagtttttcaaatattacccaggacccagaatgcctcttctccttccattctggagctattgaagccgtggctgtttctcctctcacttatctcatggccacaactgccttggactgctctgttcgaatctatgattttgctagcaaaactcctttggcccagatgaaattcaaacaaggaggtactgcccttgtttgggtaccccgaatggtaaacttcactggagcacaaattattgtaggatttgaagatggagttgttcgaattcttgaactttatgatccaaaagggctcacgatttttgcgggacggaagaaaattttggatgctgatattcagttgaaacaggttttcaaaccccatactgcttgtgtcactgctttagcttatgaacgtgatggggaaattctagccacagggagtaaagatcaaactgttttcttctttgaagtggaaagggattataagccgattggttatattaatactcctggacctgtgtgtcagttaatgtggtctcccatgtctcatcctgaaagtactttactaattatctgtgaaaatggctatattcttgaagctccacttccaaccataaagcaagaagaggatgatcatgatgtagtctcctatgaaatcaaagacatgtgcataaaatgtttccatttttcaagtgtcaaatctaagattctgagattaatagaaattgaaaagagggagagacaaagggagttgaaggagaaaataagggaagaaaggaggaacaagctagcagcagagatgggagaagatggagaaaaagaatttcaggaggaggaagaggagaaagaggaggaggaggaggaagaagagccattacctgaaatatttattccgtcaaccccctctcccatcctctgtggattttactcagagccagggaagttctgggtttctttgggtggctatgattctggttttctatatcactgtgagttccccccttgtgatgaaagcagtgatttcaaagaacaaaaagatgaacctattgatgtccgttatcttgcggatacagaggacaatcccatccaaactatcactttcaacattaacaaagttatgatgttttgtggaatgaaaaatggagcaattcgagtctatgtcctaaatcaaaatgatccttcattgaccagtttggtggactactggcacttcaatatgcatgacaataattatggatgtattaaaagtattgctaatagctttgatgatcgtttcttggtgactgctggagcagatggcaatatctttgttttcaacattttttctgaatttatgctaaggaaagacatgaaggccaaagttccatctcccaggtttggaattgaaacagagccaattccagaagacattgaagatcccaaagcctacagtatcgagaatgctaggagaaaaagagaacatgacaagttaatgaaagaagtgggagaaataaaggcacggaagagagagcaaatcaaagctttgaggagtgaattttgtaatctattagaaatgaatgaaaaattaccaaagcatatgcagtttaaacgaacagtaagcctaatataaacttgatttttattttaacatatgctatttctggatagagatgactattttcccaacaagtagaaacacttaaaatcatctttcttttttgtttgtttctttcaaaatttcaatagccatttattttgggcatcttttaatttgtatgtggggtttatcccttttaatcagttaagattcttgttgacacaaattgttttacatcaactgttgttatagaacacatgaaaggaatacatggggaagaaataaagtagaacccaag

SEQ ID NO: 8527 - DNA, 2218 bp, Homo sapiens
tcgatgcagaactccgtctccttagacatcagaaactaaaactagatactcagatgaaattatctgacctgcaccatgtcaccttatttcaagaaatacttctcctgaagaattttgaaaaacaggagaacatacttcaagaacgtgttaattccttagacaaagaggaacagtacatgcaatggaaaataaatgaaactcttaaagagatggaagagaaaaagaatgaaatcaccaaactccaggagcaagaaaaggcactctatgctggttttcaagcagccattggagaaaacaataaatttgcaaacttcctcatgaaggtcctaaagaagaagattaaacgggtaaagaaaaaagaagttgaaggagatgctgatgaagatgaggagagtgaggaatcaagtgaagaagaatctagcttggagagtgatgaagatgagtctgaatcagaagatgaggtttttgatgattctatttgcccaacaaattgtgatgtggctctttttgagctggcccttcaccttcgagagaaaaggctggacattgaggaggctttagttgaagaaaagaaaattgttgataacctcaaaaaggaatatgatacattgtcaaaaaaagtgaaaattgtggcaactaatctgaatgcagcagaggaggccctggaggcttatcagcgagagaagcagcagcggctgaatgaactgctagttgtgattccgctcaagctccaccagatagagtatgtggtatttggagaaatacctagcgatctttctggtactttggtcttctctaaccatgccttgagacggctgcaagaacgaatccatgagctccaggaggaaaattccaagcagcaaaaacttaacaaagaatggagagagagacgtaaacagctcatccgagaaaagagagaaatgacaaaaaccatacacaaaatggaggaaacagtccggcagctcatgatcagcaagtttggccgtgtggtaaatctagaagcccttcaaacgctttctgttaatacaacacttgaagaactgaagatcagaaaacttcgaaaggagctagcaaatgcgaaagagatgaagatgtgggaggaaaagattgctcaaatgcgatgggaactgatgatgaagacaaaagaacacaccagaaagctttatcagatgaatgatttgtgtattgaaaagaagaaacttgattctcggttgaatacactacagaatcagcagaaccctggaaatggtctaagctaagtgttccaacagtttggtcctctgaagaagagcatcagcatcacctgggaacttgtttaaaatggcaatgccttccagggccctcgggaagcagatgttgtggcaagagaggaggtcactgaattgatccaactccaggcggaaaggatttcggccttaaaggaggagattgctcttttgcgtaggaaaggcagtcttatcctcccacccattcagtctccacgagagaaagagatacagcccgcagacctttgagtttgctattttctcaaacccatacaagatttctgacataactcactggaagttctgtctcctcatcacctccaacaatcttattactttaaactgaactcgcctgaaagtgtaaaaccagatccagtcacgttaagtcactttaagaatctctctacaatttggttatcttagaactgactgcagcacccaacctctgttatgaaactgaatcattttagatgtttcgaacctactagattgaatatgaagtctcggaaggctgtgtttcatgattgcagcaaatcacctgtaatatattttgttttaggaaaatttgatttgggggtatcctgaatttttagcccttggcaagaaaaactatcattcagcaattcatgagaaaactttgttttcttgatccttagaaaataaacttagatgttattaagtgttctctgagaggatgcaggagaaaaggacattttgtcagctatatcttagaatagaaatgcaaatttcagttttggcattgttgacttcataaagcagtgttttgagggctcaggattcaggaaatacaaacagacatggcagagcagtttgctttgggttggcagaaagcaggaaaataaccagccttcttggattgcccacagtttttgtagactcctcagttctgagtggagcagaggggcatgcttaataaaacagtcaataaagag

SEQ ID NO: 8528 - DNA, 10259 bp, Homo sapiens
gagtaaacggaggcctccggcagacgctgtgaagagaggagccgcggcggtcagtaccttcgaggaaatgaaggaaccagatgatcaggatactgatggggagaaatcagttacatcaaagagtgatgggaagaagtctctgaggtcttctaaatcagaatcaagatctcctgttcaagaagataacacatttttagaagatgacacagatgaaacatttaccaaaggggaaggatcatatttagaagaagactcagatgaggaacgtttggaaggaagtttgagttcatttcagtatggtgatttgcaaagcactacagtacctcagcaaacccctgctccagctgtggaagaagcagaggaggaagttaagaagaaaatatcagagagcttcttctatgattatatggagcttgcttcgatgccttttgtgactctggattcaaacataccactggatcttctcacacttgtacattcttttggttatgactgtagaaagcgagccaacctacaacttctggacgacagtatcgccatatacatagctgggaaccaactgatctttctgaatttgaaaaccaaggaacagatctacctgcgaagtagcagtggtgaaggaattggcgtcattggggttcatccacataaaacttatttcacagtagctgaaaaagggagttttccagatattatcatctatgaatatccttctctgagaccatacagagtccttcgagatgggactgagaagggatatgcttatgtggactttaactacagcggtaacttgctggcctctgttggtagtaaccctgactacacactgactatctggaactggaaagaagaacaacccatactaaggacaaaagctttttctcaggaagtttttaaggttactttcaatcctgataaggaagagcagcttactacatcgggatcaggccacatcaagttctgggaaatggcttttacgttcaccggtctcaagctgcagggatcactaggtcgatttggcaaaacaatcactactgatatagaaggctacatggagctcccagatgggaaggtgctctcagggtcagaatggggcaacatgctgctttgggaaggtggtctgatcaaagtggagctctgtcgagggacaagcaagtcatgtcacaatggtcccattaaccagataatgctgtatgagggtgaagttatcactgttgggtcagatggatatgttaggatatgggattttgagacaatagacactgctgatgtaatagatgagactggattgttggagattgagcctattaatgaacttcaagtagacaagaatgtgaatctcttctctatgataaaaatgaatgaaactggaaataacttttggttggctcaggatgccaatggagccatatggaagcttgaccttagtttttcaaatattacccaggacccagaatgcctcttctccttccattctggagctattgaagccgtggctgtttctcctctcacttatctcatggccacaactgccttggactgctctgttcgaatctatgattttgctagcaaaactcctttggcccagatgaaattcaaacaaggaggtactgcccttgtttgggtaccccgaatggtaaacttcactggagcacaaattattgtaggatttgaagatggagttgttcgaattcttgaactttatgatccaaaagggctcacgatttttgcgggacggaagaaaattttggatgctgatattcagttgaaacaggttttcaaaccccatactgcttgtgtcactgctttagcttatgaacgtgatggggaaattctagccacagggagtaaagatcaaactgttttcttctttgaagtggaaagggattataagccgattggttatattaatactcctggacctgtgtgtcagttaatgtggtctcccatgtctcatcctgaaagtactttactaattatctgtgaaaatggctatattcttgaagctccacttccaaccataaagcaagaagaggatgatcatgatgtagtctcctatgaaatcaaagacatgtgcataaaatgtttccatttttcaagtgtcaaatctaagattctgagattaatagaaattgaaaagagggagagacaaagggagttgaaggagaaaataagggaagaaaggaggaacaagctagcagcagagatgggagaagatggagaaaaagaatttcaggaggaggaagaggagaaagaggaggaggaggaggaagaagagccattacctgaaatatttattccgtcaaccccctctcccatcctctgtggattttactcagagccagggaagttctgggtttctttgggtggctatgattctggttttctatatcactgtgagttccccccttgtgatgaaagcagtgatttcaaagaacaaaaagatgaacctattgatgtccgttatcttgcggatacagaggacaatcccatccaaactatcactttcaacattaacaaagttatgatgttttgtggaatgaaaaatggagcaattcgagtctatgtcctaaatcaaaatgatccttcattgaccagtttggtggactactggcacttcaatatgcatgacaataattatggatgtattaaaagtattgctaatagctttgatgatcgtttcttggtgactgctggagcagatggcaatatctttgttttcaacattttttctgaatttatgctaaggaaagacatgaaggccaaagttccatctcccaggtttggaattgaaacagagccaattccagaagacattgaagatcccaaagcctacagtatcgagaatgctaggagaaaaagagaacatgacaagttaatgaaagaagtgggagaaataaaggcacggaagagagagcaaatcaaagctttgaggagtgaattttgtaatctattagaaatgaatgaaaaattaccaaagcatatgcagtttaaacgaacagattttgatgtagattcccaaatccgtgctgagatgcacagaaaaacagctttcaaaattcaacaagtggaaaaggaattagcttgggaaaaagagaaacatgaactcggcctaatgaagctaaagaatcgatttcgagatccactggaaagtgatactattgtggttcatgccatactgagtgaccacaagatatcctcttacaggctggtgcagccctctaagtactccaaattcaaacgagctagtcaatcagagagaaaaccaagcaaattggacaggtttgaaaaagagggacctggaagaaaggacagccagagagatgcaggtgggagtgttaccatacaagaagaatcaataatagaaaaagggaagaaatttcggcctaaaaccctaagtgaaatcatcgtggaaaatcaaattgagaaaacgagaaaacttatattaaaagctgaaagggcacaactaaagattcaacagcgaaaaaaagaatgggaggaactatacaagagtaaacctggtgatgactatgaagatcccaaagatcttcaagccatcaaagaagcccaggtgtatatgggagatttcaatctgaagacagccccagactacaagatacctgagcacatgagaataaatgctgccaagaaggaagaggaactaggacacctagattctttggtccatggaaataaaaggcacatgaacaagtgcattctctctcttagagaccttaaagtggctgttgttgaggaaatacagtgcctggtacaagaactgaagaacattcagtcgactcttcacatatccaagcacatacccattcccaaaattcctcagatacacccagaagaagttccagaaaagagatttcagtatgatgaagaaactctcctaaattttaagcaacagcaaatgaaaagtaaagatgaaaagtcccccggagtggaacagacagggtctggaggcccagttggaggattcctcaaactctcttctagaaaggatggggatttgacaacccgtgattcaatatctagatcatcaaaggcatcaacattcagcctagatataccaaagtgtttggaatttgaaaaagcagagccaacggatgtggagctggaaattatgaagagagacgagattaaacacgtgtacatgcaacagtatttggtcaacaggatcaaagaactggttgtcactttcgatgcagaactccgtctccttagacatcagaaactaaaactagatactcagatgaaattatctgacctgcaccatgtcaccttatttcaagaaatacttctcctgaagaattttgaaaaacaggagaacatacttcaagaacgtgttaattccttagacaaagaggaacagtacatgcaatggaaaataaatgaaactcttaaagagatggaagagaaaaagaatgaaatcaccaaactccaggagcaagaaaaggcactctatgctggttttcaagcagccattggagaaaacaataaatttgcaaacttcctcatgaaggtcctaaagaagaagattaaacgggtaaagaaaaaagaagttgaaggagatgctgatgaagatgaggagagtgaggaatcaagtgaagaagaatctagcttggagagtgatgaagatgagtctgaatcagaagatgaggtttttgatgattctatttgcccaacaaattgtgatgtggctctttttgagctggcccttcaccttcgagagaaaaggctggacattgaggaggctttagttgaagaaaagaaaattgttgataacctcaaaaaggaatatgatacattgtcaaaaaaagtgaaaattgtggcaactaatctgaatgcagcagaggaggccctggaggcttatcagcgagagaagcagcagcggctgaatgaactgctagttgtgattccgctcaagctccaccagatagagtatgtggtatttggagaaatacctagcgatctttctggtactttggtcttctctaaccatgccttgagacggctgcaagaacgaatccatgagctccaggaggaaaattccaagcagcaaaaacttaacaaagaatggagagagagacgtaaacagctcatccgagaaaagagagaaatgacaaaaaccatacacaaaatggaggaaacagtccggcagctcatgatcagcaagtttggccgtgtggtaaatctagaagcccttcaaacgctttctgttaatacaacacttgaagaactgaagatcagaaaacttcgaaaggagctagcaaatgcgaaagagatgaagatgtgggaggaaaagattgctcaaatgcgatgggaactgatgatgaagacaaaagaacacaccagaaagctttatcagatgaatgatttgtgtattgaaaagaagaaacttgattctcggttgaatacactacagaatcagcagggcaatgccttccagggccctcgggaagcagatgttgtggcaagagaggaggtcactgaattgatccaactccaggcggaaaggatttcggccttaaaggaggagattgctcttttgcgtaggaaaggcagtcttatcctcccacccattcagtctccacgagagaaagagatacagcccgcagacctttgagtttgctattttctcaaacccatacaagatttctgacataactcactggaagttctgtctcctcatcacctccaacaatcttattactttaaactgaactcgcctgaaagtgtaaaaccagatccagtcacgttaagtcactttaagaatctctctacaatttggttatcttagaactgactgcagcacccaacctctgttatgaaactgaatcattttagatgtttcgaacctactagattgaatatgaagtctcggaaggctgtgtttcatgattgcagcaaatcacctgtaatatattttgttttaggaaaatttgatttgggggtatcctgaatttttagcccttggcaagaaaaactatcattcagcaattcatgagaaaactttgttttcttgatccttagaaaataaacttagatgttattaagtgttctctgagaggatgcaggagaaaaggacattttgtcagctatatcttagaatagaaatgcaaatttcagttttggcattgttgacttcataaagcagtgttttgagggctcaggattcaggaaatacaaacagacatggcagagcagtttgctttgggttggcagaaagcaggaaaataaccagccttcttggattgcccacagtttttgtagactcctcagttctgagtggagcagaggggcatgcttaataaaacagtcaataaagaggcttttctttaaagatttctgcaactccgtcagaattctaagttttccccatagtttctcatgtcccctgccattttctttcaggttttacttgggccatttgctggttttgatatagatgaggagataatgaaatagatttactagagatcatctttaacaatcacctttgattatgcataacattttaaactaattgaagagtatccttttggtttgggggtaagtgctcattgaagttcatggctataaccattgcaggataatctcactgacatttggaatcctgttagtaacagagcatagctctttagattaagagctctgtattaacgagctactcattgaggctgttccaggataagctggtcactgagaagggcgggtgaagaaaggaacattgcataaatgtagaagggaactcagcaatgccaagtcttcctcacctgtgattagcctgctaatgtgccccccaaaattacagacaggtcttgctttctttgtacatcagcatattcttagaggtggccacttggcctattgtcttcctaagattccttcatattcctatttaagaggtcagaataccttattgtttgcacttgtcaccattaatttctgatgtagtcacttctctactggagagcacccacttttttttttaaatcactttctgtgttgtatatcctaagccatgtgtgcctttcaagtatttttaaaaatatgctagtcatagccctgagtgtcttatttattgcggtaaaaaattacccccaaacttagcttgaaacaacaaacttgtgatctcacccaggagtgagagggtttctgaggtccaggaatctggggacagcttggccgggtgttctggctcagggtctttcgtggagttgcagtcacactaggagctggggctgcagccatctgaagcttggctggagctggaggggctattagcaaattcactcccttggccattaggcagggcttcagttcctcgccatgtgggcctctccatagggccgcttgggatatgacttctcccagagcaagtgatccaagagtgagggagacagcaagagagaatgatgtatacaagagccacagtcttttacagcccaagctcagaagtgacatagcgtcactattgtcatatgggtcacaggctgaccctgtgtgatgtgggaggggactgaacagggtgtgaatgccaggtgggggtcaccggggccttcgtgggagctggcagccacaagaagcagctgcctggagagagtggctggtctctgagaaaggtcttgaggcgataccatccccttggtaattgtagagaatcaggagaagttacgttatcttcctgggcctcattttattatctgacaaatgaaggattggtagaatgggttccttcccattctgagattctgattctgattgcagcaagaatggacctacagtctacagaagagccacatcaggacttgctgtgcatttcaactgagaggaaagctaatcgggataattattcccaaactgagctggactaaatcactagttaattctacaatattcagggcttcattccgcatgtttgggaattgacgacagttaacactgaattactttattttgaattggacaaaatatgttgatagctttaggttcatttcaacttgattccaggcttagtcttaaatctgtagttaagttagagcatctgagtctttgggaagttaagcttcaaacacaagtagaccagcagggtgtggcatgggcagggtggctgggaagctatcctgctcctggcacacttccctgccttctgctgtgctcccagaggagcagcctcacctctgagggtaaggccaaaaatcagcctacactgagttacttgtgggtcaattgttcatataacttggctcttctgaactgtcatccatagtatcaccgatgatcaatctcagcattggaagaaaaagaaaccacagagtccagcccctctgtcacaacttcagagtaaaggagttgctcatgcctgccagccagcctgtcccaccacagcgggctccccagcttagggaggtctgtgagccatgtgctaaatttctctttagagctaaatccattgagtgctatgattccagtgctgtgcagaaagcagatgtttcacctatcacttcagaaaagttcaccagacttcattttgacagctaccttagatcatcaaggagaaaaaggaaaaaatgtaaaaaccagtggggctagaaggtgagttacagctcagattggggggcctctggatagcaaagcaatgactgagagcgtcagccctacccaccccagaagtgagctctgggccgtgatgccaggttgtctgaaatcacagtatcttattttttctcttctcttccctgctctgcttctcatttcctaacatttacctgttccttacagtccttccttttaaataatatttttaaaatactgctttcctgaaaaccatgctgcacttccacatgaagttctctctgacgttgagcttgatggaaaaaggatgcagaagtcaggaatagcaggtgctatacttattttggccagcagaggatgcacttgccctaaacagtcagagtgactcttccctaggaccctgtttatcaaattcttcatgtttaaaagccagggtctggccccccacttaacgagattgtctcaagtggcatttcatctgtaactcaattttacagaaatctagaaaatacaggctccccccaccctctccagccccaaaacacaaagcgtagtaaggctttcattgcaagcatcagtctccatctaattccacttccacatataaagattttaaaatttcaattaaaaaagaatctatggttgatcctttggttggacaacagtaagtaaatgttgattttaaactagtgagtcaactactctggcaatgttggtgtatctttggaaagaagggaagtgaatttattatgcaccatatgtccatgtgtggcacagcacttagctaaacagtattttggagaaaatatttggtcttcaacacacacctatataaaaaagattagttctatttcttcaatatgacctaaacttcatctcaagtccagttggtaagagaactatgaacctgtttttcctggtctgttgtacaacggttcccttgtggactaaacggtaatgtgttctgcatgaatccaagcacaactgacattcactgttttaaaaaacaaaaaagagaaacatttactacctttttcagatctcatttctgatggacctgaaaatattgtaagtgggtattttcttcaaatactcagagactgaattctaacatgtaaagaaaatgctgactcacacatgactcagtttgaaggttacagggaagactaaacatttatttagaagttacagtgtttgtttttacagagatatgttgccacggattattgattctggaaggttttttaatgctcatagtgctgtacacatcttggtctgttctcatgggcatcttaggaaaatgtttcccgtagcaccggatccagccatctgtgtgggtgtctccaggctgtgataccgtgccccttgctgttccctcatgctcgtgatgaaccatgtgcctgggatccttcctcttgccagcttatctgtgggcctcctgcagcctcgcctgccactgcagaggccccaggttaggagtctgtcccgcgccagcctgtgcggtgctttcctgggtgactcctgttaggtggcagcttctttattttccctctccaacctcaacgggtaggactccttatgtctctccagaattataaaacatatacatttatttacaagtgcataaatatataaatatggctataatagaaaaataaataccaattttctctgtc

SEQ ID NO: 8529 - DNA, 724 bp, Homo sapiens
gggagacagtcatcatactacactctcctttgtcctttgatcgtgtagtgtaccatatctgctttaggcataccagtctatcttcagagaccaggaagatataacagtgtggcagtttaagtaaccctcatagcaggcttgtaaaaagttttttcttcattcccattacagttggggaattcatataaagtttagttagctagttatatgtcagtactgggattcaaaccctaatctaactataaatctgatccaaatagaactagtgttccattctgcttgccaggcatatcgtagaagaatgttgaggaaacatagggtgtttagtatagagaagtgaagacttagaaggaaggtgttttcaaatatatgaaaagctgcattatagacagagggcagagaaaacctgttgtgtcgctcccctctttaaaaccctttaatggttttcagttgtcaaggaaataagaggaaatgaaggaaccagatgatcaggatactgatggggagaaatcagttacatcaaagagtgatgggaagaagtctctgaggtcttctaaatcagaatcaagatctcctgttcaagaagataacacatttttagaagatgacacagatgaaacatttaccaaaggggaaggatcatatttagaagaagactcagatgaggaacgtttggaaggaagtttgagttcatttcagtatggtgatttgcaaagcactacag

SEQ ID NO: 8530 - DNA, 1671 bp, Homo sapiens
gttcctctcggccccggatgtgactgtttggctgcgccgcctcacgcctgacgctcgacgggattgggcgccggcgggtgaggttatcactaggcgccgaggaggggagcgggaagcgcagtgccagcgccacagcccttcaatcattttggttgctatccagcttctccacatcaagtccaacttcagaaacccgaagcctgtagagaaaagttgacctgtgctgactctggtgatggtgactgtctctcactaatttctttgaagtcttcaaggataagcagagttgatccatctgagaaagggatcatgaactagacagaatgaacagccttagaggcacagactcttgaacgggacggtggtggtatgactagtgcagagtgtttagagatcactcagtttttaaagactggcctttatcgtgtctcagtgcagccgaggcagagcctttgaaggatgcgatgttgtcattcttactaatctagtccagccgctgaggtgactttcaacggcagaccgtctcctgagcgccccaggtagaatttcaaaagtctccgggaccattatggcagtcaagtggacgggtgggcattcttctcctgtcctctgcctgaatgcaagtaaagaagggctgctggcttctggagcagagggcggagatctcacggcttggggtgaagatggaactccattaggacacacgcggttccaaggggctgatgatgttaccagtgtcttattttctccctcctgtcccaccaagctctatgcctcacatggagaaaccattagtgtactggatgtcaggtccctcaaagattccttggaccattttcatgtgaatgaagaagaaatcaattgtctttcattgaatcaaacggaaaacctgctggcttctgctgacgactctggggcaatcaaaatcctagacttggaaaacaagaaagttatcagatccttgaagagacattccaatatctgctcctcagtggcttttcggcctcagaggcctcagagcctggtgtcatgtggactggatatgcaggtgatgctgtggagtcttcaaaaagcccgaccactctggattacaaatttacaggaggatgaaacagaagaaatggaaggcccacagtcacctggtcagctcttaaaccctgccctagcccattctatctctgtggcttcgtgtggtaatatttttagttgtggtgcagaagatggtaaggttcgaatctttcgggtgatgggagttaagtgtgaacaggaactgggatttaagggccacacttcaggggtatcccaggtctgctttctcccagaatcctatttgctgcttactggagggaatgatgggaagatcacgttgtgggatgcaaacagtgaagttgagaaaaaacagaagagtcccacaaaacgtacccacaggaagaaacctaaaagaggaacttgcaccaagcagggtggaaatactaacgcttcagtaacagatgaggaagaacatggcaacattttaccaaagctaaatattgaacatggagaaaaagtgaactggctcttgggtacaaaaataaagggacaccaaaatatattagtagctgatcaaactagttgtatatctgtataccccttaaatgaattttaaatccaataaaaacatttgaagaattg

SEQ ID NO: 8531 - DNA, 980 bp, Homo sapiens
gcaggtatgaggctggcgccggtggcttcgatgctgctttccggtgacttcgatgctgttttccagtgctttttcctttttctgtgccagcgccacagcccttcaatcattttggttgctatccagcttctccacatcaagtccaacttcagaaacccgaagcctgtagagaaaagttgacctgtgctgactctggtgatggtgactgtctctcactaatttctttgaagtcttcaaggataagcagagttgatccatctgagaaagggatcatgaactagacagaatgaacagccttagaggcacagactcttgaacgggacggtggtggtatgactagtgcagagtgtttagagatcactcagtttttaaagactggcctttatcgtgtctcagtgcagccgaggcagagcctttgaaggatgcgatgttgtcattcttactaatctagtccagccgctgaggtgactttcaacggcagaccgtctcctgagcgccccagagtctccgggaccattatggcagtcaagtggacgggtgggcattcttctcctgtcctctgcctgaatgcaagtaaagaagggctgctggcttctggagcagagggcggagatctcacggcttggggtgaagatggaactccattaggacacacgcggttccaaggggctgatgatgttaccagtgtcttattttctccctcctgtcccaccaagctctatgcctcacatggagaaaccattagtgtactggatgtcaggtccctcaaagattccttggaccattttcatgtgaatgaagaagaaatcaattgtctttcattgaatcaaacggaaaacctgctggcttctgctgacgactctggggcaatcaaaatcctagacttggaaaacaagaaagttatcagatccttgaagagacattccaatatctgctcctcagtggcttttcggcctcagaggcctcagagcctggtgtca

SEQ ID NO: 8532 - DNA, 616 bp, Homo sapiens
cagtgccagcgccacagcccttcaatcattttggttgctatccagcttctccacatcaagtccaacttcagaaacccgaagcctgtagagaaaagttgacctgtgctgactctggtgatgagtctccgggaccattatggcagtcaagtggacgggtgggcattcttctcctgtcctctgcctgaatgcaagtaaagaagggctgctggcttctggagcagagggcggagatctcacggcttggggtgaagatggaactccattaggacacacgcggttccaaggggctgatgatgttaccagtgtcttattttctccctcctgtcccaccaagctctatgcctcacatggagaaaccattagtgtactggatgtcaggtccctcaaagattccttggaccattttcatgtgaatgaagaagaaatcaattgtctttcattgaatcaaacggaaaacctgctggcttctgctgacgactctggggcaatcaaaatcctagacttggaaaacaagaaagttatcagatccttgaagagacattccaatatctgctcctcagtggcttttcggcctcagaggcctcagagcctggtgtcatgtggactggatatgcag

SEQ ID NO: 8533 - DNA, 1147 bp, Homo sapiens
gtgcgtacgtgcgtcgtctctatggtggcggcggatttggagggaccctacgaaccaggagtcaggcgagccgatctggggctgcaggatgttccgctgggagcgctccattcccctgcgaggctcggccgccgccctgtgcaacaacctcagtgtgctgcagctgccggctcgcaacctcacgtattttggcgtggttcatggaccaagcgcccagcttctcagcgctgctcctgagggtgtgcccttggcccagcgccagctccacgctaaggagggtgctggagtgagtcccccacttatcactcaggtccactggtgtgtcctccccttccgagtgctgctggtactcacctcacatcgaggaatacagatgtacgagtccaatggctacaccatggtctactggcatgcactggactctggagatgcctccccagtacaggctgtgtttgcccggggaattgctgccagtggccacttcatctgtgtgggaacgtggtcaggccgggtgctggtgtttgacatcccagcaaagggtcccaacattgtactgagcgaggagctggctgggcaccagatgccaatcacagacattgccaccgagcctgcccagggacaggattgtgtggctgacatggtgacggcagatgactcaggcttgctgtgtgtctggcggtcagggccagaattcacattattgacccgcattccaggatttggagttccgtgcccctctgtgcagctgtggcaggggatcatagcagcaggctatgggaacggacaagtgcatctatatgaggccactacaggaaatctacatgtccagatcaatgcccatgcccgggccatctgcgccctggacctggcttctgaggtgggcaagctactctctgcaggtgaggacacctttgtgcatatctggaagctgagcagaaacccagagagtggctacattgaggtggaacactgtcatggtgagtgtgtcgccgacacccagctgtgtggtgctcgattttgtgattcctcaggcaactcctttgctgtgactggctatgaccttgcggagatccggagattcagcagtgtgtgagaagagcagccttcctttgtccctgtggtattcataaagtacccgctccaccca

SEQ ID NO: 8534 - DNA, 2925 bp, Homo sapiens
atggcggcgcgatggagcagcgaaaacgtggttgtagagttccgtgactcccaggcaactgcgatgtctgtggactgtcttgggcagcatgcagtgctttctggccgcagattcttatacatcgtcaatctagatgcccctttcgaaggtcaccgaaagatctctcgccagagcaaatgggacattggagctgtgcagtggaatcctcatgacagctttgcacactattttgcggcttcgagtaaccaacgagtagacctttacaagtggaaagacggcagtggggaagttggcacaaccttacaaggccacactcgtgtcatcagcgacttggactgggcggtgtttgagcctgacctcctggttaccagctctgtggacacctacatctacatttgggatatcaaagacacaaggaaacctactgttgcactgtctgctgttgcgggtgcctcccaggtcaaatggaataaaaaaaatgctaactgccttgccaccagccatgacggcgatgtgcggatatgggataagaggaaacccagtacagcagtggaatatctagccgcccacctctccaaaatccatggcctggactggcacccagacagcgagcacattcttgctacctccagtcaagacaattctgtgaagttctgggattaccgccagcctcggaaatacctcaatattcttccttgccaggtgcctgtctggaaggccagatacacacctttcagcaatggattggtgactgtgatggttccccagctgcggagggaaaacagccttctcctgtggaatgtctttgacttgaacaccccagtccacaccttcgtggggcatgatgatgtggtcctggagttccagtggaggaagcagaaggaagggtccaaggactatcaactggtgacgtggtcccgggatcagaccttgagaatgtggcgggtggattcccagatgcagaggctttgtgcaaatgacatattagatggtgttgatgagttcattgagagtatttcccttctgccggaacctgagaagaccctgcacactgaagatacagatcaccagcacactgcaagccatggggaggaagaagccctaaaagaagatccccctagaaatctcctggaagagaggaaatcagatcaactggggctgcctcagaccttgcagcaggaattctccctgatcaatgtgcaaatccggaatgtcaatgtggagatggatgcggcagacaggagctgcacagtgtctgtgcactgcagcaaccatcgtgtcaagatgctggtgaagttccctgcacagtacccaaacaacgccgccccttccttccagtttattaaccccacaaccatcacatccaccatgaaagctaagctgctgaagatcctgaaggacacagccctgcagaaagtgaagcgtggccagagctgcctggagccctgcctgcgccagctcgtctcctgccttgagtcctttgtgaaccaggaagacagcgcttccagcaacccgtttgcactccccaactctgtcactccccccttaccgacgtttgcgcgggtgaccacggcttacgggtcgtaccaggacgccaacattccctttcctaggacttctggggccaggttctgcggagcaggttacctggtatatttcacaaggcccatgacaatgcatcgggcggtgtctcccacagagcctactccgagatctctctcagccttgtctgcttatcacactggcttgatcgcgcccatgaagatccgcacagaggcccctgggaaccttcgtttatacagtgggagccccactcgcagcgagaaagagcaggtctccatcagctccttctactacaaggagcggaaatcaagacgatggaaaagtaagcgtgagggatcagactctggcaatcgacagatcaaggctgctgggaaagtcatcatccaggatattgcttgcctcctgcctgttcacaaatcgctgggagagctgtacatattgaatgtgaatgatattcaggaaacatgtcagaagaatgccgcctctgccttgctcgttggaagaaaggatcttgtccaggtttggtcgctggctacggtagctacagatctttgccttggtccgaaatctgacccagatttggaaacaccctgggctcgacatccatttgggcggcagctgctggagtccctgttggctcactattgccggctccgggatgttcagacactggcgatgctctgtagcgtgtttgaagcccagtctcggcctcaggggctaccaaacccctttgggccttttcctaaccgttcttctaatcttgtggtgtcccatagtcgatatcctagctttacctcttctggttcctgctccagtatgtcagacccagggctcaacactggcggctggaacatagcgggaagagaggcagagcacttgtcctccccttggggagaatcctcaccagaagagctccgctttgggagtctgacctacagtgatccccgtgagcgagaacgcgaccagcatgataaaaataaaaggctcctggaccccgccaatacccagcaatttgatgactttaagaaatgctatggggaaatcctctaccgttggggtctgagagagaagcgagctgaagtgttgaagtttgtctcctgtcctcctgaccctcacaaagggatcgagttcggcgtgtactgcagccactgccggagtgaggtccgtggcacgcagtgtgccatctgcaaaggcttcacgttccagtgtgccatctgtcacgtggctgtgcggggatcgtccaatttctgcctgacctgtgggcacggtggccacaccagccacatgatggagtggtttcggacccaggaggtgtgtcccaccgggtgtgggtgccactgcctgcttgaaagcactttctga

SEQ ID NO: 8535 - DNA, 1752 bp, Homo sapiens
ctcttaggccccgtcgggggagggaagacgaccatcgggggcaatcggggcgagcatggacggagtttcggggctccctacgcgggtaggggagtggggtccgccttgtgacactgaggcagagactgcgcatcgtgagtgctgaggggaggcttcccacaatcagggtacggagcgagggcgtgacggcttcccgaggccctagccgcgtgtggcgacttaaggcaactgcgatgtctgtggactgtcttgggcagcatgcagtgctttctggccgcagattcttatacatcgtcaatctagatgcccctttcgaaggtcaccgaaagatctctcgccagagcaaatgggacattggagctgtgcagtggaatcctcatgacagctttgcacactattttgcggcttcgagtaaccaacgagtagacctttacaagtggaaagacggcagtggggaagttggcacaaccttacaaggccacactcgtgtcatcagcgacttggactgggcggtgtttgagcctgacctcctggttaccagctctgtggacacctacatctacatttgggatatcaaagacacaaggaaacctactgttgcactgtctgctgttgcgggtgcctcccaggtcaaatggaataaaaaaaatgctaactgccttgccaccagccatgacggcgatgtgcggatatgggataagaggaaacccagtacagcagtggaatatctagccgcccacctctccaaaatccatggcctggactggcacccagacagcgagcacattcttgctacctccagtcaagacaattctgtgaagttctgggattaccgccagcctcggaaatacctcaatattcttccttgccaggtgcctgtctggaaggccagatacacacctttcagcaatggattggtgactgtgatggttccccagctgcggagggaaaacagccttctcctgtggaatgtctttgacttgaacaccccagtccacaccttcgtggggcatgatgatgtggtcctggagttccagtggaggaagcagaaggaagggtccaaggactatcaactggtgacgtggtcccgggatcagaccttgagaatgtggcgggtggattcccagatgcagaggctttgtgcaaatgacatattagatggtgttgatgagttcattgagagtatttcccttctgccggaacctgagaagaccctgcacactgaagatacagatcaccagcacactgcaagccatggggaggaagaagccctaaaagaagatccccctagaaatctcctggaagagaggaaatcagatcaactggggctgcctcagaccttgcagcaggaattctccctgatcaatgtgcaaatccggaatgtcaatgtggagatggatgcggcagacaggagctgcacagtgtctgtgcactgcagcaaccatcgtgtcaagatgctggtgaagttccctgcacagtacccaaacaacgccgccccttccttccagtttattaaccccacaaccatcacatccaccatgaaagctaagctgctgaaggtgggggtctgggttcccaaattctccttgctgttctgcatcattgtctagatggattagtaaagaagaatgaaaactccagtagatgagattcggaagtcatctgtttcgtacacacactagtattagcaacgtaacctctgaacttgccatttactttgtgcagaaaacatcagagcagtggttcttaacc

SEQ ID NO: 8536 - DNA, 4168 bp, Homo sapiens
gtagccgacaggccagagtttccagtttcggtggcttcgtaggcttttagcttctgaaatccgctaaaagcggcggttcattcatcttcaagtacctagcctgactggtagggctgctcagcattccgaaacatttcgacctggggaggggggcggcggtgaaagaatactttctgtagagagtgcccctcgcgtcgcccctgctttgaaggctttatgtattaacggaatgccgaacatttgtgtcctacttgctgacagcgcacaggatccttctaacagtatttctcaagtacttaacaaaaagatgaaaacttgaagtccaagccgtgctgctgattccgtctcacagtttaaagactgtccagaaactttaagctttcaaaactgtacattttaaaatcctgtgcgtttatcttcattttgctgggcagaaagccaaagtactggactgcctggttcagggctgaacgcctagtacacctgctaacttggagcttcagagccatggcaaccaaggagtcaagagacgccaaagcacagttggccctctcctcatcggccaatcagagcaaggaagtgcctgaaaacccaaactatgctctcaaatgtactcttgtgggacacacggaagcagtgtcatcagttaagtttagtcctaatggagaatggctagcaagttcttctgctgataggctaatcataatttggggagcatatgatggaaaatatgagaaaacactctatggtcataatttggaaatatcggatgttgcctggtcatcagattccagtcgtcttgtttctgcctcagatgataaaactctaaaattatgggatgtgagatctggaaaatgtttgaaaacactgaaggggcacagtaattatgtcttttgttgtaacttcaatccgccatccaaccttataatctcgggatcttttgatgagactgtaaaaatatgggaggtgaaaacaggaaagtgtctcaagactttgtctgctcattctgacccagtttctgctgttcattttaattgtagtgggtccttgatagtgtcaggtagctatgatggcctctgtagaatctgggatgctgcatcaggtcagtgtttaaaaacgctcgttgatgacgataaccctcctgtctcttttgtaaaattttctccaaatggtaaatacattctcactgcaactttggacaacactcttaaactatgggattatagcagaggcaggtgcctgaaaacatacactggtcataagaatgagaaatattgcatatttgccaatttttcagttactggtggaaagtggattgtgtctggttccgaggataacctggtttacatttggaaccttcagactaaagagattgtgcagaaattacaaggccatacagatgttgtgatctcagcagcttgtcatcctacagaaaacctcatcgcatcagcagcattagaaaatgacaaaacaattaaactgtggatgagtaaccactaatccctttgaaaatcaagtagtagagccaagttggccaaaaaacttggatatttaaaaagacggtttcttttaattttggcagtttggtattttaaaaattgtctattgttaaattttgagattcatacactacatttacaaaatgagatagttgaaaaagcacatctagaattcagcttctgactaccaatcttttttgagcaactttttgtaatttttatggatttatgtcacttttattacagggatatattgcatagtggtgaaatctgggcttagtataccctcacccaaatagtatacattgtacctagtaaatactttcccatctctcaccccactcccacctttgaaggctctagtgtctatgattctgctctccacgtccaggtgtacacattgtttatctcccacttacgagaacatgtggtttttgactttctgtatcattacttcacttaatggcctccaggtccatccatgttgttgcaaaagataagatttcattatttttttttggctgagtagtattctgtggtgtgtatgtgtgtgtgtgtatgcatatatgtgtatgtgtatgtatataagtatatacaccacattatccagtcatctggatatgtatataagtatatacaccacattttctttatccagtcatctcttgatggacccttaggttggttccataactttgctattacgaatagtgctgcgataaacagcactattatgaatagtgctgcgataaacagtgcaggtgattttaaaatataatttcctttgggtagatacctactagtgggattgctggatcgaatggtagtttttagttggaaaatctccatactgttttccagaggttgtaaaatgtacattcctccccacagtgtataagctgtgcctttactctgcatctttgccatgattctttttgagacagagtctctggtgcccaggctggagtgcagtggcacaatcttggctcactgcaacctctgcctcccgggttcaagcagttctcatgtctcaacatcccaggtagctaggattacaggcgtgccaccatgcctggctaatgtttctatttttagtagagacagggtttcaccatgttcgaggctggtcttgaactcctggcctcaagtgatccacctgcctcggcctcccaaagtgctgggattacaggcatgagccactgtacccagccattttttgactttttaataatagccattctaactggtttaagagagtatctcattgtggttatattttgtattcctctgatgattagtgatgttgagcatttttttgtgtgtgtttgttggccacttgtatgtcttctttgaaaactgacttctaatcttgaggcctattaataatttcatttgtctgtcactggacaatttctcattcctctcagtgactatcctagaggatcagtgtatttgagaaatatttagaagtaaagttgacaggacaggatgattgattaaaagaggggagcaagggaatttgaaataattccagggtttctggtttgggagatcagatgaacaagtgcataagcctgggatgctggtggaggactggagagacatggcagatgctacctgcacacttttggtaatattctgtgtgatgggatatgaaatggtccatagaaaaaaaccggaaaaatacgccaaggttaggttcattctaagagtctaaaaatttcaaaaaccaaaacaacattataaatggtgtttctcaaggacctttcactacctttttagattgtgcttgtgattttcaggcaagctaaatgtctgatgaagactgctcttcttttgttctgtgtctgacctactaattcctgcccatgcttcaaactcagttcagaaatcactgaaggaaccatccactgccggcctgcctgcaaccacagctgacagctgagttagttaggttttcctgtccctattatttaccagtttgtactgaaatgctttcatgggctgtgcttccagattatgagttctgtggaatcaggaagtatgtctctgtattcttgtattctttggcttttttgtgtagtaaagggactcaagtaatgtttgacagtgaaggatacaacttcattccttgcctgctttgataaattttagtaataaattcccaaaactatcatgttgattaaaaataaaaagtaaccgtaacctcacacattaactttattcaaacaaacagcacttacaggaaatgtaaagtagaaaaagatttctgcccactttacctacggagacatgataaacacgcaaaaaaaacctagaaattaagcaaaaaatagcacaataatttaactgaaagcaacaagggcaaaactgtctccttttgtagtttgtggtaccttatagtagtgctcattcagtttcgtttgcttgataaatctgaggactatgagatatcagagttactagtagggtaggagtgctgtaagggtactgggagaagtaggattagttaggggcagatcttgaattctggccaagaaactgatatttaacccataaagagatagtcactatatgttatcaaataggagaataacacaaatgagaaatgactgttaattcctgatgcataataacagttgtgagctttagtttaatgtaatatttgt

SEQ ID NO: 8537 - DNA, 3769 bp, Homo sapiens
ctgggcagtgcttctgggccctctgctgctcctgcttgtcggttgctaggcgctgggacgcgcctcccgaagggtgcggggcacaggtggcctcttcggggtggaccgcgcctggccggggccgaggacaccgcggccgcccgggcctgcgggaagcgatggagcccgggaagagaagaaccaaagatgatacctggaaagcagatgacctcagaaaacatctctgggccatacagtcaggtggttccaaggaagaaagaaagcacagagagaagaagctgcgtaaggagtctgagatggaccttcctgaacataaggagccgaggtgcagggatcccgaccaggatgccaggagcagagacagggtggccgaagtccacaccgctaaggagagtcctcgtggggagagggacagagacagacagagggagaggagaagagacgcaaaagaccgggagaaagaaaagctgaaggagaaacatcgagaggcagaaaagtctcacagcagaggaaaggacagggaaaaagaaaaagacagaagggcccggaaggaagagctccggcagaccgtggcccaccacaacctgctgggccaggagacacgcgaccggcagctcctggagcgggcggagaggaaaggccgctcagtaagtaaagtaagaagtgaagagaaagatgaagactctgaaagaggagatgaagatagagaaagaagataccgagaaagaaagctgcagtacggagacagcaaggacaaccctctcaagtactggctttataaagaagaaggcgagaggagacacaggaagcccagagagccagatcgagacaacaaacaccgagaaaaaagcagcacaagggaaaaaagagagaaatattccaaagagaaaagtaattcattctctgacaaaggggaagaaagacataaagaaaagcgacacaaagaaggttttcattttgatgatgagaggcaccaaagcaacgtggatagaaaagagaaatcggcaaaagatgagcccaggaaaagggaatcccagaatggtgaacacagaaatcgaggtgcaagctcaaaaagagatgggaccagcagccagcatgctgagaatttagtaaggaatcatggaaaagataaagattcaagacggaagcatggccacgaggaaggctcttctgtgtggtggaagctggaccagaggccgggaggcgaggaaaccgtggaaattgaaaaggaagaaactgatttagaaaatgctagagctgatgcatatacagccagttgtgaagatgattttgaagactatgaagatgactttgaggtttgtgatggtgatgatgatgaaagcagtaatgaacctgagtcaagagaaaaactggaagaacttcctctagctcaaaaaaaggaaatacaagaaattcaaagagctattaatgcagaaaatgaaaggattggcgagttatctttgaaactgtttcagaagcgaggtagaacagaatttgaaaaggagcccaggacagatacaaacagttccccttccagagcctctgtttgtggaatttttgtggattttgcctcagcttcacaccgtcaaaagagtcggactcaggcccttaagcaaaagatgcgaagtacaaaactgcttcggctcattgacttagatttttcatttactttctctctcttggatctaccaccagtaaatgaatatgacatgtatatcagaaactttgggaaaaaaaataccaagcaggcatatgttcagtgtaacgaagataatgttgaaagagacattcaaacggaggaaatagagaccagggaagtgtggacccagcacccgggagaaagtactgttgtatctggaggcagtgaacaaagagatacctctgatgctgtagttatgccaaagattgatactccaaggttatgtagctttctgcgggctgcttgtcaggtgatggccgttttgctggaagaggatcgcttggcagctgaacccagctggaatcttagggctcaagacagggccctgtattttagtgacagctcatctcagctgaacaccagtctaccattccttcaaaatcgaaaagtatcctccttgcacacctcccgagttcagaggcagatggtggtctccgttcacgacttacccgagaagagctttgtgcccctgctggacagcaaatacgtcctctgtgtgtgggatatttggcagccttcagggccacagaaagttctgatatgtgagtcccaggtcacgtgttgctgcttgagccctttgaaagcatttttactgtttgccggaacagcgcacggctcagttgtcgtctgggatttgagagaagactcaaggctgcattactctgtgacgctgagcgatggcttctggacgttccggaccgccacgttttccaccgatggaatccttacctcagtaaaccaccgaagccctcttcaagcagtagaacctatctcaacgtccgtccacaaaaagcagagctttgtgctttcacccttttctactcaagaagaaatgtcaggtttgtccttccacatcgcttccttggatgagagtggggttctcaatgtatgggtggttgttgaattaccaaaggcagacatcgcaggttcaataagtgatttaggtctgatgcctggagggagggtcaagctggtacatagtgctctgatccagttgggtgacagtctttcccataaaggtaatgaattttggggcactacacaaacactgaatgttaaatttctgccttcagatcctaatcactttattattggcacagacatgggtctcataagccatggcacaagacaagatttgagagtggctcccaaactattcaaacctcagcaacatggtataagaccagtgaaagttaatgtcattgatttttcaccatttggagaaccaatatttttggccggctgttcggacggaagcatcaggctgcaccagctgagctccgcgtttccgctcctgcagtgggacagcagcacggacagccatgcggtcaccggcctgcagtggtccccaaccaggcctgccgtgttcctggtgcaggacgacacatccaacatctacatctgggacctcctccagagcgatctgggtcctgtcgccaaacagcaggtctcccccaacaggctggtggccatggctgcggtgggtgagcctgagaaggctggtggcagcttcctggccctggtgctggccagggcgtctggctccatcgacatccagcacctgaagaggcggtgggcggccccggaggtggacgagtgcaacaggctgcgtctgcttttgcaggaagccctgtggccagagggaaaactgcacaagtagcgggtgtggctgagaggaccgcgtttctgtaatgacccagatttaaaagacataaggtggataattctacatttgtgtgcaagtatatttatgtatatagactatgtatattctgtatataatttattttacatgaatatgtctttggtattcccagtaaatagatgactacttttgagtggaaacaaagaacattctagcatttacaaaacttccaggggaatgtagagccacgtccagggtgctcttttctgagagtatttcgagttatttttagaacagtttaaatattgtcacattactgctagattttaaacagcctaccatgaaaatgtatcttaatgaactattttcttatgcataaagtatgtgaacacatgtctaaattaaaaggaattactccaccgaaa

SEQ ID NO: 8538 - DNA, 1387 bp, Homo sapiens
aaatttccaactaccactcctctggaagcaggacctggcttcctccctcctctctccgcccaccctcgtcggcgtctgccccgcgcccgccatagcgacggcaacgggcgctgcggagtgctccgagccgtgagggcggggccggcgcgatgccccgccccttcgatagctcatctttgcgcgtcgcagtcgcgcggagcccggcttccgacgtgcagcctggcagtgcagtgagctgtctggccttttgtccttgatccttggttaaggaaatgaccaaccagtacggtattctcttcaaacaagagcaagcccatgatgatgccatttggtcagttgcttgggggacaaacaagaaggaaaactctgagacagtggtcacaggctccctagatgacctggtgaaggtctggaaatggcgtgatgagaggctggacctacagtggagtctggagggacatcagctgggagtggtgtctgtggacatcagccacaccctgcccattgctgcatccagctctcttgatgctcatattcgtctttgggacttggaaaatggcaaacagataaagtccatagatgcaggacctgtggatgcctggactttggccttttctcctgattcccagtatctggccacaggaactcatgtcgggaaagtgaacatttttggtgtggaaagtgggaaaaaggaatattctttggacacgagaggaaaattcattcttagtattgcatatagtcctgatgggaaatacctagccagtggagccatagatggaatcatcaatatttttgatattgcaactggaaaacttctgcataccctggaaggccatgccatgcccattcgctccttgaccttttccccggactcccagctccttgtcactgcttcagatgatggctacatcaagatctatgatgtacaacatgccaatttggctggcacgctgagcggccatgcctcctgggtgctgaacgttgcattctgtcctgatgacactcactttgtttccagttcgtctgacaaaagtgtaaaagtttgggatgttggaacgaggacttgtgttcacaccttctttgatcaccaggatcaggtctggggagtaaaatacaatggaaatggttcaaaaattgtgtctgttggagatgaccaggaaattcacatctatgattgtccaatttaaacatcaaagtctccaggcttatgctgcaaagagaatgtacggattgatcatgacattccttaccttcttaggcttgtttaaaagaaatatagcatttattgtagcaaagacttaaattttgtagatacaatatgaatcttttcatgttttattggaaatgctgttcatactttaacataaagctttcttaatgcaaa

SEQ ID NO: 8539 - DNA, 1266 bp, Homo sapiens
tcgcgcggagcccggcttccgacgtgcagcctggcagtgcagtggggaacttcctgtgtgccttctatcctgatgacaccccctcactgaaatcctggtgttgtttccacagagctgtctggccttttgtccttgatccttggttaaggaaatgaccaaccagtacggtattctcttcaaacaagagcaagcccatgatgatgccatttggtcagttgcttgggggacaaacaagaaggaaaactctgagacagtggtcacaggctccctagatgacctggtgaaggtctggaaatggcgtgatgagaggctggacctacagtggagtctggagggacatcagctgggagtggtgtctgtggacatcagccacaccctgcccattgctgcatccagctctcttgatgctcatattcgtctttgggacttggaaaatggcaaacagataaagtccatagatgcaggacctgtggatgcctggactttggccttttctcctgattcccagtatctggccacaggaactcatgtcgggaaagtgaacatttttggtgtggaaagtgggaaaaaggaatattctttggacacgagaggaaaattcattcttagtattgcatatagtcctgatgggaaatacctagccagtggagccatagatggaatcatcaatatttttgatattgcaactggaaaacttctgcataccctggaaggccatgccatgcccattcgctccttgaccttttccccggactcccagctccttgtcactgcttcagatgatggctacatcaagatctatgatgtacaacatgccaatttggctggcacgctgagcggccatgcctcctgggtgctgaacgttgcattctgtcctgatgacactcactttgtttccagttcgtctgacaaaagtgtaaaagtttgggatgttggaacgaggacttgtgttcacaccttctttgatcaccaggatcaggtctggggagtaaaatacaatggaaatggttcaaaaattgtgtctgttggagatgaccaggaaattcacatctatgattgtccaatttaaacatcaaagtctccaggcttatgctgcaaagagaatgtacggattgatcatgacattccttaccttcttaggcttgtttaaaagaaatatagcatttattgtagcaaagacttaaattttgtagatacaatatgaatcttttcatgttttattggaaatgctgttcatactttaacataaagctttcttaatgcaaa

SEQ ID NO: 8540 - DNA, 1036 bp, Homo sapiens
agtgcagtggtgagttggagcgcagggccgttggggattggggtcattagggccgttgacagtccaggccagagggcgagtgagcgaggttgggcccgaggctgcctgtaagcagagctgtctggccttttgtccttgatccttggttaaggaaatgaccaaccagtacggtattctcttcaaacaagagcaagcccatgatgatgccatttggtcagttgcttgggggacaaacaagaaggaaaactctgagacagtggtcacaggctccctagatgacctggtgaaggtctggaaatggcgtgatgagaggctggacctacagtggagtctggagggacatcagctgggagtggtgtctgtggacatcagccacaccctgcccattgctgcatccagctctcttgatgctcatattcgtctttgggacttggaaaatggcaaacagataaagtccatagatgcaggacctgtggatgcctggactttggccttttctcctgattcccagtatctggccacaggaactcatgtcgggaaagtgaacatttttggtgtggaaagtgggaaaaaggaatattctttggacacgagaggaaaattcattcttagtattgcatatagtcctgatgggaaatacctagccagtggagccatagatggaatcatcaatatttttgatattgcaactggaaaacttctgcataccctggaaggccatgccatgcccattcgctccttgaccttttccccggactcccagctccttgtcactgcttcagatgatggctacatcaagatctatgatgtacaacatgccaatttggctggcacgctgagcggccatgcctcctgggtgctgaacgttgcattctgtcctgatgacactcactttgtttccagttcgtctgacaaaagtgtaaaagtttgggatgttggaacgaggacttgtgttcacaccttctttgatcaccaggatcaggtctggggagtaaaatacaatggaaatggttcaaaaattgtgtctgttggagat

SEQ ID NO: 8541 - DNA, 2995 bp, Homo sapiens
agcgacagatgcgtcctggcaacagtcggcagagttgctgcggtttgtgcccttgcgatttctttttctgagagaggagagtcaaactcccacctccagctctcgaaggagcttttcctgagggcactgcaaagaggctccttttctttcagatcagcagtatcagcccaagtcagaaccatggctccaaaacaaaagaaaaagacatcacgtggcaaaaaaagactaaaaccagtattagctgctagtgaagacatggaaccagtaaatatggagagcatgggtcatccagaaatttatcctttagtattaaccaccaagacccaagaaatatttaactgccgaatagatgaagatgtcacagatgaacaaccttataagcttatcaataaagaagacatttttgaggacctgcgcaacagagctgcagtatctgatttccacccagtcaaaaaaattgtccaggaatatcctggaaatgagcttctgcttgtttatgacaaagacttcaaatatggacttaacttttatcttattgcaactgaagagggcaaagaaaactatttaaatcccccagaagtaccagaagaacaagaagaatataaagaacatattcctgaagatgtgtatatttataaaccacctgtctctaaaccatgggtttctttgggcagtgaaaaagaaattgaggaagaatcagttacggaatctacaaagcagattacatatatgatttctcgaaaacgaagtgaatttggtgcaccaattaagttcagtgaccagaatgcttccagtgtaaaagatgcctatattgaatgtacagcctacccagataaaaattttacccttaaacaacttgaaaaagatgttggcatgcaagtaatcccccaaataaaggacataagcactcagacaaaatggacatatcctaaaaatgctactacgcaatattatccaagagaattctcagaagaggaaaaagagacactcaaacaatcaaagcctttggttgattttcttaacaatgcatccataagtgttgaaatagccctgcagcaaaatgaaatcatgaacacatttattgatgactggaaatacctcgcagaagaagaaggcacctttggggacaagaccgatacccacctgaaagagtaccagtcctttaccgaccttcatagcccaacggagaaaatgattacctgtgtctcatggcatccaactatctatgggctaatagctgtgtcggtagccgtgcgactttcttttgaagacagagttcacttttctggtaaattattgctgcagccatcactgattcttttctggagcttctctgatcctatacatcctcagttaatgctggagagcccagatgacatcttctgcttcaagttctgtccgagtgatcctaatatcattgctggaggctgtatcaatgggcagattgtcatgtgggatatcaccgcacatgcagatcgcatagaaaacattaaggcaggtggtagtagaagtaaaagagccacactgaagcctatgtttctccttgaaccggagagtaataaagaagcaatgtatatcagacactgtgcagtctcttcaatagaaaatggacataagaaagtaattacagatatacactggttgtctgacacatttgagattaacagaatgggctccgtctttgagaatcgaagtggaatatgctgtcaacttgtcacatgttcagcagattgcacaatatgtttttgggatattagaccacagaaacctttaaccccccaaacaacagagaaaaagaaggaggaaagtattgaaattccttttgatgtaccatctacttttttgcatctggatctctcctggaaacctctcactaaggtaaggctgtccaagggtgaaacaagtttagaccactgtccaaccaagataagcctgaatgaagaccatcttctttgcaaaacacaagacaaaatgttagcacagagcaaaacagagaaggcagaagaaatgaacccgtatcataatctggaaagtgggatggccaatcttctcaagccaatagatgacttctgcacaaagttctttgtgggaacagaggaaggcgaagtgatatacacagattggaaaatggaaaaagaccctgaaactggccgacttatgtcaaagaagccagtgagccaccacaccattcacgacggaactgtccacactattcagagatcacctttctacaacgacattattctcacggttggaggttggaacgtggccatatggaaagaaggtgttatgactggaccgctccttcagtcatgctgtgcaccaaaaaggtacacctcaggccactggtccctgactcggcccggagttttctacatcggccgagaagatggatacattgatatctgggaccttctggagaaaacccatgaaccagcccagtctcaaaacatttgcataactatgatcacctacatcaaaccctggatcttttcttctaaacagcaatttatagccacagctgattattatggaacactgcatatattagaaattccttggacattaagtcgcccttccaccaatgagatggcaagtgtcaaccactattttgaaagagaagtcaagcatctggaatacgtagaacagcgcaaaaaaattcgtgagcaagaaaagaaagaaatggaactagaaatggcaaagaaaaaagttaaaacatatcagaagtcaaaagaacaaatgcaggctgaattaaaaatggactatgagagttatctggaactggaaaagactgttcttatcaaccttggcctaatcaaagtcacagagaaggggtcatacatggaggtgatgtaaaaaagcttcctgaaggggtgttttggggacttcttccctctatttatttttatgtcaggtgaactggcatgctgaacatatatatatataggctcatttatagacttttatttccctgctattaaaacttttgaatttt

SEQ ID NO: 8542 - DNA, 2888 bp, Homo sapiens
ttttctcttagcgacagatgcgtcctggcaacagtcggcagagttgctgcggtttgtgcccttgcgatttctttttctgagagaggagagtcaaactcccacctccagctctcgaaggagcttttcctgagggcactgcaaagaggctccttttctttcagatcagcagtatcagcccaagtcagaaccatggctccaaaacaaaagaaaaagacatcacgtggcaaaaaaagactaaaaccagtattagctgctagtgaagacatggaaccagtaaatatggagagcatgggtcatccagaaatttatcctttagtattaaccaccaagacccaagaaatatttaactgccgaatagatgaagatgtcacagatgaacaaccttataagcttatcaataaagaagacatttttgaggacctgcgcaacagagctgcagtatctgatttccacccagtcaaaaaaattgtccaggaatatcctggaaatgagcttctgcttgtttatgacaaagacttcaaatatggacttaacttttatcttattgcaactgaagagggcaaagaaaactatttaaatcccccagaagtaccagaagaacaagaagaatataaagaacatattcctgaagatgtgtatatttataaaccacctgtctctaaaccatgggtttctttgggcagtgaaaaagaaattgaggaagaatcagttacggaatctacaaagcagattacatatatgatttctcgaaaacgaagtgaatttggtgcaccaattaagttcagtgaccagaatgcttccagtgtaaaagatgcctatattgaatgtacagcctacccagataaaaattttacccttaaacaacttgaaaaagatgttggcatgcaagtaatcccccaaataaaggacataagcactcagacaaaatgtgttgaaatagccctgcagcaaaatgaaatcatgaacacatttattgatgactggaaatacctcgcagaagaagaaggcacctttggggacaagaccgatacccacctgaaagagtaccagtcctttaccgaccttcatagcccaacggagaaaatgattacctgtgtctcatggcatccaactatctatgggctaatagctgtgtcggtagccgtgcgactttcttttgaagacagagttcacttttctggtaaattattgctgcagccatcactgattcttttctggagcttctctgatcctatacatcctcagttaatgctggagagcccagatgacatcttctgcttcaagttctgtccgagtgatcctaatatcattgctggaggctgtatcaatgggcagattgtcatgtgggatatcaccgcacatgcagatcgcatagaaaacattaaggcaggtggtagtagaagtaaaagagccacactgaagcctatgtttctccttgaaccggagagtaataaagaagcaatgtatatcagacactgtgcagtctcttcaatagaaaatggacataagaaagtaattacagatatacactggttgtctgacacatttgagattaacagaatgggctccgtctttgagaatcgaagtggaatatgctgtcaacttgtcacatgttcagcagattgcacaatatgtttttgggatattagaccacagaaacctttaaccccccaaacaacagagaaaaagaaggaggaaagtattgaaattccttttgatgtaccatctacttttttgcatctggatctctcctggaaacctctcactaaggtaaggctgtccaagggtgaaacaagtttagaccactgtccaaccaagataagcctgaatgaagaccatcttctttgcaaaacacaagacaaaatgttagcacagagcaaaacagagaaggcagaagaaatgaacccgtatcataatctggaaagtgggatggccaatcttctcaagccaatagatgacttctgcacaaagttctttgtgggaacagaggaaggcgaagtgatatacacagattggaaaatggaaaaagaccctgaaactggccgacttatgtcaaagaagccagtgagccaccacaccattcacgacggaactgtccacactattcagagatcacctttctacaacgacattattctcacggttggaggttggaacgtggccatatggaaagaaggtgttatgactggaccgctccttcagtcatgctgtgcaccaaaaaggtacacctcaggccactggtccctgactcggcccggagttttctacatcggccgagaagatggatacattgatatctgggaccttctggagaaaacccatgaaccagcccagtctcaaaacatttgcataactatgatcacctacatcaaaccctggatcttttcttctaaacagcaatttatagccacagctgattattatggaacactgcatatattagaaattccttggacattaagtcgcccttccaccaatgagatggcaagtgtcaaccactattttgaaagagaagtcaagcatctggaatacgtagaacagcgcaaaaaaattcgtgagcaagaaaagaaagaaatggaactagaaatggcaaagaaaaaagttaaaacatatcagaagtcaaaagaacaaatgcaggctgaattaaaaatggactatgagagttatctggaactggaaaagactgttcttatcaaccttggcctaatcaaagtcacagagaaggggtcatacatggaggtgatgtaaaaaagcttcctgaaggggtgttttggggacttcttccctctatttatttttatgtcaggtgaactggcatgctgaacatatatatatataggctcatttatagacttttatttccctgctattaaaacttttgaatttta

SEQ ID NO: 8543 - DNA, 2905 bp, Homo sapiens
tggagcccggggtttggggacccctgcagacggagaaatagtttcaaaagggagatctgaggatctcaaacattaatgtgcatatgagtcaccagagtttttattgaagcagactgattcagtaggacctgaggttttgcatttctagcaagaagatgctcctgctgctgctgctgctgctggtcccactctcccaagtcagaaccatggctccaaaacaaaagaaaaagacatcacgtggcaaaaaaagactaaaaccagtattagctgctagtgaagacatggaaccagtaaatatggagagcatgggtcatccagaaatttatcctttagtattaaccaccaagacccaagaaatatttaactgccgaatagatgaagatgtcacagatgaacaaccttataagcttatcaataaagaagacatttttgaggacctgcgcaacagagctgcagtatctgatttccacccagtcaaaaaaattgtccaggaatatcctggaaatgagcttctgcttgtttatgacaaagacttcaaatatggacttaacttttatcttattgcaactgaagagggcaaagaaaactatttaaatcccccagaagtaccagaagaacaagaagaatataaagaacatattcctgaagatgtgtatatttataaaccacctgtctctaaaccatgggtttctttgggcagtgaaaaagaaattgaggaagaatcagttacggaatctacaaagcagattacatatatgatttctcgaaaacgaagtgaatttggtgcaccaattaagttcagtgaccagaatgcttccagtgtaaaagatgcctatattgaatgtacagcctacccagataaaaattttacccttaaacaacttgaaaaagatgttggcatgcaagtaatcccccaaataaaggacataagcactcagacaaaatgtgttgaaatagccctgcagcaaaatgaaatcatgaacacatttattgatgactggaaatacctcgcagaagaagaaggcacctttggggacaagaccgatacccacctgaaagagtaccagtcctttaccgaccttcatagcccaacggagaaaatgattacctgtgtctcatggcatccaactatctatgggctaatagctgtgtcggtagccgtgcgactttcttttgaagacagagttcacttttctggtaaattattgctgcagccatcactgattcttttctggagcttctctgatcctatacatcctcagttaatgctggagagcccagatgacatcttctgcttcaagttctgtccgagtgatcctaatatcattgctggaggctgtatcaatgggcagattgtcatgtgggatatcaccgcacatgcagatcgcatagaaaacattaaggcaggtggtagtagaagtaaaagagccacactgaagcctatgtttctccttgaaccggagagtaataaagaagcaatgtatatcagacactgtgcagtctcttcaatagaaaatggacataagaaagtaattacagatatacactggttgtctgacacatttgagattaacagaatgggctccgtctttgagaatcgaagtggaatatgctgtcaacttgtcacatgttcagcagattgcacaatatgtttttgggatattagaccacagaaacctttaaccccccaaacaacagagaaaaagaaggaggaaagtattgaaattccttttgatgtaccatctacttttttgcatctggatctctcctggaaacctctcactaaggtaaggctgtccaagggtgaaacaagtttagaccactgtccaaccaagataagcctgaatgaagaccatcttctttgcaaaacacaagacaaaatgttagcacagagcaaaacagagaaggcagaagaaatgaacccgtatcataatctggaaagtgggatggccaatcttctcaagccaatagatgacttctgcacaaagttctttgtgggaacagaggaaggcgaagtgatatacacagattggaaaatggaaaaagaccctgaaactggccgacttatgtcaaagaagccagtgagccaccacaccattcacgacggaactgtccacactattcagagatcacctttctacaacgacattattctcacggttggaggttggaacgtggccatatggaaagaaggtgttatgactggaccgctccttcagtcatgctgtgcaccaaaaaggtacacctcaggccactggtccctgactcggcccggagttttctacatcggccgagaagatggatacattgatatctgggaccttctggagaaaacccatgaaccagcccagtctcaaaacatttgcataactatgatcacctacatcaaaccctggatcttttcttctaaacagcaatttatagccacagctgattattatggaacactgcatatattagaaattccttggacattaagtcgcccttccaccaatgagatggcaagtgtcaaccactattttgaaagagaagtcaagcatctggaatacgtagaacagcgcaaaaaaattcgtgagcaagaaaagaaagaaatggaactagaaatggcaaagaaaaaagttaaaacatatcagaagtcaaaagaacaaatgcaggctgaattaaaaatggactatgagagttatctggaactggaaaagactgttcttatcaaccttggcctaatcaaagtcacagagaaggggtcatacatggaggtgatgtaaaaaagcttcctgaaggggtgttttggggacttcttccctctatttatttttatgtcaggtgaactggcatgctgaacatatatatatataggctcatttatagacttttatttccctgctattaaaacttttgaatttta

SEQ ID NO: 8544 - DNA, 4371 bp, Homo sapiens
atcagacctaaatcagctttcctccctgctaacatcctagtggcaactcttactcctacccgcactatgggattttaagatcaaaggaattagacctagggcaaaaactgagacagcagggaggcactgtaacaactggaaagttttccaaattggtaaacttgcagtattctttctgtacagaagtaaaagatcccctatgtccctatggatatcaggaaggaaaagcgtctcaacatggcacttcagatgagcaatttcaaaaaggctttgaacaggtttgaaaaattggttgaacaaacagcagcccagaaaagagatgaaagagcaggcttatttatccataaagaagatgcaattggttatgacaagttttatgcatcggtacagaagctctttggtccagatgtgaagaatcaagatgtgaaacgcttttacaggaaactgtgcaacaacacggatgcatctgcagactggtgtgagatctttggatacttctcctctgaagaagatcctattgcttcccagttggatgaagaaaatttggttttctttgtgtctagaaaaaggcgaattttaatttcaggtagtagaagacgagatgtgattaagagcattgtcaagatacctcacctggatttactaataacagctactcagaaaggattaataacagtttttaataaccaggacacctcctggattacagggtgtgattacctcttgcagctgaaacgaatcgtagccacaaccgaaaggaccattattgtctgggattataaagctcaagggagcagccaggaaaattattttgtcataaaaccaatggatcactgcctcctgtgtgtgtgtgtggtgcctttgcctgaccatctctgccgagatgacatcctcttgggggatgatgggggttttgtgaacagattcacagtcaacagtgatgactttggaataaagcaggcaaaatccaaaagaaaattacaaaatcaggtcttagactcaaagaactttaaaagtgttaaaaggaagctacataatgactgggttatgaaaattagatatatttcagccctaaattgttttggatcctgctccttagacagtaatcattcattagttttggaatccttgaagagactcgaggataatttgcctgtcagagagttttccatgccaagaggagccaacactttttgctactgtgttaaggcaaatgtgattgtcactggaggagatgataaggtcatccggttgtggcaccccaatatcagcaccaagccagtagggaaacttgtaggacacatgttcagtatcgccgagatcgtaaccaatgaaaaagatcaacatgtcgtcagcctttcctctgcaaaggttttccgggtgtgggatatacaaactctttcactattacaagtcttccatgacagccagggaggaccaggagacatgcagatttactctatgatatatgatgccaatcatggcatgcttattacgggatctagtgttatggacatgtatcctttgactaggatgatacaagatacaaaacaggttcctcacactcatgaacgagaaatcaatgtcatgctttacaacaaatattttcatcaagtactcactatctgctctgaatccataattagggtatgggaactcgagactgggctccaagtataccagattttagaacctcatggtttcaatactgaagtgacttctgcagctgtcgatgaaagtggatttctttttgccacaggagcgtataatggaacagtcagaatctgggactttggcagtgggcaggagatgaaggtgttgccggaggggaaagactggaaggaggacgagcactgcctacgacgcctcattttcctcaaagcccaagaaaaacaccagcagctggtcctggccttggagcgcaacgggactatcaaaatgatccagggtaaggaagatgatatctacctcatggtgatctgggagctgcctgatgttgtgcctttcctacaagatgggaaacatgctgtgcatctgagaatgtctactagagacaggaacatggctattcctttcccagatgtcgagttgatagttgagaggaacttttctcaacctactgataatcccaccatggatttattacgagtgaactgcattgatttactacaagtagaaggatataatttgatagcagctggaaccttaaatggtgtgatcatcttatggaattttgtgacgtctactgtcaaaaaagtgtaccgacctgaagattgcttcactgtaaaccctgacttgcatcccaagcactttaaaattaatgacatactgttcctctttcgtacccctgaatgtgcaaggagatcaagtcaggattccatatgttcttcatcccagtgtgaatccagcaaaggtccacagagcagtaagggaagcaagcaaagcatacatgacagtgaggttaaaggtgaacaaacagatgtaatggtgggaaagcaacagccaatggacaaaaaacaccctggaattgccaatttaccagaagcccagccacctatccttgtcactgctcatgaggatggacacctccgcttgtggactctggagggaagactactgaaagatatgctacctttcacaaaacattctgccatttctctgacatcgctgtatactgattcatgtacgaggatactactggctggaaatgtggaaggacatgttatcctttgcaatattagctctttcctggatccacctcatgatgaaaagaaattcaagcagctgctttcctggcgtgctcattctttggaaattattcaagtaatctatgtagaagaaaaacaagtggtacttactgcctccatcgatggctcagtaaggctctggcatgccctcaatggacattattgtggatattttggacagcgaaggctctttgaattatcacagacaagagatttcattttgccttgtgatgttactgaatatcccatagaaataaaagaagaaagcaagttcacagagaagcaaaaatatgaatatcctctgatatttgaccgggaaaaatggagaaaaatgagctcagtgtctctacttttcaaacgcacacctcccaaggcctttgaagtggaacaggatttcaagtttttcaagtctctttcttctcctaagattcgaagatatcccttggaaggtttcgtgactgaaaacagagaggcagggattgttttcggctctctgcctatatacagtatatcaagccccactagtctaagatttcttccactgattggcgtagaagcccaaaaggactcttcagatggcattacaggaaagaagaagggaggtcatgttcaacgtgaaaaagcaccacgaagaagaagtttgaaaaaaaatttagtcccacaaataaatctggcttcttccttcttcccagctatacccaagtaaggagaaaaaatcagaaatggctgctgcacataaaatggcaacgtttggatgatacctgctctttatttcaggatgagagggagaaaccaccagacactatcagtcatctctggtgtcaggccatcctattgatgggaaagattgcttagggagttctggtgaccttaactctgaataccaagcaagcagcaagcagccagaagtttaggcggtgtttcttatttactgtcagcaaactgacacataagaaaacaaatgaaatcaacagcattagtaggtctaaaataatatggttatcaatgtttagctttccacttcctcccattggtcaccttactccacagcaagaatgactgtcagaacatgtgcagtaaaaggcactttcaagtcatgctatgtgttgtacaaaaagaattattaaaaagaaaaatgtaccagtcagatctctagatgtttgtcttcttcatttagagaaatattatctggaagaaaatgtcctaagtttctcaaagtcagaaattatttctatgtagtccagacctgactccagataaatataaaagacggcaaagaaaggaagaaaaatgggtcatagaaatagaaaaagcatagtaacatggtagatttaaccttaaatatatcaataattatgaaacctttaataggttaaagtatgcaagtttaaaaggttgtcagaatggattaaaaaaacaaaatccaactatatgttgtttacaagaaacacatctaacatacaaggacaccaaactcttaaagataaaagaatgaaaaaagatgtatgatgcaaaaactaacctaaagaaaatcaatatagccatattaatattaaaatacactttaagaaaataaacaagaatctttataaaagttttataaagttattaataataactcaaa

SEQ ID NO: 8545 - DNA, 3870 bp, Homo sapiens
atcagacctaaatcagctttcctccctgctaacatcctagtggcaactcttactcctacccgcactatgggattttaagatcaaaggaattagacctagggcaaaaactgagacagcagggaggcactgtaacaactggaaagttttccaaattggtaaacttgcagtattctttctgtacagaagtaaaagatcccctatgtccctatggatatcaggaaggaaaagcgtctcaacatggcacttcagatgagcaatttcaaaaaggctttgaacaggtttgaaaaattggttgaacaaacagcagcccagaaaagagatgaaagagcaggcttatttatccataaagaagatgcaattggttatgacaagttttatgcatcggtacagaagctctttggtccagatgtgaagaatcaagatgtgaaacgcttttacaggaaactgtgcaacaacacggatgcatctgcagactggtgtgagatctttggatacttctcctctgaagaagatcctattgcttcccagttggatgaagaaaatttggttttctttgtgtctagaaaaaggcgaattttaatttcaggtagtagaagacgagatgtgattaagagcattgtcaagatacctcacctggatttactaataacagctactcagaaaggattaataacagtttttaataaccaggacacctcctggattacagggtgtgattacctcttgcagctgaaacgaatcgtagccacaaccgaaaggaccattattgtctgggattataaagctcaagggagcagccaggaaaattattttgtcataaaaccaatggatcactgcctcctgtgtgtgtgtgtggtgcctttgcctgaccatctctgccgagatgacatcctcttgggggatgatgggggttttgtgaacagattcacagtcaacagtgatgactttggaataaagcaggcaaaatccaaaagaaaattacaaaatcaggtcttagactcaaagaactttaaaagtgttaaaaggaagctacataatgactgggttatgaaaattagatatatttcagccctaaattgttttggatcctgctccttagacagtaatcattcattagttttggaatccttgaagagactcgaggataatttgcctgtcagagagttttccatgccaagaggagccaacactttttgctactgtgttaaggcaaatgtgattgtcactggaggagatgataaggtcatccggttgtggcaccccaatatcagcaccaagccagtagggaaacttgtaggacacatgttcagtatcgccgagatcgtaaccaatgaaaaagatcaacatgtcgtcagcctttcctctgcaaaggttttccgggtgtgggatatacaaactctttcactattacaagtcttccatgacagccagggaggaccaggagacatgcagatttactctatgatatatgatgccaatcatggcatgcttattacgggatctagtgttatggacatgtatcctttgactaggatgatacaagatacaaaacaggttcctcacactcatgaacgagaaatcaatgtcatgctttacaacaaatattttcatcaagtactcactatctgctctgaatccataattagggtatgggaactcgagactgggctccaagtataccagattttagaacctcatggtttcaatactgaagtgacttctgcagctgtcgatgaaagtggatttctttttgccacaggagcgtataatggaacagtcagaatctgggactttggcagtgggcaggagatgaaggtgttgccggaggggaaagactggaaggaggacgagcactgcctacgacgcctcattttcctcaaagcccaagaaaaacaccagcagctggtcctggccttggagcgcaacgggactatcaaaatgatccagggtaaggaagatgatatctacctcatggtgatctgggagctgcctgatgttgtgcctttcctacaagatgggaaacatgctgtgcatctgagaatgtctactagagacaggaacatggctattcctttcccagatgtcgagttgatagttgagaggaacttttctcaacctactgataatcccaccatggatttattacgagtgaactgcattgatttactacaagtagaaggatataatttgatagcagctggaaccttaaatgaaggacatgttatcctttgcaatattagctctttcctggatccacctcatgatgaaaagaaattcaagcagctgctttcctggcgtgctcattctttggaaattattcaagtaatctatgtagaagaaaaacaagtggtacttactgcctccatcgatggctcagtaaggctctggcatgccctcaatggacattattgtggatattttggacagcgaaggctctttgaattatcacagacaagagatttcattttgccttgtgatgttactgaatatcccatagaaataaaagaagaaagcaagttcacagagaagcaaaaatatgaatatcctctgatatttgaccgggaaaaatggagaaaaatgagctcagtgtctctacttttcaaacgcacacctcccaaggcctttgaagtggaacaggatttcaagtttttcaagtctctttcttctcctaagattcgaagatatcccttggaaggtttcgtgactgaaaacagagaggcagggattgttttcggctctctgcctatatacagtatatcaagccccactagtctaagatttcttccactgattggcgtagaagcccaaaaggactcttcagatggcattacaggaaagaagaagggaggtcatgttcaacgtgaaaaagcaccacgaagaagaagtttgaaaaaaaatttagtcccacaaataaatctggcttcttccttcttcccagctatacccaagtaaggagaaaaaatcagaaatggctgctgcacataaaatggcaacgtttggatgatacctgctctttatttcaggatgagagggagaaaccaccagacactatcagtcatctctggtgtcaggccatcctattgatgggaaagattgcttagggagttctggtgaccttaactctgaataccaagcaagcagcaagcagccagaagtttaggcggtgtttcttatttactgtcagcaaactgacacataagaaaacaaatgaaatcaacagcattagtaggtctaaaataatatggttatcaatgtttagctttccacttcctcccattggtcaccttactccacagcaagaatgactgtcagaacatgtgcagtaaaaggcactttcaagtcatgctatgtgttgtacaaaaagaattattaaaaagaaaaatgtaccagtcagatctctagatgtttgtcttcttcatttagagaaatattatctggaagaaaatgtcctaagtttctcaaagtcagaaattatttctatgtagtccagacctgactccagataaatataaaagacggcaaagaaaggaagaaaaatgggtcatagaaatagaaaaagcatagtaacatggtagatttaaccttaaatatatcaataattatgaaacctttaataggttaaagtatgcaagtttaaaaggttgtcagaatggattaaaaaaacaaaatccaactatatgttgtttacaagaaacacatctaacatacaaggacaccaaactcttaaagataaaagaatgaaaaaagatgtatgatgcaaaaactaacctaaagaaaatcaatatagccatattaatattaaaatacactttaagaaaataaacaagaatctttataaaagttttataaagttattaataataactcaaa

SEQ ID NO: 8546 - DNA, 4467 bp, Homo sapiens
tttatcctttcttttttattttaagatgtatgcatattaatcaatttaccatcactggggcatggcagtgtgggcggggagaattattcacattctcctaaaatgacagcagcagagagccttctgcctcagtggctctggctggtttcctgcaggggtcccagtggaaacccgtgtggccacctgttgccgtcttccatgagatgttagtggagagccactttgacgtggaatgatcctaatagatatagccagaccggttttgcggaaacgctttgtgctgagaaccgcaagctggtgcaccctgtgtcatatctgcccccagccagctggaattgtctgcaacacgcggtgcccggtgaggaggcaggcaggacggttgtgtgctgcatccatgagacctggaaattcagtttgcttttggaaaagagcattgtatccgagttcatacttctccaccccatcttgccaaggttgcggaaagtaaaaattggcagtattggccgctgcagcttcttaggggacgggaccatgtgaaaaggtgggatcgtgcgagcggaggaaggacagaaaagcgaggaaagtctatgccgccagcgaccggcaggaggcacgtcgggcacgctcgtcaccgtttcctggcacgtgaccaccgccctgccctgtcgctttagggcctgtcgcttccggcggtggcggttgccatggggacggagcttgggtggcaaccagaactagggagctggtggagaaggtggcggccgctggaaggaggcccgggaggtggctgaggggtccaggcggcgggacgactctggccttttgaagaccgggaggaaactctacagagaagaatgtcagatgcagcagaagctccccgagaagcaacaggagaaaatggagaaacagaaatgaaagaagaggaggaacctaatccaaattataaagaagtagaagatccacaacaggaatcaaaagatgacacaatagcatggagagagtctcaggaggaggagaggaaaacgggcgaggaggaaggggaggaggaggggaaggaggacaaaaagattgtcatggaagaaactgaggaaaaggctggagaagtccaagagaaggaggcttcaggaatacaggaagaaaccacagtagagccccaagaagtcacagcgtccatgatccgtttggagacacagattactgattcccagtcaatcacatcaggaattttcccaaaaacccaaagaggtagcaagtcaaagctttccttacaattggaggatgcagaaacagatgagcttttaagagacctgagcacacaaattgaatttcttgatttggatcaaatcagtcctgaggaacaacagattagttcccctgaaaggcagccctcaggagagcttgaggagaaaaccgaccggatgccccaagatgaactgggacaagaaagaagggacttggagccagaaaacagagaggagggacaagaaaggagagtatccgacatccagtccaaagcagggatctcccgggagtcactggtgtccagcaccacagaggacattctgtttcaaaaggataaaagcaccccggtgtatcccttgaccatgacctggtcgtttggatggaacagttctcttcctgtttactatattcgagaggaaaggcagagagttcttctgtatgtttgtgctcacactgcgatcatctacaacgtgttcaggaacaatcaataccaccttcagggccacgccaatattatctcctgcctctgcgtcagtgaagacaggcggtggatcgccacagcagacaaagggccagactgcctggtgattatatgggactccttcacaggtattcctgtgcacacaatatttgacagctgccctgaagggaatggcatcatggccatggccatgacccacgacgccaagtatctggcaaccatctcagatgctgaagtccagaaggtatgcatctggaagtggactttggcagtggaaacgccagcatgcactctcgaactccccacagagtacggtgttcagaactacgttacttttaacccaacaaataataaagaattggtgagcaatagtaaaacacgggcaatatattatgcatggtatgaagagagggatacactggctcacagtgccccacttttaactgaaaaaaccttcaacaagcttgtgggaaagtttagccagtccatctttcacttgaatttaacacaaatactctcagccacaatggaagggaagctggttgtctgggacatacaccgcccaccctcatctgcctccacctttttgggctttccctatatcaagccttgtaaattggttcatttgcagaaagagggtatcacggtacttaccacaattgatagctacattgtcacaggtgacattaaggggaacattaagttctatgatcacaccctgtctattgttaactggtacagtcacttgaaactgggcgccataagaactctgtccttttcaaagaccccagcaactcctcctactgaaaaatcaaactatcctcctgactgcactttaaaaggtgacctttttgtcttaaggaattttatcattggaacatctgatgccgcggtgtaccacttaacaacagatgggaccaaacttgagaagttatttgtagagcccaaggatgccatttgtgccatctcctgccacccatatcaacccctcattgccatcgggagcatctgtgggatgatcaaagtgtggaattatgaaaacaaacaatatcttttcagcagggtttttgagaaggggcttggagtccagagtctgacctacaaccccgaaggagcccttcttggagctggctttacagaggggacagtttacattcttgatgcaatgtctttagaaaatgaaagcccagagcctttcaaatattccagaaccagtgtgactcatataagcttttcccatgactcccagtatatggcaactgctgatagaagttttactgtggctgtttacatgctggtggtcagaaatggacagagggtctgggagtacttagcaagacttcgctctcatcgcaaaagcattcgaagtctcctgtttggggtttacctggacagcaatgagcctagactgctgagccttgggacagacaggctcttgatagagtatgatcttctcaggagctacaaagaccacctggaagtcctggacattcaccacaccgaccagggctgctatcccacctgcatggtctggtacccaccactcaccagggaactcttcctgcttatttgcaacagtggctacaaagtgaagctttttaatgctactaccaaaatgtgcagaaagacgcttctggggccagcttatggttcccctattgagcagacacaagtcctcccagtgagaagcatggcggagctacagaaacgctacttggtgtttattaacagagacaaggtgggacttcagatcttaccagttgacggcaatccacataagacatctgctattgtttgccacccgaacggggtggccggcatggccgtttcctatgatggctgctacgccttcactgcgggagggcacgatcgctcggtggtgcagtggaaaatcaccttaagtgtcctggaggcagcggtttctcttgggggtgaagacttgaccccattctatggtctgctgtctggtggccgggaaggaaaattctacagggagctagaagactacttctactattctcagctccgcagtcaaggcatcgacacaatggagaccagaaaggtgtcagaacacatttgcctgtcagagcttccttttgtcatgagagcaattggcttttacccatctgaagagaagattgatgatatatttaacgaaatcaaatttggtgaatatgtggacactggaaagctaatcgacaagatcaacttaccagatttcctaaaagtgtaccttaaccacaagccaccttttggtaacaccatgagtggcatccacaagagctttgaggtgctcggttataccaactccaaagggaaaaaggccattcgaagagaggacttcctgagactgctcgttactaaaggtgagcatatgacggaggaggagatgttggattgctttgcttcactgtttggcctgaatcccgagggatggaaatccgagcctgcaacctgctccgtcaaaggttcagaaatttgccttgaagaagaacttccagacgaaatcactgcagaaatattcgcgactgaaattcttggcttaaccatttcagaagattccggccaggatggtcagtgaagttaccaggaatgtttaaagcacaaaggactttgggtgtgtgtgcatgcacatgtgtgtgttttccatgaggcactgctttttatgcatttccctcccccctctcatctttagaacatttagacattaaagcaagtttctggtgagcaatggaattcacaaa

SEQ ID NO: 8547 - DNA, 3420 bp, Homo sapiens
agaactagggagctggtggagaaggtggcggccgctggaaggaggcccgggaggtggctgaggggtccaggcggcgggacgactctggccttttgaagaccggggtgggtgctctctaggaaactctacagagaagaatgtcagatgcagcagaagctccccgagaagcaacaggagaaaatggagaaacagaaatgaaagaagaggaggaacctaatccaaattataaagaagtagaagatccacaacaggaatcaaaagatgacacaatagcatggagagagtctcaggaggaggagaggaaaacgggcgaggaggaaggggaggaggaggggaaggaggacaaaaagattgtcatggaagaaactgaggaaaaggctggagaagtccaagagaaggaggcttcaggaatacaggaagaaaccacagtagagccccaagaagtcacagcgtccatgatccgtttggagacacagattactgattcccagtcaatcacatcaggaattttcccaaaaacccaaagaggtagcaagtcaaagctttccttacaattggaggatgcagaaacagatgagcttttaagagacctgagcacacaaattgaatttcttgatttggatcaaatcagtcctgaggaacaacagattagttcccctgaaaggcagccctcaggagagcttgaggagaaaaccgaccggatgccccaagatgaactgggacaagaaagaagggacttggagccagaaaacagagaggagggacaagaaaggagagtatccgacatccagtccaaagcagggatctcccgggagtcactggtgtccagcaccacagaggacattctgtttcaaaaggataaaagcaccccggtgtatcccttgaccatgacctggtcgtttggatggaacagttctcttcctgtttactatattcgagaggaaaggcagagagttcttctgtatgtttgtgctcacactgcgatcatctacaacgtgttcaggaacaatcaataccaccttcagggccacgccaatattatctcctgcctctgcgtcagtgaagacaggcggtggatcgccacagcagacaaagggccagactgcctggtgattatatgggactccttcacaggtattcctgtgcacacaatatttgacagctgccctgaagggaatggcatcatggccatggccatgacccacgacgccaagtatctggcaaccatctcagatgctgaagtccagaaggtatgcatctggaagtggactttggcagtggaaacgccagcatgcactctcgaactccccacagagtacggtgttcagaactacgttacttttaacccaacaaataataaagaattggtgagcaatagtaaaacacgggcaatatattatgcatggtatgaagagagggatacactggctcacagtgccccacttttaactgaaaaaaccttcaacaagcttgtgggaaagtttagccagtccatctttcacttgaatttaacacaaatactctcagccacaatggaagggaagctggttgtctgggacatacaccgcccaccctcatctgcctccacctttttgggctttccctatatcaagccttgtaaattggttcatttgcagaaagagggtatcacggtacttaccacaattgatagctacattgtcacaggtgacattaaggggaacattaagttctatgatcacaccctgtctattgttaactggtacagtcacttgaaactgggcgccataagaactctgtccttttcaaagaccccagcaactcctcctactgaaaaatcaaactatcctcctgactgcactttaaaaggtgacctttttgtcttaaggaattttatcattggaacatctgatgccgcggtgtaccacttaacaacagatgggaccaaacttgagaagttatttgtagagcccaaggatgccatttgtgccatctcctgccacccatatcaacccctcattgccatcgggagcatctgtgggatgatcaaagtgtggaattatgaaaacaaacaatatcttttcagcagggtttttgagaaggggcttggagtccagagtctgacctacaaccccgaaggagcccttcttggagctggctttacagaggggacagtttacattcttgatgcaatgtctttagaaaatgaaagcccagagcctttcaaatattccagaaccagtgtgactcatataagcttttcccatgactcccagtatatggcaactgctgatagaagttttactgtggctgtttacatgctggtggtcagaaatggacagagggtctgggagtacttagcaagacttcgctctcatcgcaaaagcattcgaagtctcctgtttggggtttacctggacagcaatgagcctagactgctgagccttgggacagacaggctcttgatagagtatgatcttctcaggagctacaaagaccacctggaagtcctggacattcaccacaccgaccagggctgctatcccacctgcatggtctggtacccaccactcaccagggaactcttcctgcttatttgcaacagtggctacaaagtgaagctttttaatgctactaccaaaatgtgcagaaagacgcttctggggccagcttatggttcccctattgagcagacacaagtcctcccagtgagaagcatggcggagctacagaaacgctacttggtgtttattaacagagacaaggtgggacttcagatcttaccagttgacggcaatccacataagacatctgctattgtttgccacccgaacggggtggccggcatggccgtttcctatgatggctgctacgccttcactgcgggagggcacgatcgctcggtggtgcagtggaaaatcaccttaagccatcctgggagccaggcaccaatattatccccatcagacacatcaagaagctaactccaaggggtctgatgactgcccaagcaatggaggaggcagtggagctgggattcacagccagggctttctaagtccaccccacaccttaacaaacattcattacaggaggaaaataaaggacttttgtctccaatctttgtgatatggtttggctctgtgttcctacccaaatctcatcttgaattgtactccgataattcccgtgtatggtgggagggacctggtgggagatggttggatggtgggggagcagggggtggtttcccccatgttgttctcgtggtagtgaataagtctcacaagatctgatggtttgataaggggaaacctgtttcacttggctctcattctctcttgccactgccatgtgagacgtgcctttcaccttccgccatgattgtgaggcctccccagccacatgaaactgtaacaataaacctctttcttttgtaaa

SEQ ID NO: 8548 - DNA, 1704 bp, Homo sapiens
gcgcatgcgcacccgcgtcccgctgctgtttagccgtttccaaggctacgaagcccatcggccggggataagagagcaagaaaatgaagctcaagagcctcctgctccggtattacccgccaggaattatgttggaatatgaaaaacatggagaattaaagactaagtccatagatttgcttgatcttggtcccagcactgatgtcagtgcgttagtagaagaaatccagaaggcagaacctctactcacagcttcacgaacagagcaagtcaaacttttgatacagaggttgcaagagaaactcggccagaacagcaatcacacgttctatctttttaaggttctcaaagcacatatattgccactgactaatgttgcacttaacaaatcgggctcatgctttatcacaggaagctatgatcggacgtgcaagctctgggacactgcgtctggagaggagctgaacacgctggagggccacaggaatgtggtttatgccatagcattcaacaatccttacggtgacaaaatcgccactgggtcctttgataaaacttgtaaactctggagtgtggaaacaggaaaatgttaccataccttcaggggtcatacagcagaaatagtgtgtttatcatttaaccctcaaagcacattggtggcgactggaagtatggacacaacagccaaattgtgggacattcagaatggcgaggaagtttacaccttaagaggacattctgccgaaatcatctccttgtcatttaacacctcaggagacagaatcatcacggggtcttttgatcataccgttgtagtgtgggacgctgatactggaaggaaggtaaatatcttaattggtcattgtgctgagattagcagtgcctcattcaattgggattgctctctaatattaactggctctatggacaaaacctgcaagctgtgggatgctacaaatggaaaatgtgtggcaaccttaacaggccatgatgatgaaatactagacagctgctttgattacactggaaagcttattgcaactgcttcagctgatggaacagcaagaattttcagtgctgccacaagaaaatgcattgccaaactggaaggtcatgaaggtgaaatttcaaagatttctttcaaccctcaagggaaccatcttctaactggcagctctgacaaaacggctagaatctgggatgctcagactggccagtgcctccaggttcttgaggggcacactgatgaaatcttttcatgtgctttcaactataaaggcaacatagtcattacaggcagcaaggataatacctgtaggatatggcgttgactgaaggaagctggtcagtgagcaaccttgctagcaatggtaatcaagaactggaacttcacagacagcagctctcttaatatttcttatactttctctttttctgcaagtcaactatttctacaactgtccttcatttcacagatatgaccattaaacatgacaaagttatgccactccaatattattatttgatggcgatggcaggacacagcataatgtttggctaatgccaccagttatttcagttgtgtttgttttttaaaagcattatgatactgaaaaaggagaccagaacaacttaacaacgtgtctcctggattttactttgaagcctattgttataatttctgttgaataaagtgtttggagg

SEQ ID NO: 8549 - DNA, 1335 bp, Homo sapiens
atcggccggggataagagagcaagaaaatgaagctcaagagcctcctgctccggtattacccgccagtctttggtgagccaaatcatatgcaagtttccaagatactactgaatagcaggaattatgttggaatatgaaaaacatggagaattaaagactaagtccatagatttgcttgatcttggtcccagcactgatgtcagtgcgttagtagaagaaatccagaaggcagaacctctactcacagcttcacgaacagagcaagtcaaacttttgatacagaggttgcaagagaaactcggccagaacagcaatcacacgttctatctttttaaggttctcaaagcacatatattgccactgactaatgttgcacttaacaaatcgggctcatgctttatcacaggaagctatgatcggacgtgcaagctctgggacactgcgtctggagaggagctgaacacgctggagggccacaggaatgtggtttatgccatagcattcaacaatccttacggtgacaaaatcgccactgggtcctttgataaaacttgtaaactctggagtgtggaaacaggaaaatgttaccataccttcaggggtcatacagcagaaatagtgtgtttatcatttaaccctcaaagcacattggtggcgactggaagtatggacacaacagccaaattgtgggacattcagaatggcgaggaagtttacaccttaagaggacattctgccgaaatcatctccttgtcatttaacacctcaggagacagaatcatcacggggtcttttgatcataccgttgtagtgtgggacgctgatactggaaggaaggtaaatatcttaattggtcattgtgctgagattagcagtgcctcattcaattgggattgctctctaatattaactggctctatggacaaaacctgcaagctgtgggatgctacaaatggaaaatgtgtggcaaccttaacaggccatgatgatgaaatactagacagctgctttgattacactggaaagcttattgcaactgcttcagctgatggaacagcaagaattttcagtgctgccacaagaaaatgcattgccaaactggaaggtcatgaaggtgaaatttcaaagatttctttcaaccctcaagggaaccatcttctaactggcagctctgacaaaacggctagaatctgggatgctcagactggccagtgcctccaggttcttgaggggcacactgatgaaatcttttcatgtgctttcaactataaaggcaacatagtcattacaggcagcaaggataatacctgtaggatatggcgttgactgaagga

SEQ ID NO: 8550 - DNA, 2983 bp, Homo sapiens
cgcggtccctctgcggaaggcgccgctcttggcttcggcggcgccgctgtagcttgaaggcggtacttcctccagcatttgccgcaagttattggcaagttcccctgcagttgtttgggctgtccctgtggctggttctggggtgtgcggccagccatggagcgctctgggcccagcgaagtgacaggctcagacgcgtcgggaccggacccgcagcttgcggtcaccatgggcttcacggggttcggtaaaaaagctcgcacatttgacttggaagcaatgtttgaacaaactcgaaggacagctgtggaaagaagtcgcaaaacactggaagcaagagaaaaagaggaagaaatgaacagagagaaagaattaagaagacaaaatgaagatattgagccaacatcctcaagatcaaatgtggtcagagattgctccaaatcatcttccagggatacgagcagcagtgaaagtgaacagagttctgactcttctgatgatgagttaattggccctcctttaccccctaaaatggtaggaaaaccagttaattttatggaggaagatatcctcggtcctttacctccacctcttaatgaagaagaagaagaagcagaggaagaagaagaggaagaggaggaagaggaaaatcctgttcacaagattcctgactcgcatgagataacgctgaagcatggcactaaaacagtgtctgctttgggtctggatccctcaggtgcccgtttggtgacaggaggatatgactatgatgttaagttttgggattttgctggaatggatgcttcttttaaggcatttcgatcccttcagccctgtgagtgccatcagatcaagtcattacagtatagtaacacaggagacatgattcttgttgtatctggaagctctcaggccaaggtgattgacagagatggttttgaagtaatggaatgtataaaaggagaccagtatattgtggacatggccaacaccaagggtcatacagcaatgcttcatactggctcatggcatcccaaaataaagggagaatttatgacttgctcaaatgatgcgactgtgaggacgtgggaagttgaaaatccaaagaagcaaaaaagtgtgtttaaaccacggacgatgcaaggcaaaaaagtcattcccactacgtgcacatatagtagagatggaaacctcatagcagctgcctgccagaatggaagcatacagatctgggaccgaaatttgactgttcatcctaagttccactataaacaggctcatgactcgggcacagacacttcttgcgtgactttttcctatgatggtaatgtccttgcctctcgtggaggtgacgattcattaaaattatgggacatccgacaatttaataaaccacttttttcagcctcgggtcttcccaccatgttcccaatgactgactgctgtttcagtccagatgataagctcatagtcactggtacatctattcaaagaggatgtggcagcggcaaacttgttttctttgagcgtaggactttccaaagggtgtatgaaatagacatcacagatgcgagtgttgttcgctgcctgtggcatccaaagctgaaccagatcatggttggaactggaaatggattggctaaagtctattacgaccccaacaagagtcagaggggagcaaaattatgtgtggttaaaacccagcggaaggcaaaacaagctgagactctaactcaggactacatcatcacccctcatgccttgcctatgttccgtgagccccgccaacggagtacaaggaaacagctggagaaggacagactggatcccctgaagtcgcataaacctgaacctcctgtagcaggcccaggtcgtggtggccgagttggaacccacgggggcactctctcttcctatattgtgaagaacattgctttggacaagaccgatgacagtaatcctcgggaagccattttgcgtcatgccaaagcagcagaagacagcccatattgggtttctccagcatattccaagactcagcccaaaaccatgtttgcccaagttgaatctgatgatgaggaagcaaagaatgagccagaatggaaaaaacgtaaaatttgaagaatctcatttgagagctgtttgcatgagtgggaggggtatgggacaggtttgggttttttttttatgctcatgaaattaaaaattcatttttatgaacaggttttgtcctttgcattattgaactggtcaaaagtttggtggctaggcttcactaaaattgtgcttaaattttcttacctgcaactattaaactgattacagataaacaagaaacagattcttagtctattaccaagtactttaggtatttggaaactttattcaacaattattggtcttgtccagattctcataaccttagagaggaaaatgtacattaagatgtgcatctgtctctagcaattctaggaacataatatagaaatagagatcaaaaagtttaatgtttctgtataatttcacaacagttgtttacatgactgtaattaattaggctgagttcaaaccaaatacattgccatactgggaaagagcattatctcattatccttcaatagcagaatacagtggttaagagttaggagtgggctttgaagtcagactcatgtggattcaagtcctggctttgctctttacttctgggtcatcttaagagagttatttaacttttcttttctagcctcagatgatgaaatagtacgtactttgcaggttcgtcagaagaattaaatgggacatgcctcacagagcatttagtacagtacctggaacacagtaaatgtataccaaatatttgctattttaaaatagggctaatatttactttgcttggtttttatcagtattaaattagaaaggtatagaattgctttgtaaatgtaaagactaaacagaagacattaaaaattattctaaaaaa

SEQ ID NO: 8551 - DNA, 1900 bp, Homo sapiens
agagccgcgcggcccccgaaggctcgcaggcggaagtgagacgccggaagcggtcgttgccatggatcctggggacgactggctggtggaatccttgcgcttgtaccaggatttctatgcattcgacctgtcaggagccactcgagtccttgaatggattgatgacaaaggagtctttgttgctggctatgaaagcctgaaaaagaatgaaattcttcatctgaaattacctctcagactttctgtaaaggaaaacaagggcttattcccagaaagagatttcaaagtgcgccatggaggattttcagacaggtctatctttgatctaaagcatgtgccacataccagattgctggttaccagtggccttccaggttgttatctgcaggtgtggcaggttgcagaggacagtgatgtcattaaagctgtcagcaccattgctgtgcatgagaaagaggagagtctctggcctagggtggccgtcttctccacattggcacccggagtcctccatggggcgaggctccgaagtctgcaggtcgttgatctggagtcccggaagaccacgtacacctcagatgtcagtgacagtgaggagctgagtagcctgcaggtcctagatgcagacacctttgccttctgctgtgcttcaggccggctggggcttgttgacacccggcagaagtgggcaccgttggagaatcgcagccctggccctgggtctggtggagagagatggtgtgctgaagttgggagctggggccagggccctgggcccagcattgccagccttggctcagatgggcgtctttgtcttcttgacccccgggatctctgccatcctgtgagctcagtccagtgcccagtatccgtacctagccctgacccagagctgctgcgagtgacttgggccccaggcctgaagaattgcttggccatctcaggttttgatggtacagtccaggtctatgatgccacatcttgggatggaacacggagccaagatggaacacggagccaagtagaacctctcttcactcacagaggtcacatcttcctagatggaaatgggatggaccctgctcctttggtcaccacccacacctggcatccctgcagaccaaggactttgttatcagcaacaaatgatgcctctctgcatgtgtgggactgggtggacctttgtgccccccgctgacaccagcatctttccatctaggcctctagaaaggggaggagctgctgtagtagcaagggtgctcatgtaggactcaagtgactaccagtccctgttaccagctgtgtggccttgggcaagtctgccagcgtcacttagcctcagtttccttatctgtaaaatgaggatagtaagaactacctcgtagtgatattgcgaaggttagaagaaacgcatggcataattacttggtagctattgttagatctgggagtgtgaaatggtagcgttttgtccctgtcttcacactatcatagggagaatcaaaagagctaacaaatataaacatgctttgtgaatttttttaaagaaaaaaatgtagaggggccaataaacatgaaaaaatcccagccctagtagcaattaaggaaatagcaaaacaggatttctgctcctcttgagtgggtctcatgggaacacaggtgcactttcccacacttgtccccccaggtgactaggttcaagagacatttgcttttggtggccccacaaacatttccttttgagggcccatagtgaatattaaagtgtgctggacatggtggctcatgcctgtaatcccagcactttcagaggctgaggtgggcagattgcttgagctgaggagtttgagaccagcctgggcaacatagcaagatcccttcccttaaaaaaaaaaaaaaa

SEQ ID NO: 8552 - DNA, 3978 bp, Homo sapiens
tcggacccgcccctcccggcctcccgccgcaatcttggcgggaaggcgccggccgctaagaagccgaaagatgtccaggtcgggcgcggcggctgagaaggcggactccagacagcgaccccagatgaaggtaaatgaatataaagaaaatcaaaacatcgcttatgtgtctctgagaccagcacagactacagttttaataaaaacagctaaggtctatcttgcccccttttcactcagtaattaccagctagaccagcttatgtgccccaaatccctatcagaaaagaattctaacaatgaagtggcgtgtaagaagactaaaataaagaaaacttgcagaaggattatacctccaaagatgaaaaacacatcttccaaggcagaatccacgctgcaaaattcatcctcagctgttcatactgaaagtaacaagctacaacccaagagaacggcagatgcgatgaatctcagtgttgatgtggaaagtagtcaggatggagacagtgatgaagataccacaccatccctggatttttcgggattgtcaccctacgaaaggaagagactgaagaacatatcagaaaacgcagacttttttgcttctcttcagttgtctgagtctgctgcaagactccgtgaaatgatagagaagagacagcctcctaaatccaaaagaaagaagcctaagagagaaaatgggattggatgtagaaggtcaatgcgattactaaaagttgatccttcgggagtttcattaccagcagctccaacaccgccgacattagtagcagatgaaactcctttgttacctcctgggcctttagaaatgacttctgaaaatcaagaagacaacaatgaacgatttaaaggatttctgcacacatgggcaggaatgagcaagccaagtagtaagaacactgagaagggattatctagcattaaaagctacaaagccaatttaaatggcatggtcattagtgaagataccgtttacaaagttaccacaggcccaatattctctatggctctccatccatcagaaactagaactttggtagcagttggggccaaatttgggcaagttggactttgtgatttgacccagcaacctaaagaagatggagtttatgtttttcatccccatagtcagccagttagctgtctttacttctcacccgccaatccggcccacatactgtcactgagctatgatggcacgttacgctgtggggatttttccagggctatttttgaagaggtgtatagaaatgaaagaagtagcttttcctccttcgacttcttggcagaagatgcctccactttaatagtaggacactgggatggaaatatgtcactggtggatagacggacacctggaacttcttatgagaaacttaccagttcttctatgggaaaaataagaactgttcatgtccacccagtgcatagacagtattttatcactgccggattgagggatactcatatttatgatgcaaggcgattgaattccaggagaagtcagcctttgatttctttgactgaacatacaaagagcattgcttccgcctatttttcacctcttactggtaacagagtggtgaccacatgtgctgattgtaatctgagaatttttgacagcagctgtatatcttctaagattccgctcctcaccaccatcaggcacaacactttcactgggcgatggctgaccaggttccaagccatgtgggatcctaaacaagaagactgtgtcatagttggcagcatggcccatccacgacgggtagaaatcttccatgagacaggaaagagggtgcattcgtttggtggagaataccttgtctctgtgtgttccatcaatgccatgcacccaactcggtatattttggctggaggtaattccagcgggaagatacatgtttttatgaatgaaaaaagctgctgagtttttggtttaggaacatcaatttgttcaaattgaccactgtctaaggagcctagtaatcggcgtgccttagtgtgtttatgtggtaatgtgttacatttagcaattataacattgttttattaataagactataagaagagtgtacttttagtaagggagaagtcttggagggttgcttctgcaggacggggagggaatttgaggggaggctgaggtgccgtcaggactttttttttttttttttttttgagatggagttttgctcttgttgcccaggctggagtgcaatagcgcgatcttggctcaccgcaacctccgcctcccaggttcaagcgattctcctgcctcagactcctaagtagctgggattacaggcacctgccaccacgcctggctatttttttgtatttttagtagagatggggtttcatcatgttggccaggctggtctcgagctcctgacctcaggtgatctgcccgcctcggcctccaaaagtgctggaattacaggcgtgagccaccatgcctggccatcagaacttgtaatcaagacagtatgttgagaaattctaacattataaattacaaagctttgactattaaagtttttgtgatctaatgatacagttttgattctatagtaatttgtggcttattttatagtttataatgaatacttatttctagactcatacactggaaggggacccggaaaggtaatgtaactcagtgattttaaaacttgatttttttaactgagaactttttttgccccctgcctgtaggttaagtcttacgtgaaatgccaagataattgctgagcagctttggttacccagggcggggtctgggtctgtctgtactttgcctttactctagatggctcctgagacacaggcaggactcccaagcaccgggttgggatctgccctggtcccggcattccagtataagattgcctcagacctgtgtttttcagactgggtttttgctcttcacatgaaatcaagttagatgacaatgactggtgttgaaaaaaatgaaaaggaaagaatttgtaaagaacagaaaatatatttgagtaagtattgtttggtaaaacttagttacatatgcatatatatttgttaggtatatatgtttatgtgtattctgatgtaaaatatatatatatatatattttattactatagtaccatgggtaatggataaagaagttaaagctactgcttagaatgaagaaggccccaggcttacctgtcccgatctttaaactgtccgaaggaaattcaatagcctgttaagtgaataccttcattcttacttgtatttgggggaatattatgaaatactcaccacttttggtattttatgaaaatgttttcttttcagaagttatggtaatttcaatgtgtttgttgttgggaggggagctgccaaatcagttactaatattactgtgtgacatctatccaacttttttcattattcttcattgccaaatactgaaagacttgtaaatggctttggcaatatgtttgaattctaagaggaaatattttcccataattgtatatcagagaaatatagtgatatacaatttccttgaaaaccaatttctaaataattttcttctctgtaatctaagtgtaaaaaggtttagttttttaataggtttaggtgtttataagcaatagttctctattttctagttgatataagtagaagaattgacaagtgagatggaaatgttaatttataaagggaaagaaaagctaggtgaggttgagttataattaaactgttcaggaaacatcgtaaaggctttaggctccctttttcatttctataccaattaatctcatgggttctagagtggttagttctacgggaattgtttttgtttttgtttttaaagatgctgaaaactactctcaatcaaattagtaccatcatttaagctttgaatacttggcagtaattgcctgggctcgtcaataaatgttagcaaattcttgatgttc

SEQ ID NO: 8553 - DNA, 2586 bp, Homo sapiens
ggcctcccgccgcaatcttggcgggaaggcgccggccgctaagaagccgaaagatgtccaggtcgggcgcggcggctgagaaggcggactccagacagcgaccccagatgaaggtgagaaacggactggtgcttccaaggtaaatgaatataaagaaaatcaaaacatcgcttatgtgtctctgagaccagcacagactacagttttaataaaaacagctaaggtctatcttgcccccttttcactcagtaattaccagctagaccagcttatgtgccccaaatccctatcagaaaagaattctaacaatgaagtggcgtgtaagaagactaaaataaagaaaacttgcagaaggattatacctccaaagatgaaaaacacatcttccaaggcagaatccacgctgcaaaattcatcctcagctgttcatactgaaagtaacaagctacaacccaagagaacggcagatgcgatgaatctcagtgttgatgtggaaagtagtcaggatggagacagtgatgaagataccacaccatccctggatttttcgggattgtcaccctacgaaaggaagagactgaagaacatatcagaaaacgcagacttttttgcttctcttcagttgtctgagtctgctgcaagactccgtgaaatgatagagaagagacagcctcctaaatccaaaagaaagaagcctaagagagaaaatgggattggatgtagaaggtcaatgcgattactaaaagttgatccttcgggagtttcattaccagcagctccaacaccgccgacattagtagcagatgaaactcctttgttacctcctgggcctttagaaatgacttctgaaaatcaagaagacaacaatgaacgatttaaaggatttctgcacacatgggcaggaatgagcaagccaagtagtaagaacactgagaagggattatctagcattaaaagctacaaagccaatttaaatggcatggtcattagtgaagataccgtttacaaagttaccacaggcccaatattctctatggctctccatccatcagaaactagaactttggtagcagttggggccaaatttgggcaagttggactttgtgatttgacccagcaacctaaagaagatggagtttatgtttttcatccccatagtcagccagttagctgtctttacttctcacccgccaatccggcccacatactgtcactgagctatgatggcacgttacgctgtggggatttttccagggctatttttgaagaggtgtatagaaatgaaagaagtagcttttcctccttcgacttcttggcagaagatgcctccactttaatagtaggacactgggatggaaatatgtcactggtggatagacggacacctggaacttcttatgagaaacttaccagttcttctatgggaaaaataagaactgttcatgtccacccagtgcatagacagtattttatcactgccggattgagggatactcatatttatgatgcaaggcgattgaattccaggagaagtcagcctttgatttctttgactgaacatacaaagagcattgcttccgcctatttttcacctcttactggtaacagagtggtgaccacatgtgctgattgtaatctgagaatttttgacagcagctgtatatcttctaagattccgctcctcaccaccatcaggcacaacactttcactgggcgatggctgaccaggttccaagccatgtgggatcctaaacaagaagactgtgtcatagttggcagcatggcccatccacgacgggtagaaatcttccatgagacaggaaagagggtgcattcgtttggtggagaataccttgtctctgtgtgttccatcaatgccatgcacccaactcggtatattttggctggaggtaattccagcgggaagatacatgtttttatgaatgaaaaaagctgctgagtttttggtttaggaacatcaatttgttcaaattgaccactgtctaaggagcctagtaatcggcgtgccttagtgtgtttatgtggtaatgtgttacatttagcaattataacattgttttattaataagactataagaagagtgtacttttagtaagggagaagtcttggagggttgcttctgcaggacggggagggaatttgaggggaggctgaggtgccgtcaggactttttttttttttttttttttgagatggagttttgctcttgttgcccaggctggagtgcaatagcgcgatcttggctcaccgcaacctccgcctcccaggttcaagcgattctcctgcctcagactcctaagtagctgggattacaggcacctgccaccacgcctggctatttttttgtatttttagtagagatggggtttcatcatgttggccaggctggtctcgagctcctgacctcaggtgatctgcccgcctcggcctccaaaagtgctggaattacaggcgtgagccaccatgcctggccatcagaacttgtaatcaagacagtatgttgagaaattctaacattataaattacaaagctttgactattaaagtttttgtgatctaatgat

SEQ ID NO: 8554 - DNA, 1697 bp, Homo sapiens
accgtcgccatgacgcccggcaaacattccggagcctcggcccgagccgctaacggaggagcttgggggtacagggacttcagaggcggccaaaaaaaggggtggtgcaccactccccagctggtcgccaccatgccagtctctccggcaggcagtcacaagcagcagaacttcgggttgaacaatgccacacaaccaaagaagtctattagcttttttgctacaatgaaagcaacttcagtgaaaggatatactggtgcaaatcaaagcagaatggctgtgtccaaaaccgtgcttattccacctgaactgaaaactgtagaaaaaccaaatcccaatataaagacaacacaggtatttgacataaatggaactgatgttactccccgacctctttaccatccagatccacttactggtacagcaaaaccaagtaaactcttgacatcacaagaaggatcacttggatcagaatttatatcttcctatagcctttatcagaatacaataaatcctagtacgttagggcagtttacaaggtcagttttaggaagcagtacagtttctaagtcaagtgtatcagcaagtgaatcaatagcagaagacctggaagaaccatcctataaacgggaaagattgactagtttcacagatttgcaagttataagggcagcacctgaaaaaattgtaacaaaagaagacctggagaagaatatagagataatactcacagagacagaaacactgagattttttgacttgcccacagtcatggtctctgtagaatctgaagaagctgagaaagtaactcagagaaacaagaattatgaagtcctttgtagaaacagattaggcaatgacctatatgttgaaaggatgatgcagactttcaatggagcaccaaagaataaagatgttcaatgtgataaaatcataatggaagataaaggcataatgtccactgcctgggatttgtatgattcttacaatgctatggaacttgtatctttatcagtaaaacaatctgtggttgagtcaagtagtaaagcaaatgtacttcctaaagatcaggaccaaagattgccagggagcactacagaaaaaaatagtgaaactagttctctaatggacatagaaaatgtaattctggcaaaaatccatgaagatgaggaagaccactcagatgcaatattaaaatctgacaaatttcatcaggacttattttttatggaacgggttctgatggaaaatatatttcagcccaaacttgcagcttatcgtcagcttcctgttttaaaagaacctgaacctgaagagcctgaagatgttttagaaagtgcaaaacatgaagaggtagaggaagaatctaagaaggaggaggaagaagaaatacatgcagaagaatcaacaatacccgccaacttggaacgactttggtctttttcctgtgacttaaccaaaggcctcaatgtgagcagccttgcctggaataaaacaaatccagatcttttggctgttggctatgggcactttggatttaaagagcaaaaaagaggactggcttgctgctggtcaataaagaatcccatggtaacccaaacaagaataagaagcatttttatctggctgttgacaaaattctcataaaatatataattacatgtaataattaaataaagtctagaaaattttatcaa

SEQ ID NO: 8555 - DNA, 3848 bp, Homo sapiens
ctcgtgccgccagccaaccgcgcggccgcttgttgagccagggctccaccgtcgccatgacgcccggcaaacattccggagcctcggcccgagccgctaacggaggagcttgggggtacagggacttcagaggcggccaaaaaaaggggtggtgcaccactccccagctggtcgccaccatgccagtctctccggcaggcagtcacaagcagcagaacttcgggttgaacaatgccacacaaccaaagaagtctattagcttttttgctacaatgaaagcaacttcagtgaaaggatatactggtgcaaatcaaagcagaatggctgtgtccaaaaccgtgcttattccacctgaactgaaaactgtagaaaaaccaaatcccaatataaagacaacacaggtatttgacataaatggaactgatgttactccccgacctctttaccatccagatccacttactggtacagcaaaaccaagtaaactcttgacatcacaagaaggatcacttggatcagaatttatatcttcctatagcctttatcagaatacaataaatcctagtacgttagggcagtttacaaggtcagttttaggaagcagtacagtttctaagtcaagtgtatcagcaagtgaatcaatagcagaagacctggaagaaccatcctataaacgggaaagattgactagtttcacagatttgcaagttataagggcagcacctgaaaaaattgtaacaaaagaagacctggagaagaatatagagataatactcacagagacagaaacactgagattttttgacttgcccacagtcatggtctctgtagaatctgaagaagctgagaaagtaactcagagaaacaagaattatgaagtcctttgtagaaacagattaggcaatgacctatatgttgaaaggatgatgcagactttcaatggagcaccaaagaataaagatgttcaatgtgataaaatcataatggaagataaaggcataatgtccactgcctgggatttgtatgattcttacaatgctatggaacttgtatctttatcagtaaaacaatctgtggttgagtcaagtagtaaagcaaatgtacttcctaaagatcaggaccaaagattgccagggagcactacagaaaaaaatagtgaaactagttctctaatggacatagaaaatgtaattctggcaaaaatccatgaagatgaggaagaccactcagatgcaatattaaaatctgacaaatttcatcaggacttattttttatggaacgggttctgatggaaaatatatttcagcccaaacttgcagcttatcgtcagcttcctgttttaaaagaacctgaacctgaagagcctgaagatgttttagaaagtgcaaaacatgaagaggtagaggaagaatctaagaaggaggaggaagaagaaatacatgcagaagaatcaacaatacccgccaacttggaacgactttggtctttttcctgtgacttaaccaaaggcctcaatgtgagcagccttgcctggaataaaacaaatccagatcttttggctgttggctatgggcactttggatttaaagagcaaaaaagaggactggcttgctgctggtcaataaagaatcccatgtggccagaacgtatttatcagagtccatatggagttactgctgtggatttttcaattggagcacctaaccttttagccgttggctatcacaatggcacaattgcaatttacaatgtacggagcaacagtaatgttccagttctggatagtagtgaatcacctcaaaaacatttgggacctgtatggcaactacagtggatagaacaagatcgaggaacaacaggagatggcaaaagagaaatactagtttctatatcagcagatggaagaatctccaaatgggttatacgaaaaggactagactgttatgatttgatgcgattaaagagaactacagctgccagtaacaaaaaaggaggggaaaaggaaaagaaagatgaagctttgatatctcgacaggctcctggaatgtgttttgcttttcatcccaaggacacaaatatctatttggctggcactgaagaaggtcatattcacaaatgttcttgttcatataatgaacaatacttagatacctacagaggacataagggtccagtgtataaagtgacatggaatccattttgtcatgatgtatttttaagctgttctgcagattggggtgttattatatggcaacaggagaatgtcaagccatctttgagtttttatccagctacttctgttgtttacgacgttgcctggtctccaaaatcatcctatatatttgcagctgcaaatgagaacagggtggagatttgggaccttcatatcagcactttggaccctctgattgtgaatactgctaaccctggaatcaagttcacaaccattctctttgccaaacaaacagattgccttctggtaggagacagtgatggacaggtttctgtgtatgaactgagaaatatgcctactgttttggaaactggccggggagatataatggatactttgcttggatccaagtcaaaccaatcagcataattcatcattcctaatatttttcttgtagttgttttaaaaaaggaattaacatccaatattctgtattacatactgtacaccagattttgatttcagaaaacaatatttgatgtataacttccacttaatttaaatttaataaacttttatttcagagatatttgattagtttacaatctaagagttattcttaagagtttcagtggaattttcttaatttttctaaagatattcctactctcttgatcatattctaagtacatatgagtacatgtacattcttatacaatgtctaaatgggttagaaaattattatacctatagaagcgaaacttggaaattaatagaatcacttaaaccaaaatctttataagacacaattctattgattttaaagcttctgctttccaggctctgttttccagagtttataattacgtagtttttagtagatgaaaataatggattcttgtacctaacattttatcctcttagatctaagagccgaagctatagaactttgttagactatttggcaagcaaaatatatgacagtaaatatcagaattttatggtttgaccagcgcttatcacattcccaattcagtgagaaaaattcatctgggacacaacagggtactcttctctgtttgcccagaatcagctctggattttaagcccagacttcagtggacccagatagaaaatataaagtctctgatctataggccacatcaggatgttattttatgaagagttctagagcaaggttgcggaaatcggggtggagatggggagcagtgactcctccaaatattcattgctaacaggccattctatgcagtttgttttaacaaatcctgggttaaactgaggccacaggacatgatgggctgttctataaagcattctaagtggagaggagacgatagggcatatgaaattcactaaactctctggaaaaaaaatatgtatatattaaaaaccaagactggaatcagtgcaacagtgggaactaccttttacaagtatccattgcttcataaactccatttgtttggaccaatcccttaaacaaaagcaaggcaaattttacatggatttagagcctaggtcaggttattaggattataaattttccactggtatgtcattgtgattatctttgtttttgtctttctgaaagattggattttctataacaccttgtgtaagaaaataaaaaacttgatctaactgaaaaaa

SEQ ID NO: 8556 - DNA, 3743 bp, Homo sapiens
ctcgtgccgccagccaaccgcgcggccgcttgttgagccagggctccaccgtcgccatgacgcccggcaaacattccggagcctcggcccgagccgctaacggaggagcttgggggtacagggacttcagaggcggccaaaaaaaggggtggtgcaccactccccagctggtcgccaccatgccagtctctccggcaggcagtcacaagcagcagaacttcgggttgaacaatgccacacaaccaaagaagtctattagcttttttgctacaatgaaagcaacttcagtgaaaggatatactggtgcaaatcaaagcagaatggctgtgtccaaaaccgtgcttattccacctgaactgaaaactgtagaaaaaccaaatcccaatataaagacaacacaggtatttgacataaatggaactgatgttactccccgacctctttaccatccagatccacttactggtacagcaaaaccaagtaaactcttgacatcacaagaaggatcacttggatcagaatttatatcttcctatagcctttatcagaatacaataaatcctagtacgttagggcagtttacaaggtcagttttaggaagcagtacagtttctaagtcaagtgtatcagcaagtgaatcaatagcagaagacctggaagaaccatcctataaacgggaaagattgactagtttcacagatttgcaagttataagggcagcacctgaaaaaattgtaacaaaagaagacctggagaagaatatagagataatactcacagagacagaaacactgagattttttgacttgcccacagtcatggtctctgtagaatctgaagaagctgagaaagtaactcagagaaacaagaattatgaagtcctttgtagaaacagattaggcaatgacctatatgttgaaaggatgatgcagactttcaatggagcaccaaagaataaagatgttcaatgtgataaaatcataatggaagataaaggcataatgtccactgcctgggatttgtatgattcttacaatgctatggaacttgtatctttatcagtaaaacaatctgtggttgagtcaagtagtaaagcaaatgtacttcctaaagatcaggaccaaagattgccagggagcactacagaaaaaaatagtgaaactagttctctaatggacatagaaaatgtaattctggcaaaaatccatgaagatgaggaagaccactcagatgcaatattaaaatctgacaaatttcatcaggacttattttttatggaacgggttctgatggaaaatatatttcagcccaaacttgcagcttatcgtcagcttcctgttttaaaagaacctgaacctgaagagcctgaagatgttttagaaagtgcaaaacatgaagaggtagaggaagaatctaagaaggaggaggaagaagaaatacatgcagaagaatcaacaatacccgccaacttggaacgactttggtctttttcctgtgacttaaccaaaggcctcaatgtgagcagccttgcctggaataaaacaaatccagatcttttggctgttggctatgggcactttggatttaaagagcaaaaaagaggactggcttgctgctggtcaataaagaatcccatgtggccagaacgtatttatcagagtccatatggagttactgctgtggatttttcaattggagcacctaaccttttagccgttggctatcacaatggcacaattgcaatttacaatgtacggagcaacagtaatgttccagttctggatagtagtgaatcacctcaaaaacatttgggacctgtatggcaactacagtggatagaacaagatcgaggaacaacaggagatggcaaaagagaaatactagtttctatatcagcagatggaagaatctccaaatgggttatacgaaaaggactagactgttatgatttgatgcgattaaagagaactacagctgccagtaacaaaaaaggaggggaaaaggaaaagaaagatgaagctttgatatctcgacaggctcctggaatgtgttttgcttttcatcccaagggtccagtgtataaagtgacatggaatccattttgtcatgatgtatttttaagctgttctgcagattggggtgttattatatggcaacaggagaatgtcaagccatctttgagtttttatccagctacttctgttgtttacgacgttgcctggtctccaaaatcatcctatatatttgcagctgcaaatgagaacagggtggagatttgggaccttcatatcagcactttggaccctctgattgtgaatactgctaaccctggaatcaagttcacaaccattctctttgccaaacaaacagattgccttctggtaggagacagtgatggacaggtttctgtgtatgaactgagaaatatgcctactgttttggaaactggccggggagatataatggatactttgcttggatccaagtcaaaccaatcagcataattcatcattcctaatatttttcttgtagttgttttaaaaaaggaattaacatccaatattctgtattacatactgtacaccagattttgatttcagaaaacaatatttgatgtataacttccacttaatttaaatttaataaacttttatttcagagatatttgattagtttacaatctaagagttattcttaagagtttcagtggaattttcttaatttttctaaagatattcctactctcttgatcatattctaagtacatatgagtacatgtacattcttatacaatgtctaaatgggttagaaaattattatacctatagaagcgaaacttggaaattaatagaatcacttaaaccaaaatctttataagacacaattctattgattttaaagcttctgctttccaggctctgttttccagagtttataattacgtagtttttagtagatgaaaataatggattcttgtacctaacattttatcctcttagatctaagagccgaagctatagaactttgttagactatttggcaagcaaaatatatgacagtaaatatcagaattttatggtttgaccagcgcttatcacattcccaattcagtgagaaaaattcatctgggacacaacagggtactcttctctgtttgcccagaatcagctctggattttaagcccagacttcagtggacccagatagaaaatataaagtctctgatctataggccacatcaggatgttattttatgaagagttctagagcaaggttgcggaaatcggggtggagatggggagcagtgactcctccaaatattcattgctaacaggccattctatgcagtttgttttaacaaatcctgggttaaactgaggccacaggacatgatgggctgttctataaagcattctaagtggagaggagacgatagggcatatgaaattcactaaactctctggaaaaaaaatatgtatatattaaaaaccaagactggaatcagtgcaacagtgggaactaccttttacaagtatccattgcttcataaactccatttgtttggaccaatcccttaaacaaaagcaaggcaaattttacatggatttagagcctaggtcaggttattaggattataaattttccactggtatgtcattgtgattatctttgtttttgtctttctgaaagattggattttctataacaccttgtgtaagaaaataaaaaacttgatctaactg

SEQ ID NO: 8557 - DNA, 3794 bp, Homo sapiens
aaagagcaggcgaaagccacggcgtctgcgtttgcaatgcatgctggtccgtgtagttctcagcctgacaccgtcgttcccagaacccagcgcgctctgtgctggcgggcgcagaggcctcccaggaggagagcaaggacctggcaggggctgctgaggaggaggagagcgggctgcccggggccgggcctggctcctgtgcttttggggaggagattcccatggatggggagcctcctgcctcctcgggcctggggctcccagactacacgtctggcgtcagcttccacgaccaggctgacctccctgagacagaggacttccaagccgggctctatgtgactgagtctccccagccccaggaggctgaggctgtgagcctgggccggctgagtgacaagagcagcaccagcgagacctccctgggtgaggagcgggctccagacgaggggggtgcccccgtggacaagagcagccttcgatcaggtgacagcagccaggacttgaagcaaagcgagggctccgaggaggaagaggaggaggaggacagctgcgtggtgctagaggaggaggagggggagcaggaggaggtcaccggggcatctgagctcactctgtctgacacggtgctgtccatggagacggttgtggccggcggcagtgggggagatggagaagaagaggaggaggcactgcctgagcagtcagaaggcaaagaacagaagatcctccttgatacagcctgcaagatggtccgctggctgtctgccaagctcggccccacagtggcctctcgccacgtggcccggaacctgctccgcctgctgacgtcttgttatgttggacccactcggcagcagttcacagtgagcagtggcgagagcccaccgctgagcgccggcaacatctaccagaagaggccggtcctgggcgacatcgtgtcagggcctgtgctcagctgcctcctccacatcgcccgcctgtatggggagcctgtcctcacctaccagtacctgccctacatcagctacctggtggccccagggagtgcctcaggccccagccgactgaacagccgtaaggaggcggggctgctggccgcggtgacgctgactcagaagatcatcgtgtacctctcagacaccacactcatggacatcctgccccggatcagccatgaggtcctgctgcccgtgctcagcttcctcacctccctcgtcacggggttcccaagtggggcccaggctcggaccatcctgtgtgtgaaaaccatcagcctcatcgccctcatctgcctgcgcattggacaggagatggtccagcagcacctgagcgagcccgtggccacctttttccaggtcttctctcagctgcatgagcttcggcaacaggatctgaagctggaccctgcgggccgtggtgagggccagctgccacaggtggtcttctctgatgggcagcagcggcccgtggaccccgccctgctggacgagctgcagaaggtgttcaccctggagatggcatacacaatctacgtgcccttctcctgcctgttgggtgacatcatccggaaaatcatccccaaccacgagctggttggggagctggcggcgctgtacttggagagcatcagccccagcagtcgcaaccctgccagcgtggagcccaccatgcccggcaccgggcccgagtgggacccccatggtgggggctgccctcaggatgacggccactcagggacctttgggagcgtcctggtggggaaccgcattcagatccccaatgactctcggcctgagaaccccggaccactgggccccatctcgggggtgggtggcgggggcctgggcagcgggagcgacgacaacgccctgaagcaggagctgccgcggagcgtgcacgggctgagcggaaactggctggcgtactggcagtacgagatcggcgtgagccagcaggatgcccactttcacttccaccagatccgcctgcagagcttcccgggccactcgggggccgtcaagtgcgtggcacccctaagcagcgaggacttcttcctgagcggcagcaaggatcgtaccgtgcgcctctggccgctgtacaactacggcgacgggaccagcgagacggccccacgcctcgtctacacccagcaccgcaagagcgtcttcttcgtgggccagcttgaggccccgcagcacgtggtgagctgtgacggggctgtgcacgtctgggaccccttcacagggaagacccttcgcacagtggagccgctggacagccgggtgcccctgactgcggtggctgtcatgcccgccccccacaccagcatcaccatggccagctctgactctaccctgcgctttgtggactgcaggaagcctggtctgcagcacgagttccgactgggcggtgggctgaaccctgggcttgtccgtgccctggccatcagccccagtggccgtagtgtcgtggccggcttctcctcaggcttcatggtgctcctggacacccgcacaggcctggttctgcgaggctggccagcccacgagggggacattctgcagatcaaggcggtggagggcagcgtcctggtcagctcctcctctgaccattccttgaccgtctggaaggagctggagcagaagcccacccatcactacaagtcagcatccgaccccatccacacctttgacctgtacggcagcgaggtggtcactggcaccgtgtccaacaagattggcgtctgctccctgcttgagccaccctcgcaggccaccacgaagctcagctctgagaacttccgcggcacgctcaccagcctggccttgctgcccactaaacgccacctcctgctgggctcagacaacggggttatccgcctcctggcatagactgaggcaggagctggccgggcaagggtgggaagacatctgcgggcgcgtgtccactcaccctgttccctgagcagcagctccctccagggaggccctgggtcccacgccctgggtgcccacatggcctgccaactagggcctgcaaatggagtgggggagtcctggcccctgaatcaccagagccaccaagcctgccagaggggtctcattcatggcttggggacacagggctcctagcaagcaggaagttaagagcaggaggaagcgttgctaccttcacttctccccagctctgccctctgggtccacatgaggacagggaagctcgggaaggggaagggagactggccctgcccagccggtctctagcccctcagcccccgctgggcactctctgtcccatccctctaggacagggaagctggcctggtccagggcactgatggtgcttggattccagcctaaggaaggctggccgtggtccaggagttaagggcttgggtctggggtttaagtggccacccatccaggccctggccagtgtgggaccgggacgggaaggaagaaggaggctaggagcagggggaaaaggtgcacttggccagtggcgcctgccaggagtgagtccatgcgttgtctgcccacccctaccacagtgtttgtgccttcagctgagggggcagcctctgggccctgaacccctgctggggctccacgaccctgagagaaggggtgagaagaatcatctctgcacctcgggtctctgccagaggaagacttaagcatccctgcgacctcacattctagacagagatgaggtccaggggttggcccctgctgccttctcacaatttgcaatagatgtaaataggaccaataaatcctttggaagagcca

SEQ ID NO: 8558 - DNA, 2993 bp, Homo sapiens
atggatggggagcctcctgcctcctcgggcctggggctcccagactacacgtctggcgtcagcttccacgaccaggctgacctccctgagacagaggacttccaagccgggctctatgtgactgagtctccccagccccaggaggctgaggctgtgagcctgggccggctgagtgacaagagcagcacctaccagtacctgccctacatcagctacctggtggccccagggagtgcctcaggccccagccgactgaacagccgtaaggaggcggggctgctggccgcggtgacgctgactcagaagatcatcgtgtacctctcagacaccacactcatggacatcctgccccggatcagccatgaggtcctgctgcccgtgctcagcttcctcacctccctcgtcacggggttcccaagtggggcccaggctcggaccatcctgtgtgtgaaaaccatcagcctcatcgccctcatctgcctgcgcattggacaggagatggtccagcagcacctgagcgagcccgtggccacctttttccaggtcttctctcagctgcatgagcttcggcaacaggatctgaagctggaccctgcgggccgtggtgagggccagctgccacaggtggtcttctctgatgggcagcagcggcccgtggaccccgccctgctggacgagctgcagaaggtgttcaccctggagatggcatacacaatctacgtgcccttctcctgcctgttgggtgacatcatccggaaaatcatccccaaccacgagctggttggggagctggcggcgctgtacttggagagcatcagccccagcagtcgcaaccctgccagcgtggagcccaccatgcccggcaccgggcccgagtgggacccccatggtgggggctgccctcaggatgacggccactcagggacctttgggagcgtcctggtggggaaccgcattcagatccccaatgactctcggcctgagaaccccggaccactgggccccatctcgggggtgggtggcgggggcctgggcagcgggagcgacgacaacgccctgaagcaggagctgccgcggagcgtgcacgggctgagcggaaactggctggcgtactggcagtacgagatcggcgtgagccagcaggatgcccactttcacttccaccagatccgcctgcagagcttcccgggccactcgggggccgtcaagtgcgtggcacccctaagcagcgaggacttcttcctgagcggcagcaaggatcgtaccgtgcgcctctggccgctgtacaactacggcgacgggaccagcgagacggccccacgcctcgtctacacccagcaccgcaagagcgtcttcttcgtgggccagcttgaggccccgcagcacgtggtgagctgtgacggggctgtgcacgtctgggaccccttcacagggaagacccttcgcacagtggagccgctggacagccgggtgcccctgactgcggtggctgtcatgcccgccccccacaccagcatcaccatggccagctctgactctaccctgcgctttgtggactgcaggaagcctggtctgcagcacgagttccgactgggcggtgggctgaaccctgggcttgtccgtgccctggccatcagccccagtggccgtagtgtcgtggccggcttctcctcaggcttcatggtgctcctggacacccgcacaggcctggttctgcgaggctggccagcccacgagggggacattctgcagatcaaggcggtggagggcagcgtcctggtcagctcctcctctgaccattccttgaccgtctggaaggagctggagcagaagcccacccatcactacaagtcagcatccgaccccatccacacctttgacctgtacggcagcgaggtggtcactggcaccgtgtccaacaagattggcgtctgctccctgcttgagccaccctcgcaggccaccacgaagctcagctctgagaacttccgcggcacgctcaccagcctggccttgctgcccactaaacgccacctcctgctgggctcagacaacggggttatccgcctcctggcatagactgaggcaggagctggccgggcaagggtgggaagacatctgcgggcgcgtgtccactcaccctgttccctgagcagcagctccctccagggaggccctgggtcccacgccctgggtgcccacatggcctgccaactagggcctgcaaatggagtgggggagtcctggcccctgaatcaccagagccaccaagcctgccagaggggtctcattcatggcttggggacacagggctcctagcaagcaggaagttaagagcaggaggaagcgttgctaccttcacttctccccagctctgccctctgggtccacatgaggacagggaagctcgggaaggggaagggagactggccctgcccagccggtctctagcccctcagcccccgctgggcactctctgtcccatccctctaggacagggaagctggcctggtccagggcactgatggtgcttggattccagcctaaggaaggctggccgtggtccaggagttaagggcttgggtctggggtttaagtggccacccatccaggccctggccagtgtgggaccgggacgggaaggaagaaggaggctaggagcagggggaaaaggtgcacttggccagtggcgcctgccaggagtgagtccatgcgttgtctgcccacccctaccacagtgtttgtgccttcagctgagggggcagcctctgggccctgaacccctgctggggctccacgaccctgagagaaggggtgagaagaatcatctctgcacctcgggtctctgccagaggaagacttaagcatccctgcgacctcacattctagacagagatgaggtccaggggttggcccctgctgccttctcacaatttgcaatagatgtaaataggaccaataaatcctttggaagagccatggggtgaactgag

SEQ ID NO: 8559 - DNA, 3184 bp, Homo sapiens
aaacgagagtcctaaagagcaggcgaaagccacggcgtctgcgtttgcaatgcatgctggtccgtgtagttctcagcctgacaccgtcgttcccagaacccagcgcgctctatacagcctgcaagatggtccgctggctgtctgccaagctcggccccacagtggcctctcgccacgtggcccggaacctgctccgcctgctgacgtcttgttatgttggacccactcggcagcagttcacagtgagcagtggcgagagcccaccgctgagcgccggcaacatctaccagaagaggccggtcctgggcgacatcgtgtcagggcctgtgctcagctgcctcctccacatcgcccgcctgtatggggagcctgtcctcacctaccagtacctgccctacatcagctacctggtggccccagggagtgcctcaggccccagccgactgaacagccgtaaggaggcggggctgctggccgcggtgacgctgactcagaagatcatcgtgtacctctcagacaccacactcatggacatcctgccccggatcagccatgaggtcctgctgcccgtgctcagcttcctcacctccctcgtcacggggttcccaagtggggcccaggctcggaccatcctgtgtgtgaaaaccatcagcctcatcgccctcatctgcctgcgcattggacaggagatggtccagcagcacctgagcgagcccgtggccacctttttccaggtcttctctcagctgcatgagcttcggcaacaggatctgaagctggaccctgcgggccgtggtgagggccagctgccacaggtggtcttctctgatgggcagcagcggcccgtggaccccgccctgctggacgagctgcagaaggtgttcaccctggagatggcatacacaatctacgtgcccttctcctgcctgttgggtgacatcatccggaaaatcatccccaaccacgagctggttggggagctggcggcgctgtacttggagagcatcagccccagcagtcgcaaccctgccagcgtggagcccaccatgcccggcaccgggcccgagtgggacccccatggtgggggctgccctcaggatgacggccactcagggacctttgggagcgtcctggtggggaaccgcattcagatccccaatgactctcggcctgagaaccccggaccactgggccccatctcgggggtgggtggcgggggcctgggcagcgggagcgacgacaacgccctgaagcaggagctgccgcggagcgtgcacgggctgagcggaaactggctggcgtactggcagtacgagatcggcgtgagccagcaggatgcccactttcacttccaccagatccgcctgcagagcttcccgggccactcgggggccgtcaagtgcgtggcacccctaagcagcgaggacttcttcctgagcggcagcaaggatcgtaccgtgcgcctctggccgctgtacaactacggcgacgggaccagcgagacggccccacgcctcgtctacacccagcaccgcaagagcgtcttcttcgtgggccagcttgaggccccgcagcacgtggtgagctgtgacggggctgtgcacgtctgggaccccttcacagggaagacccttcgcacagtggagccgctggacagccgggtgcccctgactgcggtggctgtcatgcccgccccccacaccagcatcaccatggccagctctgactctaccctgcgctttgtggactgcaggaagcctggtctgcagcacgagttccgactgggcggtgggctgaaccctgggcttgtccgtgccctggccatcagccccagtggccgtagtgtcgtggccggcttctcctcaggcttcatggtgctcctggacacccgcacaggcctggttctgcgaggctggccagcccacgagggggacattctgcagatcaaggcggtggagggcagcgtcctggtcagctcctcctctgaccattccttgaccgtctggaaggagctggagcagaagcccacccatcactacaagtcagcatccgaccccatccacacctttgacctgtacggcagcgaggtggtcactggcaccgtgtccaacaagattggcgtctgctccctgcttgagccaccctcgcaggccaccacgaagctcagctctgagaacttccgcggcacgctcaccagcctggccttgctgcccactaaacgccacctcctgctgggctcagacaacggggttatccgcctcctggcatagactgaggcaggagctggccgggcaagggtgggaagacatctgcgggcgcgtgtccactcaccctgttccctgagcagcagctccctccagggaggccctgggtcccacgccctgggtgcccacatggcctgccaactagggcctgcaaatggagtgggggagtcctggcccctgaatcaccagagccaccaagcctgccagaggggtctcattcatggcttggggacacagggctcctagcaagcaggaagttaagagcaggaggaagcgttgctaccttcacttctccccagctctgccctctgggtccacatgaggacagggaagctcgggaaggggaagggagactggccctgcccagccggtctctagcccctcagcccccgctgggcactctctgtcccatccctctaggacagggaagctggcctggtccagggcactgatggtgcttggattccagcctaaggaaggctggccgtggtccaggagttaagggcttgggtctggggtttaagtggccacccatccaggccctggccagtgtgggaccgggacgggaaggaagaaggaggctaggagcagggggaaaaggtgcacttggccagtggcgcctgccaggagtgagtccatgcgttgtctgcccacccctaccacagtgtttgtgccttcagctgagggggcagcctctgggccctgaacccctgctggggctccacgaccctgagagaaggggtgagaagaatcatctctgcacctcgggtctctgccagaggaagacttaagcatccctgcgacctcacattctagacagagatgaggtccaggggttggcccctgctgccttctcacaatttgcaatagatgtaaataggaccaataaatcctttggaagagccatggggtgaactgag

SEQ ID NO: 8560 - DNA, 2356 bp, Homo sapiens
tccgcctgctgacgtcttgttatgttggacccactcggcagcagttcacagtgagcagtggcgagagcccaccgctgagcgccggcaacatctaccagaagaggccggtcctgggcgacatcgtgtcagggcctgtgctcagctgcctcctccacatcgcccgcctgtatggggagcctgtcctcacctaccagtacctgccctacatcagctacctggttcccaagtggggcccaggctcggaccatcctgtgtgtgaaaaccatcagcctcatcgccctcatctgcctgcgcattggacaggagatggtccagcagcacctgagcgagcccgtggccacctttttccaggtcttctctcagctgcatgagcttcggcaacaggatctgaagctggaccctgcgggccgtggtgagggccagctgccacaggtggtcttctctgatgggcagcagcggcccgtggaccccgccctgctggacgagctgcagaaggtgttcaccctggagatggcatacacaatctacgtgcccttctcctgcctgttgggtgacatcatccggaaaatcatccccaaccacgagctggttggggagctggcggcgctgtacttggagagcatcagccccagcagtcgcaaccctgccagcgtggagcccaccatgcccggcaccgggcccgagtgggacccccatggtgggggctgccctcaggatgacggccactcagggacctttgggagcgtcctggtggggaaccgcattcagatccccaatgactctcggcctgagaaccccggaccactgggccccatctcgggggtgggtggcgggggcctgggcagcgggagcgacgacaacgccctgaagcaggagctgccgcggagcgtgcacgggctgagcggaaactggctggcgtactggcagtacgagatcggcgtgagccagcaggatgcccactttcacttccaccagatccgcctgcagagcttcccgggccactcgggggccgtcaagtgcgtggcacccctaagcagcgaggacttcttcctgagcggcagcaaggatcgtaccgtgcgcctctggccgctgtacaactacggcgacgggaccagcgagacggccccacgcctcgtctacacccagcaccgcaagagcgtcttcttcgtgggccagcttgaggccccgcagcacgtggtgagctgtgacggggctgtgcacgtctgggaccccttcacagggaagacccttcgcacagtggagccgctggacagccgggtgcccctgactgcggtggctgtcatgcccgccccccacaccagcatcaccatggccagctctgactctaccctgcgctttgtggactgcaggaagcctggtctgcagcacgagttccgactgggcggtgggctgaaccctgggcttgtccgtgccctggccatcagccccagtggccgtagtgtcgtggccggcttctcctcaggcttcatggtgctcctggacacccgcacaggcctggttctgcgaggctggccagcccacgagggggacattctgcagatcaaggcggtggagggcagcgtcctggtcagctcctcctctgaccattccttgaccgtctggaaggagctggagcagaagcccacccatcactacaagtcagcatccgaccccatccacacctttgacctgtacggcagcgaggtggtcactggcaccgtgtccaacaagattggcgtctgctccctgcttgagccaccctcgcaggccaccacgaagctcagctctgagaacttccgcggcacgctcaccagcctggccttgctgcccactaaacgccacctcctgctgggctcagacaacggggttatccgcctcctggcatagactgaggcaggagctggccgggcaagggtgggaagacatctgcgggcgcgtgtccactcaccctgttccctgagcagcagctccctccagggaggccctgggtcccacgccctgggtgcccacatggcctgccaactagggcctgcaaatggagtgggggagtcctggcccctgaatcaccagagccaccaagcctgccagaggggtctcattcatggcttggggacacagggctcctagcaagcaggaagttaagagcaggaggaagcgttgctaccttcacttctccccagctctgccctctgggtccacatgaggacagggaagctcgggaaggggaagggagactggccctgcccagccggtctctagcccctcagcccccgctgggcactctctgtcccatccctctaggacagggaagctggcctggtccagggcactgatggtgcttggattccagcctaag

SEQ ID NO: 8561 - DNA, 6733 bp, Homo sapiens
atggcccagggcagcggggggcgggaaggcgctctcagaaccccggccgggggctggcattccccgccaagcccagacatgcaggagctgctccggagcgtggagagggacctgagcatcgatcccaggcagctggctccggccccggggggcacccacgtggtggccctagtgcctgcgcgctggctggccagcctccgcgatcgccggctgcccctgggaccctgtccccgcgcagagggcctgggagaagcggaagtcaggactctcctgcagcgctctgtgcaaaggctgcctgccggctggacgcgcgtggaggtgcatgggctgcggaagcggagactgtcctaccctctgggcgggggcctgccctttgaggacgggtcctgcggccctgagaccctcactcgcttcatgcaggaggttgccgcccagaattatcgcaacctgtggcgccatgcataccacacttacggccagccgtacagtcacagccctgccccctcagctgtccctgccttggactcagtacggcaggctctgcagagggtctatggttgctccttcctgccagtgggtgaaactacccaatgcccttcatatgccagagaaggcccctgcccccctcggggcagccctgcttgccctagtcttttacgggctgaggccttgctggagtcgccggagatgctgtatgtggtacacccttacgtacagttctccctacatgacgtggtcaccttcagccctgccaagctgaccaacagccaggccaaggtgctgttcattctcttccgcgtgctgagggctatggacgcctgtcaccgccaggggctggcgtgtggggccctgtctttgtatcacatcgcagtggatgagaagctttgcagcgagctgcgactggacctgagtgcttatgagaggcccgaggaggacgagaatgaggaggcccctgtggcaagggatgaggcgggcattgtgtctcaagaggagcagggagggcaacctgggcaacccactggccaggaggaacttcggagcctcgtgctagattgggtccacggccgcatcagcaacttccactacctcatgcagctgaatcggttggcaggtcggcggcagggggaccccaactaccaccccgtgctgccctgggtggtggacttcactacgccccatgggcgcttccgagacctgcgcaagtccaagttccgcctcaacaagggggataagcaactggacttcacgtatgagatgacacggcaggcattcgtagcaggcggggcgggcggcggggaaccccctcatgttccccaccacatctcagacgtgctctccgacatcacgtactatgtgtacaaggctcggcgcacgcctcggtcggtgctctgcggacacgtccgcgcgcagtgggagccccatgagtatccggccagcatggagcggatgcagaactggaccccggatgagtgcattccggagttctacaccgatccctctatcttccgctccatccaccccgacatgcctgacctggatgtgccagcctggtgcagctccagccaggagttcgtagctgcccaccgagccctgctggagagccgcgaggtatcccgggacctgcaccattggatcgacctcacgtttggctataaactccagggtaaggaggctgtcaaggaaaagaatgtgtgtctgcacctggtggacgcccacactcacctggccagctacggggtggtgcagctcttcgatcagccacacccccagcgcctggctggggctcctgcccttgcccccgagcctcccctcatccccaagctgttggtccagaccatccaggagaccacaggccgggaggacttcacggaaaacccgggacagcttccaaatggagtgggccggccagttttagaggccactccctgtgaggctagctggaccagagacaggccggtggcaggagaagacgacttggaacaggccacagaagctctggattccatttcccttgctgggaaagcaggtgaccagctgggctcctccagtcaagcgtcccctggacttctctctttctcagtggcctcagcctcccgtccaggccgcaggaataaagctgctggggcagaccctggggagggtgaggaggggaggattcttcttcccgagggcttcaatcccatgcaggccctggaggagctggagaaaacgggcaacttcttggccaaaggcctagggggcctgttggaggtgcctgagcagccccgggtccagccggctgtgccactgcagtgcctactccacagggacatgcaggcgctgggtgtcctattggcagagatggtgtttgccaccagggtgcggacgctgcagcccgatgcacctttgtgggtacgcttccaggctgtccgagggctctgcacgcgccaccccaaggaggtccctgtgtctttgcagcccgtgctggacacactcctgcagatgagtggccccgaagtccccatgggagcagagaggggcaagctggaccaactgtttgagtacaggcctgtctcccagggcctgcccccaccctgcccaagccagcttctcagccccttcagctccgtggttcccttcccaccctacttcccggcactgcacagattcatcctcctgtaccaggcaaggcgtgtggaggacgaggcccaggggcgcgagctggtgtttgctctgtggcagcagctgggcgcggtgctgaaggacatcacccctgagggcctggagatcctgctgcccttcgtgctctcactcatgtccgaggagcacacagctgtgtacacggcctggtatctgtttgagcctgttgccaaggcactgggccccaaaaatgccaataagtacctcctgaagccgctcattggtgcctacgagagcccctgccagctacacggccgcttctacctgtacacggactgctttgtggcccagctgatggtgcggctgggcctgcaggcatttctcactcacctgctgccccatgtcctgcaggtgctggcgggcgcagaggcctcccaggaggagagcaaggacctggcaggggctgctgaggaggaggagagcgggctgcccggggccgggcctggctcctgtgcttttggggaggagattcccatggatggggagcctcctgcctcctcgggcctggggctcccagactacacgtctggcgtcagcttccacgaccaggctgacctccctgagacagaggacttccaagccgggctctatgtgactgagtctccccagccccaggaggctgaggctgtgagcctgggccggctgagtgacaagagcagcaccagcgagacctccctgggtgaggagcgggctccagacgaggggggtgcccccgtggacaagagcagccttcgatcaggtgacagcagccaggacttgaagcaaagcgagggctccgaggaggaagaggaggaggaggacagctgcgtggtgctagaggaggaggagggggagcaggaggaggtcaccggggcatctgagctcactctgtctgacacggtgctgtccatggagacggttgtggccggcggcagtgggggagatggagaagaagaggaggaggcactgcctgagcagtcagaaggcaaagaacagaagatcctccttgatacagcctgcaagatggtccgctggctgtctgccaagctcggccccacagtggcctctcgccacgtggcccggaacctgctccgcctgctgacgtcttgttatgttggacccactcggcagcagttcacagtgagcagtggcgagagcccaccgctgagcgccggcaacatctaccagaagaggccggtcctgggcgacatcgtgtcagggcctgtgctcagctgcctcctccacatcgcccgcctgtatggggagcctgtcctcacctaccagtacctgccctacatcagctacctggtggccccagggagtgcctcaggccccagccgactgaacagccgtaaggaggcggggctgctggccgcggtgacgctgactcagaagatcatcgtgtacctctcagacaccacactcatggacatcctgccccggatcagccatgaggtcctgctgcccgtgctcagcttcctcacctccctcgtcacggggttcccaagtggggcccaggctcggaccatcctgtgtgtgaaaaccatcagcctcatcgccctcatctgcctgcgcattggacaggagatggtccagcagcacctgagcgagcccgtggccacctttttccaggtcttctctcagctgcatgagcttcggcaacaggatctgaagctggaccctgcgggccgtggtgagggccagctgccacaggtggtcttctctgatgggcagcagcggcccgtggaccccgccctgctggacgagctgcagaaggtgttcaccctggagatggcatacacaatctacgtgcccttctcctgcctgttgggtgacatcatccggaaaatcatccccaaccacgagctggttggggagctggcggcgctgtacttggagagcatcagccccagcagtcgcaaccctgccagcgtggagcccaccatgcccggcaccgggcccgagtgggacccccatggtgggggctgccctcaggatgacggccactcagggacctttgggagcgtcctggtggggaaccgcattcagatccccaatgactctcggcctgagaaccccggaccactgggccccatctcgggggtgggtggcgggggcctgggcagcgggagcgacgacaacgccctgaagcaggagctgccgcggagcgtgcacgggctgagcggaaactggctggcgtactggcagtacgagatcggcgtgagccagcaggatgcccactttcacttccaccagatccgcctgcagagcttcccgggccactcgggggccgtcaagtgcgtggcacccctaagcagcgaggacttcttcctgagcggcagcaaggatcgtaccgtgcgcctctggccgctgtacaactacggcgacgggaccagcgagacggccccacgcctcgtctacacccagcaccgcaagagcgtcttcttcgtgggccagcttgaggccccgcagcacgtggtgagctgtgacggggctgtgcacgtctgggaccccttcacagggaagacccttcgcacagtggagccgctggacagccgggtgcccctgactgcggtggctgtcatgcccgccccccacaccagcatcaccatggccagctctgactctaccctgcgctttgtggactgcaggaagcctggtctgcagcacgagttccgactgggcggtgggctgaaccctgggcttgtccgtgccctggccatcagccccagtggccgtagtgtcgtggccggcttctcctcaggcttcatggtgctcctggacacccgcacaggcctggttctgcgaggctggccagcccacgagggggacattctgcagatcaaggcggtggagggcagcgtcctggtcagctcctcctctgaccattccttgaccgtctggaaggagctggagcagaagcccacccatcactacaagtcagcatccgaccccatccacacctttgacctgtacggcagcgaggtggtcactggcaccgtgtccaacaagattggcgtctgctccctgcttgagccaccctcgcaggccaccacgaagctcagctctgagaacttccgcggcacgctcaccagcctggccttgctgcccactaaacgccacctcctgctgggctcagacaacggggttatccgcctcctggcatagactgaggcaggagctggccgggcaagggtgggaagacatctgcgggcgcgtgtccactcaccctgttccctgagcagcagctccctccagggaggccctgggtcccacgccctgggtgcccacatggcctgccaactagggcctgcaaatggagtgggggagtcctggcccctgaatcaccagagccaccaagcctgccagaggggtctcattcatggcttggggacacagggctcctagcaagcaggaagttaagagcaggaggaagcgttgctaccttcacttctccccagctctgccctctgggtccacatgaggacagggaagctcgggaaggggaagggagactggccctgcccagccggtctctagcccctcagcccccgctgggcactctctgtcccatccctctaggacagggaagctggcctggtccagggcactgatggtgcttggattccagcctaaggaaggctggccgtggtccaggagttaagggcttgggtctggggtttaagtggccacccatccaggccctggccagtgtgggaccgggacgggaaggaagaaggaggctaggagcagggggaaaaggtgcacttggccagtggcgcctgccaggagtgagtccatgcgttgtctgcccacccctaccacagtgtttgtgccttcagctgagggggcagcctctgggccctgaacccctgctggggctccacgaccctgagagaaggggtgagaagaatcatctctgcacctcgggtctctgccagaggaagacttaagcatccctgcgacctcacattctagacagagatgaggtccaggggttggcccctgctgccttctcacaatttgcaatagatgtaaataggaccaataaatcctttggaagagccatggggtg

SEQ ID NO: 8562 - DNA, 3315 bp, Homo sapiens
tggagaccctttcagccccgggaggaagcggagcccagaccgagccagagcggagcagcgggagggagggcggggaggccgccgggcaggaagcggggtcccgcccgggcctctggagccacgtgcgcttgtttccgtgctggggcgatcacgtgacccgcgtcagctgacccgtcacggtggagcccggtgctcgcgcccggcagcctctgccccgccgcgcccggagcgcaggacccgcggagggatacagcctgcaagatggtccgctggctgtctgccaagctcggccccacagtggcctctcgccacgtggcccggaacctgctccgcctgctgacgtcttgttatgttggacccactcggcagcagttcacagtgagcagtggcgagagcccaccgctgagcgccggcaacatctaccagaagaggccggtcctgggcgacatcgtgtcagggcctgtgctcagctgcctcctccacatcgcccgcctgtatggggagcctgtcctcacctaccagtacctgccctacatcagctacctggtggccccagggagtgcctcaggccccagccgactgaacagccgtaaggaggcggggctgctggccgcggtgacgctgactcagaagatcatcgtgtacctctcagacaccacactcatggacatcctgccccggatcagccatgaggtcctgctgcccgtgctcagcttcctcacctccctcgtcacggggttcccaagtggggcccaggctcggaccatcctgtgtgtgaaaaccatcagcctcatcgccctcatctgcctgcgcattggacaggagatggtccagcagcacctgagcgagcccgtggccacctttttccaggtcttctctcagctgcatgagcttcggcaacaggatctgaagctggaccctgcgggccgtggtgagggccagctgccacaggtggtcttctctgatgggcagcagcggcccgtggaccccgccctgctggacgagctgcagaaggtgttcaccctggagatggcatacacaatctacgtgcccttctcctgcctgttgggtgacatcatccggaaaatcatccccaaccacgagctggttggggagctggcggcgctgtacttggagagcatcagccccagcagtcgcaaccctgccagcgtggagcccaccatgcccggcaccgggcccgagtgggacccccatggtgggggctgccctcaggatgacggccactcagggacctttgggagcgtcctggtggggaaccgcattcagatccccaatgactctcggcctgagaaccccggaccactgggccccatctcgggggtgggtggcgggggcctgggcagcgggagcgacgacaacgccctgaagcaggagctgccgcggagcgtgcacgggctgagcggaaactggctggcgtactggcagtacgagatcggcgtgagccagcaggatgcccactttcacttccaccagatccgcctgcagagcttcccgggccactcgggggccgtcaagtgcgtggcacccctaagcagcgaggacttcttcctgagcggcagcaaggatcgtaccgtgcgcctctggccgctgtacaactacggcgacgggaccagcgagacggccccacgcctcgtctacacccagcaccgcaagagcgtcttcttcgtgggccagcttgaggccccgcagcacgtggtgagctgtgacggggctgtgcacgtctgggaccccttcacagggaagacccttcgcacagtggagccgctggacagccgggtgcccctgactgcggtggctgtcatgcccgccccccacaccagcatcaccatggccagctctgactctaccctgcgctttgtggactgcaggaagcctggtctgcagcacgagttccgactgggcggtgggctgaaccctgggcttgtccgtgccctggccatcagccccagtggccgtagtgtcgtggccggcttctcctcaggcttcatggtgctcctggacacccgcacaggcctggttctgcgaggctggccagcccacgagggggacattctgcagatcaaggcggtggagggcagcgtcctggtcagctcctcctctgaccattccttgaccgtctggaaggagctggagcagaagcccacccatcactacaagtcagcatccgaccccatccacacctttgacctgtacggcagcgaggtggtcactggcaccgtgtccaacaagattggcgtctgctccctgcttgagccaccctcgcaggccaccacgaagctcagctctgagaacttccgcggcacgctcaccagcctggccttgctgcccactaaacgccacctcctgctgggctcagacaacggggttatccgcctcctggcatagactgaggcaggagctggccgggcaagggtgggaagacatctgcgggcgcgtgtccactcaccctgttccctgagcagcagctccctccagggaggccctgggtcccacgccctgggtgcccacatggcctgccaactagggcctgcaaatggagtgggggagtcctggcccctgaatcaccagagccaccaagcctgccagaggggtctcattcatggcttggggacacagggctcctagcaagcaggaagttaagagcaggaggaagcgttgctaccttcacttctccccagctctgccctctgggtccacatgaggacagggaagctcgggaaggggaagggagactggccctgcccagccggtctctagcccctcagcccccgctgggcactctctgtcccatccctctaggacagggaagctggcctggtccagggcactgatggtgcttggattccagcctaaggaaggctggccgtggtccaggagttaagggcttgggtctggggtttaagtggccacccatccaggccctggccagtgtgggaccgggacgggaaggaagaaggaggctaggagcagggggaaaaggtgcacttggccagtggcgcctgccaggagtgagtccatgcgttgtctgcccacccctaccacagtgtttgtgccttcagctgagggggcagcctctgggccctgaacccctgctggggctccacgaccctgagagaaggggtgagaagaatcatctctgcacctcgggtctctgccagaggaagacttaagcatccctgcgacctcacattctagacagagatgaggtccaggggttggcccctgctgccttctcacaatttgcaatagatgtaaataggaccaataaatcctttggaagagccatggggtgaa

SEQ ID NO: 8563 - DNA, 1428 bp, Homo sapiens
ttccccgtccccagcgaagtcggcgccggaactgccctaatggaaaccagccgccgggcgctccgggagggctcaggccgaccccggggtccattagaggcgccccaggccgagggagcccgcggcggctggaaggacatgaaagctatgtgaccttctgccagctggaggatgaggctgccttcacatgcagcgccgactgcaccatcaggaggtgggacgtgctgaccgggcagtgtctgcaggtgtaccgaggacacacgtccatcgtgaacaggatcctggttgccaacaaccagctcttcagcagctcctatgaccggacagctcgggtctggagtgtggacaaggggcagatgtcccgggagttccggggccaccgcaactgcgtgctgaccctagcctactctgccccgtgggacctccccagcactccctgcgcggaggaggccgcggccggggggcttctggtgaccggcagcacagatggcacagccaaggtgtggcaggtggccagcggctgctgccaccagacgctgcggggccacacgggtgcagtgctgtgcctagtgctagacacgcccggccacacggccttcacaggcagcaccgacgccaccatccgtgcctgggacatcctgagtggggagcagctgcgggtgttccgggagcaccggggctccgtcatctgtctggagtgttcacgggcagcggggacgcttgcgcccgggccttcgacgcgcagtctggagagctgcggagggtgttccggggccacacattcatcatcaactgcatccaggtgcacggccaggtgctctacaccgcctcgcacgacggcgccctgcgcctctgggacgtgcgcgggctccgaggtgccccgcggccccctccgcccatgcgcagcctctcgcggctcttcagcaacaaggtgggctgcgccgccgcgcccctgcagccggcctgatcccgcggggcccctgcagacgccagcccagacacccagcggctcccagagcgccccgccctgctacccgcggtggtggcgcccgatggccggcgaggggcgaggagcgaggaagcccgggcgggaggagagcccgtcgcaggcgtctggtttttctttggtggccaggaggcgctgggagcgggagtgctcgccctggggaccgcccccttttcccttttagggtggctcctgtcctccctccccatccctgacctggcgaaaggcctagtcctggggaccctcccacctcaggggctgcaggcggactgccccagctcccccagccccacgaaactgggcctttcctgctgagaggaagtgactttttacagaagccactgaacctggttattttggcaaatcgtccgtctcgagggccttggggggaactgaaatatacagcctgaacgttaaaagtg

SEQ ID NO: 8564 - DNA, 2023 bp, Homo sapiens
cggccggggagggcgcggggcgctcggcttcccgtgttcctctccccgccccagccccgtgggcgcgagaggaggcggggggctccttgtgcaccagagacgcagctgccttgttcgcccggtggggtgtggatcctccgagcggtgctgggaagggggttctctctgcccgcgcgcccaggactctacccagggcggaggtcccgagtgggccgccccccgcagcgccctgggttcgcgggcccagaggctggaggcagcggggagctagggtccttcaccctcccctcgccgcgtgcctccgcaggagtcgggctccccgttccccgcgatggccgcgggccgcagtcgtacggagccgccgcgcggaccccggggcgcccctccctagcggggcgcagctccttcttgttccccgccctgccagcgggatggggggcggcgggtcggccctgagggtctgcgccgaccaccgcgggggcatcaactggctgagcctgagccccgacgggcagcgcctgctgacgggcagcgaggacggcacggcccggctctggagcaccgcggacggccagtgctgcgcgctcctgcaaggacatgaaagctatgtgaccttctgccagctggaggatgaggctgccttcacatgcagcgccgactgcaccatcaggaggtgggacgtgctgaccgggcagtgtctgcaggtgtaccgaggacacacgtccatcgtgaacaggatcctggttgccaacaaccagctcttcagcagctcctatgaccggacagctcgggtctggagtgtggacaaggggcagatgtcccgggagttccggggccaccgcaactgcgtgctgaccctagcctactctgccccgtgggacctccccagcactccctgcgcggaggaggccgcggccggggggcttctggtgaccggcagcacagatggcacagccaaggtgtggcaggtggccagcggctgctgccaccagacgctgcggggccacacgggtgcagtgctgtgcctagtgctagacacgcccggccacacggccttcacaggcagcaccgacgccaccatccgtgcctgggacatcctgagtggggagcagctgcgggtgttccgggagcaccggggctccgtcatctgtctggagctggtgaaccgactcgtgtactctggcagcgcggacaggaccgtcaagtgctggctggcagacacaggggagtgtgtgcgcacgttcacggcccacagacgcaacgtgagcgccctcaagtaccacgcgggcaccttgttcacgggcagcggggacgcttgcgcccgggccttcgacgcgcagtctggagagctgcggagggtgttccggggccacacattcatcatcaactgcatccaggtgcacggccaggtgctctacaccgcctcgcacgacggcgccctgcgcctctgggacgtgcgcgggctccgaggtgccccgcggccccctccgcccatgcgcagcctctcgcggctcttcagcaacaaggtgggctgcgccgccgcgcccctgcagccggcctgatcccgcggggcccctgcagacgccagcccagacacccagcggctcccagagcgccccgccctgctacccgcggtggtggcgcccgatggccggcgaggggcgaggagcgaggaagcccgggcgggaggagagcccgtcgcaggcgtctggtttttctttggtggccaggaggcgctgggagcgggagtgctcgccctggggaccgcccccttttcccttttagggtggctcctgtcctccctccccatccctgacctggcgaaaggcctagtcctggggaccctcccacctcaggggctgcaggcggactgccccagctcccccagccccacgaaactgggcctttcctgctgagaggaagtgactttttacagaagccactgaacctggttattttggcaaatcgtccgtctcgagggccttggggggaactgaaatatacagcctgaacgttaaaagtg

SEQ ID NO: 8565 - DNA, 8847 bp, Homo sapiens
acgcgcgttcagacccctggcctcgggaagtccgccggctgcggggttgggggccaaccgttctgtgggcggagtcctctcgcaacatccgccaggtagcttcttagttgctgcccctagctctaggagctcctgagtgcacacgccgtacccgtcccttgtcgggaatcctgtcgcaggtttttaagcaacagtcctcaggagggccaagggagtctgacggtgatgtcttcccccaggctcattcccctgtggaaagatttaaaactcctcctaaatgacaccataaataaaagcaagcaaccttcggaagacccaaagaactgcctgattgtgctgagtgaccggtcccaggctgtagcatggatgaagagcaaaactgaggacatggttgagaaaagaacattctccatgactgaacgattgccacccatccagtccatggtccatgcaggctcctttcatatcctcgtggtctactgtggtgacctgatcctgcgactctttggggaccactttcgggcattcaaacccctgggtaaagtgccctgccgcttcaacatcagctgcctctgctatgacccggaaatgaagatgcttctgtctggcatcctgggggcagtggtgacctgggtcattgagctaggtggcacgggcctccaaatagcccacatggtctccatgccaggtgatgagcttgtccaggacatcgtgctgaatggtcccagtggctccctcctggccctgtgtgagacggtggtgagggtccttatgcaccagggcaagggccagctgggagaggtaaagaggttcacgtccaccagcagcggctcctccatcacctgctgcttcacctgttttgatcagggctttctctatgctggaaaccaagctggggaaatccaagtttggagcctccagcagggccatccactccacagtttccaggcccatcaatcaggagtgatctgtatccgcagccgaccagaggcccacaccctgctaacagctggtagtgacagcctaatcaaggagtggaacctgacttcagggagcctgcttcggcggctagagcttggtgaggagctataccggctccagtttattgacagcattactttcttctgccaaactgcccatagtttttccttgcaccgcctgccctgcttctacagcctcttcaatgtctgtggctctgctccccagcagttgcgtcgggtctgctgtggaaataactggttccggatcctgtgtaccactgaggatggcttgttgcgctttgtgtccccagtaacaggggaccttctggttatcacctggcccttctcaatcctggaccaggctgtggattgggcctacgacccaggtaaagaggagctctttgtagcaacaggcagctcagaggttctggtatttgacacaacccgctgcccttgcccagccaagtatctcttaggcacctcaccaaattctcaggactttgtacaatgcctggcttatgggcatttcaacttggggcggggtctagagggactgatattctctgggcaccagagtggtgtgataagagtgctctcccagcacagctgtgctcgattagaaaaattcatgcactttggcgctgtactggcactctccacgctgtctggagggatttttggtggccaaggaaactctctgctctgttcctatggaatggatgactatgtgcacctgtcagaagctgtgcttgatggggtcaaagtacaactgcggcctctcgccagcattctcagcagctgtcacctaacacatctgatactcttgcccaagtctgtgggtgccatcacagagacaaactgcctgcgtctctggaagttccatgattttctgtcctctgggtcacagaatggcttgaaattcatagaaacactgcctctgcacctgtgtgccatcacatcctttgatgtctgcctctccttgagtctttttgtcacaggttctgccgatggctctgttcggatctgggacttccatggcagactcataggcattctggactcatcactgcactttggcccagtctgttttgcaaatgaccggggtgacctgcttgtgacttttaaccagagtctttacctagtgtcctgtttaaaattgcttcccccagccctgctgactcgcctttcctttatgagcatatcagatgaagtactggaagtccctaagcctttcataccaagcttcttcttctcctttgagaccatgtttgtgcccaagtacatctaccctggacaagcgcaacagaaattagtgggtctggagaaacttgtcaacaaccgggccattgcctttgaccattctgtgccacatgtgatagaagaagatgaggaagggagcccagtgttactgcgttcctccatgcattattctttgcaggacatggaagattggatgcaggtgagcaaacgttaccaatgccattatgtgcttcctccccagctacaactgactagctgggatggactcaacccctatcagatattgcgatactactttggtcatgggcgggaatggctttttgcccctgactgctatatccccaattcagtgattcgtgcccgtctttggccagagggcaccccaatatacctacagtgcaacctgcatgcaccccagcgggagctggaatgggacaggtctcaagaattctttttctggcacagcagggtaagagctataagtaatacagaatatccaaagaataaggaggaggatgaacacttcctagaaatgagactttccaaggatgtaacctacagtgtccttacagatggagcaaaccgaagttggctgggaagaaagatgagtgaaataaccattaatagcatgattgagacaatgctcaatattatggtccatgcttccttgctgaagtaccagtgctgtgttggtgcactagggcaaatctttgcctcttaccaggtgtccccagccctacgctctgagacagcccgtcggctactgaatgatacaaccaattccaacccgctgatccgagaactagcttgggaagggctgaagcgtctaggaatgattactcatctttttgccatgcctctggctcaaggattaatggacaaggatgaaagagtgaggatcaagaccctaagcctcatggctgagattggaatccactctaggacctcactcttacagctgacccaaaaacaagagacttttcgggagatgcagcagcagatgatcggggaggaacccctggaccatctactggggatgcgggccacagatctccaaatcctttccactcaagtggagcagagattgaatgaaaacctgaccctgtcacatagagatgaaaagccggctttttctttagatgtctcaatgccttctgaacttaaatcctccctgaaacctcctacagtttctgaagaatctgaagtggccatcaagcccagcaaaggccaaagacgaggccaagcaggggtcaaaaagcatagccaaaaatggttgcggggtctcaagaagacgaaagagagagactctaaacagatgagcacagagccaggcctcttagaggatgaaagtgggactgaggccgcaccaattgagatggaggaagcatccgtctattcccaatggtcttcaagcaccagtgtaataaagctctcaaaagatgttgattctcaagagaaagatatctcgaaggatcacattgcattgaccctgaagaggctgcagaaaatacgtgacaaaagagacaagaaagcaacagctcagaaactcaaaaagaagcacaaaaagaagggaaaagaagccaaagttataaatgaggaaactacacctcctgtaatggaacagccagttactaaaaaggttaaaatccaagggcggggagcctctggaatatctggccgcaggtcaaccgctggagatggctcatcatggagggacgatctatgtcgtcttatggccctgaggatatctggttcccaaacaaaaatgtcagaaaacctaaacgctgagctagtgacatttgctcaggagatgctggtagataggcaccccagctgggaactctttcaggagatctgccccctattgaagaaagaaagtaaggttctgcttgaggaccttgattgggatgtagtcccgccagagaagaaaccaatttttatccaggaaggagcaattagagaggacatgatacaaggtgtgacccaagaggtgatcagacacaaggaagtgatgccaagggaagaagaacaagcacaaaagaaagcaagagacatgctgggcttggaggaaacccaagtgattttgaaaaagggcaagaaagttatttttttagaaccaggtaatgtaaccatgggaaaagaaatatcaaagaaagaagagaagaaaacctttcagaagtcacctaagcaagggaggaaagctgtccagaaggaaagaaaagtaggaaaaataaagagggaaatgaccaaagaagagagggatatgagtgaggaagtggaggaaatggccacactagaggagaaagtggtcaaacaagaaggaaaactggttatgattgagaggacaccatcttggcaggactggaaaaaggcctgggatgagtggaaacaggtccatggtgagacaaggaaatcctggaaggcatggaaggaagaatgggagaagaggcttcttcaggaagaggagaaactacatcaggctggagagaagctatccccggaggaggaaatgcttcaggaggacaagaagctgaaatgggaggagtggaaacaagtctgggaaaatatgttatcatctaagtccaaggagcaacagtacaaggatgaggaagaagtgactttggaggaagaagtgtctcgggagggggaagaaaaagaacagcaggtcacagaagagcagagacacatccaagaagaacacaaatgggccagaatacacaggaaacgagcccgagctgaaaaaaaacgagcccaagaagagaggaaattagcacaagaagaagagaaacttgcacaagaagagagacagttggcccaggaagagagaaaactggcccaggcatacgtgaaaataacccaggatgacagggaaatggcccaggcagagggtaagtttgcccagaaagaggaaacactggcccaaagaggggagaagctaagccaggaggcggagaaattggcccagaaaaggaagaaactggccaagaaatgggagaaagtggctagagaagaagagaaactagcaaagaaaggagggaaactggctgaggtgaaaaacatattggcccagaaagtggaagaactgccccagagggaacaaaatctggactggcaagaaaaggagctggcccaggaattggaggaactggaatgggacatggaagaactgtcttggaaagaagaggaactgaatcaggaagaggggaaactggttgaggaaaagaagaaactggctgaggaagaggaggcattggcctggcaaagggagaaactgtctgaagaagagacaaaactggcccaggaagaagagttgctgatccaggaaaaggagaaactggcccagcacaaggaaaaaatgcctgaggaagaggaaagactgggacggaaaagggagcaattgattgagaagaagatgaaactggcccaaaaaagggaaagatggatcaacagcatggaagaactcacaaagaacaagatgatactgtaccagaagaagaatctggctcaggaaaagaagaatctggcccaggagaaggaaaaattggctcagaggaaagagaacctactctataataaagaaagactcacccacagcaaaaagcaattagtgcaagtaaagaacaaattgggaatgttcaacaagatactggctcaggtagaggagaagctgacacaggaaaaggagactgtgatcaagaagaaggagaaactggctgaaacagagaaaaaattggtccaagtagaggatagtttggccaaaaaacaggagaaattggcccaggaaaaaatgaaattagctctggagaaggcaatggtccaaggaaagaaacggctcagaggagagttggatattgctaaggaagaaaaggcattgaacctggaaatgaaaagactggctgaggagaagatgagactggttgagggaaaagaaacactgtctaagggagagactccagaaacttctagacaaaggaaaatgactcaagttgaacaagaactatttgagagaaaattgtcactagaggagaagatactgctacatgaagacaggatattggccatggaggaaagcgaaattgccaaaggaaaactggaatttactagaggacagagaatatttgtccaggggcaaagaaagttagccaaggcttcaaggaagttgattaaaaaaagggagagcctttccaaggaaccagcaaaactgaacaaaatcttaaaggcacttcaaaaactaaccagggatgaaaggaaactaacacaggaagaaataaaaatgacaaagatgaagagggcactctttgttaaggagcgcaggttgagtatagaacagagtaagctggatatcaaagagtgggatttttctgaaaaacgatcagaactgactaaagatgagaagaaactggctcggaagcagagaaaactggccaacaaaatgagaagaatgataaacaaagaagaaaaaatgactgaggaagagagcaaattggccagaaagcattcagaagtcatactggatgatgaagaggaaggaggaatagaagaagaagaggtaatcccattccttaaacgaaggtggagaaagaggaaagaggccaagagaggtgacaaaccaaaagaaaagttttccagtcaagtggatgaagtggaaagtgaagagcatttttctgaagaaatggaaagcctgttagatgaactagaaaagcaagagagtttgtcttctgaggaggaggaggaaagggaggaagaagaggaaagggaggaggaggaggtaagggaggaggaggaggaaaggaaggaggaggaggaaggggaggagaagcaagtggagaaagaagaggaggagaagaagaagaagaaaaaggaaaagaagaaggaggaggttcaggagaaggaagaagtgtttgaggagaaagaagaaattatgagtgaggaagagacagaaagtttgagtgacgaggaagaggaagaggagagctgctcattggaagaagaggtggacagggaaaaagagatcttaaaaaaagaaaaacaatttaagttacaagaacaaagaagaaagagcctaagaggaagggaaagagtcctttccattttaagaggagttcctcatggcaaaggcagggctataagactaggagttctaaaaagccctttgaagaaactgatgtcaacagctctggagatgaaagagaaaacaccagtgccagtgccggagaaacaaatatcctgggaagataaaaaggccacagtagttgaaatacccaggaaattcttagggacaatggataaagaaagagaagtgatgggaaaatatgaacccatacctccacatgttttgggtacagttttggagtcccaagcacaggacttaaagaccccatttatgtcccacatattaaggaggaccgtggaagctgaggaactccaacacaaaccactaggtgcctggtggaagtggtttttgcagcatccacctctgatgggacagactgaggtacagttacctctctcccaaatcccagctaaggaacaacatgcagacgtaagcctctcagatgtagagtggatccgccatgtcctagaacgaatggaagcgggagaacagctttccagggatggtttccatagactgtgccagctgctcaaagaccttgcctcaaagggaaacttagaatggctgcatctggccaaacatgaagccattgtgtaccgtcacagacaggccctggagtcacaagacacaaggatctcaagtagacagtccatgagtccaaaatacctgaaagtgattcctcctataaaagcaaaggaaaaggagagctggccaaaacctttggctgtccccacacaaaagtccccattagctaccaagaggattccagacccaagggctaaaaattggcatcttctaggagaaccttacagaagtgagagggcacagcagatatccattgctcacaaggagatggaaatgcaatacttttatcctgccaccagagacatttttccaagtgcccatgcctctgtggaaaaacaaaccctggcactgatgtttcaaaaggacttctgggattttaaggataaacgcaggtttcctaaactgcccaagttagagaagaagacacagcccatttctaaaaaaaaggaagagttgcctttgtgggagacatttgtggcactgtaccatgttttgcggatgctgcagcagcgatatccaaaagacagcactgcttggatggaacagttctaccagctcatggacctgtaccaacttaagtcccccagaatccagaagctgcttcaggagctgctaatgagagaggaacctcaaccccaagagatcatctacgaagaggccctaaaagccacagagctagttcccggggaacggctgttctgctgcctgttttgtggcagttctcatactcctagaagtcctcaggagttccagggtgcggtacccctcccatggcagaactgtgtgcgcaccatccttcccgtgggcattgcccggtatgggatcttagaacttgcctggaagagcctgcctgaagctgatcttcatctcaccaaggcactgacacacaccgttgctcccactctctaa

SEQ ID NO: 8566 - DNA, 9009 bp, Homo sapiens
gtgggcggagtcctctcgcaacatccgccaggtagcttcttagttgctgcccctagctctaggagctcctgagtgcacacgccgtacccgtcccttgtcgggaatcctgtcgcaggtttttaagcaacagtcctcaggagggccaagggagtctgacggtgatgtcttcccccaggctcattcccctgtggaaagatttaaaactcctcctaaatgacaccataaataaaagcaagcaaccttcggaagacccaaagaactgcctgattgtgctgagtgaccggtcccaggtactgttcaaagagtctcgctatcctcaaaatatgccgtgtgtatgctattacttcagtgatgcccacttcttcgcctccctctcttgggtgacatcaaacacaaaagaaatacaagctgtagcatggatgaagagcaaaactgaggacatggttgagaaaagaacattctccatgactgaacgattgccacccatccagtccatggtccatgcaggctcctttcatatcctcgtggtctactgtggtgacctgatcctgcgactctttggggaccactttcgggcattcaaacccctgggtaaagtgccctgccgcttcaacatcagctgcctctgctatgacccggaaatgaagatgcttctgtctggcatcctgggggcagtggtgacctgggtcattgagctaggtggcacgggcctccaaatagcccacatggtctccatgccaggtgatgagcttgtccaggacatcgtgctgaatggtcccagtggctccctcctggccctgtgtgagacggtggtgagggtccttatgcaccagggcaagggccagctgggagaggtaaagaggttcacgtccaccagcagcggctcctccatcacctgctgcttcacctgttttgatcagggctttctctatgctggaaaccaagctggggaaatccaagtttggagcctccagcagggccatccactccacagtttccaggcccatcaatcaggagtgatctgtatccgcagccgaccagaggcccacaccctgctaacagctggtagtgacagcctaatcaaggagtggaacctgacttcagggagcctgcttcggcggctagagcttggtgaggagctataccggctccagtttattgacagcattactttcttctgccaaactgcccatagtttttccttgcaccgcctgccctgcttctacagcctcttcaatgtctgtggctctgctccccagcagttgcgtcgggtctgctgtggaaataactggttccggatcctgtgtaccactgaggatggcttgttgcgctttgtgtccccagtaacaggggaccttctggttatcacctggcccttctcaatcctggaccaggctgtggattgggcctacgacccaggtaaagaggagctctttgtagcaacaggcagctcagaggttctggtatttgacacaacccgctgcccttgcccagccaagtatctcttaggcacctcaccaaattctcaggactttgtacaatgcctggcttatgggcatttcaacttggggcggggtctagagggactgatattctctgggcaccagagtggtgtgataagagtgctctcccagcacagctgtgctcgattagaaaaattcatgcactttggcgctgtactggcactctccacgctgtctggagggatttttggtggccaaggaaactctctgctctgttcctatggaatggatgactatgtgcacctgtcagaagctgtgcttgatggggtcaaagtacaactgcggcctctcgccagcattctcagcagctgtcacctaacacatctgatactcttgcccaagtctgtgggtgccatcacagagacaaactgcctgcgtctctggaagttccatgattttctgtcctctgggtcacagaatggcttgaaattcatagaaacactgcctctgcacctgtgtgccatcacatcctttgatgtctgcctctccttgagtctttttgtcacaggttctgccgatggctctgttcggatctgggacttccatggcagactcataggcattctggactcatcactgcactttggcccagtctgttttgcaaatgaccggggtgacctgcttgtgacttttaaccagagtctttacctagtgtcctgtttaaaattgcttcccccagccctgctgactcgcctttcctttatgagcatatcagatgaagtactggaagtccctaagcctttcataccaagcttcttcttctcctttgagaccatgtttgtgcccaagtacatctaccctggacaagcgcaacagaaattagtgggtctggagaaacttgtcaacaaccgggccattgcctttgaccattctgtgccacatgtgatagaagaagatgaggaagggagcccagtgttactgcgttcctccatgcattattctttgcaggacatggaagattggatgcaggtgagcaaacgttaccaatgccattatgtgcttcctccccagctacaactgactagctgggatggactcaacccctatcagatattgcgatactactttggtcatgggcgggaatggctttttgcccctgactgctatatccccaattcagtgattcgtgcccgtctttggccagagggcaccccaatatacctacagtgcaacctgcatgcaccccagcgggagctggaatgggacaggtctcaagaattctttttctggcacagcagggtaagagctataagtaatacagaatatccaaagaataaggaggaggatgaacacttcctagaaatgagactttccaaggatgtaacctacagtgtccttacagatggagcaaaccgaagttggctgggaagaaagatgagtgaaataaccattaatagcatgattgagacaatgctcaatattatggtccatgcttccttgctgaagtaccagtgctgtgttggtgcactagggcaaatctttgcctcttaccaggtgtccccagccctacgctctgagacagcccgtcggctactgaatgatacaaccaattccaacccgctgatccgagaactagcttgggaagggctgaagcgtctaggaatgattactcatctttttgccatgcctctggctcaaggattaatggacaaggatgaaagagtgaggatcaagaccctaagcctcatggctgagattggaatccactctaggacctcactcttacagctgacccaaaaacaagagacttttcgggagatgcagcagcagatgatcggggaggaacccctggaccatctactggggatgcgggccacagatctccaaatcctttccactcaagtggagcagagattgaatgaaaacctgaccctgtcacatagagatgaaaagccggctttttctttagatgtctcaatgccttctgaacttaaatcctccctgaaacctcctacagtttctgaagaatctgaagtggccatcaagcccagcaaaggccaaagacgaggccaagcaggggtcaaaaagcatagccaaaaatggttgcggggtctcaagaagacgaaagagagagactctaaacagatgagcacagagccaggcctcttagaggatgaaagtgggactgaggccgcaccaattgagatggaggaagcatccgtctattcccaatggtcttcaagcaccagtgtaataaagctctcaaaagatgttgattctcaagagaaagatatctcgaaggatcacattgcattgaccctgaagaggctgcagaaaatacgtgacaaaagagacaagaaagcaacagctcagaaactcaaaaagaagcacaaaaagaagggaaaagaagccaaagttataaatgaggaaactacacctcctgtaatggaacagccagttactaaaaaggttaaaatccaagggcggggagcctctggaatatctggccgcaggtcaaccgctggagatggctcatcatggagggacgatctatgtcgtcttatggccctgaggatatctggttcccaaacaaaaatgtcagaaaacctaaacgctgagctagtgacatttgctcaggagatgctggtagataggcaccccagctgggaactctttcaggagatctgccccctattgaagaaagaaagtaaggttctgcttgaggaccttgattgggatgtagtcccgccagagaagaaaccaatttttatccaggaaggagcaattagagaggacatgatacaaggtgtgacccaagaggtgatcagacacaaggaagtgatgccaagggaagaagaacaagcacaaaagaaagcaagagacatgctgggcttggaggaaacccaagtgattttgaaaaagggcaagaaagttatttttttagaaccaggtaatgtaaccatgggaaaagaaatatcaaagaaagaagagaagaaaacctttcagaagtcacctaagcaagggaggaaagctgtccagaaggaaagaaaagtaggaaaaataaagagggaaatgaccaaagaagagagggatatgagtgaggaagtggaggaaatggccacactagaggagaaagtggtcaaacaagaaggaaaactggttatgattgagaggacaccatcttggcaggactggaaaaaggcctgggatgagtggaaacaggtccatggtgagacaaggaaatcctggaaggcatggaaggaagaatgggagaagaggcttcttcaggaagaggagaaactacatcaggctggagagaagctatccccggaggaggaaatgcttcaggaggacaagaagctgaaatgggaggagtggaaacaagtctgggaaaatatgttatcatctaagtccaaggagcaacagtacaaggatgaggaagaagtgactttggaggaagaagtgtctcgggagggggaagaaaaagaacagcaggtcacagaagagcagagacacatccaagaagaacacaaatgggccagaatacacaggaaacgagcccgagctgaaaaaaaacgagcccaagaagagaggaaattagcacaagaagaagagaaacttgcacaagaagagagacagttggcccaggaagagagaaaactggcccaggcatacgtgaaaataacccaggatgacagggaaatggcccaggcagagggtaagtttgcccagaaagaggaaacactggcccaaagaggggagaagctaagccaggaggcggagaaattggcccagaaaaggaagaaactggccaagaaatgggagaaagtggctagagaagaagagaaactagcaaagaaaggagggaaactggctgaggtgaaaaacatattggcccagaaagtggaagaactgccccagagggaacaaaatctggactggcaagaaaaggagctggcccaggaattggaggaactggaatgggacatggaagaactgtcttggaaagaagaggaactgaatcaggaagaggggaaactggttgaggaaaagaagaaactggctgaggaagaggaggcattggcctggcaaagggagaaactgtctgaagaagagacaaaactggcccaggaagaagagttgctgatccaggaaaaggagaaactggcccagcacaaggaaaaaatgcctgaggaagaggaaagactgggacggaaaagggagcaattgattgagaagaagatgaaactggcccaaaaaagggaaagatggatcaacagcatggaagaactcacaaagaacaagatgatactgtaccagaagaagaatctggctcaggaaaagaagaatctggcccaggagaaggaaaaattggctcagaggaaagagaacctactctataataaagaaagactcacccacagcaaaaagcaattagtgcaagtaaagaacaaattgggaatgttcaacaagatactggctcaggtagaggagaagctgacacaggaaaaggagactgtgatcaagaagaaggagaaactggctgaaacagagaaaaaattggtccaagtagaggatagtttggccaaaaaacaggagaaattggcccaggaaaaaatgaaattagctctggagaaggcaatggtccaaggaaagaaacggctcagaggagagttggatattgctaaggaagaaaaggcattgaacctggaaatgaaaagactggctgaggagaagatgagactggttgagggaaaagaaacactgtctaagggagagactccagaaacttctagacaaaggaaaatgactcaagttgaacaagaactatttgagagaaaattgtcactagaggagaagatactgctacatgaagacaggatattggccatggaggaaagcgaaattgccaaaggaaaactggaatttactagaggacagagaatatttgtccaggggcaaagaaagttagccaaggcttcaaggaagttgattaaaaaaagggagagcctttccaaggaaccagcaaaactgaacaaaatcttaaaggcacttcaaaaactaaccagggatgaaaggaaactaacacaggaagaaataaaaatgacaaagatgaagagggcactctttgttaaggagcgcaggttgagtatagaacagagtaagctggatatcaaagagtgggatttttctgaaaaacgatcagaactgactaaagatgagaagaaactggctcggaagcagagaaaactggccaacaaaatgagaagaatgataaacaaagaagaaaaaatgactgaggaagagagcaaattggccagaaagcattcagaagtcatactggatgatgaagaggaaggaggaatagaagaagaagaggtaatcccattccttaaacgaaggtggagaaagaggaaagaggccaagagaggtgacaaaccaaaagaaaagttttccagtcaagtggatgaagtggaaagtgaagagcatttttctgaagaaatggaaagcctgttagatgaactagaaaagcaagagagtttgtcttctgaggaggaggaggaaagggaggaagaagaggaaagggaggaggaggaggtaagggaggaggaggaggaaaggaaggaggaggaggaaggggaggagaagcaagtggagaaagaagaggaggagaagaagaagaagaaaaaggaaaagaagaaggaggaggttcaggagaaggaagaagtgtttgaggagaaagaagaaattatgagtgaggaagagacagaaagtttgagtgacgaggaagaggaagaggagagctgctcattggaagaagaggtggacagggaaaaagagatcttaaaaaaagaaaaacaatttaagttacaagaacaaagaagaaagagcctaagaggaagggaaagagtcctttccattttaagaggagttcctcatggcaaaggcagggctataagactaggagttctaaaaagccctttgaagaaactgatgtcaacagctctggagatgaaagagaaaacaccagtgccagtgccggagaaacaaatatcctgggaagataaaaaggccacagtagttgaaatacccaggaaattcttagggacaatggataaagaaagagaagtgatgggaaaatatgaacccatacctccacatgttttgggtacagttttggagtcccaagcacaggacttaaagaccccatttatgtcccacatattaaggaggaccgtggaagctgaggaactccaacacaaaccactaggtgcctggtggaagtggtttttgcagcatccacctctgatgggacagactgaggtacagttacctctctcccaaatcccagctaaggaacaacatgcagacgtaagcctctcagatgtagagtggatccgccatgtcctagaacgaatggaagcgggagaacagctttccagggatggtttccatagactgtgccagctgctcaaagaccttgcctcaaagggaaacttagaatggctgcatctggccaaacatgaagccattgtgtaccgtcacagacaggccctggagtcacaagacacaaggatctcaagtagacagtccatgagtccaaaatacctgaaagtgattcctcctataaaagcaaaggaaaaggagagctggccaaaacctttggctgtccccacacaaaagtccccattagctaccaagaggattccagacccaagggctaaaaattggcatcttctaggagaaccttacagaagtgagagggcacagcagatatccattgctcacaaggagatggaaatgcaatacttttatcctgccaccagagacatttttccaagtgcccatgcctctgtggaaaaacaaaccctggcactgatgtttcaaaaggacttctgggattttaaggataaacgcaggtttcctaaactgcccaagttagagaagaagacacagcccatttctaaaaaaaaggaagagttgcctttgtgggagacatttgtggcactgtaccatgttttgcggatgctgcagcagcgatatccaaaagacagcactgcttggatggaacagttctaccagctcatggacctgtaccaacttaagtcccccagaatccagaagctgcttcaggagctgctaatgagagaggaacctcaaccccaagagatcatctacgaagaggccctaaaagccacagagctagttcccggggaacggctgttctgctgcctgttttgtggcagttctcatactcctagaagtcctcaggagttccagggtgcggtacccctcccatggcagaactgtgtgcgcaccatccttcccgtgggcattgcccggtatgggatcttagaacttgcctggaagagcctgcctgaagctgatcttcatctcaccaaggcactgacacacaccgttgctcccactctctaatttgggactgactggaggctgggacttttcattgccaactggagaaaggcctaattaccaggatctagaccttcatctctctctctctcttttttttttttttgagacg

SEQ ID NO: 8567 - DNA, 1724 bp, Homo sapiens
gcgggcgcgggcgcgggcgcgcggcgccaccgttcccatccaggcttgtcggcggccaccggcggaccgggcttcgagatggcctccccgccgcggtgctccccgacagcccatgacagggaatgcaagttgccgccaccctccgcccccgccagcgagtattgtcccggcaagctgtcctgggggaccatggcgagggccttaggccgcttcaagctgtcgatcccgcacacgcacctgctggccaccctcgaccccctggccttggacagggaaccaccaccgcatctgttgcctgagaagcaccaggtgccggagaaattgatctggggcgaccaggaccctctctccaagatcccatttaaaattctgagtgggcacgagcacgctgtgagcacctgccacttctgtgtggatgacacaaagctcctcagtggctcctatgactgcactgtgaagctgtgggatccggtggacggttctgtggttcgcgattttgagcacaggcccaaagctcctgttgtagagtgcagcatcaccggcgacagcagcagagtcattgccgcatcctatgataagacagtgagggcctgggacctggagacaggcaagctgctgtggaaggtcaggtatgataccttcatcgtctcctgtaagttttctcctgatggtaaatacgtggtctcaggcttcgacgtggatcatggaatctgcataatggacgccgagaacatcaccaccgtttccgtcatcaaagatcatcacacaaggtccatcacgtcatgctgctttgaccccgacagccagagggtggcttctgtctcattggacaggtgcatcaagatctgggatgttacatcccaggccacgctgctcaccatcactaaggcacattccaatgcaatctcaaactgctgttttaccttcagtggccatttcctgtgtacaagctcctgggataaaaacttaaaaatatggaacgtccacacaggggagtttcgaaactgtggagcctgtgtgactctgatgcagggccatgaaggttctgtcagttcctgtcactttgccagagacagctcttttctcatttctggagggtttgataggactgtggctatttgggatgtagcagaaggctaccggaagctctctttgaagggccataatgactgggtgatggatgttgccattagcaacaacaagaaatggatcctgtctgcttccaaggataggaccatgagactgtggaatattgaagaaattgatgaaattcctttggtaatcaagtacaaaaaggccgtgggcttaaagttgaaacagtgcgaaagatgtgacaggcctttctccatcttcaagagtgacacctcttctgaaatgttcacccaatgcgtgttctgccggatagatacaaggggcttgccagcagatacttcatcgtcatcatcatcatcggaaagggagaactcaccgccgccaaggggaagcaaggatgactgacagccacaggcccctttgagtgactccagcacaggctacctagcatgtaggtttcggggctttgcaggggctttctcttgggcccctcccaggctcagcaggcctgtcagactggggcaggacccaagccctggctggactcagcacagtgccacctcctcagctctcagcttggggagtgaacactttccgttttcatgcagaataaatctaattcctttggaaaa

SEQ ID NO: 8568 - DNA, 1835 bp, Homo sapiens
gcgggcgcgggcgcgggcgcgcggcgccaccgttcccatccaggcttgtcggcggccaccggcggaccgggcttcgagatggcctccccgccgcggtgctccccgacagcccatgacagggaatgcaagttgccgccaccctccgcccccgccagcgagtattgtcccggcaagctgtcctgggggaccatggcgagggccttaggccgcttcaagctgtcgatcccgcacacgcacctgctggccaccctcgaccccctggccttggacagggaaccaccaccgcatctgttgcctgagaagcaccaggtgccggagaaattgatctggggcgaccaggaccctctctccaagatcccatttaaaattctgagtgggcacgagcacgctgtgagcacctgccacttctgtgtggatgacacaaagctcctcagtggctcctatgactgcactgtgaagctgtgggatccggtggacggttctgtggttcgcgattttgagcacaggcccaaagctcctgttgtagagtgcagcatcaccggcgacagcagcagagtcattgccgcatcctatgataagacagtgagggcctgggacctggagacaggcaagctgctgtggaaggtcaggtatgataccttcatcgtctcctgtaagttttctcctgatggtaaatacgtggtctcaggcttcgacgtggatcatggaatctgcataatggacgccgagaacatcaccaccgtttccgtcatcaaagatcatcacacaaggtccatcacgtcatgctgctttgaccccgacagccagagggtggcttctgtctcattggacaggtgcatcaagatctgggatgttacatcccaggccacgctgctcaccatcactaaggcacattccaatgcaatctcaaactgctgttttaccttcagtggccatttcctgtgtacaagctcctgggataaaaacttaaaaatatggaacgtccacacaggggagtttcgaaactgtggagcctgtgtgactctgatgcagggccatgaaggttctgtcagttcctgtcactttgccagagacagctcttttctcatttctggagggtttgataggactgtggctatttgggatgtagcagaaggctaccggaagctctctttgaagggccataatgactgggtgatggatgttgccattagcaacaacaagaaatggatcctgtctgcttccaaggataggaccatgagactgtggaatattgaagaaattgatgaaattcctttggtaatcaagtacaaaaaggccgtgggcttaaagttgaaacaggaaaagaaagaggcctacctgaagctgaagcaaggatgagcctgctgcatttgacttgctctgaatcaatcaacatgagaagcctgaggccaggcttccccgaggcctgccccagtgcgaaagatgtgacaggcctttctccatcttcaagagtgacacctcttctgaaatgttcacccaatgcgtgttctgccggatagatacaaggggcttgccagcagatacttcatcgtcatcatcatcatcggaaagggagaactcaccgccgccaaggggaagcaaggatgactgacagccacaggcccctttgagtgactccagcacaggctacctagcatgtaggtttcggggctttgcaggggctttctcttgggcccctcccaggctcagcaggcctgtcagactggggcaggacccaagccctggctggactcagcacagtgccacctcctcagctctcagcttggggagtgaacactttccgttttcatgcagaataaatctaattcctttgg

SEQ ID NO: 8569 - DNA, 1687 bp, Homo sapiens
gccagaaagcagattttcacttgggaagagacgacccgtagtatgggatgtggtatgataccagcaactggtctattatatcatttaaaccacatggctatctaaagaggtatttggctattataaataaaatagtgatgaacacgtgtacaggtgtttgtacggacataagttgtcatttctcttgagtaaatacctaaaagtgggcttgctggagttttactacccttggatgctgctgttgacatggaaaagattgaggaacaatttgctaatctgcacattgttaaatgttccttaggaaccaaagagcccacttaccttcttggtatagacacatcaaagactgtccaagcaggaaaggaaaacttggttgctgttttatgttctaatggatcaatcagaatatatgataaagaaaggttaaatgtactacgagaatttagtggatatcctggacttcttaatggagtcagatttgcaaattcctgtgacagtgtatattcagcatgtactgatggcactgtgaaatgctgggatgctcgagtagccagagaaaaacctgttcagctcttcaagggttacccttccaatatttttatcagttttgatattaattgtaatgatcatattatttgtgctggtacagaaaaagttgatgatgatgcattgttggtgttttgggatgcaaggatgaattctcagaatttatctacaactaaagactcacttggtgcatattcagagacacatagtgatgatgtcactcaagtacgtttccatcccagcaatcccaacatggtagtctcaggttcatctgatggcctggtaaatgtatttgatattaatattgataatgaggaggatgcactggttacaacctgtaactcaatttcatcagtaagctgtattggttggtctgggaaaggttataaacagatttactgcatgacacatgatgaaggattttattggtgggatcttaatcatctggacactgatgaaccagttacacgtttgaacatccaggatgtcagagaagtagttaacatgaaagaagatgctttggactatttgattggtggcctatatcatgaaaagacagacacattgcatgttattggaggaacaaacaaaggaaggattcatttgatgaactgcagcatgtcaggactgacccatgtgactagccttcagggagggcatgctgctacagtccgttctttctgttggaatgtgcaagatgattctttgttgactggaggagaagatgcacagttgttactttggaaacctggagctatagagaagacctttacaaagaaagagagtatgaaaatagcatcctctgtgcaccaacgagtacgagttcatagtaatgattcttataaaagaaggaaaaagcagtgataatgcatttggcactttgtttggtaggttttatagtttcaaatagtccttcttgtttactacccatggtagacatgtttaaagctttatgtaaaaacaagccagttagcaaacagtcctggaaaaatatggtgagaatggtttaattccggtcttcacatattctaaaaaattttaaagcctctaagtataaaatcagtgagttgaaagtaaaatttcttatttaaagaacccatctgttaatgtagtaaatgttggctttaaagaaatagctccg

SEQ ID NO: 8570 - DNA, 2993 bp, Homo sapiens
accgctctaagccgccgcgcagcctgcgttttctccggtacaggttgaggctactaagagttttactacccttggatgctgctgttgacatggaaaagattgaggaacaatttgctaatctgcacattgttaaatgttccttaggaaccaaagagcccacttaccttcttggtatagacacatcaaagactgtccaagcaggaaaggaaaacttggttgctgttttatgttctaatggatcaatcagaatatatgataaagaaaggttaaatgtactacgagaatttagtggatatcctggacttcttaatggagtcagatttgcaaattcctgtgacagtgtatattcagcatgtactgatggcactgtgaaatgctgggatgctcgagtagccagagaaaaacctgttcagctcttcaagggttacccttccaatatttttatcagttttgatattaattgtaatgatcatattatttgtgctggtacagaaaaagttgatgatgatgcattgttggtgttttgggatgcaaggatgaattctcagaatttatctacaactaaagactcacttggtgcatattcagagacacatagtgatgatgtcactcaagtacgtttccatcccagcaatcccaacatggtagtctcaggttcatctgatggcctggtaaatgtatttgatattaatattgataatgaggaggatgcactggttacaacctgtaactcaatttcatcagtaagctgtattggttggtctgggaaaggttataaacagatttactgcatgacacatgatgaaggattttattggtgggatcttaatcatctggacactgatgaaccagttacacgtttgaacatccaggatgtcagagaagtagttaacatgaaagaagatgctttggactatttgattggtggcctatatcatgaaaagacagacacattgcatgttattggaggaacaaacaaaggaaggattcatttgatgaactgcagcatgtcaggactgacccatgtgactagccttcagggagggcatgctgctacagtccgttctttctgttggaatgtgcaagatgattctttgttgactggaggagaagatgcacagttgttactttggaaacctggagctatagagaagacctttacaaagaaagagagtatgaaaatagcatcctctgtgcaccaacgagtacgagttcatagtaatgattcttataaaagaaggaaaaagcagtgataatgcatttggcactttgtttggtaggttttatagtttcaaatagtccttcttgtttactacccatggtagacatgtttaaagctttatgtaaaaacaagccagttagcaaacagtcctggaaaaatatggtgagaatggtttaattccggtcttcacatattctaaaaaattttaaagcctctaagtataaaatcagtgagttgaaagtaaaatttcttatttaaagaacccatctgttaatgtagtaaatgttggctttaaagaaatagctccgataaggactttttagaaggaaatacttggtaaaacttaataaaacaggtggttggctgcattttttaagcccagttttttacattttaaattgtctttattgtgtataaaaccagattagactatattcttcatctgaggagcatctatatgtttaatacacctaatgtattatgctggagtatttaaatgtaagtattttaatgagtaaatagaattaaccttttttacaaatgaaatgataggcatctatgtaaagtgagaaaaatatgtttcgtaaatatttgcatctttaatattgttagtaagtagtaaacaggtgttttgctgattgaaaggaagttatcttggtaaattgagactcaaagtgaaatacaaaaatgaaaatatttataataggactcgacttggagaaattgctattcttcctgttgtccaaaccataaatctgaggataacctgggcttttctctttcctcttctcctaaccagtttttcaccaagtcctgtgccatttcacctcctaacgtctgtcagctatccttttgcctttacctcaccactattaccctagagaagactttcattatttctcatctggattaccagctcgatctctaatctgcttcagttcatccttcttgctacttctaggctaaacatcaaaaacagatctggtaggggcggggaaatgagggggaagaaacaaaaacgtgatggtgcctcatgctgcttaaaatcttcagtacattgatgttttgatggcggactacataagcgttaaaaattgtgtttttcagaatctttaaaatataagacagtgctatctagtgaataaaaaaattagtttgaaagatatctggagaaatcgcattcataaaacaattggaagtgaaactattaaaacaatagggctttttaaaattaaaaatatttaaaattcaaaagtaattaatagtgttggaagatgtaggtgagaaaatattcctgaaagtagaactgaaagagacaaagagaaaagatgaaagccacagaagataaatacaggggtcaaaaccagactaacagttttagaaagtgaaaaaagttaaaaaagaaatgggggcagtgggttattagaaataacataaatggctggtatggtttgtctgtgtcctcacccaaatttcatctcgaattgtaatccccataatccccatgtgtctagggagagacctggtgggaggtgattggatcatgggggtggtttcccctacgatgttctcctgatagtgggtgagttctcacaagatctgatggttttataaagggctctgcccctttaactcctcactctttctcctgaagccttgtgaagaaggtgctttgcttcccctttgcgttcccccatgattgtaagtttcttgaggcctccctggccatgctgaactcttcagtcaattaaacactttcctttataaatta

SEQ ID NO: 8571 - DNA, 1454 bp, Homo sapiens
ctttcagcctcagtctgcagcctgctagggacgcacggccacactcctgtctttcagcctcagtctgcagcctgctagggacgcacggccacactcctgtctttcagcctcagtctgtagcctgctagggatgcacggccacgctcctgtctttgaggtgctgtcagaacagctttctcctcggtatcccgccgggtttgactggctagtgggcttgctttggtttggactcacccagatctagtgcagggacacacacgggggccggcattgctcctttccgccatgtggagttggccggggccagaggcacatgctctggtttggacagcccggccctgggggctggaataggaaatgcctgcgtccctttaccctgcccaggggccaacacccccagcctagctacggcttcccccaggtgaacgaggtggtcttcagccccggggagtcccactgcgccacatgcagtgaggatgggagtgtgcgggtgtgggccttggccagcatggagcttgtgatccagttccaggtgctgaaccagagctgcctctgcctggcatggagccccccgtgctgtggccgccctgagcagcagcggctagcggctggctacggtgacggctccctgcgcatcttcagcgtctcccgcacggccatggagctcaagatgcacccccacccggtggcgctgaccactgttgccttctccaccgatggtcagactgtcctctctggagacaaggatgggctcgtggctgtgagccacccctgcacagggacaaccttccgtgtgctgagtgaccaccagggcgccccaatctctaccatctgtgtcacgtgcaaagagactcagggccacctgccaccctccctcgctgccttctgcccttgggatggggcgctcctgatgtacgtgggccccggtgtttacaaggaggtgatcatctacaacctctgccagaagcaggtggtggagaagataccactgcccttttttgccatgtccctgagcctgtcccccgggacccacctcctggctgttggctttgctgagtgcatgctgaggctggtagactgtgccatggggactgcccaagactttgccggccacgacaacgcagtgcacctgtgcaggtttacaccgtccgccaggctgctcttcacggccgcccgcaacgagatccttgtgtgggaggtccccggcctctgagatgcagcagggactgtggtggtgggcatcacgcctggtcatgccaggcacctggacacaggcttggcagaggcgccaggttgtcaatggcctcatgctgggacaggccaggattcacgtaaatcgcctggagcaagctgttgtaaatttggcgccctgtgaatactttcatacctgttgcccttttgcctaagaaatctttaatgtttctatcttgtaataaacatgggcatttattgca

SEQ ID NO: 8572 - DNA, 5488 bp, Homo sapiens
atggcccgagcgtggcagcacccgttcctcaacgtcttcagacacttccgggtggacgagtggaagcgctccgccaagcagggggacgtggccgtggtcacggacaagaccctgaagggcgccgtgtatcgcattcggggctcagtctctgccgccaactacatccagctccctaagagcagcacccagtctctggggctgacgggacgatacctgtatgtgctctttcggcccctgcccagcaagcacttcgtcatccacctcgatgtgtcctccaaggacaaccaagtcatccgtgtgtctttctccaacctcttcaaggagtttaagtctacggccacgtggctccagtttcccttggtcctggaggccaggacacctcagagagatctggtgggtttggccccctccggagcccgctggacctgcctgcagctcgatctgcaggacgttctcctggtctacctgaaccggtgctacggccatctcaagagcatcaggctgtgcgccagcctgctggtcaggaacctgtacaccagtgacctgtgctttgagcctgccatctctggggcccagtgggcaaagctgcccgtgactcctatgcctcgggaaatggcattccctgtgcccaagggagagagctggcatgaccgctacatccacgtccggtttccaagtgagagcttgaaagtgccttccaagccgattgagaagagctgttcccctcctgaggcagtcctcctggggccggggccacagcctctcccttgcccggtggcctccagcaaacctgtgcggttcagtgtgtctccagtggtccagacgcccagccccacagcctccggccgggccgccttggcacccaggcccttcccggaggtcagcctgtcccaagagcgctcagacgcctccaacgcggatggccccggtttccatagccttgagccctgggcccagctggaggcctctgacatccacacggctgctgccggcacccacgtgttgactcacgagtcggctgaggtgcccgtggcccgcaccggctcctgcgaaggcttcctcccagacccagtcctgaggctcaagggcgtcatcggctttgggggccacggcaccagacaggccctgtggaccccagacggggcggctgtcgtgtacccctgccatgcggtcatcgtcgtcctgctcgtggacacgggggagcagcgcttcttccttggccacacagacaaggtctccgccctggcgctggatggcagcagctcactattggcctcggcccaggcaagggcccctagtgtgatgcggctctgggacttccagaccgggcggtgcttgtgcctgttccggagcccaatgcacgttgtctgctctctcagcttctctgacagcggggcccttctctgcggggttggcaaggaccaccacgggaggacgatggtggtggcctggggcaccggccaggtgggcctcggtggcgaggtggtcgttctggcaaaggcgcacactgactttgacgtccaggccttccgggtcaccttttttgatgaaaccaggatggcgtcgtgcgggcagggcagtgtgcggctctggcggctgcgtggcggggtgctgcgttcctgccccgtggacttaggggagcaccacgcgctgcagttcaccgacctggccttcaagcaggcccgggacggctgcccggagccctcggctgccatgctcttcgtgtgcagccgcagtggccacatcttggagattgactgtcagcgcatggtcgtgcggcatgcccgccgcctgctccccacacggactccaggcggtccccacccacagaagcagaccttcagctcaggccccggcattgccatcagcagcctcagcgtctccccggccatgtgtgctgtgggctctgaggacggcttcttgcggctctggcccctggacttctcctcggtgctcctggaggcagagcacgagggccccgtcagctcagtctgtgtcagccccgatggcctccgtgtgctgtctgccacctcctcgggccacctgggcttcctggacacgctgtcccgggtgtaccacatgctggctcgctcccacaccgccccggtgttggccctcgccatggagcagaggcggggacagctggccaccgtgtcccaggaccgtaccgtccgcatctgggacctggccaccctgcagcagctatacgacttcacatcatcagaggacgccccgtgcgctgtcaccttccaccccacaaggccaacctttttctgtggctttagcagtggggccgtgcgctccttcagcctggaggccgctgaggtcctggtggaacacacgtgccaccgaggagctgtcaccggcctgaccgccacccctgacggccgcctgctcttcagctcctgctcccagggctccctggcccagtacagctgtgcggacccccagtggcatgtcctccgagtggcagcggacatggtatgcccggatgcccccgcgagccccagcgccctggcagtcagcagggatggccgcctgctggcctttgtgggaccctccaggtgcacagtgacagtcatgggctcggcctcccttgatgagctgctgcgagttgacatcggcactctggacctggccagcagccgcctggactcagccatggctgtgtgctttggccctgcagctctgggccacctgctggtgtccacctcgtccaacagagtcgtggtgctggatgctgtgtcgggccgcatcatccgggagctgcccggtgtccaccctgagccctgcccctccttgacgctcagtgaggacgcccgcttcctgctgattgccgccggccggaccatcaaggtgtgggactacgccacacaggccagcccaggcccccaggtgtacatcggccactcggaacccgtgcaggctgtggccttctctcctgaccagcagcaggtcctcagcgcaggggacgccgtcttcctctgggatgtcctggcccctactgagagcgaccaaagcttccccggggcccccccagcctgcaagacaggcccgggcgcaggaccgctggaggacgcagcgtccagggccagcgagctcccccggcagcaggtccccaagccatgtcaggcatctccaccacggctgggcgtctgtgccaggcctcccgaaggtggcgatggcgccagggacaccaggaattcgggggccccacgcaccacctacctggcttcctgcaaggccttcacgcctgccagggtcagctgcagcccccactctgccaagggcacttgcccgcctcccgccagcggtgggtggctgcgtctgaaggctgtcgtcggttacagcgggaatgggcgggccaacatggtctggaggccggacacaggcttctttgcctacacgtgcggccgcctggtggtggtggaggacctgcactctggcgcccagcagcactggtccggccactctgcggagatctccacgctggccctcagccacagtgcccaggtcctggcctctgcctcgggccgaagcagcacgaccgcccattgtcagatccgcgtctgggacgtgtctggcggcctctgccagcatctcattttcccccatagcaccaccgtgctggccctggccttctcaccagatgacaggcttcttgtcacactgggggaccacgatggccgcaccctcgccctgtggggcacggccacctatgacctcgtgtcctccacccgcctcccggagccggtgcatggtgtggccttcaacccctgggacgccggcgagctcacctgtgtgggccagggcactgtcaccttctggctccttcagcagcgtggggcagacatcagccttcaggtgcgtcgagagccagtcccagaggcagtgggggctggagagctgacctcgctctgctacggggcacctcccctgctctattgtggcaccagctctggccaggtctgtgtctgggacacgcgtgccggccgctgcttcttgtcctgggaggcggatgacggtggcattgggctgttgctgttctcgggttctcgattggtcagcggcagcagcacggggcggctgcgcctgtgggccgtgggggctgtgtcggagctgaggtgcaagggctcaggcgccagttctgtgttcatggaacacgagctggtgctggacggggctgtggtgagtgccagcttcgatgacagcgtggacatgggcgtcgtgggcaccacggcgggcacgctgtggtttgtcagctgggccgagggcaccagcacacgtctcatcagtggccacaggagcaaggtgaacgaggtggtcttcagccccggggagtcccactgcgccacatgcagtgaggatgggagtgtgcgggtgtgggccttggccagcatggagcttgtgatccagttccaggtgctgaaccagagctgcctctgcctggcatggagccccccgtgctgtggccgccctgagcagcagcggctagcggctggctacggtgacggctccctgcgcatcttcagcgtctcccgcacggccatggagctcaagatgcacccccacccggtggcgctgaccactgttgccttctccaccgatggtcagactgtcctctctggagacaaggatgggctcgtggctgtgagccacccctgcacagggacaaccttccgtgtgctgagtgaccaccagggcgccccaatctctaccatctgtgtcacgtgcaaagagtgtgaagacttaggggtggagggcacagacctatggctggctgccagtggggaccagcgggtcagcgtctgggcctccgactggctgcggaaccactgtgagcttgtggactggttgagtttcccaatgcctgccaccacggagactcagggccacctgccaccctccctcgctgccttctgcccttgggatggggcgctcctgatgtacgtgggccccggtgtttacaaggaggtgatcatctacaacctctgccagaagcaggtggtggagaagataccactgcccttttttgccatgtccctgagcctgtcccccgggacccacctcctggctgttggctttgctgagtgcatgctgaggctggtagactgtgccatggggactgcccaagactttgccggccacgacaacgcagtgcacctgtgcaggtttacaccgtccgccaggctgctcttcacggccgcccgcaacgagatccttgtgtgggaggtccccggcctctgagatgcagcagggactgtggtggtgggcatcacgcctggtcatgccaggcacctggacacaggcttggcagaggcgccaggttgtcaatggcctcatgctgggacaggccaggattcacgtaaatcgcctggagcaagctgttgtaaatttggcgccctgtgaatactttcatacctgttgcccttttgcctaagaaatctttaatgtttctatcttgtaataaacatgggcatttattgca

SEQ ID NO: 8573 - DNA, 4506 bp, Homo sapiens
tttctcccaggccccgcccctccgtccctcaccgcaccacccctaaagacgctagcgctgcgatggcggaggccgtggagcgcactgacgagctggtccgggagtacctgctcttccgcgggttcacgcacacactgcggcagctggacgccgagatcaaggcggacaaggagaaggggttccgggtggataagattgtggaccagctgcagcagttaatgcaggtgtatgacttggctgcccttcgggattattggagctacttggagcgtcggctcttcagccgcttggaggatatatacagacccacaatccacaagctgaaaaccagcctgtttcgattttatcttgtctacacaatccagacaaacagaaatgacaaggctcaggagttctttgcaaagcaggccacggaactccagaaccaggctgagtggaaggattggtttgtcctgcccttcctgccatccccggacaccaaccccacctttgctacctacttttctcgacagtgggctgacaccttcattgtgtccctgcacaacttcctgagcgtcctgtttcagtgcatgccagtccctgtgatcctgaactttgatgcggagtgtcagaggactaaccaggttcaagaagaaaatgaagttctgcgtcagaagctttttgcattgcaagctgaaatccaccgactgaagaaagaggagcaacagccagaagaggaagaggccttggtccaacacaaattgcctccttatgtctccaacatggaccgcctgggggactcggaacttgccatggtgtgcagccaaaggaatgcctccctctcccagtcacctcgtgtgggcttcctgtcctcgctgctgcctcagagtaagaagagcccctcaaggttgtcgcctgctcagggccctcctcaacctcagagctcggccaagaaagagtccttcggtggtcagggcaccaagggaaaggacccgacgtccggagccaaggatgggaagagcctcctcagcgggctggccactggggagtccggttggtcacagcaccggcagcggcgcctgcaggaccatggcaaggagaggaaggagcttttctccacaaccacttcccagtgtgcagagaagaaaccagaagccagtggcccagaggctgagccctgcccagagctccacacggagccagtggagccactgactcgggcatcctcggcaggccctgagggtggaggagtccgccccgagcagccctttattgtgctgggacaggaggagtacggggaacaccactcatccatcatgcactgcagagtggactgctctgggaggagagtcgccagcttagacgtagatggggtcatcaaagtgtggtccttcaaccccatcatgcagaccaaagcatcctccatttccaaatcaccgctgctgtctttggaatgggccaccaaacgggacagactgctcttgctgggcagtggtgtgggaacagtgcgtctctatgacacggaagccaagaagaatctctgtgaaatcaatatcaacgacaacatgcccagaatcctgtctcttgcgtgcagccccaacggggcctctttcgtctgttcggcagcagctccgagcctcacttcccaggtggacttctcagcaccagacatcggcagcaagggcatgaaccaggttcctggcaggctgctgctgtgggacacgaaaaccatgaagcagcagctccagttctccctggatccagaacccattgctatcaactgtacagccttcaatcacaacgggaacctgctggtcacaggggcagctgatggcgtcatccggctgtttgttcatccagtggaacatccacaagagtggcctcaaggtatccgagtacagcctcccctcagatgccacgggcccctttgtgctgtctggatacagcggctacaagcaggttcaagtccccaggggccgactcttcgcttttgactcggagggaaattacatgctgacatgttctgccacaggcggcgtcatctacaagctgggtggcgatgagaaggttctggagagctgcttgagcctaggtggccaccgagcccctgtggtcaccgtggactggagcactgccatggactgtgggacctgcctcaccgcctccatggatggcaagatcaagctgaccaccctcctggcccataaagcctgatgacttgccccaagggccacccgaggaagcagtattatctgcggtggggggaggagatataggacaggaaaaccacgtgctccactccagctccctgccagtgcagtgactctgcagggaaagactggcaaggaggctcaggtgcttccatctgtggtgactggaatgggacccacgtggagtaggtgacatatgcttcccagagactggtattgtggctgtgccaggagtacatgtgagactatgggaggaaagctccggaagaaggagaaacattgcagtggctactgtgttggcccagtagaaattgacagtattttgtatatatgtgcccatttatctttttcttttttaaaaaaagagaatactcttgtggtcccctgatgtctctttctaggatgtgtgtcactttgcttcagtgacagccctcccacccagcctggctctgctggccctgaactgaacctctccaggctctcctgttgctttgccatggagccaggtcagctctctgtctgttctgctgggtaacaaggtttggcagttcctgtttctctgggcttaagtcaaggccacagaattctttttcttccctgaaagctggcagcttttgttacagaagattctcaggatgaaggcaggggctgaggcctctgctactggctgcccctttccatccagtggctgctgtttcccaagacaggctaagcgtttcttatctgaaatgcttgggacaggagtgttacagattttggattttttcagactttggaatatttgcatatatacataatgaggtatcttggtaggtctcatgtctaaacatgaaattcattcatgttttatatataccttatacatgtagcctgaaggtaactctatacagtattttaaataattttgtacatgaaacaaagtattgattgtggtcaggtgtggtattttccacttgtggtgtcatgttggtgctcacagttttggggctgggcacggtggctcacgtctgtaatcccagcactttgggaggccaaggtgggtggatcacttaaggtcaggagcttgagaccagcctggccaacatggtgaaaccccatctctactaaaaataccaaaattagccaggcatggtggcaggtgcctataatcccagctactctggaggctggggcaggagaatcacttgagcccaggaggcggaggttgcagtgagccgagatcacgccactgggagaacccaactcaaaaaaaaaaaaagttttgggttatggagcatttttgattttggatctttgggttaaggacgctcaacctgtacctttttcatttggtggctcctctcattcctccaactgaacatctttgtggaaagatgatggctgcctgcacccactgctggcgaatggtgagaaggtagagcaagggggccaagttgctgctggtgggcacctggggttcaggccggcccaactgtggctgagccgatctgtagctgagctgagtgtcaaccagctgtgtccacaccctgcctgaggcctgccctctcctccctggctggggtgggaccttgaagaggcatatcttcccactaggtgaggaggaacaagagcctcactccccttctccctcttgcctttcacagctgaggcagagcttatgggaggagtcactatgggagtgatggacctgggctttggtctccagtgtttggcaggggcgaccttatcactgagctggggaaggcagctgccatgagtcattttaagtctctgagctccagcccagttctaggggcacaaggctggagtagggatactcctagttacctgcttgaggaaaagcacgaagaaattggtaccaaagtcttggctttgttctgggagttgagggaaaagtagggaggtatttaagtggcttgattatgagaaaacaccagagacagtagtaaatagttatttaccgatttttacccatttctaccctggtaatcctccctgcaaatgaagaaaaccaagacttctttatttattatctttccccatctgtattgaaacagtgatcttacttatctcacccagtgattctgtaggacatttaaaaagtggtcatgggtttcattggagtgagaatggtattaacgtttcctcttgtcatctcaaagttttctctccccttaataccatctctacagcttgctgagatgctttaaggatcacagagacacaaagaaaatttgaaccctacgcttctcccatcccacttcttactccatcccgggtgagcgctcgtcctcaaataaagcatgttggaacttcc

SEQ ID NO: 8574 - DNA, 4588 bp, Homo sapiens
accgcaccacccctaaagacgctagcgctgcgatggcggaggccgtggagcgcactgacgagctggtccgggagtacctgctcttccgcgggttcacgcacacactgcggcagctggacgccgagatcaaggcggacaaggagaaggggttccgggtggataagattgtggaccagctgcagcagttaatgcaggtgtatgacttggctgcccttcgggattattggagctacttggagcgtcggctcttcagccgcttggaggatatatacagacccacaatccacaagctgaaaaccagcctgtttcgattttatcttgtctacacaatccagacaaacagaaatgacaaggctcaggagttctttgcaaagcaggccacggaactccagaaccaggctgagtggaaggattggtttgtcctgcccttcctgccatccccggacaccaaccccacctttgctacctacttttctcgacagtgggctgacaccttcattgtgtccctgcacaacttcctgagcgtcctgtttcagtgcatgccagtccctgtgatcctgaactttgatgcggagtgtcagaggactaaccaggttcaagaagaaaatgaagttctgcgtcagaagctttttgcattgcaagctgaaatccaccgactgaagaaagaggagcaacagccagaagaggaagaggccttggtccaacacaaattgcctccttatgtctccaacatggaccgcctgggggactcggaacttgccatggtgtgcagccaaaggaatgcctccctctcccagtcacctcgtgtgggcttcctgtcctcgctgctgcctcagagtaagaagagcccctcaaggttgtcgcctgctcagggccctcctcaacctcagagctcggccaagaaagagtccttcggtggtcagggcaccaagggaaaggacccgacgtccggagccaaggatgggaagagcctcctcagcgggctggccactggggagtccggttggtcacagcaccggcagcggcgcctgcaggaccatggcaaggagaggaaggagcttttctccacaaccacttcccagtgtgcagagaagaaaccagaagccagtggcccagaggctgagccctgcccagagctccacacggagccagtggagccactgactcgggcatcctcggcaggccctgagggtggaggagtccgccccgagcagccctttattgtgctgggacaggaggagtacggggaacaccactcatccatcatgcactgcagagtggactgctctgggaggagagtcgccagcttagacgtagatggggtcatcaaagtgtggtccttcaaccccatcatgcagaccaaagcatcctccatttccaaatcaccgctgctgtctttggaatgggccaccaaacgggacagactgctcttgctgggcagtggtgtgggaacagtgcgtctctatgacacggaagccaagaagaatctctgtgaaatcaatatcaacgacaacatgcccagaatcctgtctcttgcgtgcagccccaacggggcctctttcgtctgttcggcagcagctccgagcctcacttcccaggtggacttctcagcaccagacatcggcagcaagggcatgaaccaggttcctggcaggctgctgctgtgggacacgaaaaccatgaagcagcagctccagttctccctggatccagaacccattgctatcaactgtacagccttcaatcacaacgggaacctgctggtcacaggggcagctgatggcgtcatccggctgtttgacatgcagcagcatgagtgcgcgatgagctggagggcccactacggggaggtctactctgtggagttcagctatgatgagaacaccgtgtacagcatcggcgaggacgggaagttcatccagtggaacatccacaagagtggcctcaaggtatccgagtacagcctcccctcagatgccacgggcccctttgtgctgtctggatacagcggctacaagcaggttcaagtccccaggggccgactcttcgcttttgactcggagggaaattacatgctgacatgttctgccacaggcggcgtcatctacaagctgggtggcgatgagaaggttctggagagctgcttgagcctaggtggccaccgagcccctgtggtcaccgtggactggagcactgccatggactgtgggacctgcctcaccgcctccatggatggcaagatcaagctgaccaccctcctggcccataaagcctgatgacttgccccaagggccacccgaggaagcagtattatctgcggtggggggaggagatataggacaggaaaaccacgtgctccactccagctccctgccagtgcagtgactctgcagggaaagactggcaaggaggctcaggtgcttccatctgtggtgactggaatgggacccacgtggagtaggtgacatatgcttcccagagactggtattgtggctgtgccaggagtacatgtgagactatgggaggaaagctccggaagaaggagaaacattgcagtggctactgtgttggcccagtagaaattgacagtattttgtatatatgtgcccatttatctttttcttttttaaaaaaagagaatactcttgtggtcccctgatgtctctttctaggatgtgtgtcactttgcttcagtgacagccctcccacccagcctggctctgctggccctgaactgaacctctccaggctctcctgttgctttgccatggagccaggtcagctctctgtctgttctgctgggtaacaaggtttggcagttcctgtttctctgggcttaagtcaaggccacagaattctttttcttccctgaaagctggcagcttttgttacagaagattctcaggatgaaggcaggggctgaggcctctgctactggctgcccctttccatccagtggctgctgtttcccaagacaggctaagcgtttcttatctgaaatgcttgggacaggagtgttacagattttggattttttcagactttggaatatttgcatatatacataatgaggtatcttggtaggtctcatgtctaaacatgaaattcattcatgttttatatataccttatacatgtagcctgaaggtaactctatacagtattttaaataattttgtacatgaaacaaagtattgattgtggtcaggtgtggtattttccacttgtggtgtcatgttggtgctcacagttttggggctgggcacggtggctcacgtctgtaatcccagcactttgggaggccaaggtgggtggatcacttaaggtcaggagcttgagaccagcctggccaacatggtgaaaccccatctctactaaaaataccaaaattagccaggcatggtggcaggtgcctataatcccagctactctggaggctggggcaggagaatcacttgagcccaggaggcggaggttgcagtgagccgagatcacgccactgggagaacccaactcaaaaaaaaaaaaagttttgggttatggagcatttttgattttggatctttgggttaaggacgctcaacctgtacctttttcatttggtggctcctctcattcctccaactgaacatctttgtggaaagatgatggctgcctgcacccactgctggcgaatggtgagaaggtagagcaagggggccaagttgctgctggtgggcacctggggttcaggccggcccaactgtggctgagccgatctgtagctgagctgagtgtcaaccagctgtgtccacaccctgcctgaggcctgccctctcctccctggctggggtgggaccttgaagaggcatatcttcccactaggtgaggaggaacaagagcctcactccccttctccctcttgcctttcacagctgaggcagagcttatgggaggagtcactatgggagtgatggacctgggctttggtctccagtgtttggcaggggcgaccttatcactgagctggggaaggcagctgccatgagtcattttaagtctctgagctccagcccagttctaggggcacaaggctggagtagggatactcctagttacctgcttgaggaaaagcacgaagaaattggtaccaaagtcttggctttgttctgggagttgagggaaaagtagggaggtatttaagtggcttgattatgagaaaacaccagagacagtagtaaatagttatttaccgatttttacccatttctaccctggtaatcctccctgcaaatgaagaaaaccaagacttctttatttattatctttccccatctgtattgaaacagtgatcttacttatctcacccagtgattctgtaggacatttaaaaagtggtcatgggtttcattggagtgagaatggtattaacgtttcctcttgtcatctcaaagttttctctccccttaataccatctctacagcttgctgagatgctttaaggatcacagagacacaaagaaaatttgaaccctacgcttctcccatcccacttcttactccatcccgggtgagcgctcgtcctcaaataaagcatgttggaacttc

SEQ ID NO: 8575 - DNA, 2963 bp, Homo sapiens
acgggtgtacacagcagcggcgtcgcggcccgcagccccgcggcggcggaaaggtaaccgacccgccctggggtgctgcgtgcgctgcctgctcccgcctgaggaaaacactgcccatggcgcaaggccgggagcgcgacgaaggcccccactccgccggcggcgcgtccttgtccgtgagatgggtgcaaggattccctaagcagaatgttcattttgtcaacgacaacaccatttgctacccttgtgggaattatgtaatatttattaatattgaaaccaagaaaaagactgtactgcagtgtagtaatggaattgtgggcgtcatggcaactaacatcccctgtgaagttgtggctttttctgaccggaagctaaaacctctcatctacgtatacagctttccaggattgaccagaaggaccaaattgaaaggcaacattctcctggactacactttactttcattcagttactgtggcacctacctggctagttactcctctctcccagaatttgaactggccctttggaactgggaatcgagtatcattttgtgtaagaaatcacagcctggaatggatgtgaaccaaatgtcttttaaccccatgaactggcgccagctgtgcttatcaagtccaagtacagtgagcgtgtggaccattgaaagaagtaaccaggagcattgtttcagagcaaggtcggtgaaattacctctagaagatgggtcattttttaatgaaacggatgtcgttttcccccagtcgttgccgaaagatctcatctatggtcccgtgctgccactgtcagccattgccgggctggtaggcaaagaggcagagactttccggccgaaagatgatctatatcctttgcttcacccgactatgcattgctggactccaacaagtgacttgtacattggctgtgaagagggtcatcttttaatgattaatggagacaccttgcaagtgactgtacttaataagatagaagaggaatcgccattggaagacagaagaaattttatcagtccagtaaccttggtatatcagaaggagggcgtgctggcttctggaattgatggctttgtgtattcttttattattaaagatagaagttacatgatcgaggattttcttgagattgaaagacctgtagaacatatgacattttctcccaattatacagtgttgctgattcaaacagacaagggatctgtttatatctacacttttggtaaggagccaaccttaaataaagtcctagatgcttgtgatgggaaatttcaggcaattgactttatcacacctggaacccaatacttcatgacacttacatattcaggggaaatttgtgtttggtggctggaggattgtgcttgtgtaagcaagatttatctgaataccctagcaacggttctggcttgctgtccatcctccctctctgcagccgtgggcacggaggatggctcggtctacttcatcagcgtatatgataaggaatcccctcaggtcgtgcacaaggcctttctctcggaatcgtccgtgcagcacgtcgtttatgatcagcaaggaatatttctgttagttggaacagcagaaggaaaagtctttattatcaatgccaactcctcaagctcatttcagattattggattcacagaggtggccaaagacattttacagatatccacagtgtctcttttagaaacagacatagtggaagtgatggtgctttcctcgcttccagaagcagggagaagcaggttggagatgttcacactgcctacattactgccacaagtttccacaacctttgctgatgaaagaggaaggctgaaagatgaaatcattcataagtacctgtatgagttggagcacgctctgtcctctgcagtcttgggctttcaaagtaaccaaatatatggcttctgtagtcaagtgccatacatctgtagctaccttcttcctgaagaagaacataccggtatctacattcttaaaccatacaaaaaagtacaaagcagacagtatggacctggactgctctatctgtcttcacatggattgtggctcataacaatagctaaatgtggaattctgtgtatccgagacgtttatactttggaaacatttgcttggtgtcggagtcattctcaccagggtcatgggattcagtcaatgagaatttcaatggatggacaaaacattctggtgaatgggagagatgatggcacccttgtctacctaaagtggaagcgatttggaggacacctagccagtgaaattctggactattaccagaaactattaatttccctgagcagcgccatggacaaggagaatcattatttaagcacaacaccaaaagtttccgtagatttgggatccgattctgaacacacaaaacagaaggcaagcactgacttatcacaagatgaattagttctaaccgatgttaagaaggaaattccttggatacaacaaaaaagccaagaggccatcaaaaaggaggttaatctgttttccaagaaaaggaaagagataaaacaaggaatcaaatcactttccaaaactattctgaatatgatggaagaaaatgacaaactagaaaatattgcaaaattagaccaacaggaatttggtctggatcttgaggaactagaaaggcttcatgatgaaagtcaggaagaagtggcaaagatgataaaggatgtagagatgcataacttagccaagagctatttggctgaacttatcaaagaagaatgttggaattcgatggctgtgaaaggtcgagctcttaagtgttttcatatcccctgtgtggttgaaaacttcccgatgaaagcgcgcacggttgaagagctgaaagaattggaaagagttttacagcaaaagaagattgaagcagagtgtcttaaagtactattttaaatatacatgtgtttatataagtga

SEQ ID NO: 8576 - DNA, 5365 bp, Homo sapiens
acgggtgtacacagcagcggcgtcgcggcccgcagccccgcggcggcggaaaggtaaccgacccgccctggggtgctgcgtgcgctgcctgctcccgcctgaggaaaacactgcccatggcgcaaggccgggagcgcgacgaaggcccccactccgccggcggcgcgtccttgtccgtgagatgggtgcaaggattccctaagcagaatgttcattttgtcaacgacaacaccatttgctacccttgtgggaattatgtaatatttattaatattgaaaccaagaaaaagactgtactgcagtgtagtaatggaattgtgggcgtcatggcaactaacatcccctgtgaagttgtggctttttctgaccggaagctaaaacctctcatctacgtatacagctttccaggattgaccagaaggaccaaattgaaaggcaacattctcctggactacactttactttcattcagttactgtggcacctacctggctagttactcctctctcccagaatttgaactggccctttggaactgggaatcgagtatcattttgtgtaagaaatcacagcctggaatggatgtgaaccaaatgtcttttaaccccatgaactggcgccagctgtgcttatcaagtccaagtacagtgagcgtgtggaccattgaaagaagtaaccaggagcattgtttcagagcaaggtcggtgaaattacctctagaagatgggtcattttttaatgaaacggatgtcgttttcccccagtcgttgccgaaagatctcatctatggtcccgtgctgccactgtcagccattgccgggctggtaggcaaagaggcagagactttccggccgaaagatgatctatatcctttgcttcacccgactatgcattgctggactccaacaagtgacttgtacattggctgtgaagagggtcatcttttaatgattaatggagacaccttgcaagtgactgtacttaataagatagaagaggaatcgccattggacagaagaaattttatcagtccagtaaccttggtatatcagaaggagggcgtgctggcttctggaattgatggctttgtgtattcttttattattaaagatagaagttacatgatcgaggattttcttgagattgaaagacctgtagaacatatgacattttctcccaattatacagtgttgctgattcaaacagacaagggatctgtttatatctacacttttggtaaggagccaaccttaaataaagtcctagatgcttgtgatgggaaatttcaggcaattgactttatcacacctggaacccaatacttcatgacacttacatattcaggggaaatttgtgtttggtggctggaggattgtgcttgtgtaagcaagatttatctgaataccctagcaacggttctggcttgctgtccatcctccctctctgcagccgtgggcacggaggatggctcggtctacttcatcagcgtatatgataaggaatcccctcaggtcgtgcacaaggcctttctctcggaatcgtccgtgcagcacgtcgtttatgatcagcaaggaatatttctgttagttggaacagcagaaggaaaagtctttattatcaatgccaactcctcaagctcatttcagattattggattcacagaggtggccaaagacattttacagatatccacagtgtctcttttagaaacagacatagtggaagtgatggtgctttcctcgcttccagaagcagggagaagcaggttggagatgttcacactgcctacattactgccacaagtttccacaacctttgctgatgaaagaggaaggctgaaagatgaaatcattcataagtacctgtatgagttggagcacgctctgtcctctgcagtcttgggctttcaaagtaaccaaatatatggcttctgtagtcaagtgccatacatctgtagctaccttcttcctgaagaagaacataccggtatctacattcttaaaccatacaaaaaagtacaaagcagacagtatggacctggactgctctatctgtcttcacatggattgtggctcataacaatagctaaatgtggaattctgtgtatccgagacgtttatactttggaaacatttgcttggtgtcggagtcattctcaccagggtcatgggattcagtcaatgagaatttcaatggatggacaaaacattctggtgaatgggagagatgatggcacccttgtctacctaaagtggaagcgatttggaggacacctagccagtgaaattctggactattaccagaaactattaatttccctgagcagcgccatggacaaggagaatcattatttaagcacaacaccaaaagtttccgtagatttgggatccgattctgaacacacaaaacagaaggcaagcactgacttatcacaagatgaattagttctaaccgatgttaagaaggaaattccttggatacaacaaaaaagccaagaggccatcaaaaaggaggttaatctgttttccaagaaaaggaaagagataaaacaaggaatcaaatcactttccaaaactattctgaatatgatggaagaaaatgacaaactagaaaatattgcaaaattagaccaacaggaatttggtctggatcttgaggaactagaaaggcttcatgatgaaagtcaggaagaagtggcaaagatgataaaggatgtagagatgcataacttagccaagagctatttggctgaacttatcaaagaagaatgttggaattcgatggctgtgaaaggtcgagctcttaagtgttttcatatcccctgtgtggttgaaaacttcccgatgaaagcgcgcacggttgaagagctgaaagaattggaaagagttttacagcaaaagaagattgaagcagagtgtcttaaactacggaaggaaattgtagaggctcagtctggagttaagttgattaaacagcgtcatgaagaggatgatgaagaagaggaagaggaagacaagacagtaaaatatagcaatttgcccaattacctgcttggtagtctgagtactgattttggggtagatacctctttattgtcaagccaattggagcttcattccagagaagagaaaatcaaccaaattatattattgaaagatatcatttacaaggtaaaaactgttttcaataatgagtttgacgctgcatataaacaaaaagagtttgaaattgcacgcgtgaaggaaagaaatgttcgaattcgagaaattattttagatctggaattggaagaagcagtctggcaaccagaatttgaagactgtgagaagccagagagaacgcttgttgtgcaagatgaggagattacagcccacaaacacattaagccgtggcacaaagccaaagaattgatcgtgaatcatgaaaaggagcactggcttctgatacaggatgccagtacaagactccgagctctgatggacatgatgggaggagttctggaagtcaagaaggaagatattttgagaatggtgattcctcaacctgctttcatggcaaaacctgatgctgtgtggactgaagaagaaagaaaacaattcaaagattatgagaaaaaagtaaaggagttaaatgaagaaagagataagtatagaaagtcattagaagcagaactgaagaaacttcaaaactctattcaagaaagcacacaggcctttgatgaacatttgaaaagactttttgaaaggagagtgaaggcagagatggttaccaaccaggaggaactgaaaataagtaaccttgcattttctttattgttggatgaagaattaagctctagagaaaaattcctgaacaactaccttacaaggaaacagcacgagaaaagccagacttcagaagctgttcggaaatctagagaagacctggatgtgtgcaaggagcactatgacaacttactggcagaagacaaagttatggatcgcagctttaaaaaggaattttctgaaattcctggtcatcaagtggatatactctacaaactttttaaacgccgaccaaggatttccaaacagaaaacgcactcagaaacaaccagcgttgtccctttcggagaactaccaggatctggcaagttgaataaggatgcctttgcccagttaatgaaagctatggatgagttggacaatattagtaacatgccagaaggcttggaccctttggtctggaatcatttctgcatgacaagacgagcaaaagtggaaaatgaacagaaagtaaagcagaaagcagctgacttattggaaatggcaactttcctccagaagagagttgaggaggaagagaaggtgcaacaggagattgagagagtgttccatgaactcatcctattacaggaagagaaagtgagattccagttgaatttgacaatccaaattcttcttaaacaaggacaagtagaactggaaaatttccagctagtactggagtattctgatgcaattctcatcaacaagaacataattgaagacttgaattctgtgattcggactcaaggacaaaagaaagttgctagcatgatggaaagtaaagatgtacacaaaagaatacttcagattgagtgggaacataagaaaatggagatggaaagggaagatctaaatcagaaggcttgggatattcagatgctatttttttcaagagatcgtcaaaagtacctaaatgaaccaaactatgaggctctgattagtattcagattggaataatggaacaaaccattgctgttttagataagatgcacaaaaagaatgtggaaaactgcaagaaactactcaaaaaacttggaaagttcagcaatcaaaaagatatagcaaattatgccctaagctgcaatctacgagaagagttggtagctgtctcagagagaaaagacatctgtaatgcaatggggtctaaactgacttgtgaaaagattgtcaaagaacggtatgaaaacatgatgcaacagcagaagttaacaaatatttcaaaacaacaagctgaacagatttcaatactacagactgaagttgaaagattaagaatgaaaacatttcctgctcttgttcaaatgtaaaaacgctggcaggaaaacacaaggccaaatcaatcatttaaaaaatcatttcatttgggtaaaatgatttccttttctttcttactgggaaattgaagtagcatgtcctctgagttgcatgttttagataaaaaattgtttaattttagccttaattgtatacaaatttttgtcctgcatgaataaatgtgtaaaataccatgaattgctgtttttattcaagaataaacaagacttgaagtcagaaagta

SEQ ID NO: 8577 - DNA, 1434 bp, Homo sapiens
tcgcggcccgcagccccgcggcggcggaaaggtaaccgacccgccctggggtgctgcgtgcgctgcctgctcccgcctgaggaaaacactgcccatggcgcaaggccgggagcgcgacgaaggcccccactccgccggcggcgcgtccttgtccgtgagatgggtgcaaggattccctaagcagaatgttcattttgtcaacgacaacaccatttgctacccttgtgggaattatgtaatatttattaatattgaaaccaagaaaaagactgtactgcagtgtagtaatggaattgtgggcgtcatggcaactaacatcccctgtgaagttgtggctttttctgaccggaagctaaaacctctcatctacgtatacagctttccaggattgaccagaaggaccaaattgaaaggcaacattctcctggactacactttactttcattcagttactgtggcacctacctggctagttactcctctctcccagaatttgaactggccctttggaactgggaatcgagtatcattttgtgtaagaaatcacagcctggaatggatgtgaaccaaatgtcttttaaccccatgaactggcgccagctgtgcttatcaagtccaagtacagtgagcgtgtggaccattgaaagaagtaaccaggagcattgtttcagagcaaggtcggtgaaattacctctagaagatgggtcattttttaatgaaacggatgtcgttttcccccagtcgttgccgaaagatctcatctatggtcccgtgctgccactgtcagccattgccgggctggtaggcaaagaggcagagactttccggccgaaagatgatctatatcctttgcttcacccgactatgcattgctggactccaacaagtgacttgtacattggctgtgaagagggtcatcttttaatgattaatggagacaccttgcaagtgactgtacttaataagatagaagaggaatcgccattggaagacagaagaaattttatcagtccagtaaccttggtatatcagaaggagggcgtgctggcttctggaattgatggctttgtgtattcttttattattaaagatagaagttacatgatcgaggattttcttgagattgaaagacctgtagaacatatgacattttctcccaattatacagtgttgctgattcaaacagacaaggtatgttggatggtaatttcttgatatgtgattttcagatagtattattatcatcattacatgacaggaatgaggagcagagtatgctgcacagtggtactctacttgtcaagactctaggttgtaaatgaaaaaatacccaatttaaaaggcctaaattacaaagagctattggtttatttttgtgcatgtaactgaaagggcaaggagtgaatctgaataaaagagctaccatgatgcca

SEQ ID NO: 8578 - DNA, 2876 bp, Homo sapiens
ccgacccgccctggggtgctgcgtgcgctgcctgctcccgcctgaggaaaacactgcccatggcgcaaggccgggagcgcgacgaaggcccccactccgccggcggcgcgtccttgtccgtgagatgggtgcaaggattccctaagcagaatgttcattttgtcaacgacaacaccatttgctacccttgtgggaattatgtaatatttattaatattgaaaccaagaaaaagactgtactgcagtgtagtaatggaattgtgggcgtcatggcaactaacatcccctgtgaagttgtggctttttctgaccggaagctaaaacctctcatctacgtatacagctttccaggattgaccagaaggaccaaattgaaaggcaacattctcctggactacactttactttcattcagttactgtggcacctacctggctagttactcctctctcccagaatttgaactggccctttggaactgggaatcgagtatcattttgtgtaagaaatcacagcctggaatggatgtgaaccaaatgtcttttaaccccatgaactggcgccagctgtgcttatcaagtccaagtacagtgagcgtgtggaccattgaaagaagtaaccaggagcattgtttcagagcaaggtcggtgaaattacctctagaagatgggtcattttttaatgaaacggatgtcgttttcccccagtcgttgccgaaagatctcatctatggtcccgtgctgccactgtcagccattgccgggctggtaggcaaagaggcagagactttccggccgaaagatgatctatatcctttgcttcacccgactatgcattgctggactccaacaagtgacttgtacattggctgtgaagagggtcatcttttaatgattaatggagacaccttgcaagtgactgtacttaataagatagaagaggaatcgccattggaagacagaagaaattttatcagtccagtaaccttggtatatcagaaggagggcgtgctggcttctggaattgatggctttgtgtattcttttattattaaagatagaagttacatgatcgaggattttcttgagattgaaagacctgtagaacatatgacattttctcccaattatacagtgttgctgattcaaacagacaagggatctgtttatatctacacttttggtaaggagccaaccttaaataaagtcctagatgcttgtgatgggaaatttcaggcaattgactttatcacacctggaacccaatacttcatgacacttacatattcaggggaaatttgtgtttggtggctggaggattgtgcttgtgtaagcaagatttatctgaataccctagcaacggttctggcttgctgtccatcctccctctctgcagccgtgggcacggaggatggctcggtctacttcatcagcgtatatgataaggaatcccctcaggtcgtgcacaaggcctttctctcggaatcgtccgtgcagcacgtcgtgtaagtcctttctgcctccaggagcggctccgtgtcacacccgtctgttgaaaattctagtgaagccatcctttcttttaattttaagttttacgtgtttcatttgttttgaatgttaatatattcacacagttcaacactcaaaaggtacagagggctgtgtagtaaagtaccccccatacccaggtctgtccttgcaggcagcctggtaccaatttctcatgtctctcctgagatgttttatccatgaacaagcaaaacataataagcacttctttttacttgtatcaatggccatcatgtgtgtatagtgtgccaggcacttctgctgtattaactccatgaggtaaacactcttgttgtctctatttgacaggtgaggaagataaggcacaaggattttaaataacttgctcaatagtacacagatagtgaatggcaaatgttgggatttgaacccaggtagttgggctgcagagtcactgcctttgctcttaaaaggagaaaactatgtacaatgcctcatttcttttttcacttaatcgtatatcttggagaatgttttatatccacacataaagaccagcctgattatttgtatagccacatagtattccattatatgaatatactatcattttttaaaaacggtatattaatgaacatttagagtatttcaaaacttttgaagcaatacttttaagatgataatatagagacattagatttggacttgtaggtgctatcattattactgtttctttttaatttattatattattaggtattaataagaacagacatttgtattctgctttacagcttgagatcactgtagcttgtggcatgtgatcctcaaaacaccagtcagaaaggtgttattcttatccctattagacaaattagggaattcagggttagagaggtgaggaaaagcattgtccaagattacacattacacagctagcacactgaggagctggccctgccactgtggactgcccagctccaccaccctagctcagtggggaaggatggataacctccttccatttaccccctgcctttctgcactgtcatttttttgtgcctttcctttctcagatcctcttattctaatttacatcttcccactttttctaatttgataaagttgtagacatgtttcactacattcttcctcccactgccaggtaccagacacagggtaatgaaatgtcacacccaccactaatttgagaattgcttatttgcgcttgaaacatcaagaaagctctaccgacagacatgtttcattcacttatgatgaaccaactgcccatctttactgaatcttcttgactgtatttattaaagttgcaatttggaaata

SEQ ID NO: 8579 - DNA, 5281 bp, Homo sapiens
acgggtgtacacagcagcggcgtcgcggcccgcagccccgcggcggcggaaaggtaaccgacccgccctggggtgctgcgtgcgctgcctgctcccgcctgaggaaaacactgcccatggcgcaaggccgggagcgcgacgaaggcccccactccgccggcggcgcgtccttgtccgtgagatgggtgcaaggattccctaagcagaatgttcattttgtcaacgacaacaccatttgctacccttgtgggaattatgtaatatttattaatattgaaaccaagaaaaagactgtactgcagtgtagtaatggaattgtgggcgtcatggcaactaacatcccctgtgaagttgtggctttttctgaccggaagctaaaacctctcatctacgtatacagctttccaggattgaccagaaggaccaaattgaaaggcaacattctcctggactacactttactttcattcagttactgtggcacctacctggctagttactcctctctcccagaatttgaactggccctttggaactgggaatcgagtatcattttgtgtaagaaatcacagcctggaatggatgtgaaccaaatgtcttttaaccccatgaactggcgccagctgtgcttatcaagtccaagtacagtgagcgtgtggaccattgaaagaagtaaccaggagcattgtttcagagcaaggtcggtgaaattacctctagaagatgggtcattttttaatgaaacggatgtcgttttcccccagtcgttgccgaaagatctcatctatggtcccgtgctgccactgtcagccattgccgggctggtaggcaaagaggcagagactttccggccgaaagatgatctatatcctttgcttcacccgactatgcattgctggactccaacaagtgacttgtacattggctgtgaagagggtcatcttttaatgattaatggagacaccttgcaagtgactgtacttaataagatagaagaggaatcgccattggaagacagaagaaattttatcagtccagtaaccttggtatatcagaaggagggcgtgctggcttctggaattgatggctttgtgtattcttttattattaaagatagaagttacatgatcgaggattttcttgagattgaaagacctgtagaacatatgacattttctcccaattatacagtgttgctgattcaaacagacaagggatctgtttatatctacacttttggtaaggagccaaccttaaataaagtcctagatgcttgtgatgggaaatttcaggcaattgactttatcacacctggaacccaatacttcatgacacttacatattcaggggaaatttgtgtttggtggctggaggattgtgcttgtgtaagcaagatttatctgaataccctagcaacggttctggcttgctgtccatcctccctctctgcagccgtgggcacggaggatggctcggtctacttcatcagcgtatatgataaggaatcccctcaggtcgtgcacaaggcctttctctcggaatcgtccgtgcagcacgtcgtttatgatcagcaaggaatatttctgttagttggaacagcagaaggaaaagtctttattatcaatgccaactcctcaagctcatttcagattattggattcacagaggtggccaaagacattttacagatatccacagtgtctcttttagaaacagacatagtggaagtgatggtgctttcctcgcttccagaagcagggagaagcaggttggagatgttcacactgcctacattactgccacaagtttccacaacctttgctgatgaaagaggaaggctgaaagatgaaatcattcataagtacctgtatgagttggagcacgctctgtcctctgcagtcttgggctttcaaagtaaccaaatatatggcttctgtagtcaagtgccatacatctgtagctaccttcttcctgaagaagaacataccggtatctacattcttaaaccatacaaaaaagtacaaagcagacagtatggacctggactgctctatctgtcttcacatggattgtggctcataacaatagctaaatgtggaattctgtgtatccgagacgtttatactttggaaacatttgcttggtgtcggagtcattctcaccagggtcatgggattcagtcaatgagaatttcaatggatggacaaaacattctggtgaatgggagagatgatggcacccttgtctacctaaagtggaagcgatttggaggacacctagccagtgaaattctggactattaccagaaactattaatttccctgagcagcgccatggacaaggagaatcattatttaagcacaacaccaaaagtttccgtagatttgggatccgattctgaacacacaaaacagaaggcaagcactgacttatcacaagatgaattagttctaaccgatgttaagaaggaaattccttggatacaacaaaaaagccaagaggccatcaaaaaggaggttaatctgttttccaagaaaaggaaagagataaaacaaggaatcaaatcactttccaaaactattctgaatatgatggaagaaaatgacaaactagaaaatattgcaaaattagaccaacaggaatttggtctggatcttgaggaactagaaaggcttcatgatgaaagtcaggaagaagtggcaaagatgataaaggatgtagagatgcataacttagccaagagctatttggctgaacttatcaaagaagaatgttggaattcgatggctgtgaaaggtcgagctcttaagtgttttcatatcccctgtgtggttgaaaacttcccgatgaaagcgcgcacggttgaagagctgaaagaattggaaagagttttacagcaaaagaagattgaagcagagtgtcttaaactacggaaggaaattgtagaggctcagtctggagttaagttgattaaacagcgtcatgaagaggatgatgaagaagaggaagaggaagacaagacagtaaaatatagcaatttgcccaattacctgcttggtagtctgagtactgattttggggtagatacctctttattgtcaagccaattggagcttcattccagagaagagaaaatcaaccaaattatattattgaaagatatcatttacaaggtaaaaactgttttcaataatgagtttgacgctgcatataaacaaaaagagtttgaaattgcacgcgtgaaggaaagaaatgttcgaattcgagaaattattttagatctggaattggaagaagcagtctggcaaccagaatttgaagactgtgagaagccagagagaacgcttgttgtgcaagatgaggagattacagcccacaaacacattaagccgtggcacaaagccaaagaattgatcgtgaatcatgaaaaggagcactggcttctgatacaggatgccagtacaagactccgagctctgatggacatgatgggaggagttctggaagtcaagaaggaagatattttgagaatggtgattcctcaacctgctttcatggcaaaacctgatgctgtgtggactgaagaagaaagaaaacaattcaaagattatgagaaaaaagtaaaggagttaaatgaagaaagagataagtatagaaagtcattagaagcagaactgaagaaacttcaaaactctattcaagaaagcacacaggcctttgatgaacatttgaaaagactttttgaaaggagagtgaaggcagagatggttaccaaccaggaggaactgaaaataagtaaccttgcattttctttattgttggatgaagaattaagctctagagaaaaattcctgaacaactaccttacaaggaaacagcacgagaaagttatggatcgcagctttaaaaaggaattttctgaaattcctggtcatcaagtggatatactctacaaactttttaaacgccgaccaaggatttccaaacagaaaacgcactcagaaacaaccagcgttgtccctttcggagaactaccaggatctggcaagttgaataaggatgcctttgcccagttaatgaaagctatggatgagttggacaatattagtaacatgccagaaggcttggaccctttggtctggaatcatttctgcatgacaagacgagcaaaagtggaaaatgaacagaaagtaaagcagaaagcagctgacttattggaaatggcaactttcctccagaagagagttgaggaggaagagaaggtgcaacaggagattgagagagtgttccatgaactcatcctattacaggaagagaaagtgagattccagttgaatttgacaatccaaattcttcttaaacaaggacaagtagaactggaaaatttccagctagtactggagtattctgatgcaattctcatcaacaagaacataattgaagacttgaattctgtgattcggactcaaggacaaaagaaagttgctagcatgatggaaagtaaagatgtacacaaaagaatacttcagattgagtgggaacataagaaaatggagatggaaagggaagatctaaatcagaaggcttgggatattcagatgctatttttttcaagagatcgtcaaaagtacctaaatgaaccaaactatgaggctctgattagtattcagattggaataatggaacaaaccattgctgttttagataagatgcacaaaaagaatgtggaaaactgcaagaaactactcaaaaaacttggaaagttcagcaatcaaaaagatatagcaaattatgccctaagctgcaatctacgagaagagttggtagctgtctcagagagaaaagacatctgtaatgcaatggggtctaaactgacttgtgaaaagattgtcaaagaacggtatgaaaacatgatgcaacagcagaagttaacaaatatttcaaaacaacaagctgaacagatttcaatactacagactgaagttgaaagattaagaatgaaaacatttcctgctcttgttcaaatgtaaaaacgctggcaggaaaacacaaggccaaatcaatcatttaaaaaatcatttcatttgggtaaaatgatttccttttctttcttactgggaaattgaagtagcatgtcctctgagttgcatgttttagataaaaaattgtttaattttagccttaattgtatacaaatttttgtcctgcatgaataaatgtgtaaaataccatgaattgctgtttttattcaagaataaacaagacttgaagtcagaaagta

SEQ ID NO: 8580 - DNA, 3198 bp, Homo sapiens
gacctggactgctctatctgtcttcacatggattgtggctcataacaatagctaaatgtggaattctgtgtatccgagacgtttatactttggaaacatttgcttggtgtcggagtcattctcaccagggtcatgggattcagtcaatgagaatttcaatggatggacaaaacattctggtgaatgggagagatgatggcacccttgtctacctaaagtggaagcgatttggaggacacctagccagtgaaattctggactattaccagaaactattaatttccctgagcagcgccatggacaaggagaatcattatttaagcacaacaccaaaagtttccgtagatttgggatccgattctgaacacacaaaacagaaggcaagcactgacttatcacaagatgaattagttctaaccgatgttaagaaggaaattccttggatacaacaaaaaagccaagaggccatcaaaaaggaggttaatctgttttccaagaaaaggaaagagataaaacaaggaatcaaatcactttccaaaactattctgaatatgatggaagaaaatgacaaactagaaaatattgcaaaattagaccaacaggaatttggtctggatcttgaggaactagaaaggcttcatgatgaaagtcaggaagaagtggcaaagatgataaaggatgtagagatgcataacttagccaagagctatttggctgaacttatcaaagaagaatgttggaattcgatggctgtgaaaggtcgagctcttaagtgttttcatatcccctgtgtggttgaaaacttcccgatgaaagcgcgcacggttgaagagctgaaagaattggaaagagttttacagcaaaagaagattgaagcagagtgtcttaaactacggaaggaaattgtagaggctcagtctggagttaagttgattaaacagcgtcatgaagaggatgatgaagaagaggaagaggaagacaagacagtaaaatatagcaatttgcccaattacctgcttggtagtctgagtactgattttggggtagatacctctttattgtcaagccaattggagcttcattccagagaagagaaaatcaaccaaattatattattgaaagatatcatttacaaggtaaaaactgttttcaataatgagtttgacgctgcatataaacaaaaagagtttgaaattgcacgcgtgaaggaaagaaatgttcgaattcgagaaattattttagatctggaattggaagaagcagtctggcaaccagaatttgaagactgtgagaagccagagagaacgcttgttgtgcaagatgaggagattacagcccacaaacacattaagccgtggcacaaagccaaagaattgatcgtgaatcatgaaaaggagcactggcttctgatacaggatgccagtacaagactccgagctctgatggacatgatgggaggagttctggaagtcaagaaggaagatattttgagaatggtgattcctcaacctgctttcatggcaaaacctgatgctgtgtggactgaagaagaaagaaaacaattcaaagattatgagaaaaaagtaaaggagttaaatgaagaaagagataagtatagaaagtcattagaagcagaactgaagaaacttcaaaactctattcaagaaagcacacaggcctttgatgaacatttgaaaagactttttgaaaggagagtgaaggcagagatggttaccaaccaggaggaactgaaaataagtaaccttgcattttctttattgttggatgaagaattaagctctagagaaaaattcctgaacaactaccttacaaggaaacagcacgagaaagttatggatcgcagctttaaaaaggaattttctgaaattcctggtcatcaagtggatatactctacaaactttttaaacgccgaccaaggatttccaaacagaaaacgcactcagaaacaaccagcgttgtccctttcggagaactaccaggatctggcaagttgaataaggatgcctttgcccagttaatgaaagctatggatgagttggacaatattagtaacatgccagaaggcttggaccctttggtctggaatcatttctgcatgacaagacgagcaaaagtggaaaatgaacagaaagtaaagcagaaagcagctgacttattggaaatggcaactttcctccagaagagagttgaggaggaagagaaggtgcaacaggagattgagagagtgttccatgaactcatcctattacaggaagagaaagtgagattccagttgaatttgacaatccaaattcttcttaaacaaggacaagtagaactggaaaatttccagctagtactggagtattctgatgcaattctcatcaacaagaacataattgaagacttgaattctgtgattcggactcaaggacaaaagaaagttgctagcatgatggaaagtaaagatgtacacaaaagaatacttcagattgagtgggaacataagaaaatggagatggaaagggaagatctaaatcagaaggcttgggatattcagatgctatttttttcaagagatcgtcaaaagtacctaaatgaaccaaactatgaggctctgattagtattcagattggaataatggaacaaaccattgctgttttagataagatgcacaaaaagaatgtggaaaactgcaagaaactactcaaaaaacttggaaagttcagcaatcaaaaagatatagcaaattatgccctaagctgcaatctacgagaagagttggtagctgtctcagagagaaaagacatctgtaatgcaatggggtctaaactgacttgtgaaaagattgtcaaagaacggtatgaaaacatgatgcaacagcagaagttaacaaatatttcaaaacaacaagctgaacagatttcaatactacagactgaagttgaaagattaagaatgaaaacatttcctgctcttgttcaaatgtaaaaacgctggcaggaaaacacaaggccaaatcaatcatttaaaaaatcatttcatttgggtaaaatgatttccttttctttcttactgggaaattgaagtagcatgtcctctgagttgcatgttttagataaaaaattgtttaattttagccttaattgtatacaaatttttgtcctgcatgaataaatgtgtaaaataccatgaa

SEQ ID NO: 8581 - DNA, 1794 bp, Homo sapiens
tgtggactgaagaagaaagaaaacaattcaaagattatgagaaaaaagtaaaggagttaaatgaagaaagagataagtatagaaagtcattagaagcagaactgaagaaacttcaaaactctattcaagaaagcacacaggcctttgatgaacatttgaaaagactttttgaaaggagagtgaaggcagagatggttaccaaccaggaggaactgaaaataagtaaccttgcattttctttattgttggatgaagaattaagctctagagaaaaattcctgaacaactaccttacaaggaaacagcacgagaaaagccagacttcagaagctgttcggaaatctagagaagacctggatgtgtgcaaggagcactatgacaacttactggcagaagacaaagttatggatcgcagctttaaaaaggaattttctgaaattcctggtcatcaagtggatatactctacaaactttttaaacgccgaccaaggatttccaaacagaaaacgcactcagaaacaaccagcgttgtccctttcggagaactaccaggatctggcaagttgaataaggatgcctttgcccagttaatgaaagctatggatgagttggacaatattagtaacatgccagaaggcttggaccctttggtctggaatcatttctgcatgacaagacgagcaaaagtggaaaatgaacagaaagtaaagcagaaagcagctgacttattggaaatggcaactttcctccagaagagagttgaggaggaagagaaggtgcaacaggagattgagagagtgttccatgaactcatcctattacaggaagagaaagtgagattccagttgaatttgacaatccaaattcttcttaaacaaggacaagtagaactggaaaatttccagctagtactggagtattctgatgcaattctcatcaacaagaacataattgaagacttgaattctgtgattcggactcaaggacaaaagaaagttgctagcatgatggaaagtaaagatgtacacaaaagaatacttcagattgagtgggaacataagaaaatggagatggaaagggaagatctaaatcagaaggcttgggatattcagatgctatttttttcaagagatcgtcaaaagtacctaaatgaaccaaactatgaggctctgattagtattcagattggaataatggaacaaaccattgctgttttagataagatgcacaaaaagaatgtggaaaactgcaagaaactactcaaaaaacttggaaagttcagcaatcaaaaagatatagcaaattatgccctaagctgcaatctacgagaagagttggtagctgtctcagagagaaaagacatctgtaatgcaatggggtctaaactgacttgtgaaaagattgtcaaagaacggtatgaaaacatgatgcaacagcagaagttaacaaatatttcaaaacaacaagctgaacagatttcaatactacagactgaagttgaaagattaagaatgaaaacatttcctgctcttgttcaaatgtaaaaacgctggcaggaaaacacaaggccaaatcaatcatttaaaaaatcatttcatttgggtaaaatgatttccttttctttcttactgggaaattgaagtagcatgtcctctgagttgcatgttttagataaaaaattgtttaattttagccttaattgtatacaaatttttgtcctgcatgaataaatgtgtaaaataccatgaattgctgtttttattcaagaataaacaagacttgaagtcagaaagt

SEQ ID NO: 8582 - DNA, 2876 bp, Homo sapiens
atggccccgctggttccaggacctcccctcgaagcctcacccaccaccctggatgcagcagtcagatgggggcttcagaggccggtgcgcggccacatggccccgggccaggcagggggtcgtggggacgcatctgcgctaggcgcacagtattcctgggcgcgggacgggcgaagcgccgtgggttccaagctgagctgggtcggccctgcagcgccggagagcaaggcggcgcagggaagggagatggggcgggatgtggggaaagctgtcgactgcttggatctctccggcccggatggcgccagctgcctccagctcagcctgcggaaatccgagctcttcccagcggcccgacggcccgggcgccccgcagaccctgggctctccccgcggtgcctccgccgcccgcccctgcgtcctggcccggcctccacgcccctccgaggtcccggcgcagcgcggccgccgccactccccccacattccagaggccgcagcgccgtctccttcctcgcattcctgcccccgcaaaggagtccctccgccccgcgcgaggccgcggggtcccggggcgggctccgggcttcgggcggacgatgcggcggcccggccggagcggcggcgggaagcggaggcggaggtgacgcgccagggccggcgggccgggccatgcagcgctccagggcgggcgcggacgaggcggccctactcctggccgggctggccctgcgggagctggagcccgggtgcggctctcccggtcgggggcggcgggggccgcggcctgggcctggagacgaggcggcgcccgcgctgggccgcagagggaagggcagcggcggccccgaggccggggcggacggactgagccgcggggagcggggtccccggcgcgcggcggttccggagctcagcgcgcagcctgcgggcagcccacgggccagcctggcggggtccgacggcggcggcggtggcggcagcgcccgatccagcggcatcagcctgggctacgaccagcgccacggcagcccgcgctccggtcgctcggacccgcgtcccggtcccgggccgccttcggtgggcagcgcccgctccagcgtttccagcctcggctcccggggctcggccggcgcctacgctgacttcctcccgcccggcgcctgccccgcgcccgctcgctccccggagcctgcggggccggctcccttcccgctgcctgcactcccgctgccccctggccgggagggcggcccaagcgcggccgagcggcggctggaggcgctcacccgggagctggagcgggcgctcgaggcgcgcacggcgcgggactacttcggcatttgcatcaagtgtgggcttggcatctacggagcccagcaggcgtgccaggcaatggggagtctttatcacactgactgcttcacctgcgactcgtgtgggagacgactccgtgggaaggcgttctacaacgtgggtgagaaagtgtactgccaggaggacttcctgtactccgggttccagcagacggccgacaaatgcagcgtgtgtggacatctcatcatggaaatgatcctgcaggccctgggcaagtcctaccacccaggctgcttccggtgctccgtgtgcaatgagtgcctggacggggttcccttcaccgtggacgtggagaacaacatctactgcgtgcgagactatcacacggtttttgcaccaaaatgcgcctcctgtgcccgtcctatcctccctgcacagggctgcgagacaaccatccgtgtggtgtccatggacagagactaccacgtggcatgttaccactgtgaggactgcgggctgcagctgagcggggaggagggacgccgttgctatcccctggcgggccacctactgtgtcgtcgttgccacctgcggcgcctccaacctgggcctcttccctcacccactgtgcacgtcactgagctctgagcaggggaaaacccgtccctgggccggggtgggtgtgggtgtggagggagggcccgcgtgggtggccctggtcagcgtcaggggagctccctccaatcagtttcccaccgagctgctgtctgcaggggccggacccccgcgtggaagcttctatttattcaccgtctgtgcctgctcaagtcacttccctgcgggccctgcctcccacccaccccatcaccagctttccacttggaggccccctgtgccctgcagcctcagggtaggccgtgggtcaccaggctggagagggcccctgccttggccaggggtgcgaggtgacccggctgcattgctgggtgggagctgctgtctgttgttcaggggcctggcccccgccctcccccccgaccccgacctcgcaaagcgcactcccgggcagggtgtggtctggaaggcggggctggcggggacatgggtgttcctgcatctcctagcgcagttcctgctggtgggtggaagggtgcctggtttaggcggggtcccaggagggggtgaggggtgacacccttggggagggggcctgcaaagggcactgcctgtggccacgtggtgtctgtgggaattggtcctggggactttgatgggtgtttgcggccccagttgccgccctgctccctcttccagggctcctggcttgggccccccgacccccctgctcagctcgggaaaatccccgtgcggctccagccccgggtcacgctcaggagcgatgagaggggcgccctggccacgcttcaggaaagcctgtgtctgcgcgcggggcaaggggctccacgacaaaaggacaagatttgacttaaattaagtttttcccttgaggatattttcattttctttaaaagaatataattttcttctaagatcttgga

SEQ ID NO: 8583 - DNA, 11341 bp, Homo sapiens
ctcagctccgggccgagcgcgagcttgggctcgtaccccgctcccctctctccgcccgctctttacctaccggccgtagctggcccggtgggctcgcggggagacgctcgcgcgcgcaagcgcacacgacgcggagcggagctcgagacatcgaggagaggagtaagaagcatcggaggaggcgatcgaggaggaggcggtgtgtgtgtatgtgtctattctacggtgtggctcgtcgtggggcgagaggaggctcgagagagggcgagggagaagcgaaaagagtaagagagtcttcctttgcgagagcctctaatctggttgctatggaaatacatgaccacgcaaaaggaagtccattctgataattctgatacctgagatgtaactggactgaagagtagaaacaggaaaaattttagtgccaactttaattacaatggccactgattcaggggatccagccagcacagaagattctgagaaacctgatggaatttcatttgaaaacagagttccccaggtcgctgcaactttgacagtagaagctagactaaaggagaaaaacagtaccttctctgcttctggggaaactgtagaaaggaagagatttttccgaaagagtgttgaaatgacggaagatgacaaagttgccgaatcatcccccaaagatgagagaattaaggctgcaatgaatattccaagagtagataagcttccttcaaatgtgttgagaggtggacaagaagttaaatatgaacagtgttcaaagtcaacctcagaaatctcaaaagattgtttcaaggagaaaaatgaaaaggaaatggaagaagaagcagaaatgaaggctgtagctacttctcctagtggcagattcctgaaatttgacatagaactaggaagaggagcatttaaaacagtatataaaggactggacactgaaacatgggttgaggttgcttggtgtgagctgcaggaccgaaagttaaccaaagctgagcagcaaagattcaaggaagaagcagagatgttgaagggtctccagcaccccaatatagttcgattttatgattcctgggaatctatattaaaaggaaagaaatgtattgtattagtgactgaactaatgacatctgggaccttaaagacgtacttaaaacgatttaaagtcatgaaaccaaaggtcttaaggagctggtgcaggcaaattttaaaggggttgcagttcttgcacactaggactcctcctattattcaccgggatctgaagtgtgacaatattttcatcacgggacccactggatctgtgaagattggtgatctaggattagccaccttaatgcgtacctcatttgctaagagtgtcattggaactcctgagtttatggctccagagatgtatgaagaacactatgatgaatccgtagatgtttatgcttttggaatgtgtatgctggaaatggccacatcggagtatccttattctgagtgtcagaatgcagctcaaatataccggaaagtaactagtggcataaaaccagccagcttcaataaagtcactgatcctgaagtcaaagaaatcattgaaggatgtattcgtcaaaacaaatctgaaaggttgtctatcagggacctattaaaccatgcattttttgctgaggatacaggactgagggtggagttagcagaagaagatgattgctcaaattcatcccttgctttaagactctgggttgaagaccctaaaaaattgaaaggcaaacacaaagacaatgaagctattgaatttagtttcaacttagaaacagatacacctgaggaagtagcatatgaaatggtcaagtctgggttcttccatgaaagtgattccaaagctgttgctaaatccattagagaccgggtgacgccaataaagaagacaagagagaagaagcctgctggctgtttggaagaacgcagggattctcagtgcaagtctatggggaatgtattccctcagccccagaatacaactttaccccttgctcccgctcagcaaactggggctgaatgtgaagaaactgaagttgatcaacatgttagacaacagcttctacaaagaaaaccacagcagcactgctcctctgttacaggtgacaatttgtctgaggcaggagctgcatcagttatacattcagatacttcaagtcagcccagtgtagcctattcctcaaatcaaacgatgggctctcaaatggtttctaatatcccgcaggctgaagtaaatgttccagggcaaatttattcatctcagcaactagtaggacattaccagcaagtttcagggttacagaagcattcaaagctgactcagccgcagattttgcctttggttcaaggtcagtccactgttttacctgtacatgtccttggaccgacagttgtttcacaaccccaggtttccccattaactgttcagaaggtcccacagataaagcctgtatcccaaccagttggagctgaacaacaagcagctcttctaaaaccagatttagttcgaagcttgaatcaagatgtggcaactacgaaggaaaacgtcagtagccctgataacccaagtggaaatggcaaacaggatcggatcaaacagagaagagcttcctgtccccgaccagagaaggggactaaatttcagcttaccgtccttcaggtatcaacctctggagataacatggtagagtgtcagctggagacacacaacaacaagatggtcaccttcaagtttgatgttgatggtgatgcgccagaggatattgcagactatatggttgaagataactttgtgctggaaagtgagaaagaaaaatttgtagaagaattgagagctattgtaggtcaagcccaggagatccttcatgtccactttgccacagaaagagccactggagttgattctattactgtggactccaacagtagccagacagggtcatctgaacaagtacagataaattctacatctactcaaaccagcaatgaatctgctcctcagtcatccccagttggtcggtggcgattctgtatcaatcagacgataagaaaccgtgagactcagtctcctccttctcttcagcattccatgtctgcggttcctggccgacatccacttcctagtccaaaaaacacaagtaataaggaaatatcacgggacacattgctcactatagaaaataatccatgccaccgtgcacttttcacctccaaatcagaacacaaggatgtggttgatggtaagatttctgaatgtgctagtgtagaaaccaagcagccagctatactttatcaagtggaagataacaggcagataatggcaccagttactaatagttccagttactctactacttcagttcgtgcagttccagctgaatgtgagggactcaccaaacaagcaagcatattcatacctgtgtatccatgtcaccaaactgccagtcaggctgatgcacttatgtcccatcctggcgaatcaactcagacttctggtaactctcttacaactctggcatttgatcaaaagcctcaaaccttatcagtacagcagccagctatggatgcagagtttatttctcaagaaggagaaactacagtgaacactgaagcaagttctcctaagacagtcattcccactcagacccctggccttgaaccaactacccttcaacccactactgtcctggaatcagatggagaaagacctccaaaactggagtttgcagacaaccgaattaaaactctggatgaaaaattaagaaacttgctctatcaggagcacagcatctctagcatctatcccgagagtcagaaggatacccaaagcatagactctccattttcttcctctgctgaagataccctctcctgtccagtgacagaagtcatagccatcagtcactgtggaattaaagatagccctgtacaatcccctaatttccaacagacaggctctaagcttctgtccaatgtggctgcaagtcagcctgctaatatatcagtgttcaaaagggacctgaatgtgataacttctgtacccagcgaattgtgtttacatgagatgtcctcagatgcttcacttccaggggatccagaggcctatcctgctgctgtgtcaagcggtggagccattcatctgcagacaggaggtggatattttggcctaagctttacttgtcctagtctcaaaaatcctattagcaagaaatcctggactcgcaaattaaaaagctgggcatacaggctacggcagtcaaccagctttttcaagagatcaaaagtccgtcaagtggaaacagaagagatgagatcagcaattgctcctgatcccattcctctgacacgggagtccacagctgatactagggctttgaatagatgtaaagcgatgagtggatcatttcagcggggtcggttccaggtgattacaattcctcagcagcagtcagcaaaaatgacatcttttggaatagaacacatatcagtgttcagtgagacaaaccattctagtgaagaagcctttattaaaacagcaaagtctcagttggtagaaatagaacctgccacacaaaatccaaaaacttcgttttcttatgagaagttacaagctcttcaggaaacctgtaaagaaaataaaggagttcccaaacaaggtgacaacttcttatctttcagcgcagcttgtgagactgatgtatcttcagtgaccccagaaaaggaatttgaagaaacttcagccacaggaagtagcatgcagtctggatctgaactgttgcttaaagagagagagatattgactgctgggaaacagcctagctctgatagtgaattttcagccagtcttgctggcagtggaaagtcagtggcaaagactggtccagagagtaatcagtgcttaccacaccacgaagaacaagcttatgctcaaacacagagttcactcttctattcgccatcttccccaatgagcagtgatgatgaatcagaaatagaggatgaggacttgaaggtggagcttcaaagattacgagaaaaacacattcaggaggtggtaaatcttcaaacccagcagaataaggagctgcaggagctctatgaacgccttcggtcaattaaagatagcaaaacccaatctactgagattcctttgccacctgcatcaccacgtcgaccaagatctttcaaaagcaaacttcgaagccgcccccagtccttgacacatgtggacaatggcatagttgctacagggaaaagctgccttataaatgagttggaaaatccactgtgtgtggagagtaatgcagcatcatgccaacagtctccagccagtaaaaaagggatgttcacagatgacttacacaagctggtggatgactggacaaaggaagcagtaggaaattctcttattaagccaagtttaaaccaacttaaacaaagtcaacacaaactagagacagaaaactggaataaagtatctgaaaatactccgtctactatgggctacacatcaacatggatttcttctctgtcccaaatccgtggagctgtcccaacttccttgccacaaggactctcactcccttcatttcctgggccattatcatcatatggaatgcctcacgtttgtcagtataatgctgtggcgggggcggggtatccagtacagtgggtaggaatttcaggaacaacacaacaatctgtagtaattcccgcccaatctgggggaccattccagccagggatgaatatgcaggcatttccaacttcatcagtgcagaatcctgccacaatccctcctggtcctaaatgaatcagagtagatggtgataaaaagggaggttttttcagaattattttcaggacacccaagatattaaagtttcttcctcttgggttctgtcatattttccctcatttgagtttactttagactatatattttttgttccagtgtggtatttgatacagctcatcattctgtagaaatgtgcagtttgcagatagaacactgcacacagaaatgttttttcacttcaaattctatcctctttgatacttgattttttaaaaatactgttcagaatgctttaataagctcagcttgagcattaccatttccaggacactttccatgaattgttgagaagctccccatcccccgccttttttttttttttttttaactgctgctatctgcagctggatactcttctttaaaaatgtttaaaaattatttagattgattctccccaaatgtggatgaactgagaccctccatcagccagagtcttatgggatcttcacttcacatgtttgtcttaggtttacctttcacagaaggcagggtaacttgctgcaggaaacgttttggtgtataaaattagaatcacttttttttttttttttgagatggagtctctctctgtcacccaggttggagtgcagtggtgtgatcttggctcactgctgcaacctccccctcctgggttcaagcgattctcctgcctcagcctcctgagtagctgggactacaggcgccagccaccatgcctggctaatttttgtatttttagtagaggatggggtttcactatgttggccagactggtctcaaactcctaaccttgtgatccgccctccttagcccccccaaaaaattacaataattttgtcaaccaatacagaacatgagccctttttaaatgtgatttcccgtcatcacagcagtaggatgaagccttgttttgggtgagacagagggaaagggaaaaaacagaattgtaacagttccttgattctgcagatactgctgctgttttacgatttcagtaataattcaaagcagctgtctccttgtttctcacatgcatactacattggttttgagcatctgagaggcattggtttgtcttgcattcttttgcaaggcatatattgcagctgatatgaatctcgtttggggggaatccttgtattcctaacaagggggattaaagctacacctcaatccattcttctgaagtgaaatttacttgacacagtaggtttcgagacttacatatgaaacactggctttacagggttctcagagatgtggggtatacactgtcctgcagtgagatagtagaccctagaaggatactatttaagttgtccttagctctttttaattacaatttttagttgttagaatttctttttagtatctatagtatcttagatgattttagatcttaaatgagtttggcagcctctttagaatctgagagagatcactgtcaagttgcactttactgggttttatccagttttaggaggaggggaggcaatgtcaaaatgtacacctttggtttttaagaaggttaactataataatgttaaaggctagtcacagggttacctaatgctcagtctgtgaaacctaaatagaattcttaaaatgttatttaccaactaagtattcatgttcaaattacttaccttccactctgaagactttaaggtcatttctaatacacatttacctaattaggagttctgtctactagtaaacattccaaattgctacccaacattactgttaacagattttcctccgtattcttctaaaaattataccccatgggcttgccaggtaatgacgaaaacttaatgggtgtacttttttttttttttgcacagtctactttgtgacattaagtacctcttttccaaaaaaaaaaaaaaatgtgttttatgttgcttacctgaggatcacatccattatcaagaagattctgtcgctataatttgaggcatctagggcagcattttgagaattgctgttgataagatccactgtttcttttcatagaacatgatctgttttgtatgagtctttccaaatgttaagtacagattcttcaaatttcttgtacagtattggtttgcagtttaaagtgattttaggacattagtgtaatgcaaatgcttgcattgcactgttttccatatgtataaaaacaatgctcctaaaatccctaattctttaaaactgcctgtgtttcattataaaaagttggctttgtgtaattacaccgagccatacaacctataaagtgaaaatactgcagattttaggaccccttcttctctagtcacaatcattttaaacagtgtaccccaggatgaaaaaagctccatggctgacatgtacaattacatgtattaatgactgctctacatcctatgttctgcctttggccaccacctctattccacatataattcatcattcttgtttgcctgcagactcttgcagtgccttgtaatatttacaatcttttcaggtttttgctggaaagaaaagtagtcttctaaagtttgaagatggtgaatagtgtactgctgtctccatgctgactgcagtaaccgggttatcatatatgttatgtatacattatgtatatataacatgtgtacatttaaaaatacagaaaaaagtgagcttgtgcagaaatggagaaaacaatgttattctcatcactgtggggttttattaaaattattttttcccatgacttacatgtttggttcagattatagtcactttgactgtaaatactggctagttttctatccagggcttttgcattatttcataattttgctaaatcatataatagtgctattttcatccttgtctgaggtacttttcctccccagaaataattaacttgaggtaaagctcagaaattcccttcttaacaaagagcctactatataaaaagggccttcctttccaaaaaacacacaaacctgtccttttcattttccttcttgtagaggagaaaatggttgtacttaaccatcctgcttgtaaagtttattcagaggatagtctgtatgtccagccaccatgtttacttctcaaagtgcaagtctgatgaatagtactgtatctccatatgtggtaatgtgagcatttcatcatgaagtacctgctgctatgtctgtgaagttgggtgtaacatcataagaatatgaaaccagtattggtgtaaatctaatgaaaataaccctatgtatatttgtagcagtcttgaatctctatttaaggtaatttgctgtaatataacaaatattcattctgtttttcatcccttccttgccagttttatatcaagcatgaattccaatggtttgacagcaaaattatctgtgaaagtttaaaaggcacttttctgctgtgatttttggattgagtgtggagtgttatgtacagtttgatgggatatatcattttagaaccccagatttaattctagtccaattaattttgtttaactacctcgttttcagtgctgttttgggtgcacaagtaaacactacctgtgaaacttgcttttttgccttgattctcagtattctttcagattataaatctggtctgcctcttttttcccagtgctagccaacagtttgagatgagagggatcatcactctcatctgtgtttaagtggagagccatgtgcttctgtgaaatatgctttggggatttgggggtggagagcagaagaataattgaaattggtggcaatataggatttaggtgtaggagttagttataaaataaacaaatggtaagaaagtacctgaattagacaatccagtgcctataactttgcattttttattagagatgcatttctcgtctgtgtgcctaaagggcaatgggttgaaattgctttaactaccacagcgaaatatttgacaaatccttcagcaatggcctatcattcaacatatattagcacagtgctaggtatttgcagtggtattttgttaccttaaaacggccaaatgcatttagttgaaatgtagttgatagtaagggttttatataactttatccaatctctaaagtttatggaagcattgactttcttctttgctgtcttttctgagtgatgaaaatgatgcattccttttttttccttgaaaactcagcaaatgtttgtaaccagatgttccttgtttcacatgtttactgtgtaacactacagcatatttaatattggtaaatactgtatttcagtcattatgcataagtacattcctgaggtatatttgccatcattttgggattcagttattttatcttctgtttgggtcagaaaaacttgaactatctgaggtggtatgcaggccattttctagaagattgttttttgaatctgtagtttatcaaggacttgttccccccctccctttgtttagaagaggaatcagaaaaggggggtggtgtgtagaaaaggcctttgatttgataggtgtaatttctaagattgaaattttaaaaatgcagatcgtaagatagtaacactcaaacttgataaaatcctttgaattgaaattagtatgaaatttttatggaaccaaatgccttcaggtcaccctggaaatagtctttgtatgtgaaagatcaacacaaacattggtcaggaaccctgacagccaatatatgaaggagcctgggatagtaactaggttacactaaagttattttcaactaagatagctagacgagtgtacaaaccaatagctcctattctggaaggttttctttttattaaaaaaaattcaaacaaggttaaaagtcaagcaagaagggaagagagaaactgggttctgagaaaaaaatgtgccagtataaaataaactcctaaatgcgtgcttgtcatcctctagtttttttttaagttgaatttcttttccactgtaacttaagatttgagattgaggtttgcggtccagaacataccctcagcagatacagtgactaactggaaagtgcagttgttcaaggtctgtcatgctcaatcacctaaagctataatttgtttgatatattaagcatgtagacctagtgcagcatgggagccactcaggaagtttatgcaattaataaactttcagcataatttactatgaagtatgcagaatttcaccctcttctccacacttaacatttagttgtatatgtgaactctcctttcttaattggggaatgtagcattatatagaatgttgttaaagttaattttaatcctttttgacattaacctttttttttttttggtaaaccaagtgatctgcctttcagcaactgtcttattttggttctttgaaactgtgatttttatttcatttgtacccaaccattgtaagtattttgttttgtttcctggaaattctgttttgaaacagaaaataaaggctgtgttaaatgagtatgttatcttattaaaatgctgccatagtcactgc

SEQ ID NO: 8584 - DNA, 1235 bp, Homo sapiens
cctgagtcccgggaggaaagtgctcgcccattcctgacctgtgacacgctcactgcgaaggcaggttattagaagagtcccatgaaaggtggctccacggtcccagcgacatgcaggggctcctcttctccactcttctgcttgctggcctggcacagttctgctgcagggtacagggcactggaccattagatacaacacctgaaggaaggcctggagaagtgtcagatgcacctcagcgtaaacagttttgtcactggccctgcaaatgccctcagcagaagccccgttgccctcctggagtgagcctggtgagagatggctgtggatgctgtaaaatctgtgccaagcaaccaggggaaatctgcaatgaagctgacctctgtgacccacacaaagggctgtattgtgactactcagtagacaggcctaggtacgagactggagtgtgtgcataccttgtagctgttgggtgcgagttcaaccaggtacattatcataatggccaagtgtttcagcccaaccccttgttcagctgcctctgtgtgagtggggccattggatgcacacctctgttcataccaaagctggctggcagtcactgctctggagctaaaggtggaaagaagtctgatcagtcaaactgtagcctggaaccattactacagcagctttcaacaagctacaaaacaatgccagcttatagaaatctcccacttatttggaaaaaaaaatgtcttgtgcaagcaacaaaatggactccctgctccagaacatgtgggatgggaatatctaacagggtgaccaatgaaaacagcaactgtgaaatgagaaaagagaaaagactgtgttacattcagccttgcgacagcaatatattaaagacaataaagattcccaaaggaaaaacatgccaacctactttccaactctccaaagctgaaaaatttgtcttttctggatgctcaagtactcagagttacaaacccactttttgtggaatatgcttggataagagatgctgtatccctaataagtctaaaatgattactattcaatttgattgcccaaatgaggggtcatttaaatggaagatgctgtggattacatcttgtgtgtgtcagagaaactgcagagaacctggagatatattttctgagctcaagattctgtaaaaccaagcaaatgggggaaaagttagtcaatcctgtcatataataaaaaaattagtgagt

SEQ ID NO: 8585 - DNA, 2615 bp, Homo sapiens
cgcgaacagcgtttcctgaggcacctcccgcgcgtggttccgccgcgccccgcgccctgcgcccctcagcccctcgccggcgcccgcgtcgcgggttggcagcctagcccggcagccgcgttcccgccgcgtcccgcgcccggtacctatggaggcgccgctcgccggcgaggccgccgaccatgcctaggagggccgggagcggtcagctgccgctgccccggggctgggaggaggccagggactacgacggcaaggtcttctacattgaccacaacaccaggaggaccagctggatcgacccccgggacaggttaacgaagcccttgtcatttgctgattgtgttggggatgagctgccgtggggatgggaagcagggtttgaccctcagattggtgtctactacatcgatcacatcaacaaaaccacgcagatagaagatccaagaaaacaatggaggggggaacaggagaagatgctcaaggactacctctctgtggcacaggatgccctccggacacagaaggaactgtaccatgtgaaggagcagaggctggcgctggccctggatgaatacgtgcgattaaatgatgcctataaggaaaagtcaagttctcacacaagcttattctcaggatcttcatccagtactaaatatgatcccgatattttaaaagctgagatctccactacaagattaagggttaaaaagctaaagagagagctctcacagatgaagcaggaactgctctataaagaacaaggctttgaaacattgcagcaaattgataaaaaaatgtctggaggccagagcgggtatgaactcagtgaagccaaagccattctaacagaactaaaatctatcagaaaggcaattagctcaggagaaaaagaaaaacaagatctgatgcagagtcttgctaagctgcaggagcggtttcatttggatcagaacattggcagatctgagccagatttgagatgtagtcctgtgaactctcatttatgtctctccagacagacccttgatgctgggtcacaaacaagcatttccggagatattggagtaagaagtagatcaaatttagctgaaaaggtcaggctaagcctacagtatgaagaagccaaaagaagtatggccaacttaaaaattgaactgtcaaaattggacagtgaggcctggcctggggcactggatattgagaaggaaaaactgatgctgattaatgaaaaagaagaacttttgaaagagcttcagttcgtcaccccacagaaacgtacccaagatgaattagaacgcctagaagctgaaaggcagcggctggaagaagagttgctgtctgtgaggggaacaccaagcagagctctggccgagagattgagattggaagagagaagaaaagagctgctacagaaacttgaagaaactactaaattaactacttatttgcattcacaacttaaaagcctctctgccagcaccctgtccatgtcatctgggagcagcctgggttccctggcatcgagtcggggctctctgaacacctccagcagagggtcactcaactccctcagttccaccgaactctattacagcagtcaaagtgatcagatagatgtggattatcagtataaactggacttccttctgcaagagaaaagcggttacattccttctggacccatcaccaccatccatgaaaacgaggtggtcaagtcccctagccagcctggccagagtggactctgtggagtggcagctgcagcaacaggccacactcctccactggctgaggccccgaagtctgtggcctccctgtcctcgaggtcctccctttcctccttgtctcctccaggctctcccttggttttggaaggcacgtttcccatgtcttcttctcatgatgcctctctccatcagttcactgctgactttgaagactgtgagttgagtagccattttgcagatatcagcctcatcgaaaatcagattttgctggattctgattcaggaggagcctcccagtctctttcagaggataaagaccttaatgaatgtgctagggagccattatatgaaggaactgcagatgtggaaaaatcattaccaaaaagaagagtgatccacttgcttggggagaaaaccacttgtgtgtcggctgctgtgtctgatgagtctgtggctggagacagtggggtctatgaagctttcgtgaaacaacctagtgaaatggaagatgtcacatacagtgaagaggatgtagccattgtagagaccgcccaggttcagataggactcagatacaatgcaaaaagttcaagtttcatggtgattatagcacagctccgaaaccttcatgccttcttgatacctcatacttcaaaagtatattttagggttgccgttcttccttcctcaactgatgtcagctgtctgtttcgcacaaaagttcatccgcccacagaatccattttattcaatgatgtgttcagagtcgccatttcccaaacagccttacaacagaagacactgaggaagaactttacctttgtgacagctatcactcatggagtgtgcttaccactcccagtaccaatgccaagctttgcgtga

SEQ ID NO: 8586 - DNA, 8826 bp, Homo sapiens
ctgatccgcagcggggccgcgaacagcgtttcctgaggcacctcccgcgcgtggttccgccgcgccccgcgccctgcgcccctcagcccctcgccggcgcccgcgtcgcgggttggcagcctagcccggcagccgcgttcccgccgcgtcccgcgcccggtacctatggaggcgccgctcgccggcgaggccgccgaccatgcctaggagggccgggagcggtcagctgccgctgccccggggctgggaggaggccagggactacgacggcaaggtcttctacattgaccacaacaccaggaggaccagctggatcgacccccgggacaggttaacgaagcccttgtcatttgctgattgtgttggggatgagctgccgtggggatgggaagcagggtttgaccctcagattggtgtctactacatcgatcacatcaacaaaaccacgcagatagaagatccaagaaaacaatggaggggggaacaggagaagatgctcaaggactacctctctgtggcacaggatgccctccggacacagaaggaactgtaccatgtgaaggagcagaggctggcgctggccctggatgaatacgtgcgattaaatgatgcctataaggaaaagtcaagttctcacacaagcttattctcaggatcttcatccagtactaaatatgatcccgatattttaaaagctgagatctccactacaagattaagggttaaaaagctaaagagagagctctcacagatgaagcaggaactgctctataaagaacaaggctttgaaacattgcagcaaattgataaaaaaatgtctggaggccagagcgggtatgaactcagtgaagccaaagccattctaacagaactaaaatctatcagaaaggcaattagctcaggagaaaaagaaaaacaagatctgatgcagagtcttgctaagctgcaggagcggtttcatttggatcagaacattggcagatctgagccagatttgagatgtagtcctgtgaactctcatttatgtctctccagacagacccttgatgctgggtcacaaacaagcatttccggagatattggagtaagaagtagatcaaatttagctgaaaaggtcaggctaagcctacagtatgaagaagccaaaagaagtatggccaacttaaaaattgaactgtcaaaattggacagtgaggcctggcctggggcactggatattgagaaggaaaaactgatgctgattaatgaaaaagaagaacttttgaaagagcttcagttcgtcaccccacagaaacgtacccaagatgaattagaacgcctagaagctgaaaggcagcggctggaagaagagttgctgtctgtgaggggaacaccaagcagagctctggccgagagattgagattggaagagagaagaaaagagctgctacagaaacttgaagaaactactaaattaactacttatttgcattcacaacttaaaagcctctctgccagcaccctgtccatgtcatctgggagcagcctgggttccctggcatcgagtcggggctctctgaacacctccagcagagggtcactcaactccctcagttccaccgaactctattacagcagtcaaagtgatcagatagatgtggattatcagtataaactggacttccttctgcaagagaaaagcggttacattccttctggacccatcaccaccatccatgaaaacgaggtggtcaagtcccctagccagcctggccagagtggactctgtggagtggcagctgcagcaacaggccacactcctccactggctgaggccccgaagtctgtggcctccctgtcctcgaggtcctccctttcctccttgtctcctccaggctctcccttggttttggaaggcacgtttcccatgtcttcttctcatgatgcctctctccatcagttcactgctgactttgaagactgtgagttgagtagccattttgcagatatcagcctcatcgaaaatcagattttgctggattctgattcaggaggagcctcccagtctctttcagaggataaagaccttaatgaatgtgctagggagccattatatgaaggaactgcagatgtggaaaaatcattaccaaaaagaagagtgatccacttgcttggggagaaaaccacttgtgtgtcggctgctgtgtctgatgagtctgtggctggagacagtggggtctatgaagctttcgtgaaacaacctagtgaaatggaagatgtcacatacagtgaagaggatgtagccattgtagagaccgcccaggttcagataggactcagatacaatgcaaaaagttcaagtttcatggtgattatagcacagctccgaaaccttcatgccttcttgatacctcatacttcaaaagtatattttagggttgccgttcttccttcctcaactgatgtcagctgtctgtttcgcacaaaagttcatccgcccacagaatccattttattcaatgatgtgttcagagtcgccatttcccaaacagccttacaacagaagacactgagggtagacctttgctctgtcagtaaacaccgaagggaagaatgcctggctggaactcagatcagcctggcagatttaccattttccagtgaggttttcactctatggtataacttgcttccttccaagcaaatgccttgcaaaaagaatgaagaaaatgaggactctgtatttcaaccaaaccagccgttagtagattctatagacttggatgcagtgtcagccttacttgcaagaacatcagctgagttgttagctgtggaacaagaattagcacaagaagaagaagaagaatcaggacaagaagagccaaggggcccagatggagactggctaacaatgctaagagaggcctctgatgaaattgtggctgaaaaagaggctgaagttaaattgccagaggacagtagctgtacagaagatttaagttcatgcactagtgtgcctgagatgaatgaagacgggaacaggaaagaaagcaactgtgccaaagacctcagaagtcagccacctactagaataccaacactggttgacaaagagacaaacactgatgaagccgctaatgacaatatggcagttcgccccaaagagcgcagcagcctgagctctagacagcatccgtttgtgaggagcagtgtgatagtgcgctcacagaccttttctccaggagagcggaaccagtacatctgcaggttaaatcggagtgacagtgacagttcaaccctggctaaaaaatcactgtttgtgagaaactccaccgaacgccgcagtttgagggtcaaaaggacggtttgccagtcagtccttagaagaacaacacaggaatgcccagtgcggacatctctagacttagaactggaccttcaggcatctctgacccggcagagccgcctcaatgatgagctgcaggcgctgagggacttgcggcagaagctggaggaactgaaagctcagggagagactgaccttccaccaggcgtgctggaggatgagaggttccagaggcttctgaagcaagctgagaagcaggctgaacagtccaaagaagagcagaagcaaggtctgaatgcagagaagttgatgaggcaagtctccaaggacgtgtgtcggctccgggagcagagccagaaggtgcctcggcaggtgcagtccttcagggagaagattgcctacttcaccagagcaaagataagcatcccatccctgccagctgatgatgtgtgattacatgacttaagaaattattttttcatctgttcactttcttagggagggtaaaagactgaagatttgtgtttttgttttggtgtttggttttttttggtaacgtaactgtcaactcttgaagaacttttatttcacatcagattttcaacacattaatttgtaaagtaccttgagtgtaatttttatatgcttaaaaaagaaaaaatcatataagaaagatgggataacctggtacacaaatgttgcccagtatgtgcgcattgccagtggacttcattttgtaaaaatggaatagaggcagtaccccacatgtgtactgttgagccggctgttgagaaacaacttggttcagccggtggttttgcttctcctttgtgttcctgtgagtaggctgtgccgatggcagcagcgccacgtggtatctgtgcgctggcgaggagaggagcgctttccatttggaggcagtgtgagcacacgctggagtgcagcgttccaaagtccgcccgaaatggatgctgcgtccacggccatcacctgtgcgggaacacctggtttccttaagacaatttcctttttgtccttttatatttttctaaagaaaactaagatataaactaccaagtgctcttaagaataaaaataagaataagaatacaaaggagcactactcttggctacacgaaagatcttgggattcatgacactgagggcagggagaagaaagaacaccagccacgcagagatacaaataagctcatcaaatgagcagctggtttgtctcactcagcctgaatttgcattaagtgttcaaaagtgagtttctggcttgcactagtgttttgccctaaatctaaggatggtgcctagtggtggccctgtgttctgaggacagagagagctggaggggtggagggaaatgcatcggcactcatttggtgtaaccaagaagagggggaaagatgtcttgatagaatcaaagttgccaaaaacaaagaagagtttatcaagcagatttctaacatttagtagaaactacttcatagctctcatttttagggggttctatctataatttatggtaaatagttgggaggcaaagggaagaatgtgtgtggggggattattaatttgaagtataagctaaattgtttattaaaaagcctattttggatgaacaagtttagagagataaactgactaatgtgtcctccagtttagaatttcaccttacccgacccaggcacttcttaaaaacacagatcctcagtgcagctctgccagcatcaaggcttttaaaatatgtagtatttaggccatttaaaccatacttattactcaataacccaagaaacaattttgggttagccatctaatatagcaaataaaatagattttttaaagaaatccaaaattgtcttaaaggaatggaccccttgaagaaaaaaaaaaaaagttttgttcctcagttagaatgctcactagctcactagcaagaatttttattttcttgaaagcaattatatatattttggaaagttcatgttattggaattgaagttcaaattaagcaacttctgagcctagaactttaattactttttcctaaatgtcccaacacttacatacaaatttctttgaagacataactggacatggcagacactgctttgaacaaaaaccagcctagtgaattgactgagtacagtcctttaaggctgcccagttcattctattagatgactaaggaaaactagaaaaagaatacagttcacccttgtcaaggtcaaatgtgaaagacagaagtttatttaatgtagaggtaaatgaaggtgagctgttttcagcatcttagtttgaccatgaaaatgtctatagaattatgtgtagttgttccgtacgattttattttcttcatttatttatttacagtcttatttatgttctgtttaatatatagtttgattctggccattttaaatatttgacacagaagagactatattggaatatttacagctttataagtctttcatcagattagctgttgactttttgtaatacaaaaagtttcagacaagtattaaagaataaaatctgtctcaggctggtagttagcagttgtgaccaagatgcttttggttgttgtatttcacaaaatttcctcatttctaacatgagagatgaacttattttaatataatcctttttctacactttaaaagtcagcaatagtgttatgtatttataggcagcttttaataatcttgtcatatttgtactaacccaaatgattcacagtgacaaaacattttaataacttgatcacaaaaccatatggacaaatatgaattttaatattataaatactatttttaaaaggtagaatttattcgcacagggtaaaaagaatgtaatatttagttctcaagtttgaattatcagtatattattacaattttgtatatcagaatcttaagtgttacaggtacaaaaagaatattgctagccaaatgaacaaagtttagctaaatctctgtagcatgcaaatcaaataaattaaaattttttgctattgctttatctatattgtcttaaatatcaaaagctcaggactgaacttaatatttaatcaggttaaattctgaacatgtttctgttttaatttgtcttgtttgtaaacgtatgcaaatacatcacatagattaactggtttctgcactttccatgtgtttgtgggtggaaaaaaattcagtggttttttttaaaaaaaaaagcaaaaacaaagctacatattgcctaatactctatttcagtgtcgtttattgttcagtttatttccctgattggcacaaacacaagagtttccttgaaccatgtaccaagcaaatacaaaatatttcatgaagaaatccccaggctggcagtttgtgatgaatagttcttgttggaactatatgtattgctgataaaaaaggacgaagtattttcattgagcaaataaaatgaagggctccagaatatgtgctctgtggtcgctgcgcctgggctggcagtgtgctccacagagaggcagccgtcccaggaggttatctacccacacaccccagtcctgccctgccgtgccccccacaggctgctcagtgcctgggaagccagaaacgctgcccgtgaaatacagaacacaggatgcagaagcacgtttgtgtggcagagtctacttgaatcatccaaaacccaagatcgccctcctgcctctgacagtatagaaggcgtgactgaatgtggctgccttttgaaaaaggttccatagagacactgaggtctctgattcagaaggagatgatgtgtctacacctttcacctctgaagcttctaaagagctagtaattattttatataataagacgtcatgcattttaaataaatatgcaacaagacctcaggcttattatactaggttatcttaaacacctgaaataagtaaatgatttgccaaatgattccgctccatatgaataataccttcaaagatacatagagattaatgttttatttaccacttctgtgcaatcgctattttaaaattgagaaaactcatccacagtaatgggtgtcattactattcagtcttgattgattttggtctcagactagaagataaaaatggtttaccagtcttggaaagaaactatagtttaatagccacaggaaaagatgcattttcaaaaatcaaaagcacagtgagatgactagagcgggacatcctaccaaatccagtgttgagcaagcgtctcctgaacagcagacgcttgtcctttctggcttagtgtttcaggttggtgtttctcgtctccagttcttgatgatgatcttgtgtttgtgccactgcgtagtggcccgaagctaggggagcgtggctggagcaggctgcacagtggagcagacaccctcctagcagaagagaaagtccagcaaaccagcccagaaacagggcctccccaaactcccacctggggacaaagtctgggacgttctcatcccagaactcctgaaccgtcttgtgggcaacccaagagacgggaaccagggctgtgactcccgaggcccaggacagaattcctcccaggatcagcagtcgcctcttgagatctctctgactctctccaattctcaaacagtccaggccaaacccagagaccagcaggcccagaaatcccagcccatttgacagaaacattaagatcctggagaccctgagttcagcaggcaaagccaggaaggagtcaaagtccttgcattgcatccccacttcctcttggatgacacaggtttgccagagtcccatggtccagttttccatttcatttaagtccaggttgaggttcttccagtgtggcaggtagtttgtaagacaggataaaacccatcccagcaaagataatgaaactccagctagttgagctacagttctaaatactaaagccattataatgtcctgagagctttagccaaactaactcctgcccttcggttgctgtgaaaagaagtgtgacacttgtgttataacttatgaaactcagaaatatttcttcattgtgtatataggaggattcttgccagagttgctattgtttgattccatgttgaatgggtttcacaaaaggatagggaaataatgccgccaaccagtaatgccaaggtgtggccaagattgtgtttgtgtcctgtgggctggatttgacagaaagcagtttgtcactgaaatataattaagtgataatctcctttcattgtcaaggttaaaatggctttcatgttattcccaacctttctaacaaagaattaagtctaaatgcaaaatgtttaactgatggttttggttcaactcctcctgctttgtgtttcactaactgcacctgtcagattttcatctcttatagttctcacatttcaaatgtgcatgttatggtaatactgagtgttattttttaaaaataggtttaagaaaagtatttcttaaccaaataaatcaatcttatcagaaa

SEQ ID NO: 8587 - DNA, 6356 bp, Homo sapiens
atgcctaggagggccgggagcggtcagctgccgctgccccggggctgggaggaggccagggactacgacggcaaggtcttctacattgaccacaacaccaggaggaccagctggatcgacccccgggacaggttaacgaagcccttgtcatttgctgattgtgttggggatgagctgccgtggggatgggaagcagggtttgaccctcagattggtgtctactacatcgatcacatcaacaaaaccacgcagatagaagatccaagaaaacaatggaggggggaacaggagaagatgctcaaggactacctctctgtggcacaggatgccctccggacacagaaggaactgtaccatgtgaaggagcagaggctggcgctggccctggatgaatacgtgcgattaaatgatgcctataaggaaaagtcaagttctcacacaagcttattctcaggatcttcatccagtactaaatatgatcccgatattttaaaagctgagatctccactacaagattaagggttaaaaagctaaagagagagctctcacagatgaagcaggaactgctctataaagaacaaggctttgaaacattgcagcaaattgataaaaaaatgtctggaggccagagcgggtatgaactcagtgaagccaaagccattctaacagaactaaaatctatcagaaaggcaattagctcaggagaaaaagaaaaacaagatctgatgcagagtcttgctaagctgcaggagcggtttcatttggatcagaacattggcagatctgagccagatttgagatgtagtcctgtgaactctcatttatgtctctccagacagacccttgatgctgggtcacaaacaagcatttccggagatattggagtaagaagtagatcaaatttagctgaaaaggtcaggctaagcctacagtatgaagaagccaaaagaagtatggccaacttaaaaattgaactgtcaaaattggacagtgaggcctggcctggggcactggatattgagaaggaaaaactgatgctgattaatgaaaaagaagaacttttgaaagagcttcagttcgtcaccccacagaaacgtacccaagatgaattagaacgcctagaagctgaaaggcagcggctggaagaagagttgctgtctgtgaggggaacaccaagcagagctctggccgagagattgagattggaagagagaagaaaagagctgctacagaaacttgaagaaactactaaattaactacttatttgcattcacaacttaaaagcctctctgccagcaccctgtccatgtcatctgggagcagcctgggttccctggcatcgagtcggggctctctgaacacctccagcagagggtcactcaactccctcagttccaccgaactctattacagcagtcaaagtgatcagatagatgtggattatcagtataaactggacttccttctgcaagagaaaagcggttacattccttctggacccatcaccaccatccatgaaaacgaggtggtcaagtcccctagccagcctggccagagtggactctgtggagtggcagctgcagcaacaggccacactcctccactggctgaggccccgaagtctgtggcctccctgtcctcgaggtcctccctttcctccttgtctcctccaggctctcccttggttttggaaggcacgtttcccatgtcttcttctcatgatgcctctctccatcagttcactgctgactttgaagactgtgagttgagtagccattttgcagatatcagcctcatcgaaaatcagattttgctggattctgattcaggaggagcctcccagtctctttcagaggataaagaccttaatgaatgtgctagggagccattatatgaaggaactgcagatgtggaaaaatcattaccaaaaagaagagtgatccacttgcttggggagaaaaccacttgtgtgtcggctgctgtgtctgatgagtctgtggctggagacagtggggtctatgaagctttcgtgaaacaacctagtgaaatggaagatgtcacatacagtgaagaggatgtagccattgtagagaccgcccaggttcagataggactcagatacaatgcaaaaagttcaagtttcatggtgattatagcacagctccgaaaccttcatgccttcttgatacctcatacttcaaaagtatattttagggttgccgttcttccttcctcaactgatgtcagctgtctgtttcgcacaaaagttcatccgcccacagaatccattttattcaatgatgtgttcagagtcgccatttcccaaacagccttacaacagaagacactgagggtagacctttgctctgtcagtaaacaccgaagggaagaatgcctggctggaactcagatcagcctggcagatttaccattttccagtgaggttttcactctatggtataacttgcttccttccaagcaaatgccttgcaaaaagaatgaagaaaatgaggactctgtatttcaaccaaaccagccgttagtagattctatagacttggatgcagtgtcagccttacttgcaagaacatcagctgagttgttagctgtggaacaagaattagcacaagaagaagaagaagaatcaggacaagaagagccaaggggcccagatggagactggttaaacacttatttcctttgctgttgggagctcaaagatgatgtgtttacacggcttacagtgaaacctttgctaacaatgctaagagaggcctctgatgaaattgtggctgaaaaagaggctgaagttaaattgccagaggacagtagctgtacagaagatttaagttcatgcactagtgtgcctgagatgaatgaagacgggaacaggaaagaaagcaactgtgccaaagacctcagaagtcagccacctactagaataccaacactggttgacaaagagacaaacactgatgaagccgctaatgacaatatggcagttcgccccaaagagcgcagcagcctgagctctagacagcatccgtttgtgaggagcagtgtgatagtgcgctcacagaccttttctccaggagagcggaaccagtacatctgcaggttaaatcggagtgacagtgacagttcaaccctggctaaaaaatcactgtttgtgagaaactccaccgaacgccgcagtttgagggtcaaaaggacggtttgccagtcagtccttagaagaacaacacaggaatgcccagtgcggacatctctagacttagaactggaccttcaggcatctctgacccggcagagccgcctcaatgatgagctgcaggcgctgagggacttgcggcagaagctggaggaactgaaagctcagggagagactgaccttccaccaggcgtgctggaggatgagaggttccagaggcttctgaagcaagctgagaagcaggctgaacagtccaaagaagagcagaagcaaggtctgaatgcagagaagttgatgaggcaagtctccaaggacgtgtgtcggctccgggagcagagccagaaggtgcctcggcaggtgcagtccttcagggagaagattgcctacttcaccagagcaaagataagcatcccatccctgccagctgatgatgtgtgattacatgacttaagaaattattttttcatctgttcactttcttagggagggtaaaagactgaagatttgtgtttttgttttggtgtttggttttttttggtaacgtaactgtcaactcttgaagaacttttatttcacatcagattttcaacacattaatttgtaaagtaccttgagtgtaatttttatatgcttaaaaaagaaaaaatcatataagaaagatgggataacctggtacacaaatgttgcccagtatgtgcgcattgccagtggacttcattttgtaaaaatggaatagaggcagtaccccacatgtgtactgttgagccggctgttgagaaacaacttggttcagccggtggttttgcttctcctttgtgttcctgtgagtaggctgtgccgatggcagcagcgccacgtggtatctgtgcgctggcgaggagaggagcgctttccatttggaggcagtgtgagcacacgctggagtgcagcgttccaaagtccgcccgaaatggatgctgcgtccacggccatcacctgtgcgggaacacctggtttccttaagacaatttcctttttgtccttttatatttttctaaagaaaactaagatataaactaccaagtgctcttaagaataaaaataagaataagaatacaaaggagcactactcttggctacacgaaagatcttgggattcatgacactgagggcagggagaagaaagaacaccagccacgcagagatacaaataagctcatcaaatgagcagctggtttgtctcactcagcctgaatttgcattaagtgttcaaaagtgagtttctggcttgcactagtgttttgccctaaatctaaggatggtgcctagtggtggccctgtgttctgaggacagagagagctggaggggtggagggaaatgcatcggcactcatttggtgtaaccaagaagagggggaaagatgtcttgatagaatcaaagttgccaaaaacaaagaagagtttatcaagcagatttctaacatttagtagaaactacttcatagctctcatttttagggggttctatctataatttatggtaaatagttgggaggcaaagggaagaatgtgtgtggggggattattaatttgaagtataagctaaattgtttattaaaaagcctattttggatgaacaagtttagagagataaactgactaatgtgtcctccagtttagaatttcaccttacccgacccaggcacttcttaaaaacacagatcctcagtgcagctctgccagcatcaaggcttttaaaatatgtagtatttaggccatttaaaccatacttattactcaataacccaagaaacaattttgggttagccatctaatatagcaaataaaatagattttttaaagaaatccaaaattgtcttaaaggaatggaccccttgaagaaaaaaaaaaaaagttttgttcctcagttagaatgctcactagctcactagcaagaatttttattttcttgaaagcaattatatatattttggaaagttcatgttattggaattgaagttcaaattaagcaacttctgagcctagaactttaattactttttcctaaatgtcccaacacttacatacaaatttctttgaagacataactggacatggcagacactgctttgaacaaaaaccagcctagtgaattgactgagtacagtcctttaaggctgcccagttcattctattagatgactaaggaaaactagaaaaagaatacagttcacccttgtcaaggtcaaatgtgaaagacagaagtttatttaatgtagaggtaaatgaaggtgagctgttttcagcatcttagtttgaccatgaaaatgtctatagaattatgtgtagttgttccgtacgattttattttcttcatttatttatttacagtcttatttatgttctgtttaatatatagtttgattctggccattttaaatatttgacacagaagagactatattggaatatttacagctttataagtctttcatcagattagctgttgactttttgtaatacaaaaagtttcagacaagtattaaagaataaaatctgtctcaggctggtagttagcagttgtgaccaagatgcttttggttgttgtatttcacaaaatttcctcatttctaacatgagagatgaacttattttaatataatcctttttctacactttaaaagtcagcaatagtgttatgtatttataggcagcttttaataatcttgtcatatttgtactaacccaaatgattcacagtgacaaaacattttaataacttgatcacaaaaccatatggacaaatatgaattttaatattataaatactatttttaaaaggtagaatttattcgcacagggtaaaaagaatgtaatatttagttctcaagtttgaattatcagtatattattacaattttgtatatcagaatcttaagtgttacaggtacaaaaagaatattgctagccaaatgaacaaagtttagctaaatctctgtagcatgcaaatcaaataaattaaaattttttgctattgctttatctatattgtcttaaatatcaaaagctcaggactgaacttaatatttaatcaggttaaattctgaacatgtttctgttttaatttgtcttgtttgtaaacgtatgcaaatacatcacataga

SEQ ID NO: 8588 - DNA, 1216 bp, Homo sapiens
tgagtctgtttatttcccagataacaacttagcatgcccaggttgcgtgttcatggagcatgcctgcctaccaaaagtgttttgtttttgttttaccataggctaacaatgctaagagaggcctctgatgaaattgtggctgaaaaagaggctgaagttaaattgccagaggacagtagctgtacagaagatttaagttcatgcactagtgtgcctgagatgaatgaagacgggaacaggaaagaaagcaactgtgccaaagacctcagaagtcagccacctactagaataccaacactggttgacaaagagacaaacactgatgaagccgctaatgacaatatggcagttcgccccaaagagcgcagcagcctgagctctagacagcatccgtttgtgaggagcagtgtgatagtgcgctcacagaccttttctccaggagagcggaaccagtacatctgcaggttaaatcggagtgacagtgacagttcaaccctggctaaaaaatcactgtttgtgagaaactccaccgaacgccgcagtttgagggtcaaaaggacggtttgccagtcagtccttagaagaacaacacaggaatgcccagtgcggacatctctagacttagaactggaccttcaggcatctctgacccggcagagccgcctcaatgatgagctgcaggcgctgagggacttgcggcagaagctggaggaactgaaagctcagggagagactgaccttccaccaggcgtgctggaggatgagaggttccagaggcttctgaagcaagctgagaagcaggctgaacagtccaaagaagagcagaagcaaggtctgaatgcagagaagttgatgaggcaagtctccaaggacgtgtgtcggctccgggagcagagccagaaggtgcctcggcaggtgcagtccttcagggagaagattgcctacttcaccagagcaaagataagcatcccatccctgccagctgatgatgtgtgattacatgacttaagaaattattttttcatctgttcactttcttagggagggtaaaagactgaagatttgtgtttttgttttggtgtttggttttttttggtaacgtaactgtcaactcttgaagaacttttatttcacatcagattttcaacacattaatttgtaaagtaccttgagtgtaatttttatatgcttaaaaaagaaaaaatcatataagaaa

SEQ ID NO: 8589 - DNA, 4887 bp, Homo sapiens
atgcctaggagggccgggagcggtcagctgccgctgccccggggctgggaggaggccagggactacgacggcaaggtcttctacattgaccacaacaccaggaggaccagctggatcgacccccgggacaggttaacgaagcccttgtcatttgctgattgtgttggggatgagctgccgtggggatgggaagcagggtttgaccctcagattggtgtctactacatcgatcacatcaacaaaaccacgcagatagaagatccaagaaaacaatggaggggggaacaggagaagatgctcaaggactacctctctgtggcacaggatgccctccggacacagaaggaactgtaccatgtgaaggagcagaggctggcgctggccctggatgaatacgtgcgattaaatgatgcctataaggaaaagtcaagttctcacacaagcttattctcaggatcttcatccagtactaaatatgatcccgatattttaaaagctgagatctccactacaagattaagggttaaaaagctaaagagagagctctcacagatgaagcaggaactgctctataaagaacaaggctttgaaacattgcagcaaattgataaaaaaatgtctggaggccagagcgggtatgaactcagtgaagccaaagccattctaacagaactaaaatctatcagaaaggcaattagctcaggagaaaaagaaaaacaagatctgatgcagagtcttgctaagctgcaggagcggtttcatttggatcagaacattggcagatctgagccagatttgagatgtagtcctgtgaactctcatttatgtctctccagacagacccttgatgctgggtcacaaacaagcatttccggagatattggagtaagaagtagatcaaatttagctgaaaaggtcaggctaagcctacagtatgaagaagccaaaagaagtatggccaacttaaaaattgaactgtcaaaattggacagtgaggcctggcctggggcactggatattgagaaggaaaaactgatgctgattaatgaaaaagaagaacttttgaaagagcttcagttcgtcaccccacagaaacgtacccaagatgaattagaacgcctagaagctgaaaggcagcggctggaagaagagttgctgtctgtgaggggaacaccaagcagagctctggccgagagattgagattggaagagagaagaaaagagctgctacagaaacttgaagaaactactaaattaactacttatttgcattcacaacttaaaagcctctctgccagcaccctgtccatgtcatctgggagcagcctgggttccctggcatcgagtcggggctctctgaacacctccagcagagggtcactcaactccctcagttccaccgaactctattacagcagtcaaagtgatcagatagatgtggattatcagtataaactggacttccttctgcaagagaaaagcggttacattccttctggacccatcaccaccatccatgaaaacgaggtggtcaagtcccctagccagcctggccagagtggactctgtggagtggcagctgcagcaacaggccacactcctccactggctgaggccccgaagtctgtggcctccctgtcctcgaggtcctccctttcctccttgtctcctccaggctctcccttggttttggaaggcacgtttcccatgtcttcttctcatgatgcctctctccatcagttcactgctgactttgaagactatgtggaaaaatcattaccaaaaagaagagtgatccacttgcttggggagaaaaccacttgtgtgtcggctgctgtgtctgatgagtctgtggctggagacagtggggtctatgaagctttcgtgaaacaacctagtgaaatggaagatgtcacatacagtgaagaggatgtagccattgtagagaccgcccaggttcagataggactcagatacaatgcaaaaagttcaagtttcatggtgattatagcacagctccgaaaccttcatgccttcttgatacctcatacttcaaaagtatattttagggttgccgttcttccttcctcaactgatgtcagctgtctgtttcgcacaaaagttcatccgcccacagaatccattttattcaatgatgtgttcagagtcgccatttcccaaacagccttacaacagaagacactgagggtagacctttgctctgtcagtaaacaccgaagggaagaatgcctggctggaactcagatcagcctggcagatttaccattttccagtgaggttttcactctatggtataacttgcttccttccaagcaaatgccttgcaaaaagaatgaagaaaatgaggactctgtatttcaaccaaaccagccgttagtagattctatagacttggatgcagtgtcagccttacttgcaagaacatcagctgagttgttagctgtggaacaagaattagcacaagaagaagaagaagaatcaggacaagaagagccaaggggcccagatggagactggctaacaatgctaagagaggcctctgatgaaattgtggctgaaaaagaggctgaagttaaattgccagaggacagtagctgtacagaagatttaagttcatgcactagtgtgcctgagatgaatgaagacgggaacaggaaagaaagcaactgtgccaaagacctcagaagtcagccacctactagaataccaacactggttgacaaagagacaaacactgatgaagccgctaatgacaatatggcagttcgccccaaagagcgcagcagcctgagctctagacagcatccgtttgtgaggagcagtgtgatagtgcgctcacagaccttttctccaggagagcggaaccagtacatctgcaggttaaatcggagtgacagtgacagttcaaccctggctaaaaaatcactgtttgtgagaaactccaccgaacgccgcagtttgagggtcaaaaggacggtttgccagtcagtccttagaagaacaacacaggaatgcccagtgcggacatctctagacttagaactggaccttcaggcatctctgacccggcagagccgcctcaatgatgagctgcaggcgctgagggacttgcggcagaagctggaggaactgaaagctcagggagagactgaccttccaccaggcgtgctggaggatgagaggttccagaggcttctgaagcaagctgagaagcaggctgaacagtccaaagaagagcagaagcaaggtctgaatgcagagaagttgatgaggcaagtctccaaggacgtgtgtcggctccgggagcagagccagaaggtgcctcggcaggtgcagtccttcagggagaagattgcctacttcaccagagcaaagataagcatcccatccctgccagctgatgatgtgtgattacatgacttaagaaattattttttcatctgttcactttcttagggagggtaaaagactgaagatttgtgtttttgttttggtgtttggttttttttggtaacgtaactgtcaactcttgaagaacttttatttcacatcagattttcaacacattaatttgtaaagtaccttgagtgtaatttttatatgcttaaaaaagaaaaaatcatataagaaagatgggataacctggtacacaaatgttgcccagtatgtgcgcattgccagtggacttcattttgtaaaaatggaatagaggcagtaccccacatgtgtactgttgagccggctgttgagaaacaacttggttcagccggtggttttgcttctcctttgtgttcctgtgagtaggctgtgccgatggcagcagcgccacgtggtatctgtgcgctggcgaggagaggagcgctttccatttggaggcagtgtgagcacacgctggagtgcagcgttccaaagtccgcccgaaatggatgctgcgtccacggccatcacctgtgcgggaacacctggtttccttaagacaatttcctttttgtccttttatatttttctaaagaaaactaagatataaactaccaagtgctcttaagaataaaaataagaataagaatacaaaggagcactactcttggctacacgaaagatcttgggattcatgacactgagggcagggagaagaaagaacaccagccacgcagagatacaaataagctcatcaaatgagcagctggtttgtctcactcagcctgaatttgcattaagtgttcaaaagtgagtttctggcttgcactagtgttttgccctaaatctaaggatggtgcctagtggtggccctgtgttctgaggacagagagagctggaggggtggagggaaatgcatcggcactcatttggtgtaaccaagaagagggggaaagatgtcttgatagaatcaaagttgccaaaaacaaagaagagtttatcaagcagatttctaacatttagtagaaactacttcatagctctcatttttagggggttctatctataatttatggtaaatagttgggaggcaaagggaagaatgtgtgtggggggattattaatttgaagtataagctaaattgtttattaaaaagcctattttggatgaacaagtttagagagataaactgactaatgtgtcctccagtttagaatttcaccttacccgacccaggcacttcttaaaaacacagatcctcagtgcagctctgccagcatcaaggcttttaaaatatgtagtatttaggccatttaaaccatacttattactcaataacccaagaaacaattttgggttagccatctaatatagcaaataaaatagattttttaaagaaatccaaaattgtcttaaaggaatggaccccttgaagaaaaaaaaaaaaa

SEQ ID NO: 8590 - DNA, 921 bp, Homo sapiens
actggtgacgtagatctcatgtgaccaggagtcgacgtgtgcagaagtcctggtaatctggtccttgttcccgtctggataccagcttccttcagcagcgcaggcggtggtccctgaggcccgtggaaggagtcaaacttgcgggaattttgcagaagtcattgtattcaaagaagaataagcaagaaagaaaagaaggaaggaagagaggtagacagatacaagatgaaatcctgtcaaaaaatggaaggaaaaccagaaaatgagagtgaaccaaagcatgaggaagagccaaagcctgaggaaaagccagaagaggaggagaagctagaggaggaggccaaagcaaaaggaacttttagagaaaggctgattcaatctctccaggagtttaaagaagatatacacaacaggcatttaagcaatgaagatatgtttagagaagtggatgaaatagatgagataaggagagtcagaaacaaacttatagtgatgcgttggaaggttaatcgaaaccatccttacccctatttaatgtagtttaccttgatttttatctgatattaacaataccatatagcttgctttttattagcatttcctgatattcctttgtccatatttctacttataacctgttgctattaatggttttagatgtatctcttgttatctgcatctcattgtttattgtattttgaaccaatctacaagtctctgtcttttaataaaagaactttacacatttgtaaaaaagaggttcttggtaagatataaaatggaaaaaggctaagtaatatgtgaatatcatatttttgaaaggtaaaaagtacatttgtatattacatatatggacataacttgtgaaggatgaaagaaagtacagcctctcggtggtgggattatgaatgatttttctcc

SEQ ID NO: 8591 - DNA, 1096 bp, Homo sapiens
cgagctcactggtgacgtagatctcatgtgaccaggagtcgacgtgtgcagaagtcctggtaatctggtccttgttcccgtctggataccagcttccttcagcagcgcaggcggtggtccctgaggcccgtggaaggagtcaaacttgcgggaattttgcagtttatctgcagggctgttgtttccagcaagacccaaagctagaaaaggaggaggaagaaactgacccgatcagtgccagaagtcattgtattcaaagaagaataagcaagaaagaaaagaaggaaggaagagaggtagacagatacaagatgaaatcctgtcaaaaaatggaaggaaaaccagaaaatgagagtgaaccaaagcatgaggaagagccaaagcctgaggaaaagccagaagaggaggagaagctagaggaggaggccaaagcaaaaggaacttttagagaaaggctgattcaatctctccaggagtttaaagaagatatacacaacaggcatttaagcaatgaagatatgtttagagaagtggatgaaatagatgagataaggagagtcagaaacaaacttatagtgatgcgttggaaggttaatcgaaaccatccttacccctatttaatgtagtttaccttgatttttatctgatattaacaataccatatagcttgctttttattagcatttcctgatattcctttgtccatatttctacttataacctgttgctattaatggttttagatgtatctcttgttatctgcatctcattgtttattgtattttgaaccaatctacaagtctctgtcttttaataaaagaactttacacatttgtaaaaaagaggttcttggtaagatataaaatggaaaaaggctaagtaatatgtgaatatcatatttttgaaaggtaaaaagtacatttgtatattacatatatggacataacttgtgaaggatgaaagaaagtacagcctctcggtggtgggattatgaatgatttttctccttttgcttgtttgtattttctatattcctaaaattaacacacattattattgctagaataataaaagttttataaaaaagaagcaacaa

SEQ ID NO: 8592 - DNA, 6647 bp, Homo sapiens
gcggggcccgcgccgtcatgccttggctgagcggcggccggcggcgacggcggggacagccgcgcgaggccccgcgggagccgccgccttctgcgcagccccagcgggaaccgcgccgccggcgccccccgccgcggtccccacgcccccagctccttccgcgccgccgccgcgggcccgggagagcgccgagctgccgctgcccgccggctgggaggaggcgcgagactacgacggtcgcgtcttttacattgaccacaacacgcgccagacgtcgtggatcgacccccgcgaccggataacaaagccattgacctttgccgattgtgttggggacgaacttcctttaggatgggaaaccgtatatgataaacaaattggagtttattacatggaccacataaataaacttacccagattgaggatccaagagaacagtggaggcgagagcaagagcgcatgttgaaggaatatttaattgtagctcaggaggctctcaatgccaagaaagaaatctaccagattaagcagcagcggttcgagctggcccaggaggaataccagcagctgcacaaaatgtgtgaggatgacagccgctcgtacgccagctcattctctggatattcaacaaatacaaagtatgacccacaccaaattaaagcagaaatagcaagtcgtcgggataggctttccagattaaaacgagagctgacccagatgaagcaggaactgcagtacaaagaaaagggggtggagaccctgcaagagattgatcggaagatgtcaagtactcacaccagctacaaactggatgaggcgcaggctatcatgagtgagctccggaccatcaagaaggccatttgcacaggcgagaaggagaggcgggacctgatgcatagcctggccaagctgaccgatagcttcaagaacagctgctccgttaccgactctctagtggacttccctcaccatgtaggcgtgcctggcgatgctggtgtaccccagcagttctgcgatgccggctcccagactgatatcatcggggagtttgtctttgatgataaaacaagacttgtagaccgagtcagacttaattggcaatatgaagaagccagaaagagagtcgccaacatccagcagcagctggcccggcttgacaatgagtcctggccaagcacggccgaggctgacagggaccggctgcagctcatcaaggagaaggaggccctgctgcaggagcttcagctcatcattgcacagcgccgctctgcgggagatgtggcccggctggaggaggagcgggagcgcctagaggaggagctgcggcgtgcacgggccacctccgcacagggcgccacggagaggattctgcttcaggaaaaaaggaattgtctacttatgcagctggaagaagccacccgcttaacatcctacctccagtcccagttaaaaagcctgtgtgccagcaccctgacggtgtcctcggggagcagccgcgggtccctagcctccagccgtgggtctctggcctccagccggggctccctgagctcggtcagcttcacggacatctacggcctcccgcagtacgagaagcccgacgctgagggcagccagcttctacgcttcgacctcattcccttcgactctctggggcgagatgctcccttttcagagcccccaggcccctcgggcttccacaagcagaggcggtccctggacacgccccagtccctggcatcgctgtcctcccgctcctcgctgtcctcgctgtcgcccccaagctcgcccctggacacgcccttcctccctgcctcacgggactcgccgctggcgcagctggcggacagctgtgaggggccaggcctgggcgccctagacagactgcgggcacacgcctcggctatgggggacgaagacttaccaggcatggcggcccttcagccacacggggtccccggggatggggaagggccgcacgagcgaggacccccaccagccagcgctcccgtgggtggaacagtgactcttcgagaagacagtgccaagaggttggagaggagggcacgccgcatctccgcatgtctgtcggattattcgctagccagcgacagtggggtgtttgaacctctaaccaaaaggaacgaagatgccgaggagcctgcctacggagacacggccagtaacggagatccccagatccacgtgggactcctgcgcgacagtggcagcgagtgtctcctcgtgcacgtgctgcagctgaagaacccggcggggctggcggtgaaggaagactgcaaagtccacatccgagtctatttgcccccactggactcgggcacgcccaacacttactgctccaaggctctggagttccaagtgccgctggtgtttaacgaagtgttcagaatccccgtgcattccagcgcgttgacactgaagtcacttcagttatacgtgtgttcagtgactccgcagctgcaggaagaactgctgggcattgctcagattaacctggctgactatgacagtttgagtgagatgcagctgcgctggcattccgtgcaggtgttcaccagctctgaaccatcaaggacgcgggaggctgggtgtgcaggagagagctccgcccgggaccctgcacacaccatctccatctccggcaagacggatgcggtgacggtgctcctggccagaaccacggcacagctgcaggcggtggagagggaactggccgaggagcgggccaagctggagtacacggaggaggaggtcctggagatggagcgcaaggaggagcaggccgaggccatatccgagcggagttggcaagcggactcggtggatagcggctgtagcaactgcacccagaccagccctccgtacccagagccctgttgcatgggtatcgactccatcctgggccacccatttgctgctcaggcagggccttacagccccgagaaatttcagccctcgcctcttaaggttgataaggaaaccaacacggaagatctctttctggaagaagcagccagcctcgtgaaggagcggcccagccgccgggcccgagggtcgccttttgttcggagtggcacgattgtccgttcccagacattctcgcctggagcacgaagccagtatgtttgcagactttatcgtagtgacagcgacagttcaacgctgccccggaagtccccctttgtccgaaatactttggaaagacgaacccttcgctataagcagtcatgcaggtcttccctggctgagctcatggcccgcacctccctggacttggagctggatctccaggcgtcgagaacacggcagaggcagctgaatgaggagctctgcgccctccgtgagctgcggcagcggttggaggacgcccagctccgtggccagactgacctcccaccctgggtgcttcgggacgagcggctccgtggcctgctgcgggaggccgagcggcagacaagacagaccaaacttgactaccgtcatgagcaggcggctgagaagatgctgaagaaggcctccaaggagatctaccagctgcgtgggcagagccacaaagagcccatccaagtgcagacctttagggagaagatagcattcttcacaaggccaaggatcaacatacctcctctcccagccgacgacgtctgatggagtgcattgtgcacatgaagtatttatccacctgttttattttcatgaagttcttagactagctgaatttgtctttaaaatatttgtgcaaagctattaatatacacattttgtaaaaaaaaaaaaaaaacacgtatatctatacatatatattttataatagtgacggcaacagggcttggtttttccttgttgtgaaatcgacatctctgaagacaggttattttataaaagatcaactatcatgttaagaatgtacagtttttatgctgttttatttgacttaaaggctggaagacagaaacgaagtgagttcaggcaaattcactgtattgtaatttatttatagtacttttttttccttgaaggaaaatactgactttaagatgtattttaagactgaaattttgttctttagtacttttcatgcagtagaacggaacttggggctggtttggtttttgacacctgaaatgcgaacgctatgtgctaaatttgtcaccgtatcatatgtgcatttaccatgtatattgtacacattcactcccttgatgtcatgttaaaatgtcccctgcagtggttcaatcgtgactcggaagcatgtgtgtgttgcagaggtcagtctctggcgtgggccgcacgccaaccgctcatttctgtgttgcctttggaagcatctttctgtgctcagcgtgagtctgaagcaggcgccagggcctctggtgtacggggcttcagcctgcttgcttgtggtggctgtctgtggggcttcagcctgactgtccgtggtggctgtccatgctgcccgcctccccccaccccgccctgtccgactgtaacagaccaggagggtggcggaggaactcctgccacgccactgtgtcatgaaggaaagtgaaagggaacgaggaagtaggaatgcccacgctcgttgactccgtgggtgaatacagcagttaggacatacacaccatcacctttgaaagtgcttgtttgggggagggaaggacatacgggtaactagaactacccagcgagtcgtccagaggagaggatcaggtttgagtcaggaggctccctgtactggagtcgtcccactattcctcaagaaatcttagaaccagcttgtgaggaaaaacattttttaatgtaataaaaatatgccattattctttgaaatgccaaatgatataaatattttgcctaatacatatttattgtagatgaaatgcactcttctcgatgaggcctcgatttgaatcaatggggtgggccacaggaaatgtcagaggaaccagaactcagaactcttcctcctggacctttcttcccttcccttggaggtatccctttgaatcaggcctctctcttctcatcagtctgtagcttccccccttgtataacctgctttcctttttacatttattaaaagtggattttgtaaaagcatttcattgacacgcgacctatcacagacaatggaattcgtcagtggtggtaagactgaaatcctgatgcttttcacacttcttgtctcttgctatgtatttctgcctctagccttgccatgttttgccttttttttttctttttggccaattcctttttatatgtgcccacaacagaggtggggagacacggagcaccctgggtccttcccagcgctgctgggcaggccccgtctccaggccccagctgttgaaactttgaagggcaacaaacaaccatccacactgccggaccctaggctgttcagggaggcagctcatttccaccccggccccaggacacccagcctgtgccccacaaggatctctctaaatgggagggattgaggctacttttctgccaagccctattaagtagtaatgtggggaaacccactgtgtcagtgcaggaagccctagacaaatgttttcaaataaatttcactgcccagcctgcacagatttccatttgaagtacttcccatccaccctgacacccaaaggggtttttttgttttgttttgtttttgagacagggtcttgctttgttgcccaggctggagtgcagtgacgtggtcatagctcactgcagcctcaacctcctgggctcaagtgaccctcctgcctcagcctcccaaagttctgagatgataggcatgagccattgtgcctagcctattttgatttttttcttagagtcaaggtcttgctctgttgcccaggctgatcttggacttgcgagccaccatgcctggctgggttttttaaaaatagaatctcactgatagcctgcaagaaacagatgcagtgcctgcttccgtatcagtccaaggagccctcgtgtttgccacctttacctttgaacctccccctgcctccctgcctgtgtccgcttttgcagctcaatgcagccatgacaaggaaagaaaagacaaaggaaggccagagagccgcgcagttctctgcaggtgcagatgcaggcagtggaggtggcctgagcaggcagaaggacaccaagcgccctatgttgcttgtcattcatgacgtggtcttggagcttctgactagttcagactgccacgccaaccccagaaaataccccacatgccagaaaagtgaagtcctaggtgtttccatctatgtttcaatctgtccatctaccaggcctcgcgataaaaacaaaacaaaaaaacgctgccaggttttagaagcagttctggtctcaaaaccatcaggatcctgccaccagggttcttttgaaatagtaccacatgtaaaagggaatttggctttcacttcatctaatcactgaattgtcaggctttgattgataattgtagaaataagtagccttctgttgtgggaataagttataatcagtattcatctctttgttttttgtcactcttttctctctaattgtgtcatttgtactgtttgaaaaatatttcttctataaaattaaactaacctgccttaagaacaga

SEQ ID NO: 8593 - DNA, 3409 bp, Homo sapiens
ttaagtcacatttcagaacttacccagattgaggatccaagagaacagtggaggcgagagcaagagcgcatgttgaaggaatatttaattgtagctcaggaggctctcaatgccaagaaagaaatctaccagattaagcagcagcggttcgagctggcccaggaggaataccagcagctgcacaaaatgtgtgaggatgacagccgctcgtacgccagctcattctctggatattcaacaaatacaaagtatgacccacaccaaattaaagcagaaatagcaagtcgtcgggataggctttccagattaaaacgagagctgacccagatgaagcaggaactgcagtacaaagaaaagggggtggagaccctgcaagagattgatcggaagatgtcaagtactcacaccagctacaaactggatgaggcgcaggctatcatgagtgagctccggaccatcaagaaggccatttgcacaggcgagaaggagaggcgggacctgatgcatagcctggccaagctgaccgatagcttcaagaacagctgctccgttaccgactctctagtggacttccctcaccatgtaggcgtgcctggcgatgctggtgtaccccagcagttctgcgatgccggctcccagactgatatcatcggggagtttgtctttgatgataaaacaagacttgtagaccgagtcagacttaattggcaatatgaagaagccagaaagagagtcgccaacatccagcagcagctggcccggcttgacaatgagtcctggccaagcacggccgaggctgacagggaccggctgcagctcatcaaggagaaggaggccctgctgcaggagcttcagctcatcattgcacagcgccgctctgcgggagatgtggcccggctggaggaggagcgggagcgcctagaggaggagctgcggcgtgcacgggccacctccgcacagggcgccacggagaggattctgcttcaggaaaaaaggaattgtctacttatgcagctggaagaagccacccgcttaacatcctacctccagtcccagttaaaaagcctgtgtgccagcaccctgacggtgtcctcggggagcagccgcgggtccctagcctccagccgtgggtctctggcctccagccggggctccctgagctcggtcagcttcacggacatctacggcctcccgcagtacgagaagcccgacgctgagggcagccagcttctacgcttcgacctcattcccttcgactctctggggcgagatgctcccttttcagagcccccaggcccctcgggcttccacaagcagaggcggtccctggacacgccccagtccctggcatcgctgtcctcccgctcctcgctgtcctcgctgtcgcccccaagctcgcccctggacacgcccttcctccctgcctcacgggactcgccgctggcgcagctggcggacagctgtgaggggccaggcctgggcgccctagacagactgcgggcacacgcctcggctatgggggacgaagacttaccaggcatggcggcccttcagccacacggggtccccggggatggggaagggccgcacgagcgaggacccccaccagccagcgctcccgtgggtggaagtaagtgcggatgcagtgactcttcgagaagacagtgccaagaggttggagaggagggcacgccgcatctccgcatgtctgtcggattattcgctagccagcgacagtggggtgtttgaacctctaaccaaaaggaacgaagatgccgaggagcctgcctacggagacacggccagtaacggagatccccagatccacgtgggactcctgcgcgacagtggcagcgagtgtctcctcgtgcacgtgctgcagctgaagaacccggcggggctggcggtgaaggaagactgcaaagtccacatccgagtctatttgcccccactggactcgggcacgcccaacacttactgctccaaggctctggagttccaagtgccgctggtgtttaacgaagtgttcagaatccccgtgcattccagcgcgttgacactgaagtcacttcagttatacgtgtgttcagtgactccgcagctgcaggaagaactgctgggcattgctcagattaacctggctgactatgacagtttgagtgagatgcagctgcgctggcattccgtgcaggtgttcaccagctctgaaccatcaaggacgcgggaggctgggtgtgcaggagagagctccgcccgggaccctgcacacaccatctccatctccggcaagacggatgcggtgacggtgctcctggccagaaccacggcacagctgcaggcggtggagagggaactggccgaggagcgggccaagctggagtacacggaggaggaggtcctggagatggagcgcaaggaggagcaggccgaggccatatccgagcggagttggcaagcggactcggtggatagcggctgtagcaactgcacccagaccagccctccgtacccagagccctgttgcatgggtatcgactccatcctgggccacccatttgctgctcaggcagggccttacagccccgagaaatttcagccctcgcctcttaaggttgataaggaaaccaacacggaagatctctttctggaagaagcagccagcctcgtgaaggagcggcccagccgccgggcccgagggtcgccttttgttcggagtggcacgattgtccgttcccagacattctcgcctggagcacgaagccagtatgtttgcagactttatcgtagtgacagcgacagttcaacgctgccccggaagtccccctttgtccgaaatactttggaaagacgaacccttcgctataagcagtcatgcaggtcttccctggctgagctcatggcccgcacctccctggacttggagctggatctccaggcgtcgagaacacggcagaggcagctgaatgaggagctctgcgccctccgtgagctgcggcagcggttggaggacgcccagctccgtggccagactgacctcccaccctgggtgcttcgggacgagcggctccgtggcctgctgcgggaggccgagcggcagacaagacagaccaaacttgactaccgtcatgagcaggcggctgagaagatgctgaagaaggcctccaaggagatctaccagctgcgtgggcagagccacaaagagcccatccaagtgcagacctttagggagaagatagcattcttcacaaggccaaggatcaacatacctcctctcccagccgacgacgtctgatggagtgcattgtgcacatgaagtatttatccacctgttttattttcatgaagttcttagactagctgaatttgtctttaaaatatttgtgcaaagctattaatatacacattttgt

SEQ ID NO: 8594 - DNA, 3476 bp, Homo sapiens
tgacctttgccgattgtgttggggacgaacttcctttaggatgggaaaccgtatatgataaacaaattggagtttattacatggaccacataaataaacttacccagattgaggatccaagagaacagtggaggcgagagcaagagcgcatgttgaaggaatatttaattgtagctcaggaggctctcaatgccaagaaagaaatctaccagattaagcagcagcggttcgagctggcccaggaggaataccagcagctgcacaaaatgtgtgaggatgacagccgctcgtacgccagctcattctctggatattcaacaaatacaaagtatgacccacaccaaattaaagcagaaatagcaagtcgtcgggataggctttccagattaaaacgagagctgacccagatgaagcaggaactgcagtacaaagaaaagggggtggagaccctgcaagagattgatcggaagatgtcaagtactcacaccagctacaaactggatgaggcgcaggctatcatgagtgagctccggaccatcaagaaggccatttgcacaggcgagaaggagaggcgggacctgatgcatagcctggccaagctgaccgatagcttcaagaacagctgctccgttaccgactctctagtggacttccctcaccatgtaggcgtgcctggcgatgctggtgtaccccagcagttctgcgatgccggctcccagactgatatcatcggggagtttgtctttgatgataaaacaagacttgtagaccgagtcagacttaattggcaatatgaagaagccagaaagagagtcgccaacatccagcagcagctggcccggcttgacaatgagtcctggccaagcacggccgaggctgacagggaccggctgcagctcatcaaggagaaggaggccctgctgcaggagcttcagctcatcattgcacagcgccgctctgcgggagatgtggcccggctggaggaggagcgggagcgcctagaggaggagctgcggcgtgcacgggccacctccgcacagggcgccacggagaggattctgcttcaggaaaaaaggaattgtctacttatgcagctggaagaagccacccgcttaacatcctacctccagtcccagttaaaaagcctgtgtgccagcaccctgacggtgtcctcggggagcagccgcgggtccctagcctccagccgtgggtctctggcctccagccggggctccctgagctcggtcagcttcacggacatctacggcctcccgcagtacgagaagcccgacgctgagggcagccagcttctacgcttcgacctcattcccttcgactctctggggcgagatgctcccttttcagagcccccaggcccctcgggcttccacaagcagaggcggtccctggacacgccccagtccctggcatcgctgtcctcccgctcctcgctgtcctcgctgtcgcccccaagctcgcccctggacacgcccttcctccctgcctcacgggactcgccgctggcgcagctggcggacagctgtgaggggccaggcctgggcgccctagacagactgcgggcacacgcctcggctatgggggacgaagacttaccaggcatggcggcccttcagccacacggggtccccggggatggggaagggccgcacgagcgaggacccccaccagccagcgctcccgtgggtggaacagtgactcttcgagaagacagtgccaagaggttggagaggagggcacgccgcatctccgcatgtctgtcggattattcgctagccagcgacagtggggtgtttgaacctctaaccaaaaggaacgaagatgccgaggagcctgcctacggagacacggccagtaacggagatccccagatccacgtgggactcctgcgcgacagtggcagcgagtgtctcctcgtgcacgtgctgcagctgaagaacccggcggggctggcggtgaaggaagactgcaaagtccacatccgagtctatttgcccccactggactcgggcacgcccaacacttactgctccaaggctctggagttccaagtgccgctggtgtttaacgaagtgttcagaatccccgtgcattccagcgcgttgacactgaagtcacttcagttatacgtgtgttcagtgactccgcagctgcaggaagaactgctgggcattgctcagattaacctggctgactatgacagtttgagtgagatgcagctgcgctggcattccgtgcaggtgttcaccagctctgaaccatcaaggacgcgggaggctgggtgtgcaggagagagctccgcccgggaccctgcacacaccatctccatctccggcaagacggatgcggtgacggtgctcctggccagaaccacggcacagctgcaggcggtggagagggaactggccgaggagcgggccaagctggagtacacggaggaggaggtcctggagatggagcgcaaggaggagcaggccgaggccatatccgagcggagttggcaagcggactcggtggatagcggctgtagcaactgcacccagaccagccctccgtacccagagccctgttgcatgggtatcgactccatcctgggccacccatttgctgctcaggcagggccttacagccccgagaaatttcagccctcgcctcttaaggttgataaggaaaccaacacggaagatctctttctggaagaagcagccagcctcgtgaaggagcggcccagccgccgggcccgagggtcgccttttgttcggagtggcacgattgtccgttcccagacattctcgcctggagcacgaagccagtatgtttgcagactttatcgtagtgacagcgacagttcaacgctgccccggaagtccccctttgtccgaaatactttggaaagacgaacccttcgctataagcagtcatgcaggtcttccctggctgagctcatggcccgcacctccctggacttggagctggatctccaggcgtcgagaacacggcagaggcagctgaatgaggagctctgcgccctccgtgagctgcggcagcggttggaggacgcccagctccgtggccagactgacctcccaccctgggtgcttcgggacgagcggctccgtggcctgctgcgggaggccgagcggcagacaagacagaccaaacttgactaccgtcatgagcaggcggctgagaagatgctgaagaaggcctccaaggagatctaccagctgcgtgggcagagccacaaagagcccatccaagtgcagacctttagggagaagatagcattcttcacaaggccaaggatcaacatacctcctctcccagccgacgacgtctgatggagtgcattgtgcacatgaagtatttatccacctgttttattttcatgaagttcttagactagctgaatttgtctttaaaatatttgtgcaaagctattaatatacacattttgt

SEQ ID NO: 8595 - DNA, 1724 bp, Homo sapiens
tgacctttgccgattgtgttggggacgaacttcctttaggatgggaaaccgtatatgataaacaaattggagtttattacatggaccacataaataaacttacccagattgaggatccaagagaacagtggaggcgagagcaagagcgcatgttgaaggaatatttaattgtagctcaggaggctctcaatgccaagaaagaaatctaccagattaagcagcagcggttcgagctggcccaggaggaataccagcagctgcacaaaatgtgtgaggatgacagccgctcgtacgccagctcattctctggatattcaacaaatacaaagtatgacccacaccaaattaaagcagaaatagcaagtcgtcgggataggctttccagattaaaacgagagctgacccagatgaagcaggaactgcagtacaaagaaaagggggtggagaccctgcaagagattgatcggaagatgtcaagtactcacaccagctacaaactggatgaggcgcaggctatcatgagtgagctccggaccatcaagaaggccatttgcacaggcgagaaggagaggcgggacctgatgcatagcctggccaagctgaccgatagcttcaagaacagctgctccgttaccgactctctagtggacttccctcaccatgtaggcgtgcctggcgatgctggtgtaccccagcagttctgcgatgccggctcccagactgatatcatcggggagtttgtctttgatgataaaacaagacttgtagaccgagtcagacttaattggcaatatgaagaagccagaaagagagtcgccaacatccagcagcagctggcccggcttgacaatgagtcctggccaagcacggccgaggctgacagggaccggctgcagctcatcaaggagaaggaggccctgctgcaggagcttcagctcatcattgcacagcgccgctctgcgggagatgtggcccggctggaggaggagcgggagcgcctagaggaggagctgcggcgtgcacgggccacctccgcacagggcgccacggagaggattctgcttcaggaaaaaaggaattgtctacttatgcagctggaagaagccacccgcttaacatcctacctccagtcccagttaaaaagcctgtgtgccagcaccctgacggtgtcctcggggagcagccgcgggtccctagcctccagccgtgggtctctggcctccagccggggctccctgagctcggtcagcttcacggacatctacggcctcccgcagtacgagaagcccgacgctgagggcagccagcttctacgcttcgacctcattcccttcgactctctggggcgagatgctcccttttcagagcccccaggcccctcgggcttccacaagcagaggcggtccctggacacgccccagtccctggcatcgctgtcctcccgctcctcgctgtcctcgctgtcgcccccaagctcgcccctggacacgcccttcctccctgcctcacgggactcgccgctggcgcagctggcggacagctgtgaggggccaggcctgggcgccctagacagactgcgggcacacgcctcggctatgggggacgaagacttaccaggcatggcggcccttcagccacacggggtccccggggatggggaagggccgcacgagcgaggacccccaccagccagcgctcccgtgggtggaaaaatcttgacttct

SEQ ID NO: 8596 - DNA, 2265 bp, Homo sapiens
agcctgtgtgccagcaccctgacggtgtcctcggggagcagccgcgggtccctagcctccagccgtgggtctctggcctccagccggggctccctgagctcggtcagcttcacggacatctacggcctcccgcagtacgagaagcccgacgctgagggcagccagcttctacgcttccacaagcagaggcggtccctggacacgccccagtccctggcatcgctgtcctcccgctcctcgctgtcctcgctgtcgcccccaagctcgcccctggacacgcccttcctccctgcctcacgggactcgccgctggcgcagctggcggacagctgtgaggggccaggcctgggcgccctagacagactgcgggcacacgcctcggctatgggggacgaagacttaccaggcatggcggcccttcagccacacggggtccccggggatggggaagggccgcacgagcgaggacccccaccagccagcgctcccgtgggtggaacagtgactcttcgagaagacagtgccaagaggttggagaggagggcacgccgcatctccgcatgtctgtcggattattcgctagccagcgacagtggggtgtttgaacctctaaccaaaaggaacgaagatgccgaggagcctgcctacggagacacggccagtaacggagatccccagatccacgtgggactcctgcgcgacagtggcagcgagtgtctcctcgtgcacgtgctgcagctgaagaacccggcggggctggcggtgaaggaagactgcaaagtccacatccgagtctatttgcccccactggactcgggcacgcccaacacttactgctccaaggctctggagttccaagtgccgctggtgtttaacgaagtgttcagaatccccgtgcattccagcgcgttgacactgaagtcacttcagttatacgtgtgttcagtgactccgcagctgcaggaagaactgctgggcattgctcagattaacctggctgactatgacagtttgagtgagatgcagctgcgctggcattccgtgcaggtgttcaccagctctgaaccatcaaggacgcgggaggctgggtgtgcaggagagagctccgcccgggaccctgcacacaccatctccatctccggcaagacggatgcggtgacggtgctcctggccagaaccacggcacagctgcaggcggtggagagggaactggccgaggagcgggccaagctggagtacacggaggaggaggtcctggagatggagcgcaaggaggagcaggccgaggccatatccgagcggagttggcaagcggactcggtggatagcggctgtagcaactgcacccagaccagccctccgtacccagagccctgttgcatgggtatcgactccatcctgggccacccatttgctgctcaggcagggccttacagccccgagaaatttcagccctcgcctcttaaggttgataaggaaaccaacacggaagatctctttctggaagaagcagccagcctcgtgaaggagcggcccagccgccgggcccgagggtcgccttttgttcggagtggcacgattgtccgttcccagacattctcgcctggagcacgaagccagtatgtttgcagactttatcgtagtgacagcgacagttcaacgctgccccggaagtccccctttgtccgaaatactttggaaagacgaacccttcgctataagcagtcatgcaggtcttccctggctgagctcatggcccgcacctccctggacttggagctggatctccaggcgtcgagaacacggcagaggcagctgaatgaggagctctgcgccctccgtgagctgcggcagcggttggaggacgcccagctccgtggccagactgacctcccaccctgggtgcttcgggacgagcggctccgtggcctgctgcgggaggccgagcggcagacaagacagaccaaacttgactaccgtcatgagcaggcggctgagaagatgctgaagaaggcctccaaggagatctaccagctgcgtgggcagagccacaaagagcccatccaagtgcagacctttagggagaagatagcattcttcacaaggccaaggatcaacatacctcctctcccagccgacgacgtctgatggagtgcattgtgcacatgaagtatttatccacctgttttattttcatgaagttcttagactagctgaatttgtctttaaaatatttgtgcaaagctattaatatacacattttgt

SEQ ID NO: 8597 - DNA, 474 bp, Homo sapiens
gggaacgcggcggagctgtgagccggcgactcgggtccctgaggtctggattctttctccgctactgagacacggcggacacacacaaacacagaaccacacagccagtcccaggagcccagtaatggagagccccaaaaagaagaaccagcagctgaaagtcgggatcctacacctgggcagcagacagaagaagatcaggatacagctgagatcccaggtgctgggaagggaaatgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattagatatttgacttaaactatctcaataaagttttgcagctttcaccaaa

SEQ ID NO: 8598 - DNA, 622 bp, Homo sapiens
gttaatggggacctgggaaggagcataggacagggcaaggcgggataaggaggggcaccacagcccttaaggcacgagggaacctcactgcgcatgctcctttggtgcccacctcagtgcgcatgttcactgggcgtcttcccatcggccccttcgccagtgtggggaacgcggcggagctgtgagccggcgactcgggtccctgaggtctggattctttctccgctactgagacacggcggacacacacaaacacagaaccacacagccagtcccaggagcccagtaatggagagccccaaaaagaagaaccagcagctgaaagtcgggatcctacacctgggcagcagacagaagaagatcaggatacagctgagatcccagtgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattagatatttgacttaaactatctcaataaagttttgcagctttcaccaaa

SEQ ID NO: 8599 - DNA, 622 bp, Homo sapiens; identical to SEQ ID NO: 8598

SEQ ID NO: 8600 - DNA, 474 bp, Homo sapiens; identical to SEQ ID NO: 8597

SEQ ID NO: 8601 - DNA, 486 bp, Homo sapiens
aagcattcagaaggcacacatacttacacttgccctgagacttagttcgaaatgtgaaatatgatttggcgaggaagatcaacatataggcctaggccgaggagaagtgtaccacctcctgagctgattgggcctatgctggagcccggtgatgaggagcctcagcaagaggaaccaccaactgaaagtcgggatcctgcacctggtcaggagagagaagaagatcagggtgcagctgagactcaagtgcctgacctggaagctgatctccaggagctgtctcagtcaaagactgggggtgaatgtggaaatggtcctgatgaccaggggaagattctgccaaaatcagaacaatttaaaatgccagaaggaggtgacaggcaaccacaggtttaaatgaagacaagctgaaacaacacaaaactgtttttatctaagatatttgacttaaaaatatcgaaataaacttttgcagctttctccaaa

SEQ ID NO: 8602 - DNA, 497 bp, Homo sapiens
gtgagggtgtgagggtcgcgttcctgctgtctggactttttctgtcccactgagacgcagctgtgtgaaatatgatttggcgaggaagatcaacatataggcctaggccgaggagaagtgtaccacctcctgagctgattgggcctatgctggagcccggtgatgaggagcctcagcaagaggaaccaccaactgaaagtcgggatcctgcacctggtcaggagagagaagaagatcagggtgcagctgagactcaagtgcctgacctggaagctgatctccaggagctgtctcagtcaaagactgggggtgaatgtggaaatggtcctgatgaccaggggaagattctgccaaaatcagaacaatttaaaatgccagaaggaggtgacaggcaaccacaggtttaaatgaagacaagctgaaacaacacaaaactgtttttatctaagatatttgacttaaaaatatcgaaataaacttttgcagctttctccaaa

SEQ ID NO: 8603 - DNA, 477 bp, Homo sapiens
tggaagtgctcaagtgtggtatacactcaggtgcatttttccaatcacaatattctgactgaaatatgagttggcgaggaagaagatatagaccaagacgatgtttacgacttgctcagctggttgggcctatgcttgagcccagtgtgccagagcctcaacaagaagaaccaccaactgaaagtcaggatcatacacctggtcagaagagagaagatgatcagggtgcagctgagattcaagtgcctaacctggaagctgatctccaggagctgtctcagtcaaagactggggatgaatgcggagatagtcctgatgtccaggggaagattctgccaaaatcagagcaatttaaaatgccagaaggaggggaagggaaaccacagctttaaacgaagacaaccaaaagaatgcaaactggatttatccgagatatttgacttttaaaaatctcaataaagttttccagttttctcc

SEQ ID NO: 8604 - DNA, 614 bp, Homo sapiens
ggacctgggaaggagcataggacagggcaaggcgggataaggaggggcaccacagcccttaaggcacgagggaacctcactgcgcatgctcctttggtgcccacctcagtgcgcatgttcactgggcgtcttcccatcggccccttcgccagtgtggggaacgcggcggagctgtgagccggcgactcgggtccctgaggtctggattctttctccgctactgagacacggcggacacacacaaacacagaaccacacagccagtcccaggagcccagtaatggagagccccaaaaagaagaaccagcagctgaaagtcgggatcctacacctgggcagcagacagaagaagatcaggatacagctgagatcccagtgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattagatatttgacttaaactatctcaataaagttttgcagctttcaccaaa

SEQ ID NO: 8605 - DNA, 622 bp, Homo sapiens; identical to SEQ ID NO: 8598

SEQ ID NO: 8606 - DNA, 350 bp, Homo sapiens
atggagagccccaaaaagaagaaccagcagctgaaagtcgggatcctacacctgggcagcagacagaagaagatcaggatacagctgagatcccaggtgctgggaagggaaatgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattagatatttgacttaaactatctcaataaagttttgcagctttcaccaaa

SEQ ID NO: 8607 - DNA, 618 bp, Homo sapiens
gttccttggacacctgcctcagtgtgcatgttcactgggcatcttcccttcgacccctttgcccacgtggtgaccgctggggagctgtgagagtgtgaggggcacgttccagccgtctggactctttctctcctactgagacgcagcctataggtccgcaggccagtcctcccaggaactgaaatagtgaaatatgagttggcgaggaagatcaacatataggcctaggccaagaagaagtttacagcctcctgagctgattggggctatgcttgaacccactgatgaagagcctaaagaagagaaaccacccactaaaagtcggaatcctacacctgatcagaagagagaagatgatcagggtgcagctgagattcaagtgcctgacctggaagccgatctccaggagctatgtcagacaaagactggggatggatgtgaaggtggtactgatgtcaaggggaagattctaccaaaagcagagcactttaaaatgccagaagcaggtgaagggaaatcacaggtttaaaggaagataagctgaaacaacacaaactgtttttatattagatattttactttaaaatatcttaataaagttttaagcttttctccaaa

SEQ ID NO: 8608 - DNA, 618 bp, Homo sapiens; identical to SEQ ID NO: 8607

SEQ ID NO: 8609 - DNA, 478 bp, Homo sapiens
tggaagtgctcaagtgtggtatacactcaggtgcatttttccaatcacaatattctggactgaaatatgagttggcgaggaagaagatatagaccaagacgatgtttacgacttgctcagctggttgggcctatgcttgagcccagtgtgccagagcctcaacaagaagaaccaccaactgaaagtcaggatcatacacctggtcagaagagagaagatgatcagggtgcagctgagattcaagtgcctaacctggaagctgatctccaggagctgtctcagtcaaagactggggatgaatgcggagatagtcctgatgtccaggggaagattctgccaaaatcagagcaatttaaaatgccagaaggaggggaagggaaaccacagctttaaacgaagacaaccaaaagaatgcaaactggatttatccgagatatttgacttttaaaaatctcaataaagttttccagttttctcc

SEQ ID NO: 8610 - DNA, 415 bp, Homo sapiens
atgagttggcgaggaagaagatatagaccaagacgatgtttacgacttgctcagctggttgggcctatgcttgagcccagtgtgccagagcctcaacaagaagaaccaccaactgaaagtcaggatcatacacctggtcagaagagagaagatgatcagggtgcagctgagattcaagtgcctaacctggaagctgatctccaggagctgtctcagtcaaagactggggatgaatgcggagatagtcctgatgtccaggggaagattctgccaaaatcagagcaatttaaaatgccagaaggaggggaagggaaaccacagctttaaacgaagacaaccaaaagaatgcaaactggatttatccgagatatttgacttttaaaaatctcaataaagttttccagttttctccaaa

SEQ ID NO: 8611 - DNA, 870 bp, Homo sapiens
tggaagtgctcaagtgtggtatacactcaggtgcatttttccaatcacaatattctggtttttgctttggtttggtttggtttttttgagacagagttttgctcttgttgcccaggctggagtgcaatggtgcaatctcggctggctgcaacattcgccccccggttcaagtggttctcctgcctcaacttcccgagtagctgggattacaggtgctcgctaccacacccagctacgtttttgtatttttagtagagacggggtttcaccattttggccaagctggcctcgagcttctgacctcaggtgatccatccccctcagcctcccaaagtgcacactattctgtttgcagactgaaatatgagttggcgaggaagaagatatagaccaagacgatgtttacgacttgctcagctggttgggcctatgcttgagcccagtgtgccagagcctcaacaagaagaaccaccaactgaaagtcaggatcatacacctggtcagaagagagaagatgatcagggtgcagctgagattcaaggtacttcgatattggctcaggacaaaacgcagttcagtgaaacaggatagcaactccagaaaagaggtcaatgaatgacagccactgtttcctttgatgtacatttttgacagcatgtttcgtaaaaggtggataattcaggatgttggcgtgcagtgcctaacctggaagctgatctccaggagctgtctcagtcaaagactggggatgaatgcggagatagtcctgatgtccaggggaagattctgccaaaatcagagcaatttaaaatgccagaaggaggggaagggaaaccacagctttaaacgaagacaaccaaaagaatgcaa

SEQ ID NO: 8612 - DNA, 477 bp, Homo sapiens; identical to SEQ ID NO: 8603

SEQ ID NO: 8613 - DNA, 716 bp, Homo sapiens
agatatttctgatgaagaaaacgatctgctcttacctattttatgaatcagcagcatagtgtatcagagtggctaatgacatctgcttttgaagaagaagtaaaatattcacaagatgaagatttttccagaagggactttgagtcaaagatggctttttatatttgacaagtcttgtcatctgtaatgaagatcattgtgaaacagaagattgattaaagccttgtaacattggacctagattagagatttagaaaagaaagtcaaaattagtcactttagtgttagtgttcccatttcataatatttattctttcttctaaatagatttagggagtagaaattaaaattcaatgctataccaaagggtatactaatatttgtttggctttttttccctttttgtgagggagaaaaaagtagataacgaaaagctatagtcattcgtaatgaaatatactaaacagaattttatgatgtcagttcttggcattataatctacgtaactgatttaattgtggacatatgggtatctgtcagatttttccatgaaggacagtatgtttttagtgctttagcgttaagctttatgctttttggaacacttgtggctcagtgttttagttattcttggttcaaggctgatttaaagaaagcaggccaagaaagtcagcattgttttcttctacttcattgcttgcaaggaggagttttt

SEQ ID NO: 8614 - DNA, 899 bp, Homo sapiens
gttggcgcttccggtggcctgcgaccccgtaattgcctcggtgatgtcgtgggttcaagcagcctccttgatccagggccctggagacaaaggggacgtgtttgacgaagaagcagacgagtcgctcctggcgcagcgggaatggcagagtaacatgcaaagacgagtcaaagaaggttatagagatggaatagatgctggcaaagcagttactcttcaacagggcttcaatcaaggttataagaaaggtgcagaagtcattttaaactatggacgactccgaggaacattgagtgctttgctctcctggtgtcaccttcataataataattcaactttgatcaataaaataaacaatcttctggatgcagttggccagtgtgaagagtatgtgctcaaacatctgaaatcaatcactccaccgtcccatgttgtagatttattggactccattgaggatatggacctttgtcatgtagttccagctgagaaaaagattgatgaagctaaagatgaaagactctgtgaaaataatgctgagtttaacaaaaactgtagcaagagccatagtgggatagattgttcatatgtagaatgttgtagaacacaggagcatgcacattcagaaaacccaagccccacatggattttggaacagacagccagtttagttaaacagctgggcctatcagtagatgtattacaacacctcaaacaactataaaattaccttcccttttctaatgaaaataatgttcagaacatttggtttcctaacaatcgaaatttgtactggtttctgcatcaaacacctcaactgtagggttaccctttatggaagtttgaaattaacactattgtcttcaaaattaacactattaaatgtaatataagccttt

SEQ ID NO: 8615 - DNA, 968 bp, Homo sapiens
aattgcctcggtgatgtcgtgggttcaagcagcctccttgatccagggccctggagacaaaggggacgtgtttgacgaagaagcagacgagtcgctcctggcgcagcgggaatggcagagtaacatgcaaagacgagtcaaagaaggttatagagatggaatagatgctggcaaagcagttactcttcaacagggcttcaatcaaggttataagaaaggtgcagaagtcattttaaactatggacgactccgaggaacattgaggaactcaacggattggagcctactgggcttgagagccccgctgaggagtccggaggttgggacgcaactactgccgcgtcccctcccggtccccggccacatggcgagcggggcgacaccgaagcagcccacggagctcgaggcgacgctgctgagcctggttccccaaagcggccgcgccactccccgcttccccgcccggctccgggccccaggccctgggacgccgagccaccgccggcgtttcagacgcaaaccccaccgcgaccctgcagcagcctgccccgcctggccgccagaggcaccttccaactccgaaacacatttttcaacatataatagaatcattatcagaggtggacacatttagaagttgttcttaatcagagggcagcttgtgcttaggaaagccagcctcagtcctcagcacccagcacccagtgctgcaggtttctcctgggtgaagatggaccagcccaccttggccctccggcaagctagaacaatatgtacacgtctctcaaactatgaagagaagatttgggaggagtatgagaaaatcctcaataccaaactagcagagcaatacgagtcgtttgtgaaattcacacatgagcagattatgcgaccatgtgggacaagcccaacaaactatgtgtcttgaagctttttgttgcagatctcggtaccaggtttgacctcaa

SEQ ID NO: 8616 - DNA, 1351 bp, Homo sapiens
ggctgtccggcccactcccctgggagcgcgagcggtggacccaggcggccatgtcccgccctcgcatgcgcctggtggtcaccgcggacgactttggttactgcccgcgacgcgatgagggtatcgtggaggcctttctggccggggctgtgaccagcgtgtccctgctggtcaacggtgcggccacggagagcgcggcggagctggcccgcaggcacagcatccccacgggcctccacgccaacctgtccgagggccgccccgtgggtccggcccgccgtggcgcctcatcgctgctcggcccggaaggcttcttccttggcaagatgggattccgggaggcggtggcggccggagacgtggatttgcctcaggtgcgggaggagctcgaggcccaactaagctgcttccgggagctgctgggcagggcccccacgcacgcggacgggcaccagcacgtgcacgtgctcccaggcgtgtgccaggtgttcgccgaggcgctgcaggcctatggggtgcgctttacgcgactgccgctggagcgcggtgtgggtggctgcacttggctggaggcccccgcgcgtgccttcgcctgcgccgtggagcgcgacgcccgggccgccgtgggccccttctcccgccacggcctgcggtggacagacgccttcgtgggcctgagcacttgcggccggcacatgtccgctcaccgcgtgtccggggccctggcgcgggtcctggaaggtaccctagcgggccacaccctgacagccgagctgatggcgcaccccggctaccccagtgtgcctcccaccggcggctgcggtgaaggccccgacgctttctcttgctcttgggagcggctgcatgagctgcgcgtcctcaccgcgcccacgctgcgggcccagcttgcccaggatggcgtgcagctttgcgccctcgacgacctggactccaagaggccaggggaggaggtcccctgtgagcccactctggaacccttcctggaaccctccctactctgaccccctacagacaaccaagcactaatccccttagtaccaagaaaggggagccaggatttagtcctggcccagcccagagctgggacctggagcacgatctgttgacttccctgggtaggacactgccacctctgggctcaggtcctcatgcctccaaatggcatctagagtttgagcagccttcttggctgcaggcaggcctagcctgtggcagcgggctagggcccgcagagcatttggtgcccctccatgttgcaatgcaaacaccttcaccactggggcagtggggagagatggctatattaataaaataacgtgtgtctttcaaa

SEQ ID NO: 8617 - DNA, 1142 bp, Homo sapiens
cgagcggtggacccaggcggccatgtcccgccctcgcatgcgcctggtggtcaccgcggacgactttggttactgcccgcgacgcgatgagggtatcgtggaggcctttctggccggggctgtgaccagcgtgtccctgctggtcaacggtgcggccacggagagcgcggcggagctggcccgcaggcacagcatccccacgggcctccacgccaacctgtccgagggccgccccgtgggtccggcccgccgtggcgcctcatcgctgctcggcccggaaggcttcttccttggcaagatgggattccgggaggcggtggcggccggagacgtggatttgcctcaggtgcgggaggagctcgaggcccaactaagctgcttccgggagctgctgggcagggcccccacgcacgcggacgggcaccagcacgtgcacgtgctcccaggtggacagacgccttcgtgggcctgagcacttgcggccggcacatgtccgctcaccgcgtgtccggggccctggcgcgggtcctggaaggtaccctagcgggccacaccctgacagccgagctgatggcgcaccccggctaccccagtgtgcctcccaccggcggctgcggtgaaggccccgacgctttctcttgctcttgggagcggctgcatgagctgcgcgtcctcaccgcgcccacgctgcgggcccagcttgcccaggatggcgtgcagctttgcgccctcgacgacctggactccaagaggccaggggaggaggtcccctgtgagcccactctggaacccttcctggaaccctccctactctgaccccctacagacaaccaagcactaatccccttagtaccaagaaaggggagccaggatttagtcctggcccagcccagagctgggacctggagcacgatctgttgacttccctgggtaggacactgccacctctgggctcaggtcctcatgcctccaaatggcatctagagtttgagcagccttcttggctgcaggcaggcctagcctgtggcagcgggctagggcccgcagagcatttggtgcccctccatgttgcaatgcaaacaccttcaccactggggcagtggggagagatggctatattaataaaataacgtgtgtctttc

SEQ ID NO: 8618 - DNA, 1032 bp, Homo sapiens
cctccctccacggatgcgcttaaaaggcggtggcggtggcggcagcgcccggcgcccgggctcacctcggccatgagcagcgcagccggcccagacccgtcggaggcgcccgaagagcggcatttcctcagggccttggagctgcagcccccacttgccgacatgggaagagcggagcttagctcaaatgctaccacctcccttgtccagaggaggaaacaggcctggggaaggcagtcatggctagagcagatttggaacgcagggcctgtttgccagagcaccgcggaggcagccgccctggagcgggagctgctggaggattatcgctttgggcggcagcagctcgtggagctgtgcggtcatgctagtgccgtggctgtgaccaaggcgttcccgttgcccgctctctcccggaagcagaggacggtgctggtcgtgtgtggcccggagcagaacggggcagtggggctggtctgtgcccggcacctgcgggtgtttgagtatgaacccaccatcttctaccccacacgctcgctggacctgctgcatcgggacctgaccacccagtgcgagaagatggacatccccttcctgagctacctgcccactgaggtgcagctcattaacgaagcctatgggctggtggtggatgccgtactgggccccggcgtggagccgggcgaggtcgggggcccctgcacccgcgcgctggccacgctcaagctgctgtccatccccctcgtgagcctggacatcccctcaggctgggacgcagagaccggcagcgattcggaggacgggctgcggcctgacgtgctggtgtctctcgcggcgcccaagcgctgcgctggccgcttctccgggcgccaccacttcgtggccggcaggttcgtgcccgatgacgtgcgccgcaagttcgctctgcgcctgccgggatacacgggcaccgactgcgtcgcggcactgtgaccgccacccgcggccacaccgcagggaccctcgccaataaacagccctcccaccaccgcc

SEQ ID NO: 8619 - DNA, 882 bp, Homo sapiens
cctccctccacggatgcgcttaaaaggcggtggcggtggcggcagcgcccggcgcccgggctcacctcggccatgagcagcgcagccggcccagacccgtcggaggcgcccgaagagcggcatttcctcagcaccgcggaggcagccgccctggagcgggagctgctggaggattatcgctttgggcggcagcagctcgtggagctgtgcggtcatgctagtgccgtggctgtgaccaaggcgttcccgttgcccgctctctcccggaagcagaggacggtgctggtcgtgtgtggcccggagcagaacggggcagtggggctggtctgtgcccggcacctgcgggtgtttgagtatgaacccaccatcttctaccccacacgctcgctggacctgctgcatcgggacctgaccacccagtgcgagaagatggacatccccttcctgagctacctgcccactgaggtgcagctcattaacgaagcctatgggctggtggtggatgccgtactgggccccggcgtggagccgggcgaggtcgggggcccctgcacccgcgcgctggccacgctcaagctgctgtccatccccctcgtgagcctggacatcccctcaggctgggacgcagagaccggcagcgattcggaggacgggctgcggcctgacgtgctggtgtctctcgcggcgcccaagcgctgcgctggccgcttctccgggcgccaccacttcgtggccggcaggttcgtgcccgatgacgtgcgccgcaagttcgctctgcgcctgccgggatacacgggcaccgactgcgtcgcggcactgtgaccgccacccgcggccacaccgcagggaccctcgccaataaacagccctcccaccaccgcc

SEQ ID NO: 8620 - DNA, 750 bp, Homo sapiens
atgagcagcgcagccggcccagacccgtcggaggcgcccgaagagcggcatttcctcagcaccgcggaggcagccgccctggagcgggagctgctggaggattatcgctttgggcggcagcagctcgtggagctgtgcggtcatgctagtgccgtggctgtgaccaaggcgttcccgttgcccgctctctcccggaagcagaggacggtgctggtcgtgtgtggcccggagcagaacggggcagtggggctggtctgtgcccggcacctgcgggtgtttgagtatgaacccaccatcttctaccccacacgctcgctggacctgctgcatcgggacctgaccacccagtgcgagaagatggacatccccttcctgagctacctgcccactgaggtgcagctcattaacgaagcctatgggctggtggtggatgccgtactgggccccggcgtggagccgggcgaggtcgggggcccctgcacccgcgcgctggccacgctcaagctgctgtccatccccctcgtgagcctggacatcccctcaggctgggacgcagagaccggcagcgattcggaggacgggctgcggcctgacgtgctggtgtctctcgcggcgcccaagcgctgcgctggccgcttctccgggcgccaccacttcgtggccggcaggttcgtgcccgatgacgtgcgccgcaagttcgctctgcgcctgccgggatacacgggcaccgactgcgtcgcggcactgtga

SEQ ID NO: 8621 - DNA, 979 bp, Homo sapiens
ggcgcccgggctcacctcggccatgagcagcgcagccggcccagacccgtcggaggcgcccgaagagcggcatttcctcagggccttggagctgcagcccccacttgccgacatgggaagagcggagcttagctcaaatgctaccacctcccttgtccagaggaggaaacaggcctggggaaggcagtcatggctagagcagatttggaacgcagggcctgtttgccagagcaccgcggaggcagccgccctggagcgggagctgctggaggattatcgctttgggcggcagcagctcgtggagctgtgcggtcatgctagtgccgtggctgtgaccaaggcgttcccgttgcccgctctctcccggaagcagaggacggtgctggtcgtgtgtggcccggagcagaacggggcagtggggctggtctgtgcccggcacctgcgggtgtttgagtatgaacccaccatcttctaccccacacgctcgctggacctgctgcatcgggacctgaccacccagtgcgagaagatggacatccccttcctgagctacctgcccactgaggtgcagctcattaacgaagcctatgggctggtggtggatgccgtactgggccccggcgtggagccgggcgaggtcgggggcccctgcacccgcgcgctggccacgctcaagctgctgtccatccccctcgtgagcctggacatcccctcaggctgggacgcagagaccggcagcgattcggaggacgggctgcggcctgacgtgctggtgtctctcgcggcgcccaagcgctgcgctggccgcttctccgggcgccaccacttcgtggccggcaggttcgtgcccgatgacgtgcgccgcaagttcgctctgcgcctgccgggatacacgggcaccgactgcgtcgcggcactgtgaccgccacccgcggccacaccgcagggaccctcgccaataaacagccctcccaccacc

SEQ ID NO: 8622 - DNA, 1100 bp, Homo sapiens
gatactgcgagtatggcggcgtcaaaggtgaagcaggacatgcctccgccggggggctatgggcccatcgactacaaacggaacttgccgcgtcgaggactgtcgggctacagcatgctggccatagggattggaaccctgatctacgggcactggagcataatgaagtggaaccgtgagcgcaggcgcctacaaatcgaggacttcgaggctcgcatcgcgctgttgccactgttacaggcagaaaccgaccggaggaccttgcagatgcttcgggagaacctggaggaggaggccatcatcatgaaggacgtgcccgactggaaggcgttcccgttgcccgctctctcccggaagcagaggacggtgctggtcgtgtgtggcccggagcagaacggggcagtggggctggtctgtgcccggcacctgcgggtgtttgagtatgaacccaccatcttctaccccacacgctcgctggacctgctgcatcgggacctgaccacccagtgcgagaagatggacatccccttcctgagctacctgcccactgaggtgcagctcattaacgaagcctatgggctggtggtggatgccgtactgggccccggcgtggagccgggcgaggtcgggggcccctgcacccgcgcgctggccacgctcaagctgctgtccatccccctcgtgagcctggacatcccctcaggcatgccaggcagaggggggcacattggggcctggggggcttgggtggaggcccctgtgccccagctcctggtcgcccctgcctgtctgaacctcaatctccccagcttggatggacccacacttggctgaggctaagggtcacacccatccctctgatggggaagatcgaggctgccaccccaggtgaccccaggtctcctctttcctccaccccagtgcccagcccacatgccctctgcccacccctggcccagttgcctgggcagacgtgagctcactcggcaaaggccgcgcccgccctggctgccgccccatgcctgttggaaccattaggcgacaggcagacggaacaaacagccgctggccagccggaccctccgtgggggtggctggac

SEQ ID NO: 8623 - DNA, 4348 bp, Homo sapiens
agaactgcgagatgtgatgttgacagcggagacacagagacaaccgctgagaaacttgagtcaaagatgactaaattttaaggcctggaaagtgcaggagatggaaatacaaccaacaaaatgggagcacattggaactttcaagtagcaagtttctgtaggactgggcttgtgggaaaggaccggttgaaagaaagacatgctgagtcattgcttgacatttgtcatgatacaaactcttctccaactgatttgatgacagttaccaaaaatcaaaacatcatcttgcaaagcatcagcagaagtgaggagttcgaccaagatggtgactgcagtcattccacactggttaatgaagaagaagatcccagtggtggtagacaggactggcaacccaggacagaaggtgttgagatcactgtaacttttccaagagatgtcagtcctccccaagaaatgagccaagaagacttaaaagaaaagaatctgataaactcatcgcttcaagaatgggcacaagcacatgcagtttctcatccaaatgaaatagaaacggtggagctcaggaaaaagaagctgaccatgcggcccttagttttgcaaaaagaggaaagttccagggagctctgcaatgtgaacttgggctttttgctaccaagatcttgtttagaactgaacatttccaagtctgtaaccagagaagatgctcctcattttctgaaggagcagcaaagaaaatctgaagagttttcgacctctcatatgaagtacagtggccgaagcatcaagttccttctgccaccactgtcactcttgcccacgcgatctggtgtccttactatcccccaaaatcacaagtttccaaaagaaaaagaaagaaacattccaagtctcacatcttttgtgcctaagctctcagtgtctgttcgtcaatctgatgagctcagcccatcaaacgagcctccgggagccctagttaagtcgttgatggatccgactctcaggtcttctgatggcttcatttggtcaagaaacatgtgctcttttcctaagactaaccatcacaggcaatgcctggagaaggaggaaaactggaaatccaaggaaatagaagaatgtaacaaaattgaaatcactcactttgaaaaagggcagtctttggtgtcttttgagaatttgaaggaaggcaatattcctgcagttagggaagaggatattgactgccatggtagtaaaacgcgaaaacctgaagaagagaactctcaatatctttcatcaagaaagaatgagagttcagtagccaaaaactatgaacaagatccagaaatagtatgtaccattccaagcaagttccaagaaacccagcattcagaaataactccaagccaggatgaagagatgagaaataataaagctgcttcaaaaagagtttcattacataaaaatgaagcaatggaaccaaacaatattttagaagagtgtactgtacttaaaagcttatccagtgtagtctttgatgaccccattgataaactcccagaaggttgtagcagcatggagacaaacataaaaatatcaatagcagaaagagccaaaccagaaatgagtaggatggtgcctcttatccacatcaccttccctgtggatggaagccccaaggaaccagtgatagccaaaccaagcctccaaacaagaaagggaaccattcataacaaccatagtgtcaacatacctgtacaccaagaaaatgacaagcataagatgaattcccataggagtaagttggattcaaagaccaagacaagtaagaagacacctcagaattttgtgatttctactgaaggtcccattaagcctaccatgcataaaaccagcataaaaacacaaattttcccggctttgggacttgtggaccccaggccttggcaattgcccaggtttcaaaagaaaatgccacagatagcaaagaagcaatcaactcaccggactcagaaacctaaaaagcaatcatttccttgcatctgtaaaaatccaggaacacagaagtcatgtgttcctctctctgttcaaccgacagagccaagactaaattacctagatcttaagtatagtgatatgttcaaagaaatcaattcaactgctaatggacctggaatctatgaaatgtttgggacccctgtttattgtcatgtgcgagagactgaaagggatgaaaacacgtattaccgtgagatatgttcggctccatcaggcagacgtatcaccaataaatgtcgatcttcacacagtgagaggaagagcaatatcagaacaagactttctcagaaaaaaacacatatgaaatgcccaaagacttcatttggcattaaacaagagcacaaagtcttaatttctaaagaaaagagttccaaggctgtacatagcaacctacatgacattgaaaatggtgatggtatttcagaaccagactggcagataaagtcttcaggaaatgagtttctatcttccaaagatgaaattcatcccatgaacttggctcagacacctgagcagtccatgaaacagaatgaattccctcctgtctcagatttatccattgttgaagaagtttctatggaagagtctactggtgatagagacatttctaacaatcaaatactcaccacaagcctcagagatctgcaagaacttgaagagctacatcaccagatcccatttatcccttcagaagacagctgggcagtgcccagtgagaagaattctaacaagtatgtacagcaagaaaagcagaatacagcatctcttagtaaagtaaatgccagccgaattttaactaatgatctagagtttgatagtgtttcagatcactctaaaacacttacaaatttctctttccaagcaaaacaagaaagtgcatcttcccagacatatcaatattgggtacattatttggatcatgatagtttagcaaataagtcaatcacatatcaaatgtttggaaaaaccttaagtggcacaaattcaatttcccaagaaattatggactctgtaaataatgaagaattgacagatgaactattaggttgtctagctgcagaattattagctcttgatgagaaagataacaactcttgccaaaaaatggcaaatgaaacagatcctgaaaacctaaatcttgtcctcagatggagaggaagtaccccaaaagaaatgggcagagagacaacaaaagtcaaaatacagaggcatagtagtgggctcaggatatatgacagggaggagaaatttctcatctcaaatgaaaagaagatattttctgaaaatagtttaaagtctgaagaacctatcctatggaccaagggtgagattcttggaaagggagcctacggcacagttcaagtccaatgggaaagaaatatcttccttcaacagctgaatatgttactggaagtttggagaatcattactagatggcaaaaacaaaagatgttccttccattttgtgaactgcataagagatcttggggggtgggcgatgaagagaggtatactgtggtctcactagtcaaggacagctaatagctgtaaaacaggtggctttggatacctctaataaattagctgctgaaaaggaataccggaaactacaggaagaagtagatttgctcaaagcactgaaacatgtcaacattgtggcctatttggggacatgcttgcaagagaacactgtgagcattttcatggagtttgttcctggtggctcaatctctagtattataaaccgttttgggccattgcctgagatggtgttctgtaaatatacgaaacaaatacttcaaggtgttgcttatctccatgagaactgtgtggtacatcgcgatatcaaaggaaataatgttatgctcatgccaactggaataataaagctgattgactttggctgtgccaggcgtttggcctgggcaggtttaaatggcacccacagtgacatgcttaagtccatgcatgggactccatattggatggccccagaagtcatcaatgagtctggctatggacggaaatcagatatctggagcattggttgtactgtgtttgagatggctacagggaagcctccactggcttccatggacaggatggccgccatgttttacatcggagcacaccgagggctgatgcctcctttaccagaccacttctcagaaaatgcagcagactttgtgcgcatgtgcctgaccaggtaagaaactgaaagcaagaggaggaagataaatgcccggagattccaagtggcagacatttccctttcaatttatggcccattaaaagctctgttttggttatg

SEQ ID NO: 8624 - DNA, 3719 bp, Homo sapiens
ttcaaagaaacagcagcttttggacattttaatgagttctatgccaaaaccagaaagacatgctgagtcattgcttgacatttgtcatgatacaaactcttctccaactgatttgatgacagttaccaaaaatcaaaacatcatcttgcaaagcatcagcagaagtgaggagttcgaccaagatggtgactgcagtcattccacactggttaatgaagaagaagatcccagtggtggtagacaggactggcaacccaggacagaagagttttcgacctctcatatgaagtacagtggccgaagcatcaagttccttctgccaccactgtcactcttgcccacgcgatctggtgtccttactatcccccaaaatcacaagtttccaaaagaaaaagaaagaaacattccaagtctcacatcttttgtgcctaagctctcagtgtctgttcgtcaatctgatgagctcagcccatcaaacgagcctccgggagccctagttaagtcgttgatggatccgactctcaggtcttctgatggcttcatttggtcaagaaacatgtgctcttttcctaagactaaccatcacaggcaatgcctggagaaggaggaaaactggaaatccaaggaaatagaagaatgtaacaaaattgaaatcactcactttgaaaaagggcagtctttggtgtcttttgagaatttgaaggaaggcaatattcctgcagttagggaagaggatattgactgccatggtagtaaaacgcgaaaacctgaagaagagaactctcaatatctttcatcaagaaagaatgagagttcagtagccaaaaactatgaacaagatccagaaatagtatgtaccattccaagcaagttccaagaaacccagcattcagaaataactccaagccaggatgaagagatgagaaataataaagctgcttcaaaaagagtttcattacataaaaatgaagcaatggaaccaaacaatattttagaagagtgtactgtacttaaaagcttatccagtgtagtctttgatgaccccattgataaactcccagaaggttgtagcagcatggagacaaacataaaaatatcaatagcagaaagagccaaaccagaaatgagtaggatggtgcctcttatccacatcaccttccctgtggatggaagccccaaggaaccagtgatagccaaaccaagcctccaaacaagaaagggaaccattcataacaaccatagtgtcaacatacctgtacaccaagaaaatgacaagcataagatgaattcccataggagtaagttggattcaaagaccaagacaagtaagaagacacctcagaattttgtgatttctactgaaggtcccattaagcctaccatgcataaaaccagcataaaaacacaaattttcccggctttgggacttgtggaccccaggccttggcaattgcccaggtttcaaaagaaaatgccacagatagcaaagaagcaatcaactcaccggactcagaaacctaaaaagcaatcatttccttgcatctgtaaaaatccaggaacacagaagtcatgtgttcctctctctgttcaaccgacagagccaagactaaattacctagatcttaagtatagtgatatgttcaaagaaatcaattcaactgctaatggacctggaatctatgaaatgtttgggacccctgtttattgtcatgtgcgagagactgaaagggatgaaaacacgtattaccgtgagatatgttcggctccatcaggcagacgtatcaccaataaatgtcgatcttcacacagtgagaggaagagcaatatcagaacaagactttctcagaaaaaaacacatatgaaatgcccaaagacttcatttggcattaaacaagagcacaaagtcttaatttctaaagaaaagagttccaaggctgtacatagcaacctacatgacattgaaaatggtgatggtatttcagaaccagactggcagataaagtcttcaggaaatgagtttctatcttccaaagatgaaattcatcccatgaacttggctcagacacctgagcagtccatgaaacagaatgaattccctcctgtctcagatttatccattgttgaagaagtttctatggaagagtctactggtgatagagacatttctaacaatcaaatactcaccacaagcctcagagatctgcaagaacttgaagagctacatcaccagatcccatttatcccttcagaagacagctgggcagtgcccagtgagaagaattctaacaagtatgtacagcaagaaaagcagaatacagcatctcttagtaaagtaaatgccagccgaattttaactaatgatctagagtttgatagtgtttcagatcactctaaaacacttacaaatttctctttccaagcaaaacaagaaagtgcatcttcccagacatatcaatattgggtacattatttggatcatgatagtttagcaaataagtcaatcacatatcaaatgtttggaaaaaccttaagtggcacaaattcaatttcccaagaaattatggactctgtaaataatgaagaattgacagatgaactattaggttgtctagctgcagaattattagctcttgatgagaaagataacaactcttgccaaaaaatggcaaatgaaacagatcctgaaaacctaaatcttgtcctcagatggagaggaagtaccccaaaagaaatgggcagagagacaacaaaagtcaaaatacagaggcatagtagtgggctcaggatatatgacagggaggagaaatttctcatctcaaatgaaaagaagatattttctgaaaatagtttaaagtctgaagaacctatcctatggaccaagggtgagattcttggaaagggagcctacggcacagtatactgtggtctcactagtcaaggacagctaatagctgtaaaacaggtggctttggatacctctaataaattagctgctgaaaaggaataccggaaactacaggaagaagtagatttgctcaaagcactgaaacatgtcaacattgtggcctatttggggacatgcttgcaagagaacactgtgagcattttcatggagtttgttcctggtggctcaatctctagtattataaaccgttttgggccattgcctgagatggtgttctgtaaatatacgaaacaaatacttcaaggtgttgcttatctccatgagaactgtgtggtacatcgcgatatcaaaggaaataatgttatgctcatgccaactggaataataaagctgattgactttggctgtgccaggcgtttggcctgggcaggtttaaatggcacccacagtgacatgcttaagtccatgcatgggactccatattggatggccccagaagtcatcaatgagtctggctatggacggaaatcagatatctggagcattggttgtactgtgtttgagatggctacagggaagcctccactggcttccatggacaggatggccgccatgttttacatcggagcacaccgagggctgatgcctcctttaccagaccacttctcagaaaatgcagcagactttgtgcgcatgtgcctgaccagggaccagcatgagcgaccttctgctctccagctcctgaagcactccttcttggagagaagtcactgaatatacatcaagactttcttcccagttccactgcagatgc

SEQ ID NO: 8625 - DNA, 1604 bp, Homo sapiens
ttcaaagaaacagcagcttttggacattttaatgagttctatgccaaaaccagaaagacatgctgagtcattgcttgacatttgtcatgatacaaactcttctccaactgatttgatgacagttaccaaaaatcaaaacatcatcttgcaaagcatcagcagaagtgaggagttcgaccaagatggtgactgcagtcattccacactggttaatgaagaagaagatcccagtggtggtagacaggactggcaacccaggacagaaggtgttgagatcactgtaacttttccaagagatgtcagtcctccccaagaaatgagccaagaagacttaaaagaaaagaatctgataaactcatcgcttcaagaatgggcacaagcacatgcagtttctcatccaaatgaaatagaaacggtggagctcaggaaaaagaagctgaccatgcggcccttagttttgcaaaaagaggaaagttccagggagctctgcaatgtgaacttgggctttttgctaccaagatcttgtttagaactgaacatttccaagtctgtaaccagagaagatgctcctcattttctgaaggagcagcaaagaaaatctgaagagttttcgacctctcatatgaagtacagtggccgaagcatcaagaggcatagtagtgggctcaggatatatgacagggaggagaaatttctcatctcaaatgaaaagaagatattttctgaaaatagtttaaagtctgaagaacctatcctatggaccaagggtgagattcttggaaagggagcctacggcacagtatactgtggtctcactagtcaaggacagctaatagctgtaaaacaggtggctttggatacctctaataaattagctgctgaaaaggaataccggaaactacaggaagaagtagatttgctcaaagcactgaaacatgtcaacattgtggcctatttggggacatgcttgcaagagaacactgtgagcattttcatggagtttgttcctggtggctcaatctctagtattataaaccgttttgggccattgcctgagatggtgttctgtaaatatacgaaacaaatacttcaaggtgttgcttatctccatgagaactgtgtggtacatcgcgatatcaaaggaaataatgttatgctcatgccaactggaataataaagctgattgactttggctgtgccaggcgtttggcctgggcaggtttaaatggcacccacagtgacatgcttaagtccatgcatgggactccatattggatggccccagaagtcatcaatgagtctggctatggacggaaatcagatatctggagcattggttgtactgtgtttgagatggctacagggaagcctccactggcttccatggacaggatggccgccatgttttacatcggagcacaccgagggctgatgcctcctttaccagaccacttctcagaaaatgcagcagactttgtgcgcatgtgcctgaccagggaccagcatgagcgaccttctgctctccagctcctgaagcactccttcttggagagaagtcactgaatatacatcaagactttcttcccagttccactgcagatgc

SEQ ID NO: 8626 - DNA, 4377 bp, Homo sapiens
ttcaaagaaacagcagcttttggacattttaatgagttctatgccaaaaccagaaagacatgctgagtcattgcttgacatttgtcatgatacaaactcttctccaactgatttgatgacagttaccaaaaatcaaaacatcatcttgcaaagcatcagcagaagtgaggagttcgaccaagatggtgactgcagtcattccacactggttaatgaagaagaagatcccagtggtggtagacaggactggcaacccaggacagaaggtgttgagatcactgtaacttttccaagagatgtcagtcctccccaagaaatgagccaagaagacttaaaagaaaagaatctgataaactcatcgcttcaagaatgggcacaagcacatgcagtttctcatccaaatgaaatagaaacggtggagctcaggaaaaagaagctgaccatgcggcccttagttttgcaaaaagaggaaagttccagggagctctgcaatgtgaacttgggctttttgctaccaagatcttgtttagaactgaacatttccaagtctgtaaccagagaagatgctcctcattttctgaaggagcagcaaagaaaatctgaagagttttcgacctctcatatgaagtacagtggccgaagcatcaagttccttctgccaccactgtcactcttgcccacgcgatctggtgtccttactatcccccaaaatcacaagtttccaaaagaaaaagaaagaaacattccaagtctcacatcttttgtgcctaagctctcagtgtctgttcgtcaatctgatgagctcagcccatcaaacgagcctccgggagccctagttaagtcgttgatggatccgactctcaggtcttctgatggcttcatttggtcaagaaacatgtgctcttttcctaagactaaccatcacaggcaatgcctggagaaggaggaaaactggaaatccaaggaaatagaagaatgtaacaaaattgaaatcactcactttgaaaaagggcagtctttggtgtcttttgagaatttgaaggaaggcaatattcctgcagttagggaagaggatattgactgccatggtagtaaaacgcgaaaacctgaagaagagaactctcaatatctttcatcaagaaagaatgagagttcagtagccaaaaactatgaacaagatccagaaatagtatgtaccattccaagcaagttccaagaaacccagcattcagaaataactccaagccaggatgaagagatgagaaataataaagctgcttcaaaaagagtttcattacataaaaatgaagcaatggaaccaaacaatattttagaagagtgtactgtacttaaaagcttatccagtgtagtctttgatgaccccattgataaactcccagaaggttgtagcagcatggagacaaacataaaaatatcaatagcagaaagagccaaaccagaaatgagtaggatggtgcctcttatccacatcaccttccctgtggatggaagccccaaggaaccagtgatagccaaaccaagcctccaaacaagaaagggaaccattcataacaaccatagtgtcaacatacctgtacaccaagaaaatgacaagcataagatgaattcccataggagtaagttggattcaaagaccaagacaagtaagaagacacctcagaattttgtgatttctactgaaggtcccattaagcctaccatgcataaaaccagcataaaaacacaaattttcccggctttgggacttgtggaccccaggccttggcaattgcccaggtttcaaaagaaaatgccacagatagcaaagaagcaatcaactcaccggactcagaaacctaaaaagcaatcatttccttgcatctgtaaaaatccaggaacacagaagtcatgtgttcctctctctgttcaaccgacagagccaagactaaattacctagatcttaagtatagtgatatgttcaaagaaatcaattcaactgctaatggacctggaatctatgaaatgtttgggacccctgtttattgtcatgtgcgagagactgaaagggatgaaaacacgtattaccgtgagatatgttcggctccatcaggcagacgtatcaccaataaatgtcgatcttcacacagtgagaggaagagcaatatcagaacaagactttctcagaaaaaaacacatatgaaatgcccaaagacttcatttggcattaaacaagagcacaaagtcttaatttctaaagaaaagagttccaaggctgtacatagcaacctacatgacattgaaaatggtgatggtatttcagaaccagactggcagataaagtcttcaggaaatgagtttctatcttccaaagatgaaattcatcccatgaacttggctcagacacctgagcagtccatgaaacagaatgaattccctcctgtctcagatttatccattgttgaagaagtttctatggaagagtctactggtgatagagacatttctaacaatcaaatactcaccacaagcctcagagatctgcaagaacttgaagagctacatcaccagatcccatttatcccttcagaagacagctgggcagtgcccagtgagaagaattctaacaagtatgtacagcaagaaaagcagaatacagcatctcttagtaaagtaaatgccagccgaattttaactaatgatctagagtttgatagtgtttcagatcactctaaaacacttacaaatttctctttccaagcaaaacaagaaagtgcatcttcccagacatatcaatattgggtacattatttggatcatgatagtttagcaaataagtcaatcacatatcaaatgtttggaaaaaccttaagtggcacaaattcaatttcccaagaaattatggactctgtaaataatgaagaattgacagatgaactattaggttgtctagctgcagaattattagctcttgatgagaaagataacaactcttgccaaaaaatggcaaatgaaacagatcctgaaaacctaaatcttgtcctcagatggagaggaagtaccccaaaagaaatgggcagagagacaacaaaagtcaaaatacagaggcatagtagtgggctcaggatatatgacagggaggagaaatttctcatctcaaatgaaaagaagatattttctgaaaatagtttaaagtctgaagaacctatcctatggaccaagggtgagattcttggaaagggagcctacggcacagtatactgtggtctcactagtcaaggacagctaatagctgtaaaacaggtggctttggatacctctaataaattagctgctgaaaaggaataccggaaactacaggaagaagtagatttgctcaaagcactgaaacatgtcaacattgtggcctatttggggacatgcttgcaagagaacactgtgagcattttcatggagtttgttcctggtggctcaatctctagtattataaaccgttttgggccattgcctgagatggtgttctgtaaatatacgaaacaaatacttcaaggtgttgcttatctccatgagaactgtgtggtacatcgcgatatcaaaggaaataatgttatgctcatgccaactggaataataaagctgattgactttggctgtgccaggcgtttggcctgggcaggtttaaatggcacccacagtgacatgcttaagtccatgcatgggactccatattggatggccccagaagtcatcaatgagtctggctatggacggaaatcagatatctggagcattggttgtactgtgtttgagatggctacagggaagcctccactggcttccatggacaggatggccgccatgttttacatcggagcacaccgagggctgatgcctcctttaccagaccacttctcagaaaatgcagcagactttgtgcgcatgtgcctgaccagggaccagcatgagcgaccttctgctctccagctcctgaagcactccttcttggagagaagtcactgaatatacatcaagactttcttcccagttccactgcagatgctcccttgcttaattgtggggaatgatggctaagggatctttgtttccccactgaaaattcagtctaacccagtttaagcagatcctatggagtcattaactgaaagttgcagttacatattagcctcctcaagtgtcagacattattactcatagtatcagaaaacatgttcttaataacaacaaaaaactatttcagtgtttacagttttgattgtccaggaactacattctctattgttttatatgacatttctttttatttttggcctgtcctgtcaattttaatgttgttagtttaaaataaattgtaaaaacaa

SEQ ID NO: 8627 - DNA, 1453 bp, Homo sapiens
tcaaagaaacagcagcttttggacattttaatgagttctatgccaaaaccagaaagacatgctgagtcattgcttgacatttgtcatgatacaaactcttctccaactgatttgatgacagttaccaaaaatcaaaacatcatcttgcaaagcatcagcagaagtgaggagttcgaccaagatggtgactgcagtcattccacactggttaatgaagaagaagatcccagtggtggtagacaggactggcaacccaggacagaaggtgttgagatcactgtaacttttccaagagatgtcagtcctccccaagaaatgagccaagaagacttaaaagaaaagaatctgataaactcatcgcttcaagaatgggcacaagcacatgcagtttctcatccaaatgaaatagaaacggtggagctcaggaaaaagaagctgaccatgcggcccttagttttgcaaaaagaggaaagttccagggagctctgcaatgtgaacttgggctttttgctaccaagatcttgtttagaactgaacatttccaagtctgtaaccagagaagatgctcctcattttctgaaggagcagcaaagaaaatctgaagagttttcgacctctcatatgaagtacagtggccgaagcatcaaggtatactgtggtctcactagtcaaggacagctaatagctgtaaaacaggtggctttggatacctctaataaattagctgctgaaaaggaataccggaaactacaggaagaagtagatttgctcaaagcactgaaacatgtcaacattgtggcctatttggggacatgcttgcaagagaacactgtgagcattttcatggagtttgttcctggtggctcaatctctagtattataaaccgttttgggccattgcctgagatggtgttctgtaaatatacgaaacaaatacttcaaggtgttgcttatctccatgagaactgtgtggtacatcgcgatatcaaaggaaataatgttatgctcatgccaactggaataataaagctgattgactttggctgtgccaggcgtttggcctgggcaggtttaaatggcacccacagtgacatgcttaagtccatgcatgggactccatattggatggccccagaagtcatcaatgagtctggctatggacggaaatcagatatctggagcattggttgtactgtgtttgagatggctacagggaagcctccactggcttccatggacaggatggccgccatgttttacatcggagcacaccgagggctgatgcctcctttaccagaccacttctcagaaaatgcagcagactttgtgcgcatgtgcctgaccagggaccagcatgagcgaccttctgctctccagctcctgaagcactccttcttggagagaagtcactgaatatacatcaagactttcttcccagttccactgcagatgc

SEQ ID NO: 8628 - DNA, 1460 bp, Homo sapiens
ttcaaagaaacagcagcttttggacattttaatgagttctatgccaaaaccagaaagacatgctgagtcattgcttgacatttgtcatgatacaaactcttctccaactgatttgatgacagttaccaaaaatcaaaacatcatcttgcaaagcatcagcagaagtgaggagttcgaccaagatggtgactgcagtcattccacactggttaatgaagaagaagatcccagtggtggtagacaggactggcaacccaggacagaaggtgttgagatcactgtaacttttccaagagatgtcagtcctccccaagaaatgagccaagaagacttaaaagaaaagaatctgataaactcatcgcttcaagaatgggcacaagcacatgcagtttctcatccaaatgaaatagaaacggtggagctcaggaaaaagaagctgaccatgcggcccttagttttgcaaaaagaggaaagttccagggagctctgcaatgtgaacttgggctttttgctaccaagatcttgtttagaactgaacatttccaagtctgtaaccagagaagatgctcctcattttctgaaggagcagcaaagaaaatctgaagagttttcgacctctcatatgaagtacagtggccgaagcatcaagaggcatagtagtgggctcaggatatatgacagggaggagaaatttctcatctcaaatgaaaagaagatattttctgaaaatagtttaaagtctgaagaacctatcctatggaccaaggtagatttgctcaaagcactgaaacatgtcaacattgtggcctatttggggacatgcttgcaagagaacactgtgagcattttcatggagtttgttcctggtggctcaatctctagtattataaaccgttttgggccattgcctgagatggtgttctgtaaatatacgaaacaaatacttcaaggtgttgcttatctccatgagaactgtgtggtacatcgcgatatcaaaggaaataatgttatgctcatgccaactggaataataaagctgattgactttggctgtgccaggcgtttggcctgggcaggtttaaatggcacccacagtgacatgcttaagtccatgcatgggactccatattggatggccccagaagtcatcaatgagtctggctatggacggaaatcagatatctggagcattggttgtactgtgtttgagatggctacagggaagcctccactggcttccatggacaggatggccgccatgttttacatcggagcacaccgagggctgatgcctcctttaccagaccacttctcagaaaatgcagcagactttgtgcgcatgtgcctgaccagggaccagcatgagcgaccttctgctctccagctcctgaagcactccttcttggagagaagtcactgaatatacatcaagactttcttcccagttccactgcagatgc

SEQ ID NO: 8629 - DNA, 2195 bp, Homo sapiens
aagcaatcatttccttgcatctgtaaaaatccaggaacacagaagtcatgtgttcctctctctgttcaaccgacagagccaagactaaattacctagatcttaagtatagtgatatgttcaaagaaatcaattcaactgctaatggacctggaatctatgaaatgtttgggacccctgtttattgtcatgtgcgagagactgaaagggatgaaaacacgtattaccgtgagatatgttcggctccatcaggcagacgtatcaccaataaatgtcgatcttcacacagtgagaggaagagcaatatcagaacaagactttctcagaaaaaaacacatatgaaatgcccaaagacttcatttggcattaaacaagagcacaaagtcttaatttctaaagaaaagagttccaaggctgtacatagcaacctacatgacattgaaaatggtgatggtatttcagaaccagactggcagataaagtcttcaggaaatgagtttctatcttccaaagatgaaattcatcccatgaacttggctcagacacctgagcagtccatgaaacagaatgaattccctcctgtctcagatttatccattgttgaagaagtttctatggaagagtctactggtgatagagacatttctaacaatcaaatactcaccacaagcctcagagatctgcaagaacttgaagagctacatcaccagatcccatttatcccttcagaagacagctgggcagtgcccagtgagaagaattctaacaagtatgtacagcaagaaaagcagaatacagcatctcttagtaaagtaaatgccagccgaattttaactaatgatctagagtttgatagtgtttcagatcactctaaaacacttacaaatttctctttccaagcaaaacaagaaagtgcatcttcccagacatatcaatattgggtacattatttggatcatgatagtttagcaaataagtcaatcacatatcaaatgtttggaaaaaccttaagtggcacaaattcaatttcccaagaaattatggactctgtaaataatgaagaattgacagatgaactattaggttgtctagctgcagaattattagctcttgatgagaaagataacaactcttgccaaaaaatggcaaatgaaacagatcctgaaaacctaaatcttgtcctcagatggagaggaagtaccccaaaagaaatgggcagagagacaacaaaagtcaaaatacagaggcatagtagtgggctcaggatatatgacagggaggagaaatttctcatctcaaatgaaaagaagatattttctgaaaatagtttaaagtctgaagaacctatcctatggaccaagggtgagattcttggaaagggagcctacggcacagtatactgtggtctcactagtcaaggacagctaatagctgtaaaacaggtggctttggatacctctaataaattagctgctgaaaaggaataccggaaactacaggaagaagtagatttgctcaaagcactgaaacatgtcaacattgtggcctatttggggacatgcttgcaagagaacactgtgagcattttcatggagtttgttcctggtggctcaatctctagtattataaaccgttttgggccattgcctgagatggtgttctgtaaatatacgaaacaaatacttcaaggtgttgcttatctccatgagaactgtgtggtacatcgcgatatcaaaggaaataatgttatgctcatgccaactggaataataaagctgattgactttggctgtgccaggcgtttggcctgggcaggtttaaatggcacccacagtgacatgcttaagtccatgcatgggactccatattggatggccccagaagtcatcaatgagtctggctatggacggaaatcagatatctggagcattggttgtactgtgtttgagatggctacagggaagcctccactggcttccatggacaggatggccgccatgttttacatcggagcacaccgagggctgatgcctcctttaccagaccacttctcagaaaatgcagcagactttgtgcgcatgtgcctgaccaggtaagaaactgaaagcaagaggaggaagataaatgcccggagattccaagtggcagacatttccctttcaatttatggcccattaaaagctctgttttggttatg

SEQ ID NO: 8630 - DNA, 6316 bp, Homo sapiens
attacgcccgcgctcctcgcctggccgtgatatcaatggcgcaggcttcacttctgctgtggcggtgactgaggcctttctggtgacctcagcccaacacaggccgtctccggagcttcccggtagtggccccggattcccacggtctttgtcattggctgtcagctagcaggcctggccgctcccgtgcggagagaccatctcttcagggcaatgtccaggccgagcagcgtctccccgcggcagccggctcctggcggtggcggaggcggcggcccctcgccttgtggccctgggggcggcggccgggccaaggggctgaaggacattcgcattgatgaggaggtgaagatcgcagtcaatatcgcgctggagcgcttccgatacggggaccagagagaaatggaatttccttcttctttgaccagtactgaaagagcctttattcatcgactcagtcagtctcttggtttggtctctaaaagtaaaggaaagggagcaaatagatacctaactgtgaagaagaaagatggatcagaaacagctcatgcaatgatgacctgtaatttgactcataatacaaaacatgctgttaggagcctaattcaaagatttcctgtcaccaataaagagcgtacagaacttctgcctaaaacagaaagaggaaatgtgtttgcagttgaagctgaaaaccgggaaatgagcaagacaagtgggcgactcaacaatggcatacctcagattccagtgaaaagaggagaatccgaatttgattcttttaggcagtctttaccagtgtttgagaaacaggaagaaattgttaaaataattaaggaaaataaagtagttttgattgtaggagaaactgggtctggaaagaccacacagattcctcagttccttttagatgattgctttaaaaatggtatcccctgccgtatattttgtactcaaccaagacgattggcagctatcgctgtggctgaaagagttgccgcagagagacgggaaaggattggtcaaacaattggttatcagatccgattagaaagcagggtttctccaaagacacttctgacattttgtactaatggggtattgcttcgtacattgatggcaggagatagtacgttgtcgactgtgacacatgttatcgtggatgaagtgcatgaaagggatcgatttagtgattttttacttacaaagttaagagatttgttgcaaaagcacccaactttgaaactaattctttctagtgctgccttggatgtaaatctctttataagatattttggaagttgtccagtgatatatatacagggaagaccatttgaagtaaaagaaatgtttctggaagatattttaagaacaactggatatacaaacaaagaaatgttaaaatataaaaaggaaaaacagcaagaagagaaacaacaaaccacacttacagaatggtactcagctcaagaaaatagtttcaagcctgaatctcagaggcagagaactgttctaaatgtgactgatgagtatgacttactggatgatggtggtgatgctgtcttcagtcagctgactgaaaaagatgtgaattgccttgaaccatggttaataaaggaaatggatgcttgcctttctgatatatggctacataaagatattgatgcctttgctcaggtctttcatctcattttaactgaaaatgttagtgttgattacagacatagtgaaaccagtgcaacagctctgatggttgctgcaggacgtggctttgcaagtcaagtagaacagttaatcagtatgggagccaatgtccatagtaaagcatcaaatggctggatggcattggattgggctaaacactttgggcagactgaaattgtggatcttctagaatcttacagtgctacactggaatttggaaatctagatgaaagttctctggttcaaacaaatggaagtgacctcagtgctgaagacagagagctcctgaaagcttatcatcatagtttcgatgatgaaaaagtagacttggatttgatcatgcatcttctatacaatatctgccatagttgtgatgctggtgcagtactaatttttctgcctggatatgacgaaattgttggactgagagatcgcatcctgtttgatgacaagcggtttgctgacagtacacatagataccaagtctttatgcttcattcaaatatgcaaacatccgatcaaaagaaagtattaaaaaacccacctgcaggtgttcgaaaaataattctttccaccaatattgctgaaaccagcatcacagtcaatgatgttgtctttgttattgattctggtaaggtgaaagagaaatcctttgatgctctgaattttgttacaatgttaaaaatggtatggatttccaaagctagtgccatacagcggaaaggcagggcagggcgatgtagacctggaatttgttttcgtctgttcagtagactccgattccagaatatgttggaatttcagactccggaacttttgagaatgccattacaggaactttgcttacataccaagctgttagccccagttaattgtcccattgctgattttcttatgaaagctcctgaacctccaccagctttaattgtaagaaatgctgtacaaatgcttaagacaatagatgcaatggatacatgggaagatctgactgaacttgggtatcatttggctgacttgccagtagaaccacatcttggtaaaatggtcttgtgtgctgttgttttaaagtgtctggaccccatccttacaattgcttgcacactagcttatcgagatccttttgtactacctactcaggcctctcaaaaacgtgcagctatgctttgtaggaaacgttttactgcaggagctttcagtgaccatatggcacttctcagagcattccaggcctggcaaaaagcacgaagtgatgggtgggagcgagccttttgtgaaaagaattttctttcacaggctactatggaaataatcataggcatgagaacacagttgcttggtcaacttagagcatcaggttttgttagagcacgaggtggtggtgacattcgggacgttaacacaaactctgagaattgggctgtcgttaaagctgcattggtggcaggcatgtatcctaatttagtccacgtggacagagagaatctagtgttgacagggccaaaggagaaaaaagtacgatttcatcctgcttcagttctcagtcagcctcaatataaaaagattcctccagccaatggtcaagctgcagcaattaaggcactgcccacagattggcttatttatgatgaaatgaccagagcccatagaatagctaatattagatgttgttcagcagtgacgcctgtcactatattggtattctgtggaccagctagattggcaagtaatgctcttcaggaaccttcatcctttagagtggatggcattcccaatgacagtagtgatagtgaaatggaggacaaaactacagctaatttggcagccttgaaacttgatgagtggctccatttcacactggagccagaggcagctagtttattgctgcagctcagacagaagtggcatagcttatttttacgccgaatgagagctccatctaaaccttggtctcaagttgatgaagctaccataagagcaattatagctgttttaagcactgaagaacagtctgcaggtttacaacaaccatctgggattggccaaaggccaaggcctatgtcttcagaagagcttcctttggcctcatcttggaggtcaaataatagtaggaaaagttcagcagatactgaattttctgatgagtgtactactgcagaaagagtactgatgaaatctccatctccagcattacacccacctcagaagtacaaagatagaggaattttacatcctaaacgaggtactgaggaccgatcagatcagtcttctctgaaatctacagacagcagtagttacccaagtccttgtgctagtccttctcctccatcctcaggaaagggctcaaaatctccttcgccaagaccaaacatgcctgttcgatacttcataatgaagagtagcaatttgagaaaccttgaaatttctcaacagaagggtatctggtctacaactcctagtaatgaacggaagctaaatcgagccttttgggaaagcagcatagtttacttggtattttctgttcaaggatctggacatttccagggattttctaggatgtcttctgagattggaagggaaaagagtcaggactggggctctgctggactaggaggagtatttaaggtggagtggatacgaaaagaaagccttccctttcaatttgcacaccatttactcaatccatggaatgacaacaagaaagtgcagataagcagggatgggcaggaactagaacctctggttggtgaacagttgctccagttatgggaacgtcttcccttgggagaaaaaaacacaactgattgacactcagaactcttagctgtggaagaacatcatgcctatttataaccactgaatgcactgactttcaaaaactgaggtggggtgtgtgttacgaatgggctttttaacacttttagagtgttgctttagaactaccatcttcatatacaggagaaaggaagcatttaaatttttatagtgattatagagaatgattatatgatgtttgtaatgaataaaatagtagtttcattatttggcacaatagcagtttattttaaacaaacaatttgaagttaaacatttcatttttaaaaacactgaattacagttcttattgatgactttttaatgcagagtaagttgtttaagaaaggcctgaatatatcagaacatctgagcaccattttagaagagtcaactcttaagattatcattagaaaacaaatacgtcaacacctatgaaaagaagcggggaaaacaacaacaaggacaacaacaaaaaaccagtgaaattctacaagtgtcccttttaaaaatagtgtgtgctaactaagggctattcattctgccatttttaacttgagacacatttaagaataaagttggatgttctttttctgtgattatgaaatgcaataaaatctgaataaagggcaaagtttcttcctgatcagattagattaagtgcttagttttattcctaattctgccccttttaacctgatgtgtaccttactctttcctccctctcttcctcccttcctcctctccccgctcctttcctgcatttctccctccctccttccctcgtcacatctcttatatgagcacagtaattatgacctttttgttttggctacaacttgattgaaacaagttcaaaatttaaacaagttcatacaagtttttaaaaattctcaactggtagcttgcttgctgtgcgtcttccaaactaaagcctgcaagcgccacaattctaagtgccgccttccattttttttcagtatgttttcactggcttatgttttcagatatgattttcctttttcgcatatatggtttaataaatgggggataattttttttttgtaaatccgtgcttgtgccaagtctcatatttctttgccatctcagaattatctttttaccaccactgtttataaaatttccttagagactttttgaagggaaaatagagcaacagggaaaaatgaaagaaatgtcttggttactgagctctaaatagacaggtttgatggcacttctcatgatacattttagttattcttataaaagcaaacaggcaaacatgagtgtaaattaaagacaaaaagaaaactctggttttatatttgagaacacgtgaaaaatcatgggtcaacataaaatcttgagaaccttctactttctctgggaaagcattatatagtggtgcattagtttagaaagtcagctatgattttgcctatagttctagttattagctttggggttttcttgtactttaagacatacctgtaaattgaacctatttgaattatattccactgtatgtgtattatggctcttttcctattagagcaacttgtgtttccctgataatgtgtacattttttaggcatgtacttaatagttcacaatgttctaaatttggaaggacttaaaaaaaaaacttgtttaaatttccatctgttttgtaatatctagctctatatgtaaatgatgggtttgttggtatttaaaatgaatacaacttgaatgtaattaaagtgctgttttttggaagcgataaactttaaatatacttattaaaatgaaattctattaa

SEQ ID NO: 8631 - DNA, 4421 bp, Homo sapiens
attagagtagacttcctgtccttctcttcagtagcatagtcatgtaagagctgatctggaatgaatagatatcttgggaaggagaattcaagaaggaagttatggagacaaaaatggggaatgcggaaacattgaagagccagagaaagaagaaaaaggaaagagatgctaagaaagggagcaaatagatacctaactgtgaagaagaaagatggatcagaaacagctcatgcaatgatgacctgtaatttgactcataatacaaaacatgctgttaggagcctaattcaaagatttcctgtcaccaataaagagcgtacagaacttctgcctaaaacagaaagaggaaatgtgtttgcagttgaagctgaaaaccgggaaatgagcaagacaagtgggcgactcaacaatggcatacctcagattccagtgaaaagaggagaatccgaatttgattcttttaggcagtctttaccagtgtttgagaaacaggaagaaattgttaaaataattaaggaaaataaagtagttttgattgtaggagaaactgggtctggaaagaccacacagattcctcagttccttttagatgattgctttaaaaatggtatcccctgccgtatattttgtactcaaccaagacgattggcagctatcgctgtggctgaaagagttgccgcagagagacgggaaaggattggtcaaacaattggttatcagatccgattagaaagcagggtttctccaaagacacttctgacattttgtactaatggggtattgcttcgtacattgatggcaggagatagtacgttgtcgactgtgacacatgttatcgtggatgaagtgcatgaaagggatcgatttagtgattttttacttacaaagttaagagatttgttgcaaaagcacccaactttgaaactaattctttctagtgctgccttggatgtaaatctctttataagatattttggaagttgtccagtgatatatatacagggaagaccatttgaagtaaaagaaatgtttctggaagatattttaagaacaactggatatacaaacaaagaaatgttaaaatataaaaaggaaaaacagcaagaagagaaacaacaaaccacacttacagaatggtactcagctcaagaaaatagtttcaagcctgaatctcagaggcagagaactgttctaaatgtgactgatgagtatgacttactggatgatggtggtgatgctgtcttcagtcagctgactgaaaaagatgtgaattgccttgaaccatggttaataaaggaaatggatgcttgcctttctgatatatggctacataaagatattgatgcctttgctcaggtctttcatctcattttaactgaaaatgttagtgttgattacagacatagtgaaaccagtgcaacagctctgatggttgctgcaggacgtggctttgcaagtcaagtagaacagttaatcagtatgggagccaatgtccatagtaaagcatcaaatggctggatggcattggattgggctaaacactttgggcagactgaaattgtggatcttctagaatcttacagtgctacactggaatttggaaatctagatgaaagttctctggttcaaacaaatggaagtgacctcagtgctgaagacagagagctcctgaaagcttatcatcatagtttcgatgatgaaaaagtagacttggatttgatcatgcatcttctatacaatatctgccatagttgtgatgctggtgcagtactaatttttctgcctggatatgacgaaattgttggactgagagatcgcatcctgtttgatgacaagcggtttgctgacagtacacatagataccaagtctttatgcttcattcaaatatgcaaacatccgatcaaaagaaagtattaaaaaacccacctgcaggtgttcgaaaaataattctttccaccaatattgctgaaaccagcatcacagtcaatgatgttgtctttgttattgattctggtaaggtgaaagagaaatcctttgatgctctgaattttgttacaatgttaaaaatggtatggatttccaaagctagtgccatacagcggaaaggcagggcagggcgatgtagacctggaatttgttttcgtctgttcagtagactccgattccagaatatgttggaatttcagactccggaacttttgagaatgccattacaggaactttgcttacataccaagctgttagccccagttaattgtcccattgctgattttcttatgaaagctcctgaacctccaccagctttaattgtaagaaatgctgtacaaatgcttaagacaatagatgcaatggatacatgggaagatctgactgaacttgggtatcatttggctgacttgccagtagaaccacatcttggtaaaatggtcttgtgtgctgttgttttaaagtgtctggaccccatccttacaattgcttgcacactagcttatcgagatccttttgtactacctactcaggcctctcaaaaacgtgcagctatgctttgtaggaaacgttttactgcaggagctttcagtgaccatatggcacttctcagagcattccaggcctggcaaaaagcacgaagtgatgggtgggagcgagccttttgtgaaaagaattttctttcacaggctactatggaaataatcataggcatgagaacacagttgcttggtcaacttagagcatcaggttttgttagagcacgaggtggtggtgacattcgggacgttaacacaaactctgagaattgggctgtcgttaaagctgcattggtggcaggcatgtatcctaatttagtccacgtggacagagagaatctagtgttgacagggccaaaggagaaaaaagtacgatttcatcctgcttcagttctcagtcagcctcaatataaaaagattcctccagccaatggtcaagctgcagcaattaaggcactgcccacagattggcttatttatgatgaaatgaccagagcccatagaatagctaatattagatgttgttcagcagtgacgcctgtcactatattggtattctgtggaccagctagattggcaagtaatgctcttcaggaaccttcatcctttagagtggatggcattcccaatgacagtagtgatagtgaaatggaggacaaaactacagctaatttggcagccttgaaacttgatgagtggctccatttcacactggagccagaggcagctagtttattgctgcagctcagacagaagtggcatagcttatttttacgccgaatgagagctccatctaaaccttggtctcaagttgatgaagctaccataagagcaattatagctgttttaagcactgaagaacagtctgcaggtttacaacaaccatctgggattggccaaaggccaaggcctatgtcttcagaagagcttcctttggcctcatcttggaggtcaaataatagtaggaaaagttcagcagatactgaattttctgatgagtgtactactgcagaaagagtactgatgaaatctccatctccagcattacacccacctcagaagtacaaagatagaggaattttacatcctaaacgaggtactgaggaccgatcagatcagtcttctctgaaatctacagacagcagtagttacccaagtccttgtgctagtccttctcctccatcctcaggaaagggctcaaaatctccttcgccaagaccaaacatgcctgttcgatacttcataatgaagagtagcaatttgagaaaccttgaaatttctcaacagaagggtatctggtctacaactcctagtaatgaacggaagctaaatcgagccttttgggaaagcagcatagtttacttggtattttctgttcaaggatctggacatttccagggattttctaggatgtcttctgagattggaagggaaaagagtcaggactggggctctgctggactaggaggagtatttaaggtggagtggatacgaaaagaaagccttccctttcaatttgcacaccatttactcaatccatggaatgacaacaagaaagtgcagataagcagggatgggcaggaactagaacctctggttggtgaacagttgctccagttatgggaacgtcttcccttgggagaaaaaaacacaactgattgacactcagaactcttagctgtggaagaacatcatgcctatttataaccactgaatgcactgactttcaaaaactgaggtggggtgtgtgttacgaatgggctttttaacacttttagagtgttgctttagaactaccatcttcatatacaggagaaaggaagcatttaaatttttatagtgattatagagaatgattatatgatgtttgtaatgaataaaatagtagtttcatt

SEQ ID NO: 8632 - DNA, 594 bp, Homo sapiens
atgctgtttttgggcagcctgggggcctggggaacaacatctatcagcacaggttcaattttttccctgaaaaccctgcgttctcagcatgggggacaagtgggtctcaaggtcagcagacccagagctccgcgtatgggagcagctacacctaccccccgagctccctgggtggcacggtggttgatgggcagccaggctttcacagcgacaccctcagcaaggcccccgcctccacccataaagcataacatggacattggcacctgggataacaaggggcctgtgccgaaggccccagtcccccagcaggcaccctctccacaggctgccccacagccccagcaggtggctcagcctctcccagcacagcccccagctttggctcaaccgcagtatcagagccctcagcagccaccccagacccgctgggttgccccacgcaacagaaacgcggcgtttgggcagagcggaggggctggcagcgatagcaactctcctggaaacgtccagcctaattctgcccccagcgtcgaatcccaccccgtccttgaaaaactgaaggctgctcacagctacaacccgaaagagttt

SEQ ID NO: 8633 - DNA, 1933 bp, Homo sapiens
atcttaacgtgcttcttactggcaagttgctgaaacaaatgcagaaattctgtcagaaactgctgtctctgcatattgatgccaccagctgaggggctgaaattgcagcctcagagggaccagtcctgaaaacagatctgaaaagtgagcagccaaagtaacagttacccctcaatgagcgacccctacctgtccagctattacccgccgtccattggatttccttactccctcaatgaggctccgtggtctactgcaggggaccctccgattccatacctcaccacctacggacagctcagtaacggagaccatcattttatgcacgatgctgtttttgggcagcctgggggcctggggaacaacatctatcagcacaggttcaattttttccctgaaaaccctgcgttctcagcatgggggacaagtgggtctcaaggtcagcagacccagagctccgcgtatgggagcagctacacctaccccccgagctccctgggtggcacggtggttgatgggcagccaggctttcacagcgacaccctcagcaaggcccccgggatgaacagcctggagcagggcatggttggcctgaagattggggacgtcagctcctccgccgtcaagacggtgggctctgtcgtcagcagcgtggcactgactggtgtcctttctggcaacggtgggacaaatgtgaacatgccagtttcaaagccgacctcgtgggctgccattgccagcaagcctgcaaaaccacagcctaaaatgaaaacaaagagcgggcctgtcatggggggtgggctgccccctccacccataaagcataacatggacattggcacctgggataacaaggggcctgtgccgaaggccccagtcccccagcaggcaccctctccacaggctgccccacagccccagcaggtggctcagcctctcccagcacagcccccagctttggctcaaccgcagtatcagagccctcagcagccaccccagacccgctgggttgccccacgcaacagaaacgcggcgtttgggcagagcggaggggctggcagcgatagcaactctcctggaaacgtccagcctaattctgcccccagcgtcgaatcccaccccgtccttgaaaaactgaaggctgctcacagctacaacccgaaagagtttgagtggaatctgaaaagcgggcgtgtgttcatcatcaagagctactctgaggacgacatccaccgctccattaagtactccatctggtgtagcacagagcacggcaacaagcgcctggacagcgccttccgctgcatgagcagcaaggggcccgtctacctgctcttcagcgtcaatgggagtgggcatttttgtggggtggccgagatgaagtcccccgtggactacggcaccagtgccggggtctggtctcaggacaagtggaaggggaagtttgatgtccagtggatttttgttaaggatgtacccaataaccagctccggcacatcaggctggagaataacgacaacaaaccggtcacaaactcccgggacacccaggaggtgcccttagaaaaagccaagcaagtgctgaaaattatcagttcctacaagcacacaacctccatcttcgacgactttgctcactacgagaagcgccaggaggaggaggaggtggtgcgcaaggaacggcagagtcgaaacaaacaatgagggcgaaccagtttcttacatgttctaacgtttgactttgaaaacagtttaaaacacgtgtgcttggtcagctccagtgtgtcgtcccgtgcgggggttgagtgttgcatctttgcctttcttgtcgttgatttttgcccagatggatctgcatttatttgtactttttctatgtattataatcctgtagaagtcactaataaaggagtattttttttgtcagcttatc

SEQ ID NO: 8634 - DNA, 3301 bp, Homo sapiens
cgcaggcgcgaagtgtggcggcccggcgcggcgctcccggcctgccccgcgtgcacgctgacgccgcgcagtctcgtcccctgccgccgccgtcgccgctgctgtcgccgccgccgccgccattggagtcgacgcctcctcagtgcgtccgcgtcccgggctcaccgccgctgccgcctcgccaggggcccgcgcgcccagcagccgccgccgccgcccggccggcgcccggggaattggcggcggggcccggggccgcgcgagctagggtgacaggcccggcctctaggggaggcccgagccggcgggcgccccggccccgcgtctagttgttcatgaagcatgtcggccaccagcgtggacacccagagaacaaaaggacaagataataaagtacaaaatggttcgttacatcagaaggatacagttcatgacaatgactttgagccctaccttactggacagtcaaatcagagtaacagttacccctcaatgagcgacccctacctgtccagctattacccgccgtccattggatttccttactccctcaatgaggctccgtggtctactgcaggggaccctccgattccatacctcaccacctacggacagctcagtaacggagaccatcattttatgcacgatgctgtttttgggcagcctgggggcctggggaacaacatctatcagcacaggttcaattttttccctgaaaaccctgcgttctcagcatgggggacaagtgggtctcaaggtcagcagacccagagctccgcgtatgggagcagctacacctaccccccgagctccctgggtggcacggtggttgatgggcagccaggctttcacagcgacaccctcagcaaggcccccgggatgaacagcctggagcagggcatggttggcctgaagattggggacgtcagctcctccgccgtcaagacggtgggctctgtcgtcagcagcgtggcactgactggtgtcctttctggcaacggtgggacaaatgtgaacatgccagtttcaaagccgacctcgtgggctgccattgccagcaagcctgcaaaaccacagcctaaaatgaaaacaaagagcgggcctgtcatggggggtgggctgccccctccacccataaagcataacatggacattggcacctgggataacaaggggcctgtgccgaaggccccagtcccccagcaggcaccctctccacaggctgccccacagccccagcaggtggctcagcctctcccagcacagcccccagctttggctcaaccgcagtatcagagccctcagcagccaccccagacccgctgggttgccccacgcaacagaaacgcggcgtttgggcagagcggaggggctggcagcgatagcaactctcctggaaacgtccagcctaattctgcccccagcgtcgaatcccaccccgtccttgaaaaactgaaggctgctcacagctacaacccgaaagagtttgagtggaatctgaaaagcgggcgtgtgttcatcatcaagagctactctgaggacgacatccaccgctccattaagtactccatctggtgtagcacagagcacggcaacaagcgcctggacagcgccttccgctgcatgagcagcaaggggcccgtctacctgctcttcagcgtcaatgggagtgggcatttttgtggggtggccgagatgaagtcccccgtggactacggcaccagtgccggggtctggtctcaggacaagtggaaggggaagtttgatgtccagtggatttttgttaaggatgtacccaataaccagctccggcacatcaggctggagaataacgacaacaaaccggtcacaaactcccgggacacccaggaggtgcccttagaaaaagccaagcaagtgctgaaaattatcagttcctacaagcacacaacctccatcttcgacgactttgctcactacgagaagcgccaggaggaggaggaggtggtgcgcaaggaacggcagagtcgaaacaaacaatgagggcgaaccagtttcttacatgttctaacgtttgactttgaaaacagtttaaaacacgtgtgcttggtcagctccagtgtgtcgtcccgtgcgggggttgagtgttgcatctttgcctttcttgtcgttgatttttgcccagatggatctgcatttatttgtactttttctatgtattataatcctgtagaagtcactaataaaggagtattttttttgtcagcttatcaatcagactgatctaatgtgaaatgtaagtatccttaaaaacaaagcatctattttggcagaaattgtgttcttaaattcagtcatttgatattctgtgagacttcatatttctcatccctttattgctttttagcaaacataagaaaccatgagtcattttgtcatttagagtattctgataaaatctcttgaaaatactgaaatcaaaaggttaatgattttttgttcattctgatttgtcattttattatctgttatcggtctaaagtgctaatttacccatttgatttttctgctagacagataacttttaatttttcaaatttggcagacactttttttttttttttgaaaatctttccttccagatctgttgcccactgaacagccacccgtccctcactgtcctggtgtccgattgggctggatggtgttggggcatgatgtgtggaggaactggaaggtgctttaggtctggttcagggtcgggcattctttgttgtttgcacatctttttaaattttacaccttttcttaagaattctaatgccgtcttaagtttttataccaataatgctgagctttaagtgtaggatctggtagtacagacagtgtgatggatgatgctgctggttgtaaatttcatcgtgtgtgtctaattttttttcctgttgaatgggtaaaaacaaaacaaaactttttttagaagatgaatttgctgtcatgttttgtggaatgagggaccgttgagctcactaccacctggagtttgagttgaagcatgaaaatggtgcccatgcctgacgctccagcgcctggatctgcacgtgcccttgtagaggatccttaccgtcctagagagcagacgctttctgaaaactacttgctccaaaagaccctctgagttaacgtttcagctgtatcattagacttgtatttagagcgtgtcacttcctctgaactgttactgcctgaatggagtcctggacgacattgggtttttcctctaggagaatacaagccttaataaacaatactatttagcaaa

SEQ ID NO: 8635 - DNA, 1255 bp, Homo sapiens
ggagaagacagactgctgctttggacctgttggtaatgatggcctgagctaaacatctaactagaagggatacccttccatttcaaagaacagaatgctaaggaagctgtggcaatggttttatgaagaaacagaaagcagtgatgatgttgaagtgctgactctcaagaaattcaaaggagacctggcctacagacgacaagagtatcagaaagcactgcaggagtattccagtatctctgaaaaattgtcatcaaccaattttgccatgaaaagggatgtccaggaaggtcaggctcggtgtctggctcacctgggtaggcatatggaggcgctggagattgctgcaaacttggaaaataaagcaaccaacacagaccatttaaccacggtactctacctccagcttgctatttgttcaagtttgcagaacttggagaaaacaattttctgcctgcagaaactgatttctttgcatccttttaatccttggaactggggcaaattggcagaggcttacctgaatctggggccagctctttcagcagcacttgcgtcatctcagaaacagcacagtttcacctcaagtgacaaaactatcaaatccttctttccacactcaggaaaagactgtcttttgtgttttcctgaaaccttgcctgagagctctttattttctgtggaagcgaatagcagtaatagccagaaaaatgagaaagctctgacaaatatccaaaactgtatggcagaaaagagagaaacagtgttgatagagactcagctgaaagcatgtgcctcttttatacgaaccaggcttctgcttcagtttacccaacctcagcaaacatcgtttgctttggagaggaacttaaggactcagcaggaaattgaagataaaatgaaagggttcagcttcaaagaagacactttgctgttgatagctgaggtgagtgtatccctcgggtttatgtgaaacgaagcatcatagatattttccctggctctgatagcattttttataaagcagggccaaatttaatctactgaaggacttgtctccctcctctgtgtgccttttgatcactcagcaatcaccaaggcggcctcttgatcggcattcccctgcagcgtgcgggaccgcaggggctgtgtttcatgtacttgtcagtgcttgttagcacctgcctgcctgaacatcatcaatgcccaataattgtttgtttcagtgctgaataaatgaatgaatgaatgctta

SEQ ID NO: 8636 - DNA, 698 bp, Homo sapiens
cggagagatggcggagttggacatcgggcagcactgccaggtggagcattgccggcagcgagattttcttccatttgtgtgtgatgattgttcaggaatattttgccttgaacacagaagcagggagtctcatggttgtcctgaggtgactgtaatcaatgagagactgaagacagatcaacatacatcttacccatgctctttcaaagactgtgctgagagagaacttgtggcagttatatgtccttattgtgagaagaatttttgcctgagacaccgtcatcagtcagatcatgagtgtgaaaaactggaaatcccaaagcctcgaatggctgccactcagaaacttgttaaagacattattgattccaagacaggagaaacagcaagtaaacgatggaaaggtgccaaaaatagtgaaacagctgcaaaggttgcattgatgaaattaaagatgcatgctgatggcgataagtcattaccacagacagaaagaatttactttcaggttttcttacctaaagggagcaaagagaagagcaaaccaatgttcttttgccaccgatggagcattggaaaggccatagactttgccgcttctctagccaggcttaaaaatgacaataacaaatttacagctaaggtaacatctcattataataatatttctatattaataaaggttttatgatgctcca

SEQ ID NO: 8637 - DNA, 1778 bp, Homo sapiens
cccttacggcgccggagagatggcggagttggacatcgggcagcactgccaggtggagcattgccggcagcgagattttcttccatttgtgtgtgatgattgttcaggaatattttgccttgaacacagaagcagggagtctcatggttgtcctgaggtgactgtaatcaatgagagactgaagacagatcaacatacatcttacccatgctctttcaaagactgtgctgagagagaacttgtggcagttatatgtccttattgtgagaagaatttttgcctgagacaccgtcatcagtcagatcatgagtgtgaaaaactggaaatcccaaagcctcgaatggctgccactcagaaacttgttaaagacattattgattccaagacaggagaaacagcaagtaaacgatggaaaggtgccaaaaatagtgaaacagctgcaaaggttgcattgatgaaattaaagatgcatgctgatggcgataagtcattaccacaggttttcttacctaaagggagcaaagagaagagcaaaccaatgttcttttgccaccgatggagcattggaaaggccatagactttgccgcttctctagccaggcttaaaaatgacaataacaaatttacagctaagaaattaaggctgtgtcacattacttcaggagaagccttacccttggatcatactttggaaacctggattgctaaggaggattgtcctttatataatggtggaaatataatcttggaatatcttaatgatgaagaacaattctgtaaaaatgttgaatcttacttggaatagtcattcaaagattcaagtcagaaatcacagggaaaattctattacatgtttaagtccatttattttactacaaatactatttttgtaatttttaaaagttgctttttaacttatttccccttatgtcacattttaaattatgagttttctattagagttttttggttttaagtttaattgtgtacggatcctcaattattagcaaattcttatatttaattagctttcattagtttatgctgtagtgacaacaacaaagatgtatttcctggtgggggatgtcagctgttgattggctgtgacactgctttgtgtcatcttcttaccatgatcaaaggcaaaggaagggatctcttttgggacattgtgattgttttagcagagagagaaagagatgaaatacacttcggttttctcttaaaagatgcatgtatcatacgtgctttaagcaagtcatgtggccaagcctagcatcatggagccagaaagtatagccttgctgtctgtctacatcatgatgtataaattgatatatctacatgaattatagaaacttagaagtgatctttattcagtcttataatttttacatgaagaatcttaggcctaggaggagaaaatgattttctttctattacctaactagattggggcatatttctgataaagacccacctctagtgagattcatcttttttgtttgtgtgactatattccatagagaagaaagatgggatagctcaacttcattatataccaaagcaaaacacatgccaaatgatgactacattttaccaacatatttagacgagtattcttgactagtgtttactatctatacccccaaaactactactatatagacagaatggaaagtatttctatttgtcctttttttgttttctgttctaattgtcagggacatatgtagtggctataggtttacttaaaaggaataaatttggaatgctca

SEQ ID NO: 8638 - DNA, 4686 bp, Homo sapiens
gtgcaggagtctgagaagaaagggtgtagatggagaggcggtggcctcacctctgcatgctccgtgggaagcggcggaggcgcccagcatccctcctactctgcccttggtggaggtttacgaggtctgctggagtttgctggaggtccgctccataccctgtttgcctgggtatcaccagtggaggctgcagaacaacaaagattgctgcctgttcctgcctctggaagcttcgtcccagaggggcacctgccagatgccagccagagctctcctgtatgagaaaacacggccatctttatgtgtaaatgttgtaacctcttctcaccaaatcagtcggaactcctctcccacgtttcagagaagcacatggaagaaggggttaatgttgatgagattattattccccttaggcctctgagtacacctgaaccccccaactcaagcaaaaccggagatgagtttttggtcatgaagaggaagagaggcaggcctaaggggtccacgaagaagtccagcacagaagaggagctggcagaaaacatcgtgagtccgactgaggacagcccgctggctccggaggaagggaacagcctgcctccaagcagcttggagtgtagcaagtgctgtcggaagttctccaacacgcgccagctgcggaagcacatctgcattatcgtgctgaatttgggtgaggaggaaggagaagcaggtaacgagtctgaccttgaactagaaaagaagtgtaaggaagatgatcgggaaaaagcctcgaaaagaccacggtcacagaaaacagagaaagtccagaagatctcaggaaaggaggccagacagctttctggggcgaagaaacccatcataagtgtggttttaactgcacacgaagcaattccaggtgctaccaagattgtgccagtggaggctgggccccctgaaacaggagctacaaattctgagaccacttcagcagacctggtgcctcggagaggctaccaggaatacgccattcagcagacaccttatgagcaaccaatgaagtcaagcaggctaggtcccactcagctcaaaatcttcacttgtgaatactgcaacaaggtcttcaagttcaagcactcgctgcaggcccacctgaggatccacaccaatgaaaagccatacaagtgcccccagtgcagctatgccagtgccatcaaggccaacctcaatgtgcacctgcgcaagcacactggagagaagttcgcctgcgactattgctcgttcacctgcctgagcaagggccacctcaaggtgcacatcgagcgagtgcacaagaagatcaagcagcactgccgcttctgcaagaagaagtactctgacgtcaagaacctcatcaagcacatccgagacgcgcatgacccacaggacaagaaggtcaaagaggccttggacgagctctgcctgatgacgagggagggcaagcggcagctgctctatgactgccacatctgtgagcgcaagttcaagaacgagctggaccgtgaccgccatatgctggtccacggagacaagtggccttttgcctgtgagctctgtggccatggggccaccaagtaccaggcgctggaactgcatgtcaggaagcaccccttcgtgtacgtctgtgccgtctgccgcaagaagttcgtcagctccatcaggctgcgcacccacatcaaagaggtgcacggggctgcccaggaggccttggtcttcaccagttccatcaaccagagcttctgcctcctggaacctggtggggacatccagcaagaagctctgggggaccagctacagctggtggaagaggagtttgccctccagggcgtgaatgcactcaaggaagaggcctgtcctggggacactcagctggaggagggccggaaggagccggaggcccctggggaaatgcctgccccagctgtgcacctggcctccccgcaggccgaaagcacagccctgccaccctgtgagctggaaaccaccgtggtctcctcctcagacctgcattctcaagaggtggtttcagatgattttttgttgaaaaatgatacctcctccgcagaggctcatgctgctcctgagaagcccccagacatgcagcacagaagctcagtccagacgcaaggtgaagtgatcacactactgctgtccaaggcccagagtgctgggtcagatcaggaaagccatggcgcccagagccccctaggggaagggcagaacatggctgtgctttcagctggtgacccagatcccagcaggtgtctcaggtcaaacccagctgaggcctcagacctcctccctccagtagctggtggtggggacaccatcacacatcagcctgactcttgcaaagctgcccctgagcaccggtcaggcatcaccgctttcatgaaggtcctgaacagtttacagaagaagcaaatgaacaccagcttgtgtgagcggatccggaaggtttatggagacctggagtgtgaatactgtggcaaacttttttggtaccaagtgcattttgatatgcatgtccgcacccacacccgggaacatctgtattattgctctcagtgtcattattcttccatcaccaaaaactgccttaaacgccacgtaattcagaaacacagtaacatcttgctgaagtgtcccaccgatggctgtgactactcaactccagataaatataagctacaggcacatcttaaagttcacacagcactggacaaaaggagttattcttgtcctgtttgtgaaaagtctttttcagaggatcgattgataaagtcacatatcaagaccaaccatcctgaggtctccatgagcaccatttctgaggttctcgggaggagggttcagctgaaagggctaattggaaagagagccatgaaatgcccatattgtgacttttatttcatgaagaatggctcagaccttcagcgtcatatttgggctcatgaaggtgtgaagcccttcaagtgttctttgtgtgagtatgcaactcgtagcaagagtaacctcaaggctcatatgaatcgtcacagcactgagaaaacccacctatgtgacatgtgtggcaagaaattcaaatcaaaagggacactgaaaagtcacaaactccttcacactgcagatgggaagcagtttaagtgcacggtgtgtgactacacagcggcccagaagccacagctgctgcggcacatggaacagcatgtctccttcaagcctttccgctgtgcccattgccattactcctgcaacatatctggctctctgaagcggcactacaacaggaagcaccctaatgaggagtatgccaacgtgggcaccggggagctggcagcggaggtgctcatccagcaaggtggtttgaagtgtcctgtttgcagctttgtatatggcaccaaatgggagttcaataggcacttgaagaacaaacatggcttgaaggtggtggaaattgatggagaccccaagtgggagacagcaacagaagctcctgaggagccctccacccagtatctccacatcacagaggccgaagaagacgttcaagggacacaggcagcggtggccgcgctccaggacctgagatacacctctgagagtggcgaccgactggaccccacggccgtgaacatcctgcagcagatcattgagctgggcgccgagacccatgacgccactgcccttgcctcggtggttgccatggcaccagggacggtgactgtggttaagcaggtcaccgaggaggagcccagctccaaccacacggtcatgatccaggagacggtccagcaagcgtccgtggagcttgccgagcagcaccacctggtggtgtcctccgacgacgtggagggcattgagacggtgactgtctacacgcagggcggggaggcctcggagttcatcgtctacgtgcaggaggccatgcagcctgtggaggagcaggctgtggagcagccggcccaggaactctagaggacatgtggcatcggatggccacagggcggggctgccaggctctgcaggcacccagggtggggaggccacccttcctgccctacccgcagaatggtgctctcctttgccctccctgcccagcagcctgataggactctcctagtccaacttggggtgggcaaggcagtcagcatcaccagcaataccacaggaccctcaccccagcatagacacacaccccctgacccttaccatctgcttcctgaaagacttcagtgtcagctcccctacacacaccccacaccttcaccccttgcttcaagattcaaacagagactcccagtccccctcagcatcttccctgaatcacagccccagctccttgacccccatctaggtgccaaatgttcatctgcaaccgctatgcagtctggtgagagggagacagccatcacatagaaagtgaccgtacgggtttttaatcactgctgggtggggtgggggtagggggattgtcctggctttgtcgacaaagtcccacttccccgagtattaagggcccttggtatcaagtgaggtaaattcacccatcacagggtctcgccctaccatcctggaattatttcacttttaagataaatgcactatttcactgttcgcctcccattctaaggaggtgaggtggttggaataaaaacagttcctgtc

SEQ ID NO: 8639 - DNA, 2651 bp, Homo sapiens
cgcaagatggcggcgggaggggcccaggttgctgctctggccgccgagtgaggggcggggggggcccgggggcgcgcggcccgagacccccccggccgccctcctcctttctttgttcctgtggctgggggggtatcccctccctccacaacatggagccatctcctctgtctcccagtggggcagcacttcccctgccgctgtcgctggctccgcccccactacccctgccagcagctgcagtggtacatgtgtccttccctgaggtgaccagtgccctcttggagtccctcaatcagcagcgtctgcagggccagctctgcgatgtatctatcagagtgcagggccgggagttccgggctcatcgggctgtcctggctgcctcctccccttacttccatgatcaggtcctactcaaaggcatgacctccatctcgctgcccagtgtcatggacccaggcgcctttgagactgtcctagcctccgcttacactggccgcctcagcatggctgctgctgacattgtcaacttccttacagtggggtctgtgctccaaatgtggcacattgtggacaagtgcactgaactactccgagaaggccgggcctcagctaccaccaccatcactactgctgcagccacctctgtcactgtccctggtgctggggtgccatccgggagtgggggcactgtggcccctgctaccatgggctctgcgcgctcccatgcctccagccgggccagtgagaatcaatctcccagcagcagcaactacttcagccccagggagtccactgatttctcatcttcctcccaagaggcatttgcagcttctgcagtgggcagtggggagcgtcgaggaggtggccctgtattcccagcccctgtcgttggcagtggaggggccacatctggaaagctgctgctggaggcagatgagctgtgcgatgatggtggggatgggaggggggcagtggttcctggggctgggctccggagacccacctacacaccccctagcatcatgccacagaaacactgggtatacgtgaagcgaggtggtaattgcccagcgccagcacccctggttccccaagacccagatctggaggaggaagaggaggaggaagatctggtgttgacctgtgaggatgatgaagatgaagaactagggggtagctccagggttccagtggggggagggcctgaggctaccctcagcataagtgatgtccgtaccctgagtgagcccccagacaagggggaggagcaggtcaacttctgtgagtcctccaatgactttggcccatatgagggtgggggtcctgtggcaggtcttgatgactcaggggggccaactccctcttcctatgccccctcccaccctcctcgaccgctccttcccttggacatgcagggcaaccagatcctggtcttcccgtcgtcgtcttcatcctcatcctcacaggctcctggccaaccaccagggaaccaagcagaacacggggcagtgaccgtggggggcacgtcggtggggagcctgggtgtgccgggtagcgttggtggggtccctggagggactggcagtggggacgggaataagatctttctgtgccattgtgggaaggccttctcccacaagagcatgcgggaccggcacgtgaacatgcacctcaatctgcggccgtttgactgccccgtgtgcaacaaaaagttcaagatgaagcaccatctgactgagcacatgaagacgcacacaggtctcaagccctacgagtgcggagtctgcgccaagaagttcatgtggcgagacagcttcatgcgccaccgaggacactgtgagcgccggcaccgcctgggcggggtcggggccgtacctgggcctgggactcccacggggccatccttgccgtccaagagagagtctcccggagtgggcgggggcagcggcgacgaagcgagtgcggccacgcccccgtccagcagacgtgtctggtccccacccagagtccacaaggtggagatgggcttcggtggaggtggaggagcaaactgaaggggcaggctactggggtggggtagctttcgggaaagggaataaggagcacgatgcaagggcgctgtggcccccgggtgatctcccaccacacttactgtcttcctttatctctgtggacttgtatatattctggaaggggaaccacagtttcaccatcacccgcccattctactactcaacccctcccccccaaggtatttccagaactaaacccttcctttccctctgatgggtacactgaagcccctgctccacagagtagattgcacatggagggagggagagggggcgtgttgaacatcctgcagtcacagggtcaggggtcaggtggttgtagtctgtgcctgaagtctgtgtttgtgttgtcgtggagacaaggcctttgagccccacccttgtcctagaacctaccccctctcaaggatgcgctctttatttctaccctgtttctccccgccacccccgacttcccgtggaaattcccaactcggttctcatggaggagtgggtggagacaaggagggagtaagtcgtaggagtacaaggtttttattttttttaacagtgattaaaatatttattggtcattta

SEQ ID NO: 8640 - DNA, 2651 bp, Homo sapiens
cgcaagatggcggcgggaggggcccaggttgctgctctggccgccgagtgaggggcggggggggcccgggggcgcgcggcccgagacccccccggccgccctcctcctttctttgttcctgtggctgggggggtatcccctccctccacaacatggagccatctcctctgtctcccagtggggcagcacttcccctgccgctgtcgctggctccgcccccactacccctgccagcagctgcagtggtacatgtgtccttccctgaggtgaccagtgccctcttggagtccctcaatcagcagcgtctgcagggccagctctgcgatgtatctatcagagtgcagggccgggagttccgggctcatcgggctgtcctggctgcctcctccccttacttccatgatcaggtcctactcaaaggcatgacctccatctcgctgcccagtgtcatggacccaggcgcctttgagactgtcctagcctccgcttacactggccgcctcagcatggctgctgctgacattgtcaacttccttacagtggggtctgtgctccaaatgtggcacattgtggacaagtgcactgaactactccgagaaggccgggcctcagctaccaccaccatcactactgctgcagccacctctgtcactgtccctggtgctggggtgccatccgggagtgggggcactgtggcccctgctaccatgggctctgcgcgctcccatgcctccagccgggccagtgagaatcaatctcccagcagcagcaactacttcagccccagggagtccactgatttctcatcttcctcccaagaggcatttgcagcttctgcagtgggcagtggggagcgtcgaggaggtggccctgtattcccagcccctgtcgttggcagtggaggggccacatctggaaagctgctgctggaggcagatgagctgtgcgatgatggtggggatgggaggggggcagtggttcctggggctgggctccggagacccacctacacaccccctagcatcatgccacagaaacactgggtatacgtgaagcgaggtggtaattgcccagcgccagcacccctggttccccaagacccagatctggaggaggaagaggaggaggaagatctggtgttgacctgtgaggatgatgaagatgaagaactagggggtagctccagggttccagtggggggagggcctgaggctaccctcagcataagtgatgtccgtaccctgagtgagcccccagacaagggggaggagcaggtcaacttctgtgagtcctccaatgactttggcccatatgagggtgggggtcctgtggcaggtcttgatgactcaggggggccaactccctcttcctatgccccctcccaccctcctcgaccgctccttcccttggacatgcagggcaaccagatcctggtcttcccgtcgtcgtcttcatcctcatcctcacaggctcctggccaaccaccagggaaccaagcagaacacggggcagtgaccgtggggggcacgtcggtggggagcctgggtgtgccgggtagcgttggtggggtccctggagggactggcagtggggacgggaataagatctttctgtgccattgtgggaaggccttctcccacaagagcatgcgggaccggcacgtgaacatgcacctcaatctgcggccgtttgactgccccgtgtgcaacaaaaagttcaagatgaagcaccatctgactgagcacatgaagacgcacacaggtctcaagccctacgagtgcggagtctgcgccaagaagttcatgtggcgagacagcttcatgcgccaccgaggacactgtgagcgccggcaccgcctgggcggggtcggggccgtacctgggcctgggactcccacggggccatccttgccgtccaagagagagtctcccggagtgggcgggggcagcggcgacgaagcgagtgcggccacgcccccgtccagcagacgtgtctggtccccacccagagtccacaaggtggagatgggcttcggtggaggtggaggagcaaactgaaggggcaggctactggggtggggtagctttcgggaaagggaataaggagcacgatgcaagggcgctgtggcccccgggtgatctcccaccacacttactgtcttcctttatctctgtggacttgtatatattctggaaggggaaccacagtttcaccatcacccgcccattctactactcaacccctcccccccaaggtatttccagaactaaacccttcctttccctctgatgggtacactgaagcccctgctccacagagtagattgcacatggagggagggagagggggcgtgttgaacatcctgcagtcacagggtcaggggtcaggtggttgtagtctgtgcctgaagtctgtgtttgtgttgtcgtggagacaaggcctttgagccccacccttgtcctagaacctaccccctctcaaggatgcgctctttatttctaccctgtctctccccgccacccccgacttcccgtggaaattcccaactcggttctcatggaggagtgggtggagacaaggagggagtaagtcgtaggagtacaaggtttttattttttttaacagtgattaaaatatttattggtcattta

SEQ ID NO: 8641 - DNA, 2651 bp, Homo sapiens; identical to SEQ ID NO: 8640

SEQ ID NO: 8642 - DNA, 581 bp, Homo sapiens
aataaatgcttcggccgaaccaagtcctgagctcccagcggaggaggggacctgatcttttaagagacccccccggccgccctcctcctttctttgttcctgtggctgggggggtatcccctccctccacaacatggagccatctcctctgtctcccagtggggcagcacttcccctgccgctgtcgctggctccgcccccactacccctgccagcagctgcagtggtacatgtgtccttccctgaggtgaccagtgccctcttggagtccctcaatcagcagcgtctgcagggccagctctgcgatgtatctatcagagtgcagggccgggagttccgggctcatcgggctgtcctggctgcctcctccccttacttccatgatcaggtcctactcaaaggcatgacctccatctcgctgcccagtgtcatggacccaggcgcctttgagactgtcctagcctccgcttacactggccgcctcagcatggctgctgctgacattgtcaacttccttacagtggggtctgtgctccaaatgtggcacattgtggacaagtgcactgaactactccgagaag

SEQ ID NO: 8643 - DNA, 581 bp, Homo sapiens; identical to SEQ ID NO: 8642

SEQ ID NO: 8644 - DNA, 581 bp, Homo sapiens; identical to SEQ ID NO: 8642

SEQ ID NO: 8645 - DNA, 2645 bp, Homo sapiens
gaataaatgcttcggccgaaccaagtcctgagctcccagcggaggaggggacctgatcttttaagagacccccccggccgccctcctcctttctttgttcctgtggctgggggggtatcccctccctccacaacatggagccatctcctctgtctcccagtggggcagcacttcccctgccgctgtcgctggctccgcccccactacccctgccagcagctgcagtggtacatgtgtccttccctgaggtgaccagtgccctcttggagtccctcaatcagcagcgtctgcagggccagctctgcgatgtatctatcagagtgcagggccgggagttccgggctcatcgggctgtcctggctgcctcctccccttacttccatgatcaggtcctactcaaaggcatgacctccatctcgctgcccagtgtcatggacccaggcgcctttgagactgtcctagcctccgcttacactggccgcctcagcatggctgctgctgacattgtcaacttccttacagtggggtctgtgctccaaatgtggcacattgtggacaagtgcactgaactactccgagaaggccgggcctcagctaccaccaccatcactactgctgcagccacctctgtcactgtccctggtgctggggtgccatccgggagtgggggcactgtggcccctgctaccatgggctctgcgcgctcccatgcctccagccgggccagtgagaatcaatctcccagcagcagcaactacttcagccccagggagtccactgatttctcatcttcctcccaagaggcatttgcagcttctgcagtgggcagtggggagcgtcgaggaggtggccctgtattcccagcccctgtcgttggcagtggaggggccacatctggaaagctgctgctggaggcagatgagctgtgcgatgatggtggggatgggaggggggcagtggttcctggggctgggctccggagacccacctacacaccccctagcatcatgccacagaaacactgggtatacgtgaagcgaggtggtaattgcccagcgccagcacccctggttccccaagacccagatctggaggaggaagaggaggaggaagatctggtgttgacctgtgaggatgatgaagatgaagaactagggggtagctccagggttccagtggggggagggcctgaggctaccctcagcataagtgatgtccgtaccctgagtgagcccccagacaagggggaggagcaggtcaacttctgtgagtcctccaatgactttggcccatatgagggtgggggtcctgtggcaggtcttgatgactcaggggggccaactccctcttcctatgccccctcccaccctcctcgaccgctccttcccttggacatgcagggcaaccagatcctggtcttcccgtcgtcgtcttcatcctcatcctcacaggctcctggccaaccaccagggaaccaagcagaacacggggcagtgaccgtggggggcacgtcggtggggagcctgggtgtgccgggtagcgttggtggggtccctggagggactggcagtggggacgggaataagatctttctgtgccattgtgggaaggccttctcccacaagagcatgcgggaccggcacgtgaacatgcacctcaatctgcggccgtttgactgccccgtgtgcaacaaaaagttcaagatgaagcaccatctgactgagcacatgaagacgcacacaggtctcaagccctacgagtgcggagtctgcgccaagaagttcatgtggcgagacagcttcatgcgccaccgaggacactgtgagcgccggcaccgcctgggcggggtcggggccgtacctgggcctgggactcccacggggccatccttgccgtccaagagagagtctcccggagtgggcgggggcagcggcgacgaagcgagtgcggccacgcccccgtccagcagacgtgtctggtccccacccagagtccacaaggtggagatgggcttcggtggaggtggaggagcaaactgaaggggcaggctactggggtggggtagctttcgggaaagggaataaggagcacgatgcaagggcgctgtggcccccgggtgatctcccaccacacttactgtcttcctttatctctgtggacttgtatatattctggaaggggaaccacagtttcaccatcacccgcccattctactactcaacccctcccccccaaggtatttccagaactaaacccttcctttccctctgatgggtacactgaagcccctgctccacagagtagattgcacatggagggagggagagggggcgtgttgaacatcctgcagtcacagggtcaggggtcaggtggttgtagtctgtgcctgaagtctgtgtttgtgttgtcgtggagacaaggcctttgagccccacccttgtcctagaacctaccccctctcaaggatgcgctctttatttctaccctgtctctccccgccacccccgacttcccgtggaaattcccaactcggttctcatggaggagtgggtggagacaaggagggagtaagtcgtaggagtacaaggtttttattttttttaacagtgattaaaatatttattggtcatttacttggcttcccg

SEQ ID NO: 8646 - DNA, 2645 bp, Homo sapiens; identical to SEQ ID NO: 8645

SEQ ID NO: 8647 - DNA, 2645 bp, Homo sapiens
gaataaatgcttcggccgaaccaagtcctgagctcccagcggaggaggggacctgatcttttaagagacccccccggccgccctcctcctttctttgttcctgtggctgggggggtatcccctccctccacaacatggagccatctcctctgtctcccagtggggcagcacttcccctgccgctgtcgctggctccgcccccactacccctgccagcagctgcagtggtacatgtgtccttccctgaggtgaccagtgccctcttggagtccctcaatcagcagcgtctgcagggccagctctgcgatgtatctatcagagtgcagggccgggagttccgggctcatcgggctgtcctggctgcctcctccccttacttccatgatcaggtcctactcaaaggcatgacctccatctcgctgcccagtgtcatggacccaggcgcctttgagactgtcctagcctccgcttacactggccgcctcagcatggctgctgctgacattgtcaacttccttacagtggggtctgtgctccaaatgtggcacattgtggacaagtgcactgaactactccgagaaggccgggcctcagctaccaccaccatcactactgctgcagccacctctgtcactgtccctggtgctggggtgccatccgggagtgggggcactgtggcccctgctaccatgggctctgcgcgctcccatgcctccagccgggccagtgagaatcaatctcccagcagcagcaactacttcagccccagggagtccactgatttctcatcttcctcccaagaggcatttgcagcttctgcagtgggcagtggggagcgtcgaggaggtggccctgtattcccagcccctgtcgttggcagtggaggggccacatctggaaagctgctgctggaggcagatgagctgtgcgatgatggtggggatgggaggggggcagtggttcctggggctgggctccggagacccacctacacaccccctagcatcatgccacagaaacactgggtatacgtgaagcgaggtggtaattgcccagcgccagcacccctggttccccaagacccagatctggaggaggaagaggaggaggaagatctggtgttgacctgtgaggatgatgaagatgaagaactagggggtagctccagggttccagtggggggagggcctgaggctaccctcagcataagtgatgtccgtaccctgagtgagcccccagacaagggggaggagcaggtcaacttctgtgagtcctccaatgactttggcccatatgagggtgggggtcctgtggcaggtcttgatgactcaggggggccaactccctcttcctatgccccctcccaccctcctcgaccgctccttcccttggacatgcagggcaaccagatcctggtcttcccgtcgtcgtcttcatcctcatcctcacaggctcctggccaaccaccagggaaccaagcagaacacggggcagtgaccgtggggggcacgtcggtggggagcctgggtgtgccgggtagcgttggtggggtccctggagggactggcagtggggacgggaataagatctttctgtgccattgtgggaaggccttctcccacaagagcatgcgggaccggcacgtgaacatgcacctcaatctgcggccgtttgactgccccgtgtgcaacaaaaagttcaagatgaagcaccatctgactgagcacatgaagacgcacacaggtctcaagccctacgagtgcggagtctgcgccaagaagttcatgtggcgagacagcttcatgcgccaccgaggacactgtgagcgccggcaccgcctgggcggggtcggggccgtacctgggcctgggactcccacggggccatccttgccgtccaagagagagtctcccggagtgggcgggggcagcggcgacgaagcgagtgcggccacgcccccgtccagcagacgtgtctggtccccacccagagtccacaaggtggagatgggcttcggtggaggtggaggagcaaactgaaggggcaggctactggggtggggtagctttcgggaaagggaataaggagcacgatgcaagggcgctgtggcccccgggtgatctcccaccacacttactgtcttcctttatctctgtggacttgtatatattctggaaggggaaccacagtttcaccatcacccgcccattctactactcaacccctcccccccaaggtatttccagaactaaacccttcctttccctctgatgggtacactgaagcccctgctccacagagtagattgcacatggagggagggagagggggcgtgttgaacatcctgcagtcacagggtcaggggtcaggtggttgtagtctgtgcctgaagtctgtgtttgtgttgtcgtggagacaaggcctttgagccccacccttgtcctagaacctaccccctctcaaggatgcgctctttatttctaccctgtttctccccgccacccccgacttcccgtggaaattcccaactcggttctcatggaggagtgggtggagacaaggagggagtaagtcgtaggagtacaaggtttttattttttttaacagtgattaaaatatttattggtcatttacttggcttcccg

SEQ ID NO: 8648 - DNA, 5211 bp, Homo sapiens
gcctttggcttcagcgcttcgcccccgcgctgtgccctctgtcggcggcgtggggcagctgtagcagcgttggcggcaggaggcggcggccgcgtcgacgtcgacccagactggagcgacgtttaaagaaggggcagaatcgctggggagtgcggcttcttcttgttgggggactcccagccttccgcgcgtccggaggaggagaagcggcggcgccgggaagcaggcatggagagtagaaaactgatttctgctacagacattcagtactctggcagtctgctgaactccttgaatgagcaacgtggccatggactcttctgtgatgttaccgttattgtggaagaccgaaaattccgggctcacaagaatattctttcagcttctagtacctacttccatcagctcttctctgttgctgggcaagttgttgaactgagctttataagagcagagatctttgcagaaattctcaattatatctatagttctaaaattgttcgtgttagatcagatttgcttgatgagttaattaaatcagggcagttattaggagtgaaatttatagcagagcttggtgtcccattgtcacaggttaaaagcatctcaggtacagcgcaggatggtaatactgagcctttacctcctgattctggtgacaagaaccttgtaatacagaaatcaaaagatgaagcccaagataatggggctactataatgcctattataacagagtctttttcattatctgccgaagattatgaaatgaaaaagatcattgttaccgattctgatgatgatgatgatgatgtcattttttgctccgagattctgcccacaaaggagactttgccgagtaataacacagtggcacaggtccaatctaacccaggccctgttgctatttcagatgttgcacctagtgctagcaataactcgccccctttaacaaatatcacacctactcagaaacttcctactcctgtgaatcaggcaactttgagccaaacacaaggaagtgaaaaattgttggtatcttcagctccaacacatctgactcccaatattattttgttaaatcagacaccactttctacaccaccaaatgtcagttcttcacttccaaatcatatgccctcttcaatcaatttacttgtgcagaatcagcagacaccaaacagtgctattttaacaggaaacaaggccaatgaagaggaggaggaggaaataatagatgatgatgatgacactattagctccagtcctgactcggccgtcagtaatacatctttggtcccacaggctgatacctcccaaaataccagttttgatggatcattaatacagaagatgcagattcctacacttcttcaagaaccactttccaattccttaaaaatttcagatataattactagaaatactaatgatccaggcgtaggatcaaaacatctaatggagggtcagaagatcattactttagatacagctactgaaattgaaggcttatcgactggttgcaaggtttatgcaaatatcggtgaagatacttatgatatagtgatccctgtcaaagatgaccctgatgaaggggaggccagacttgagaatgaaataccaaaaacgtctggcagcgagatggcaaacaaacgtatgaaagtaaaacatgatgatcactatgagttaatagtagatggaagggtctattatatctgtattgtatgcaaaaggtcatatgtctgtctgacaagcttgcggagacattttaacattcattcttgggagaagaagtatccgtgccgttactgtgagaaggtatttcctcttgcagaatatcgcacaaagcatgaaattcatcacacaggggagcgaaggtatcagtgtttggcctgtggcaaatctttcatcaactatcagtttatgtcttcacatataaagtcagttcatagtcaagatccttctggggactcaaagctttatcgtttacatccatgcaggtctttacaaatcagacaatatgcatatctttccgatagatcaagcactattcctgcaatgaaggatgatggtattgggtataaggttgacactggaaaagaacctccagtagggaccactacatctactcagaacaagccaatgacctgggaagatatttttattcagcaggaaaatgattcaatttttaaacaaaatgtaacagatggcagtactgagtttgaatttataataccagagtcttactaaactcctttgaaatactagaaagttttgttttggatgatggggcaggggtttcagaagatctgtaaaacaaattaaggtgcgaacaagttaatttgatctgccacattatctgaaggaagtgtagtgggatttttgttgataatttttagaagcaaattttcctgaaagttttgagtagaggtgagaccccctccccaagtatctgtttatatagttagttttcagctcatttaaaagaggcaaaaattaaaagcttggagagatagtttcctgaatagaatttgaagcagtctgaatgttctttgaaaataactggagttattagcataccctagtacatcttacagctttccccttccatgttagcactttactgctgaattctcaattttcttaacattgagacaataaatgtgtgttttgtcttgtatatggcataaagagtaaataagttttagagttgttctggaaaatgtcagaataagtcagtacttgggttgtgtaatctgctagtccaagcgaacagcaacctcctgctaccctccctctatgaaaatagccatgcagacaagtctctcatctgaagaacaaattagatttagctaattagaattaatcctggctttcattgccatagtctgtaaaagactttggtggctagaccactttataccttcgcagtgtggtctctgggggcaaaaaactaatgaaaacaatctctgtaatggcagataggaggagatgaaaagttctgttgcatggatttttaattctctggctaccacatagtagagaatggaatgaagatttccttttggcttcttaaggttaaaaatattcccatgaacatgaaaattttcaaattttgaatctgaaagccaccaaatgtatctttatgtataaatccttgtaaatgatagattccatgggtgagactttacatattttgggtgggaggctactggcatatatttttaaatgttcatattgcgtagaatctccactaggaagtctttatttgaaatagttgaatcagtgatctagtattttcctttcggcaagatttgttaggtttttaccccttctaaaataagttttattccatctgcaaattgctgcaatattatagtaatcagaaactacataaggaatgttatataggcttgtcagttcccatttttcttgacaacaataaataccacttttaaaaatgacacatatttaaacacttagaaaataaagttaacacttactgaagtgctagtactaaactgtgctagtactaaaagaaaacaggttggaacatacatatagcctagcatttataacagaattgttgaacgtctgtaaatgattttttttttttttgcaaaggaaaaaattgatactggaaaagattgttgtgcatagttattagtcatttgtaaccttgcttaagtatttcttagtccaacatagatattttctttctcctgaccatgtattttaaaatatagtctatttcttgactttgaacttaaagctttaatcataatttctcatgtatacatcgttcttctgatggtaagctggatttgaaggtagtggtttcagtgtttcttaagttggtagctgagggtatcaggcatcagttcatgcaataatacaagaaaaaaaatcctttgcttgccaagaggtagagtgatgtgcatttatctgttttctgttctgtaagtctagaccttcaaaccatttgtaaactaacccctgggaaatttgaaattacctgataacttaagactctgtgatctctggaatcaccatatgtttcttttttgtgtagatattaataacattactctttgactatagtgtgcactctgaaatgtactcagtgaaaatttgttttgagtttcattaatgctatttcaccagttagacataattacttctaccgatgtgaatgatacggatgccggcagagcttccagatctttcagactcaactgctaggtcaattagtttgtcataataaaacttggcagattctacaagtctattatgacaaaccaggaactaattctataatggaaaactatccattctgaataataggtatgtaattatttgctgctgctgctgtgctctgtaaattctgaatatgacatttaaactctgtgcctactaaaggtatcttctggagtttttgggaggagagaaactggaaaattaaattgtatttttgccagaagactcttacttgcatgtgtctcagggtcttcagtttttctataagtttccatatccaaagttcagaattcatgtgaaatacttctttggggcaaaagtccttcattcctggtatttattggattggaaatctgtagcaagatgctgtttaaaattaccatattgtttttttatcttatacttagctctctggctattgaacttccttttcttgtttgaagttagcttcaaatttgctcctatgctaaattacctgtaaatattctggataggaactacttgaaatagtaatttgttaaaagatatgacaaaatgaaaatgcttaaactacagaaatttaaaaatgccataacaatcttgcgagactaactttaaaatatactttaaatgattattatgattttggtggtaacgatcccccacacacaaccactatgaagaaataatgccgcatttttcccccattgtaccaaaaagataaaaaaatggtaaacactgatcaaggtattttgtattgtcaaggcatgcatattctaaagaattaaatgctaacttaacagcactggctttctggctggtcaactatatgaaaccttgttcattcctccgagtactgtaatgttcacacttgtacaatcttccctgtcatgactttaagttctacttttcattaaccatggcctgatattagttcttagagcttcttgtggcaaaaataaaatgatttaattctga

SEQ ID NO: 8649 - DNA, 2207 bp, Homo sapiens
gggagaaggaggaggagcagcaggcctccgggcccggcgccgccgcccgcaggacatttctgatttatttgcatccttgaagagcatctgtagaagaggaagtaaaagatgggtgtgaaaacatttactcatagctcctcttcccacagccaggaaatgcttggaaagctaaatatgctgcgaaatgatggacatttttgtgatatcactattcgtgtccaggacaaaatcttccgggcacataaggtggtactagcagcttgcagtgatttctttcgcaccaaacttgtaggccaagccgaggatgagaacaagaatgtgttggatctgcatcatgttacagtgactggctttatacctcttttagaatatgcttacagccactctatcaattaacacagaaaatattattgatgttctagcagcagccagctatatgcaaatgttcagtgttgccagcacctgctcagagttcatgaaatcaagcattttatggaatacacccaacagccaacctgaaaagggtctagatgctggacaagaaaataattctaactgcaattttacttctcgagatgggagcatttctcccgtgtcctcagagtgcagtgtggtagaaagaaccattcctgtctgccgagaatcccggagaaagcgcaaaagctacattgttatgtctcctgaaagtcctgtaaagtgtggcacacaaacaagctcaccccaggtattgaattcttcagcttcctactcagaaaatagaaaccaaccagttgactcttccttagcttttccttggacttttccttttggaattgatcgaaggattcagcctgagaaagttaagcaagcagaaaatacccggactttagaattacctggcccatctgagaccggtagaagaatggctgattatgtgacttgtgagagcacaaaaactaccttgcctttaggtaccgaagaagatgtccggtcaaagtagaaagattaagtgatgaggaggtccatgaggaagtgtcccagcctgtcagtgcatctcagagttcgctgagtgatcagcagacagttccaggaagtgaacaagtccaagaggaccttctgattagtccacagtcttcctctataggctcagtagatgaaggcgtttctgagggcttgcctacacttcaaagcacgtctagcactaatgctcctccggatgatgatgatcggtcagtactaacatagcatttcgttacctcttaagggttgtgtttacaactccaaattcaagcatttcatctcaagagttgtagaagtttattacaacctcacttcagtatacttttcaaagtaatgaagtagcatcatcacattataaattagagtacctatacaaggcttttttttttccccagcatttccaaaactacctagtcccattgctttaaatcgtatctgtaccaagtgttggcaaactatgaaccacaggccaattccagcctaccacctttatttgtaaatcaagtattactggaacacaaccaggctcatttgctgacatattgtttgtggatggcagagttgagtggttgaaacagactgtatggtgtgcaaagtcagaatgtgtgctgtacggactgctgtgaaaaacatctgccaaagtctgatctgtatacccataactccctccctgcttgatatttccacataaatgtataaagggcatttcacatttaacaaggccaagacagaactcttgatttctaactccttgtctgaatcctgcttctccagcctttctcccatttcagtaagcatcatcattatcccctaatttctcaagcaaaatctctgaggattgttcttaatcttttttccttaccactcttcatctccctcgtagttaatccttaagtcctgtcaactctgcctataaaatatatccctgtctacttttctaatctgtactgtagccaccctactctaagtcaccaccatcttttgccttgactactgcaataaccttcaaagtagcctctgattgcattcttcccctaatccattttccatgtagcagccaaaatcatcttttcttttttaattaagtcagattatgtcactgttttaagctatagattcttaacattctttattcatacctaaaatctataggccttgctatgccttctaaagccctacacgatatgacttctgcctaactccgtctc

SEQ ID NO: 8650 - DNA, 2781 bp, Homo sapiens
cggtggctgtgccgccatgccccaccacaggctgctcacgggcctaggcgcggcggcccgagataggggcccctgagcctcccgggggaggagagaggcagcgagccgcgctccgccccctccccccgggccgccgccgccgccgcctcgccgccccagcctggcgggagaaggaggaggagcagcaggcctccgggcccggcgccgccgcccgcaggacatttctgatttatttgcatccttgaagagcatctgtagaagaggaagtaaaagatgggtgtgaaaacatttactcatagctcctcttcccacagccaggaaatgcttggaaagctaaatatgctgcgaaatgatggacatttttgtgatatcactattcgtgtccaggacaaaatcttccgggcacataaggtggtactagcagcttgcagtgatttctttcgcaccaaacttgtaggccaagccgaggatgagaacaagaatgtgttggatctgcatcatgttacagtgactggctttatacctcttttagaatatgcttacacagccactctatcaattaacacagaaaatattattgatgttctagcagcagccagctatatgcaaatgttcagtgttgccagcacctgctcagagttcatgaaatcaagcattttatggaatacacccaacagccaacctgaaaagggtctagatgctggacaagaaaataattctaactgcaattttacttctcgagatgggagcatttctcccgtgtcctcagagtgcagtgtggtagaaagaaccattcctgtctgccgagaatcccggagaaagcgcaaaagctacattgttatgtctcctgaaagtcctgtaaagtgtggcacacaaacaagctcaccccaggtattgaattcttcagcttcctactcagaaaatagaaaccaaccagttgactcttccttagcttttccttggacttttccttttggaattgatcgaaggattcagcctgagaaagttaagcaagcagaaaatacccggactttagaattacctggcccatctgagaccggtagaagaatggctgattatgtgacttgtgagagcacaaaaactaccttgcctttaggtaccgaagaagatgtccgggtcaaagtagaaagattaagtgatgaggaggtccatgaggaagtgtcccagcctgtcagtgcatctcagagttcgctgagtgatcagcagacagttccaggaagtgaacaagtccaagaggaccttctgattagtccacagtcttcctctataggctcagtagatgaaggcgtttctgagggcttgcctacacttcaaagcacgtctagcactaatgctcctccggatgatgatgatcgattggaaaatgttcagtatccctaccaactctacattgctccttccaccagcagtacagagcgaccaagtccaaatggtcccgacagaccttttcagtgtccaacctgcggggtgcgattcacccgtattcagaacctaaagcagcacatgctcatccactcaggaattaaaccatttcagtgtgaccgctgtgggaaaaagttcaccagggcttactcgctaaagatgcatcgcctaaagcatgaaggtaaacgctgtttccggtgccagatatgtagtgccactttcacttccttcggggaatataaacaccacatgagggtttcccggcacattatccgcaagcctcggatttacgagtgcaaaacatgtggcgccatgttcaccaactctggaaatttaatcgtgcacctgaggagtctgaaccatgaagcatcagagctagcaaactacttccagagcagtgatttcctagtaccggactacttaaaccaggaacaagaagagacccttgttcaatatgatcttggagaacacggttttgaaagcaactcctctgttcaaatgcctgtcatttcacagtaccactccaaaggcaaggaaccatgattgacaacagtcaagctgtggatgaaatgaccaggaacggagaatgaattccaagaggtggtttttgaaagagcaagaggaaagaaaaaagaaaagaaggaaagaagaataaagaagagaaacgtgtaagaatggtttgcagattgattggttaaaagtgtttttagcacatccccaaccctgaaaacttcgcattaagagccaagcacaatgttggtagctccaagatattctgactgtgttctcagaatgagggattacccatcactgggtattccttcccaagtagaaactttagattttcactggtaatacacattgccaagttttatgggaaatctgaatatactgtgaaaatgcatatctggttagttgtctgctgcccagatcttatcaataccagtaactaaccagtatttaacataaaatgatacaaataaaggcctttttctatttcagtgagggtacatttttcttgatatatatgtactttaaggatattggatctgtttatggatctgttttaggaaacagatttgcaagggataattgtatatatagtagtatttaggtttatttcaaattcatcttagggatgcctagatgcataatttttaccaggacatattgaaaatattgcaaagagatagccagttatattatcccattcattagaaattaccagtgtaactaaacataaatattccagtttagagtgcttaaacgtagctatctttcttaaggccaggagggtaactttgtggtatctaaagggcttaaatttcagaatgcaga

SEQ ID NO: 8651 - DNA, 3951 bp, Homo sapiens
cactcccactcgcgggcacgccggtggctgtgccgccatgccccaccacaggctgctcacgggcctaggcgcggcggcccgagataggggcccctgagcctcccgggggaggagagaggcagcgagccgcgctccgccccctccccccgggccgccgccgccgccgcctcgccgccccagcctggcgggagaaggaggaggagcagcaggcctccgggcccggcgccgccgcccgcaggacatttctgatttatttgcatccttgaagagcatctgtagaagaggaagtaaaagatgggtgtgaaaacatttactcatagctcctcttcccacagccaggaaatgcttggaaagctaaatatgctgcgaaatgatggacatttttgtgatatcactattcgtgtccaggacaaaatcttccgggcacataaggtggtactagcagcttgcagtgatttctttcgcaccaaacttgtaggccaagccgaggatgagaacaagaatgtgttggatctgcatcatgttacagtgactggctttatacctcttttagaatatgcttacacagccactctatcaattaacacagaaaatattattgatgttctagcagcagccagctatatgcaaatgttcagtgttgccagcacctgctcagagttcatgaaatcaagcattttatggaatacacccaacagccaacctgaaaagggtctagatgctggacaagaaaataattctaactgcaattttacttctcgagatgggagcatttctcccgtgtcctcagagtgcagtgtggtagaaagaaccattcctgtctgccgagaatcccggagaaagcgcaaaagctacattgttatgtctcctgaaagtcctgtaaagtgtggcacacaaacaagctcaccccaggtattgaattcttcagcttcctactcagaaaatagaaaccaaccagttgactcttccttagcttttccttggacttttccttttggaattgatcgaaggattcagcctgagaaagttaagcaagcagaaaatacccggactttagaattacctggcccatctgagaccggtagaagaatggctgattatgtgacttgtgagagcacaaaaactaccttgcctttaggtaccgaagaagatgtccgggtcaaagtagaaagattaagtgatgaggaggtccatgaggaagtgtcccagcctgtcagtgcatctcagagttcgctgagtgatcagcagacagttccaggaagtgaacaagtccaagaggaccttctgattagtccacagtcttcctctataggctcagtagatgaaggcgtttctgagggcttgcctacacttcaaagcacgtctagcactaatgctcctccggatgatgatgatcgattggaaaatgttcagtatccctaccaactctacattgctccttccaccagcagtacagagcgaccaagtccaaatggtcccgacagaccttttcagtgtccaacctgcggggtgcgattcacccgtattcagaacctaaagcagcacatgctcatccactcaggaattaaaccatttcagtgtgaccgctgtgggaaaaagttcaccagggcttactcgctaaagatgcatcgcctaaagcatgaaggtaaacgctgtttccggtgccagatatgtagtgccactttcacttccttcggggaatataaacaccacatgagggtttcccggcacattatccgcaagcctcggatttacgagtgcaaaacatgtggcgccatgttcaccaactctggaaatttaatcgtgcacctgaggagtctgaaccatgaagcatcagagctagcaaactacttccagagcagtgatttcctagtaccggactacttaaaccaggaacaagaagagacccttgttcaatatgatcttggagaacacggttttgaaagcaactcctctgttcaaatgcctgtcatttcacagtaccactccaaaggcaaggaaccatgattgacaacagtcaagctgtggatgaaatgaccaggaacggagaatgaattccaagaggtggtttttgaaagagcaagaggaaagaaaaaagaaaagaaggaaagaagaataaagaagagaaacgttcatctgcaaagtatgaagctgtaattctgaaatacacatccaagtgaatgagaattaaaaattttctaaatattaatactaactgggaaaaaaaaactagtgtgaagtttacagttagaagaaacagacccaaagttgccagaaggtacctgaaatgagtgacatcaggtatttggaaggagtaagatcataaactgtattcattttcttccttgtacaaagtgatgacttctaatgcttatatctcaaggtattttttaaaaaagcaacggtccctaatagagtaaaatttggttttggtccaagttcccaataatgtatttaatgtttctgttgtttactggtgcctcccgttgcatcaggtagagattgcctgcctctttgtagggcagccttgtggcaccttatgtccaacttggaggatagtatatggcttctttgtgcctctactatcttttcaaaagccattttataaaaatcctaggtagcctattttaatatttaaatatatatatttgtgaaagaacttttagaacagaccttttctttttactttaaaattcctgtatttccatttttaagagtaaatttaatctccaggatttagaagtgtctttccagagaagcataatgagaaagtcagactgaggtaataagaccagaattaagtgatagaagaaactgttgtttggttaaaggacacagatttgaaggaaaaaaattttgatgtaacaattttttaaataaaattttgtttttctgtaatgtcatatttgctgctacagtagctcaatattttacagggctaacataaagctggctccatttaaaaactggagtacttcctagtgcagccagcctaggcggaaactgtacaccatggtcttccagatgggtgactgatggctttgggtagctgatgcatgctttaatatttgcctatagcccggcagcaaggaagtcggggcggggggacttttttaccctgccagttatagcattgtgattctttctgggcactggcattttgtgaaactctcaagggaaggtgatgcaggggagaaaatgtgaattaaattacatagatgggtgtttttatgtcttctacccctttcctagaattagtacaactcttaactgtgccagtccccagttcaccagctttgtatccagtcgtcatctcattcaagtatggctttacttggtgacactggccatagctaagttaacttggcatgtttgacttttgacaataacaaaaatggttttggattttgttttatttccaaaaaatgtatacaatatcagaacttcacattttatatactagtatctggctattagtattttacaggaaccatagttcttggtgactacatatatatatatatttttgtgaccttttttgtaaactaagtgccgtttcaacgttacaatcatttttagggttattgtaatcaatgtgaatatcatgttttttcaaatctgttctgagcctatagtgtttgctttgtgaacatgtgtattgtatatattctgtatagttatattgtactgaaattagcttgtttgatataaggaaaatatgtattgagtacctttttgctagcctgattgtttaatctttttaaaaaaggtttaaactttttttaaaaaaaaaatctttaaactggcctttattacatggtcacacataaagttgcagttaggaaagggatgggcagggaaaaactagttttgagtgtctttagatagaaacatgagactaaggtttgattttgttttcgttttctcattaaaatatcttatgctttatgg

SEQ ID NO: 8652 - DNA, 3841 bp, Homo sapiens
cactcccactcgcgggcacgccggtggctgtgccgccatgccccaccacaggctgctcacgggcctaggcgcggcggcccgagataggggcccctgagcctcccgggggaggagagaggcagcgagccgcgctccgccccctccccccgggccgccgccgccgccgcctcgccgccccagcctggcgggagaaggaggaggagcagcaggcctccgggcccggcgccgccgcccgcaggacatttctgatttatttgcatccttgaagagcatctgtagaagaggaagtaaaagatgggtgtgaaaacatttactcatagctcctcttcccacagccaggaaatgcttggaaagctaaatatgctgcgaaatgatggacatttttgtgatatcactattcgtgtccaggacaaaatcttccgggcacataaggtggtactagcagcttgcagtgatttctttcgcaccaaacttgtaggccaagccgaggatgagaacaagaatgtgttggatctgcatcatgttacagtgactggctttatacctcttttagaatatgcttacacagccactctatcaattaacacagaaaatattattgatgttctagcagcagccagctatatgcaaatgttcagtgttgccagcacctgctcagagttcatgaaatcaagcattttatggaatacacccaacagccaacctgaaaagggtctagatgctggacaagaaaataattctaactgcaattttacttctcgagatgggagcatttctcccgtgtcctcagagtgcagtgtggtagaaagaaccattcctgtctgccgagaatcccggagaaagcgcaaaagctacattgttatgtctcctgaaagtcctgtaaagtgtggcacacaaacaagctcaccccaggtattgaattcttcagcttcctactcagaaaatagaaaccaaccagttgactcttccttagcttttccttggacttttccttttggaattgatcgaaggattcagcctgagaaagttaagcaagcagaaaatacccggactttagaattacctggcccatctgagaccggtagaagaatggctgattatgtgacttgtgagagcacaaaaactaccttgcctttaggtaccgaagaagatgtccgggtcaaagtagaaagattaagtgatgaggaggtccatgaggaagtgtcccagcctgtcagtgcatctcagagttcgctgagtgatcagcagacagttccaggaagtgaacaagtccaagaggaccttctgattagtccacagtcttcctctataggctcagtagatgaaggcgtttctgagggcttgcctacacttcaaagcacgtctagcactaatgctcctccggatgatgatgatcgattggaaaatgttcagtatccctaccaactctacattgctccttccaccagcagtacagagcgaccaagtccaaatggtcccgacagaccttttcagtgtccaacctgcggggtgcgattcacccgtattcagaacctaaagcagcacatgctcatccactcaggaattaaaccatttcagtgtgaccgctgtgggaaaaagttcaccagggcttactcgctaaagatgcatcgcctaaagcatgaagggcatcccaggaaatcagcttctagatctagctctgccactaactgctgttgattaaacctgtcactttacacatgaaaaagcttgaaacttagagaaagataaaattgatttcctagtaccggactacttaaaccaggaacaagaagagacccttgttcaatatgatcttggagaacacggttttgaaagcaactcctctgttcaaatgcctgtcatttcacagtaccactccaaaggcaaggaaccatgattgacaacagtcaagctgtggatgaaatgaccaggaacggagaatgaattccaagaggtggtttttgaaagagcaagaggaaagaaaaaagaaaagaaggaaagaagaataaagaagagaaacgttcatctgcaaagtatgaagctgtaattctgaaatacacatccaagtgaatgagaattaaaaattttctaaatattaatactaactgggaaaaaaaaactagtgtgaagtttacagttagaagaaacagacccaaagttgccagaaggtacctgaaatgagtgacatcaggtatttggaaggagtaagatcataaactgtattcattttcttccttgtacaaagtgatgacttctaatgcttatatctcaaggtattttttaaaaaagcaacggtccctaatagagtaaaatttggttttggtccaagttcccaataatgtatttaatgtttctgttgtttactggtgcctcccgttgcatcaggtagagattgcctgcctctttgtagggcagccttgtggcaccttatgtccaacttggaggatagtatatggcttctttgtgcctctactatcttttcaaaagccattttataaaaatcctaggtagcctattttaatatttaaatatatatatttgtgaaagaacttttagaacagaccttttctttttactttaaaattcctgtatttccatttttaagagtaaatttaatctccaggatttagaagtgtctttccagagaagcataatgagaaagtcagactgaggtaataagaccagaattaagtgatagaagaaactgttgtttggttaaaggacacagatttgaaggaaaaaaattttgatgtaacaattttttaaataaaattttgtttttctgtaatgtcatatttgctgctacagtagctcaatattttacagggctaacataaagctggctccatttaaaaactggagtacttcctagtgcagccagcctaggcggaaactgtacaccatggtcttccagatgggtgactgatggctttgggtagctgatgcatgctttaatatttgcctatagcccggcagcaaggaagtcggggcggggggacttttttaccctgccagttatagcattgtgattctttctgggcactggcattttgtgaaactctcaagggaaggtgatgcaggggagaaaatgtgaattaaattacatagatgggtgtttttatgtcttctacccctttcctagaattagtacaactcttaactgtgccagtccccagttcaccagctttgtatccagtcgtcatctcattcaagtatggctttacttggtgacactggccatagctaagttaacttggcatgtttgacttttgacaataacaaaaatggttttggattttgttttatttccaaaaaatgtatacaatatcagaacttcacattttatatactagtatctggctattagtattttacaggaaccatagttcttggtgactacatatatatatatatttttgtgaccttttttgtaaactaagtgccgtttcaacgttacaatcatttttagggttattgtaatcaatgtgaatatcatgttttttcaaatctgttctgagcctatagtgtttgctttgtgaacatgtgtattgtatatattctgtatagttatattgtactgaaattagcttgtttgatataaggaaaatatgtattgagtacctttttgctagcctgattgtttaatctttttaaaaaaggtttaaactttttttaaaaaaaaaatctttaaactggcctttattacatggtcacacataaagttgcagttaggaaagggatgggcagggaaaaactagttttgagtgtctttagatagaaacatgagactaaggtttgattttgttttcgttttctcattaaaatatcttatgctttatgg

SEQ ID NO: 8653 - DNA, 9315 bp, Homo sapiens
cggctcccgggccccctcgctcctcccctctggcccctccgagcgctgggggtgcttccctccccgcctcctcgcactcccactcgcgggcacgccggtggctgtgccgccatgccccaccacaggctgctcacgggcctaggcgcggcggcccgagataggggcccctgagcctcccgggggaggagagaggcagcgagccgcgctccgccccctccccccgggccgccgccgccgccgcctcgccgccccagcctggcgggagaaggaggaggagcagcaggcctccgggcccggcgccgccgcccgcaggacatttctgatttatttgcatccttgaagagcatctgtagaagaggaagtaaaagatgggtgtgaaaacatttactcatagctcctcttcccacagccaggaaatgcttggaaagctaaatatgctgcgaaatgatggacatttttgtgatatcactattcgtgtccaggacaaaatcttccgggcacataaggtggtactagcagcttgcagtgatttctttcgcaccaaacttgtaggccaagccgaggatgagaacaagaatgtgttggatctgcatcatgttacagtgactggctttatacctcttttagaatatgcttacacagccactctatcaattaacacagaaaatattattgatgttctagcagcagccagctatatgcaaatgttcagtgttgccagcacctgctcagagttcatgaaatcaagcattttatggaatacacccaacagccaacctgaaaagggtctagatgctggacaagaaaataattctaactgcaattttacttctcgagatgggagcatttctcccgtgtcctcagagtgcagtgtggtagaaagaaccattcctgtctgccgagaatcccggagaaagcgcaaaagctacattgttatgtctcctgaaagtcctgtaaagtgtggcacacaaacaagctcaccccaggtattgaattcttcagcttcctactcagaaaatagaaaccaaccagttgactcttccttagcttttccttggacttttccttttggaattgatcgaaggattcagcctgagaaagttaagcaagcagaaaatacccggactttagaattacctggcccatctgagaccggtagaagaatggctgattatgtgacttgtgagagcacaaaaactaccttgcctttaggtaccgaagaagatgtccgggtcaaagtagaaagattaagtgatgaggaggtccatgaggaagtgtcccagcctgtcagtgcatctcagagttcgctgagtgatcagcagacagttccaggaagtgaacaagtccaagaggaccttctgattagtccacagtcttcctctataggctcagtagatgaaggcgtttctgagggcttgcctacacttcaaagcacgtctagcactaatgctcctccggatgatgatgatcgattggaaaatgttcagtatccctaccaactctacattgctccttccaccagcagtacagagcgaccaagtccaaatggtcccgacagaccttttcagtgtccaacctgcggggtgcgattcacccgtattcagaacctaaagcagcacatgctcatccactcaggaattaaaccatttcagtgtgaccgctgtgggaaaaagttcaccagggcttactcgctaaagatgcatcgcctaaagcatgaagtgatttcctagtaccggactacttaaaccaggaacaagaagagacccttgttcaatatgatcttggagaacacggttttgaaagcaactcctctgttcaaatgcctgtcatttcacaggtctcctcaacccagaattgtgaaagcacttttcccttggggtctcttggtgggctggcagaaaaagaggaagaagtgccagagcagccaaagagcagtgcttgtgctgaggcaaccagagatgaccccccaaaatcagagctgtcttctataactattgagtagttttgtgatttggcttcagttttgttttttggaaagtgcctgtgcttggtcttgtacatttaaatttaatttaattttttaaacaaaaaaagccgggtgggagggagggggagattgggaaagaatttccctttttactttctgagccctgaaactgattttatttttcctaactgagagattgcttctgtaagtacacaataacatgatgttgaaacagaaactatgagacttaaggagaactggttgacttaaaacatataccagttccttcttccattgttaaaagtaggctaacaacagatcattagctagagaggaaatcagatgattattgaccttcttgagacaagagggtacatgagaaactaattactaaacagcttgacaaatggcctgagtagatacttactgctgtacacaggatgttgtataatattttgtaaagcctgttgtttttggaagtatttatggtaagctttcttaaaaattattatggtaaatacttctgaaatccggcgtacttttctttaagctttgtcatttctgttatgatttttcatggtgaaattttggtactgagatgggcattctctgtacctttatagtaccactccaaaggcaaggaaccatgattgacaacagtcaagctgtggatgaaatgaccaggaacggagaatgaagtatgtaaatcccagcttcataggaactcttctcatactgcttttcagattaaaattgctgtttacctggtctccgaatgtaatgcctgactgtgtcattgcccggatcagttttccccctgccccatcaatatgttctcttgcatatattggcgtgctgccatataaagtaaaaatactggagatattctatattttatatataggtttatgtgttgttggggatgttttcattgtgctcttttggacataataaataattctctattgaggctacattctttttttttttctttttttttaaaagaatggcatctcactctgttgcccaggctggagtatagtggctaagtcatagctcactgcagcttcgaactcctgggctcaggccattctcctgcctcagcctcttgagtatctaggattataggcatgctccaccacacctggttaacttcatttttattttttgtagagatgaggtctcactatggtgcccaggctggtcttgaactcctagaccaagtgatcctcctcctttggcctcccagactgctgggatcactgcaccggccaaggctgcattcttaacccaactagattgtttactgaatcccatatgacagcgatacattgtccttacatatttatttttagacattgcaaagttattaaaaacagttaactatagtttttacacaacgtaggcaacaatgaagagtatagactgtaagattttcatctatgactcataaatctgggagaaaaaaattattaagactaatgagaaactgaaaaccttaaactaatgaatattatttctgctgctaaaaatatgaaactttctggtctgtagttgaaatttgtatgatcctctagacttgggtatacttttcatctggtgccattaaagcatctctaatattgatcctaaatatttgtaagtccatgagcagtgaactttggaataagtttctgtgtagatacccaaagtttaataattatgagagcacctgatttgatagacagaaaatacagttctttagtcaaaacacaagatctgaattttgttcaggtgctagaccatactaaatgtatatatttttaattatagtgatttgtttcatttttttagattggctaattctgtaattttttccccaaaaacatgtgaagaaaggaaaagtaaattaaattccttagaactgttttaggttaagattctctgtgtctgcccatattctgcagtccttaacttgttttcaactctttacctcactcatgaacttgtttttacccatttgctgccaaacataggtgtgttcccttcaggagaatcagcatatacaggttatgataggctcccaccatttatgcttcttcactgatagggttgcattactttctgcagcagactataatacttcatatagtactgctgtgtctcaactggaaaggtcaggaattttaatgttacgttgtggtctttgaaaactgttaggcctagcaatagataaatctcaaaattaattttaaaatctgtattgacaagaataggtaaaattatgaccaggaatcattgttacccttagttccaagaggtggtttttgaaagagcaagaggaaagaaaaaagaaaagaaggaaagaagaataaagaagagaaacgtgtaagaatggtttgcagattgattggttaaaagtgtttttagcacatccccaaccctgaaaacttcgcattaagagccaagcacaatgttggtagctccaagatattctgactgtgttctcagaatgagggattacccatcactgggtattccttcccaagtagaaactttagattttcactggtaatacacattgccaagttttatgggaaatctgaatatactgtgaaaatgcatatctggttagttgtctgctgcccagatcttatcaataccagtaactaaccagtatttaacataaaatgatacaaataaaggcctttttctatttcagtgagggtacatttttcttgatatatatgtactttaaggatattggatctgtttatggatctgttttaggaaacagatttgcaagggataattgtatatatagtagtatttaggtttatttcaaattcatcttagggatgcctagatgcataatttttaccaggacatattgaaaatattgcaaagagatagccagttatattatcccattcattagaaattaccagtgtaactaaacataaatattccagtttagagtgcttaaacgtagctatctttcttaaggccaggagggtaactttgtggtatctaaagggcttaaatttcagaatgcagaataaattgcctttttaaaaccaagcattttgtacaagcttttattttcagttttttaactaccaaataggtgtgatgtactttagaagtaaacaaagatgttcacccatgataatggatgttaaagctcctgcagttgttcttttcgtgtttaaagggtatattctaatagtggaagcatcaaacatgtcagtgatttcatctcattcagaaataaagagattaatattggtctttattttttggcattttaagttttatataaatggatgcagatggagattatcacccacaaatatatttaaatggatttttcttaatttgaatttcaagtaatctttttatttcaagtaattagttacgcatttagttacattgccagttttttttttttatcaatttcagtaagacaaaatatactaaaatgtttaaatagcctcattcaatcttacattttgacatttcagcaatcattctggcttacagtaattagatcccctgttacgacacatgccctttgttcttaataactagcaaaaaaaaaaaaaaaaaaaaactttcatcttgttaaaatactttgccaaatgaaatagactagtcaatacatctgatgtccataattattggtaactcagttaccttctaactaataggctggttcaggagactctcccagtttataaatggttctcttgggagcctttggaagctgtattaaatctttcagtcttttatttctaattttttctcttaatctaaatagaggccagttatctattttatcagcttttattcttgaagattctcagattatgttttagtcccttttagctttaatagtccttgaaaaatacattactgtataatgtggcaattctgtaacagagacttattacttgaatgaataatcctaaaattttaatattttagctgaagtttgagatttgtggaatgaacaaaagaattagaaactttcatatgttactttgtttcagtcatctgcaaagtatgaagctgtaattctgaaatacacatccaagtgaatgagaattaaaaattttctaaatattaatactaactgggaaaaaaaaactagtgtgaagtttacagttagaagaaacagacccaaagttgccagaaggtaataaataaatgtagttttcactgtaagtaagttattgacgtaagatgctttatttgtaatatatttagattttgaaagttattgagagatgaatgtataaaagctaaattttcttttctgaagcagtgaaacaaaattggggtaacaaggaagctctgttgtggcaaacatgtctatgaggaatattaaaactaagcatactcccacaggctttaaactcaaactatgaacatttaaattaagttgttccttattttgcctatacccatttttatctttcattgtcgtttttgcttgacagtatggtgacagagtatttttatttggaaagtcctcagcaagatgaattagccaaaagcaataatggttcagattaaacaataaagtggaattgattcaatcccaggctcaactaagaacagtcgctctctggatgtttcattttagacgatagataagttgagatgttgtaatatttatggggggttaagcctgtgtcagttatgggatgaagacttgtagtaccagtaccatcagtggtcatacttttttttaactttttactaaactaatacagttagacatttccactctatcgtgattatatttttatgatgggaaaataaaaacacttccatgtttttataaatagtctctgcaaagatttcagatgttattggtatctcggtttggcagtatctgaaaaattgagattgtctttgaaatgtttgtgctacttttacttaagtaaacccccactgtgcaagacccaggccggcttcagctaataccaaggtttctgtgtgcataatagtttacagagaacttaagagtaaggactgcggattaaaaacaaaactttttttaactttaaaatttttagtttttgttcaaagtacctggtttataaagtcaaattcttttattagttcctttctcgtttaaattgactgatgttgctgatgaagcttaaagtcccaggcacggttgtggcgatatactgataaaattggtgcctagtggtgggaggagctccagtgtcaggacttttattaaaaggcccttgttttcccaaatgccaatctagccacatttagatttcattattcaataaaacagatgaaaaatcatcccataaatgaatgttgaggttaccaaagtacatcacctgctgaggaaggataaatcttcctgctttaagggagccctgtcatctctcctcttaatgcacgtttcccttggtattagtggaagctgtgttcaagatgggaagcctttcctgcagttcttagaaacacctgctttctaaggagagccttttctaggattagcttatgtgtgttttctctaggcgattttttatttcagttaccaatttaattttcaagttgacagatgctgtgtaaagtctctcataatgagagtagtccattaaattgttgaaagttgcactgcttttcatctttcaggtacctgaaatgagtgacatcaggtatttggaaggagtaagatcataaactgtattcattttcttccttgtacaaagtgatgacttctaatgcttatatctcaaggtattttttaaaaaagcaacggtccctaatagagtaaaatttggttttggtccaagttcccaataatgtatttaatgtttctgttgtttactggtgcctcccgttgcatcaggtagagattgcctgcctctttgtagggcagccttgtggcaccttatgtccaacttggaggatagtatatggcttctttgtgcctctactatcttttcaaaagccattttataaaaatcctaggtagcctattttaatatttaaatatatatatttgtgaaagaacttttagaacagaccttttctttttactttaaaattcctgtatttccatttttaagagtaaatttaatctccaggatttagaagtgtctttccagagaagcataatgagaaagtcagactgaggtaataagaccagaattaagtgatagaagaaactgttgtttggttaaaggacacagatttgaaggaaaaaaattttgatgtaacaattttttaaataaaattttgtttttctgtaatgtcatatttgctgctacagtagctcaatattttacagggctaacataaagctggctccatttaaaaactggagtacttcctagtgcagccagcctaggcggaaactgtacaccatggtcttccagatgggtgactgatggctttgggtagctgatgcatgctttaatatttgcctatagcccggcagcaaggaagtcggggcggggggacttttttaccctgccagttatagcattgtgattctttctgggcactggcattttgtgaaactctcaagggaaggtgatgcaggggagaaaatgtgaattaaattacatagatgggtgtttttatgtcttctacccctttcctagaattagtacaactcttaactgtgccagtccccagttcaccagctttgtatccagtcgtcatctcattcaagtatggctttacttggtgacactggccatagctaagttaacttggcatgtttgacttttgacaataacaaaaatggttttggattttgttttatttccaaaaaatgtatacaatatcagaacttcacattttatatactagtatctggctattagtattttacaggaaccatagttcttggtgactacatatatatatatatttttgtgaccttttttgtaaactaagtgccgtttcaacgttacaatcatttttagggttattgtaatcaatgtgaatatcatgttttttcaaatctgttctgagcctatagtgtttgctttgtgaacatgtgtattgtatatattctgtatagttatattgtactgaaattagcttgtttgatataaggaaaatatgtattgagtacctttttgctagcctgattgtttaatctttttaaaaaaggtttaaactttttttaaaaaaaaaatctttaaactggcctttattacatggtcacacataaagttgcagttaggaaagggatgggcagggaaaaactagttttgagtgtctttagatagaaacatgagactaaggtttgattttgttttcgttttctcattaaaatatcttatgctttatggaataaa

SEQ ID NO: 8654 - DNA, 2179 bp, Homo sapiens
gaagaggaagtaaaagatgggtgtgaaaacatttactcatagctcctcttcccacagccaggaaatgcttggaaagctaaatatgctgcgaaatgatggacatttttgtgatatcactattcgtgtccaggacaaaatcttccgggcacataaggtggtactagcagcttgcagtgatttctttcgcaccaaacttgtaggccaagccgaggatgagaacaagaatgtgttggatctgcatcatgttacagtgactggctttatacctcttttagaatatgcttacacagccactctatcaattaacacagaaaatattattgatgttctagcagcagccagctatatgcaaatgttcagtgttgccagcacctgctcagagttcatgaaatcaagcattttatggaatacacccaacagccaacctgaaaagggtctagatgctggacaagaaaataattctaactgcaattttacttctcgagatgggagcatttctcccgtgtcctcagagtgcagtgtggtagaaagaaccattcctgtctgccgagaatcccggagaaagcgcaaaagctacattgttatgtctcctgaaagtcctgtaaagtgtggcacacaaacaagctcaccccaggtattgaattcttcagcttcctactcagaaaatagaaaccaaccagttgactcttccttagcttttccttggacttttccttttggaattgatcgaaggattcagcctgagaaagttaagcaagcagaaaatacccggactttagaattacctggcccatctgagaccggtagaagaatggctgattatgtgacttgtgagagcacaaaaactaccttgcctttaggtaccgaagaagatgtccgggtcaaagtagaaagattaagtgatgaggaggtccatgaggaagtgtcccagcctgtcagtgcatctcagagttcgctgagtgatcagcagacagttccaggaagtgaacaagtccaagaggaccttctgattagtccacagtcttcctctataggctcagtagatgaaggcgtttctgagggcttgcctacacttcaaagcacgtctagcactaatgctcctccggatgatgatgatcgattggaaaatgttcagtatccctaccaactctacattgctccttccaccagcagtacagagcgaccaagtccaaatggtcccgacagaccttttcagtgtccaacctgcggggtgcgattcacccgtattcagaacctaaagcagcacatgctcatccactcaggaattaaaccatttcagtgtgaccgctgtgggaaaaagttcaccagggcttactcgctaaagatgcatcgcctaaagcatgaagtaccactccaaaggcaaggaaccatgattgacaacagtcaagctgtggatgaaatgaccaggaacggagaatgaattccaagaggtggtttttgaaagagcaagaggaaagaaaaaagaaaagaaggaaagaagaataaagaagagaaacgtgtaagaatggtttgcagattgattggttaaaagtgtttttagcacatccccaaccctgaaaacttcgcattaagagccaagcacaatgttggtagctccaagatattctgactgtgttctcagaatgagggattacccatcactgggtattccttcccaagtagaaactttagattttcactggtaatacacattgccaagttttatgggaaatctgaatatactgtgaaaatgcatatctggttagttgtctgctgcccagatcttatcaataccagtaactaaccagtatttaacataaaatgatacaaataaaggcctttttctatttcagtgagggtacatttttcttgatatatatgtactttaaggatattggatctgtttatggatctgttttaggaaacagatttgcaagggataattgtatatatagtagtatttaggtttatttcaaattcatcttagggatgcctagatgcataatttttaccaggacatattgaaaatattgcaaagagatagccagttatattatcccattcattagaaattaccagtgtaactaaacataaatattccagtttagagtgcttaaacgtagctatctttcttaaggccaggagggtaactttgtggtatctaaagggcttaaatttc

SEQ ID NO: 8655 - DNA, 312 bp, Homo sapiens
atgaagggcggaagtagagtgtctaatcctgcagtcatggcgcaggaagaggaagatgttagagattacaatttgactgaagaacagaaggcgatcaaggccaagtatccgccagtcaataggaagtacgagtatcaccagacccatcttctacaatctccacataggatctattctcatcttcactcaagtgccatctggaatccttatctccatctgatggggacataagatgttgttcagcttccaagtcaatggggaggctgtctatgccaaattctgcaagacactcattacacagtctgtagcgcc

SEQ ID NO: 8656 - DNA, 509 bp, Homo sapiens
gggcggaagtagagtgtctaatcctgcagtcatggcgcaggaagaggaagatgttagagattacaatttgactgaagaacagaaggcgatcaaggccaagtatccgccagtcaataggaagtacgagtatttggatcatacagcagatgtccagttacacgcatggggagatactctggaggaagcatttgagcaatgtgcaatggccatgtttggttacatgacagatactgggacagtggagcccctccaaacagtagaagtagaaacccaaggagatgacttacagtctcttctgtttcactttttggatgaatggctttataagttcagtgctgatgaattcttcataccccgggtggggagaagaattttcattgtccaagcaccctcagggaacagaagtcaaagcaataacatattcagcaatgcaggtctataatgaagagaacccggaagtttttgtgatcattgacatttaagacaccaaaaaataaaagactcctacg

SEQ ID NO: 8657 - DNA, 514 bp, Homo sapiens
gggcggaagtagagtgtctaatcctgcagtcatggcgcaggaagaggaagatgttagagattacaatttgactgaagaacagaaggcgatcaaggccaagtatccgccagtcaataggaagtacgagtatttggatcatacagcagatgtccagttacacgcatggggagatactctggaggaagcatttgagcaatgtgcaatggccatgtttggttacatgacagatactgggacagtggagcccctccaaacagtagaagtagaaacccaaggagatgacttacagtctcttctgtttcactttttggatgaatggctttataagttcagtgctgatgaattcttcataccccgggtggggagaagaattttcattgtccaagcaccctcagggaacagaagtcaaagcaataacatattcagcaatgcaggtctataatgaagagaacccggaagtttttgtgatcattgacatttaagacaccaaaaaataaaagactcctacgaagaa

SEQ ID NO: 8658 - DNA, 1601 bp, Homo sapiens
ccgggccgaagtccggtggatgaagggcggaagtagagtgtctaatcctgcagtcatggcgcaggaagaggaagatgttagagattacaatttgactgaagaacagaaggcgatcaaggccaagtatccgccagtcaataggaagtacgagtatttggatcatacagcagatgtccagttacacgcatggggagatactctggaggaagcatttgagcaatgtgcaatggccatgtttggttacatgacagatactgggacagtggagcccctccaaacagtagaagtagaaacccaaggagatgacttacagtctcttctgtttcactttttggatgaatggctttataagttcagtgctgatgaattcttcataccccgggaagtgaaagtacttagcattgatcaaagaaatttcaaattacgatcaattgggtggggagaagaattttcattgtccaagcaccctcagggaacagaagtcaaagcaataacatattcagcaatgcaggtctataatgaagagaacccggaagtttttgtgatcattgacatttaagacaccaaaaaataaaagactcctacgaagaactgtttttgttttcctcttccttttgagaagacactatgaattaaattctacagcttttttttgatatatggaaatttgtagaacagaaatattttagttaaagtgtgactttcagaaagggaaaatcagggcacagccttggtctgtgttccccaaatattcacactttaaagaattcttcaaccccccaagggacagttatggtcctttgattctctgctgtggcagtaggtgtgcctcatgcccttccagtgcaatgcaagccctccagcctcaccccagagaggatcactgatgtcagcagcagcctgaggctgaatccaggttgaaagaagaataacttgaaaaaatatatttccacacacagaattttgtttttcttccaagttggttaagacatatattttgtttcttttttttttttttttttgagacggagtctcgctctgtagcccaggctgaagcgcagtggtgtgagctcggcttactgcaagctccacctcccgggttcacgccattctcctacctcagcctcccgagtagctgggactataggcacccgccaccatgcccggctaatttttgtatctttagtagagacggggtttcactgtgttagctaggatggtcttgatctcctgaccttgtgatccgcccaccttggcctcccaaggtactgcgattacaggcatgagctaccatgcccggccacaagacatagattttctatatgcacatcaagggaggtgctggtttaggttgctataggacagagctatcctgtattccagttggtttttgtagagaaacaattagacttctctagatagagccctgatttttctctcacgctttcagttttttaaaagcactaatgatatttcctgttttctcataagaaaaagtcaatactatgccttacaaagagacctttccttctaatatagaattttatttgaaagtgagtacatgtttataactagagaataaaaggagaatttttgaaaaa
